United States Patent 9,328,346 (POLYCOMB-ASSOCIATED NON-CODING RNAS) - sequence listing, part 73

SEQ ID NO: 13647 - RNA, 87617 nt, Homo sapiens
gggacuuccucccggaaucccguuggccagaauagccgggccgugggugacacguaaguugggcaggagguggcggggcggcagaggcaccagccgacccgucagugacaccgcugugccguccccaaaaccagccgagacagcuggcccccacccuuccacccauugggcaggccgcacgggggcgcggcccggaguccuggucccuuuguugggcgcgcacccccucccuuagguggcaacaaagucgugcagugggagccgccgcgauagggcggggaguggccagggcgggacuccaagaacugcccgggggcagcggggccaaaaagugggaagaaggaaaaaaggcaggaggcaucuggggacaggcgcgagggcagccggcucugaaguaugcggagggccuccucccggccccgggcauucgcggagaacgagccucgcagaaguuuggcugcagcugcccgggcggcgucgauggcugcgcgccccgcgccgcgcgggggcugagcgggcgccacuuccccuccgggccggcuuuugugucuggcaucuccuccucaugcugcgucuggccaccuacugcggcggccgcugcugagacgcucgcucggaccaaggggaggagacggcgggggcggccgcggcuuuggguccaggcgggacuaugggaaacgggaugugcucccgaaagcagaagcggauuuuccagacgcugcugcugcugaccgucguguucggcuuucucuacggcgcgaugcucuacuacgagcugcagacgcagcugcggaaagccgaggcgguggcgcucaaguaccagcagcaccaggagucccucuccgcccaguuacaagguacggcuaacgggacgcgcgcagccgguggccaacuuugccccgcgccuccacccgggcaggaaaaguggcuuuggugagcuauuggcacugugguugccaccucugaccuucagggacgucagaggugagcguuucaggacugccggcaccagagugucaggggagaugacauucucauccucccgcuucuuccucccagcgguuagguuuagaacuucguagcaccagcccaucgucccgcugggcguuuggugggcgggugcacagauaguccuuuacccgagcucuugucaaaggcccagcugcaaucggggcagggaaacugguagcccuccgccgcuucugccagcccugcucugaggagcauuguuccguggauucuagguauuugcuuucuuguugacuuugucaguugcuuaaaaaaugaagaguuuggcagagauuucucaaacugugcuguuuuucaagggaaaauuaagccaugacccagcagcuuaauuaaagucauggcccagucgaauggaaggaaccuagaucuggaccugcuaguuucuuauuucuuauucuuuuaauuuaauaggaugucuuuagagaugcuggaugugugggaaaaguccacacuacauaccauucaccauccugcaguaguuuauuucuuuaaaaacagguuuacuugucuuccuaaguagcuuuuacuucaucacagagaugcauguauguuacaguuagcuucgggaagccaaagaggagaaacacagguuuucacuuugccaugcacagcaaacccaacuugagcaagaccuguagaagaacuuaaaguuucuauccuauuuuagaaucuaauuuaauguaauuuucacaaacauaauuuacuuuaaauguaaauucagaauuugaauuugaauuuacuuuuaacguaaauucaaagucagcaccauguccucuuguuaaggacguauccuauacauauuuuuuuugcaagcuuuuacuugugguuaguuuucaauacuuaugcagcuuucuccccaaccaaaaaauaauaauaaauagcuguaaguggugaaauguuggcagacuuugcugaugaugcaaauauagcuuguuuaauauugcuagguagauagaugcaagcuagagggauguuucuguguaugugugugcagauaugaaacagaugccucuucuuugcuucaguuauuuugaguguuuucuaguaaaaaauuuaagaugagagaaaaugauacacauccgauuguuuggacuuaacuugcucuucccaacuuagaagaaagaaaaguauuuuuagcuuacugacgcugcauagccacaggcaaugaaaauauauggcucggcuugguucaaaaguaaaacccguuuugauacgcucuuagguucacaaaauuuucuuuaaacucauugaaauuuacccaugaguuauuguugguaugagaauauggauauuuguuuacuuauuuauuuacaagguaucaguugcuucccugugaaguuccauggagucagaccaagggaaaaauuuaccgucuaauaguauaacaggacuagauuuucauaaacauggcuggaaggggcauguaugguggauuauaugagguugugugugccuuggucucuuaggagucccaugagggcaaaggcugucauuuucaccauuaccuccucagcaccacacugugccugacacucauuaggggaaucaaugcauguuuauucaaacaacaaacaaaaauuauucugaacuguggcgaguaaguucaucccaggcacuuuugucuuucugagacuuugcuucugugucuuugcuuuuugaaagccaaauaaaacaagaaaauauuuuguucaaguagcuccuuugccucaacggccuaugauggacgauggauauuguugacugaggcccuaauuucugaauaauggccuuuauuugcaguauuucauuuugaaauuuuagaaauuucuuuucuaauuugccuuuucuuuuuuuaguggugguggugguaguggggaagagaggugguaaaugguaauacaggaucauuaaaauauacaacuuuuguuuugcagcagauggaaauguucuaccuaauuugaauaaguggcuucaaagucccuuucuuaauuuauucuuuugucauuuccucucuaauuauggugcuacaaaacuugcaguauaauugugcaugaauaauuauuucacaagcaggcuaaaguauuuuuuuguuuguuuuuguuuuuuguggauucacuuuugacuucaguagcauuuauuuuggauuucccauguguaagccauuuaauguacauuuucuggugguaugcaacuuuugcuucccuuuuccaagacaaaugacauuuuacucaacagcacuguguaccaccugcauagaugggcuuuuaggacaucaggcucuccagucuuaauacuuguuuaguuaggugggauugcuugaccuggcuuggauuaagaucagaauuaaugacuuuaaaaagaguggucuuuuuaaaaaugacucuugaaaaaauuucaguaguuuagaccuauaaucugaugaugugcguucguuaagugagcguauuuaggucaccuucaguuuaagaauagauuauacuccauagauuccuuugaaaguggguuacuuguaaccccaaguuaacaaguuuuauuguagaagagccccauaacuagaagaugguggggauggcaugcagaaaggucagagacuaggcaaaccccuuccacuauaaaaauaucuaugucugccuguuuaucuaucccucuuagcaaucagucaucuauuuaucucccauacuggcaccuuaauuauacugaggagugggacagaggucacauacugguggcaaagguaauaacaaucuuuggccagcacaguguuuauauaaccuuuaaaguuuuuaaacugcuuucaagugagccaugcuccauugucuguaucuauaggcaguguuucucagucuagacugcccauuaguaucaccugguggcucccagaccaauuaaauaacagucuaugggggguggaacccaggcuucaaaagucuuuaaagcuccccuggugauuccugugugcagccaagguugagagccacaccucuauaaaaaaucuuaaaacugagccuuuccgugcauuuacuuuacuuguuuggccccagagacacuugaauuuuuuaucugaguaugugauuaaaagcagacugguuucuagacuguaauucaguucuaguucuacaaccuuuugugugaaccuugacguuuuucuuauuuauaaaguggagauuagaauaaccuauuuuauagagguauugugaggauuaaugaagaugauagacuguagagcucuuagcacauacuuggcauauaguagguacugcucguuaaaaguuagcuguuaucagaaucccucuuugagguaagcugcuuuaucccuuuuacucuugccagguuugucauggguaauuucaaauuuugaaauuggcagaauuuguuuauguagcuaaccaccuccuuuuauuguaccuuaaaugaacaucaaggaauaugcaaacauccaguguacuuuaaucagaagaaaggaccuuccuugacaauuuaaacuuggacugcgguuacugauuaacucuguucuggaucauaucagauuaggagagggugugacugcuaagguaauaauuaugugcugugagaucugggagagagauauaacuauuuaaauuuuuauaaaaggcauuuaguguagaggcaaagagccugacauuccuaaaacacaguauugcaaugcuuuuggacuuccagggauaaggagaaaccauccagaaaaaguuuauguaagguuuauauguuccuauuccagaugaauauguuacaacuauuuaaaauuuuaaaaaaaggucacaaaugugacguguagaagugcagaguuacaaguguggauuucucacaugcauauauugaguuguggugaagucugggcuuucagugcacccaaagaauggacauguuuaccccacaggaaaauuuccaacucucacccccugcuagccucccaccuuuuguagucuccacuuccacucucuauguccaugugugcccguuguauagcucccacuuguaaaugagaacaugcuaucuucgacuuuucuuuuucugaguuauuucccuuaggauaauggccuccagguccauccauguugcugcaaaagacaugauuucauuccuuguuacggcugaguaguauuccaugguguauauauaccacauuuucuuuaccaguucucuguugauggacgcuuagguugauuccauaucuuugcuguugugaauagugcugcaauaaacauacaagugcagguaucuuuuuuguauaauuauuuauuucccuuuggguauauaccuaguauugggauugcuggagugaaugguagcucuauuuuuaguucuuugagaaauccugauacuguuuuccagaaagguugugcuaguuuacauuccuaccaacaguguauaagcauucccguuucuuugcauguuugccaacauuuguuguuuuuugacuuuuuaauaaaagccguucugacuaguguaagaugguaucucacugugauuuuaacuugcauuucucucaugcuuagugauguugagcauuuuuuccuauguguguugucuucuugucuagcuuccuguuaaaaaugucuuuucauguccucugcucaguuuuuaauuuuuuuuuuucuugucaagcugcuugaguuccuuguagcuucuggauauuagcccuuuaucaggugcauacuuugcagauauuuuuuccuauuuuguaggcuguuuacuguguuguuucuuucggugugcagacauuuguuauuuaaguguuuuuugcauugggcuccucuaacacucaggauggcccacuggccuaagcaugaauacaucuugucauugguuacuucuuugcuuucaaccuucccuaaaucuacuuuuagaaaggaaacauuggccaggcacccugucucucgccuguaaucccagcacuuugggagacugaggcggguggaucacuugagaucaggaguuugagaccagccuggccaacauggcuaaaccucaucucuacuaaaaauacaaaaauuagccaggugugguggcacaugcuuauaaucccagcuacucaggaggcugaggcaugagaauugcuugaaccugggagacagagguugcagugagcccagucaccccccugcacuccagccugggcaacagagcgagacucugucucaaaaaaaaaaaaaaaaagagagaaacaucuucagcacagaaccaggcuuuuuuuauuccuucaucuccagcgucuggugccugguaguaccuauguaguacuuuuucuuggccuauuaaugugcauauauauggugguauugugcgcagugagguauaauagauacaggcugaggcgucagagcacuuggauuugauuuucugcuaucuuauuuugcuagcuguguggucaugggcaaguuauuuaaccuuucugugacucaaucuauucauauguaauaaucaggauaauagugcuuacaaaagguuaucuugagaaucaauaguguuagcugaugugcagugcuuagaaggguguagcuugcauuuuggaugauugaggaaacauauacaacagagugguucauagaccucagcaauuuagaccacaagugugggcaaugugugguagguguacuaauuuucaagugcagcguuagaacuuaaaacaugaacuagacauugucuauuaaauggacaucuucacugaaguacaacuuagaguuaaaugaagagacuaucauuuuugcuugauccuguaccauuuagaauauggaacaaaaauacucuuaaguucaguaauuuuuauuuguguguaaauuccuucccugaauaaaagauaaaagcuuccaaauaccuuuugaagcucuaauucagugaagcauucuuuugaauauguaugauuugcacauaaucuauaaucgauuucacacguugugcccaccuuagucaucccucuaauauguaacaugccaacucuaaugagaguacugguguccagguaaauaauugguugcuguguaagagaauuacuuguuaucugggagccuuuaguuuaaguuccaaguagauuggaagccuugccuugauuucuuuuuauucuuucuuuucuuaggaaggacaguuuccaaaagggcugggguacaauaccacauuacuguggcugaaggaauaagugaauuggaguuggggaaaugaauacugacuaaauauggugugaaucaaaaagcaaaggauuggagagaaaccagaagagggcagggaaagaaaaggggacacauaucaccuggugacuuuucaaaguacugaggaagaguuuuguucacaucuuuauguccuaaaagaaaagcagcaggaaauggugacuggagagcugguuggggcaucagaugugguuucagugcaacucaggcauuuaccagcagggugaccuugagcaggcaaauaaccucucugaacuucagccucuucguguuuuaauuuggguuagcaaugucuaacuugcaaacuuguauggauuagaaauagugcaucugaagugacgaguaugaguccuggagaauauuacuacuaccauuuauuaggugaccagaacuacuguuguugaauuaacauugggcuucuuuuuauuuugcccagccuuuacuacaucuaguagguaagaguguuauuagugcuggccuaaaaguggcuccuuucacuaugugcccuacuuggcugaaacuuuuugauuaagauauucucacucugucuuuucuacccuuuugagccguucuugggguggaaaaaaccugaaaaugcuuuacaugauagcaacuaagaguuguuguuuuucauuuugacagccaaugguucuucuuuuaucauuaaggacaaagugguuuugcuacuuuugccaguagaugguuuauggguuuuauagcuuuauuuugaagugaaaguuauauaucauauagcuuuauuauaaaagaaaaaugauaaacuauauuuucuuuuuagccaguguucuuuggagugaauuuuaguagaauuuugaaaacuuauuugagaaaauuaaauuauuuuuaauccauaacauuuauugaguaccuaccauguucggguucaaugcuaagcuuauuacaugcauuaugucauuuaacugugacacuagcacuuuaaucugaaugagcaaucugaggcuuagagagguuaauuaacuugccagugucaagaucuagccugaugaaacuaagcuuagaaaccuaauguaacuuuuuccauagugcaucauugcccucaaaauuauuuuagugucucucaugacaguauuaaugguuuuaagaaaguagguuaggugggucauauggggauucaugauaaaauuuagaaucagaaauaacggguguacuauuugaugcagcauuuccaggguacaagaaauuugcugcugguaugaaagaugauuuugguugauacuagaguugauuuuauguggcauguagauguugccugaaaugacagugaaucauauaaugaaaaacuuauuuccuuucaaugcuuuccugacaaguaauggagaaauucucagucugaugcuagaaucucucuccuagagaguugcuucucuguuuuuccaaagagaauagacguuaggcagccaacaacuugauagcuagaauuugauaauuguuuuguuguauuauuguauuuaauuuuaaaauuaaaucuauuaccaaucauuaaugcuauguaaaucagauuuuucauuuauaaaguagugguguaaaaguuuccuguuuaaaguuuauuuuaaggaaaaauaaacuuauuuaagugauuauuugguggauucaaaaaaacuguacagguuuugcaugaguguaguaagaacucgccugaggggugccugcaugucugaaguuuaggaaugcauugacugaucaaguuggauacagacacugaauuuuacaguuaguuaacugaauucuaagguggauaagucacuuaccagguagcuuaagcuaagcugagagcccacauacucugacucucaguacaagauaauaccccuucacugcucugugcugucucuguagacuaggacccucuucucugugagaagaaaugggcauugcuauuuuuaaacagugcuguguauuucugaaugguauauuuguguucuuuguuuuuauuggcccaugagugcauaugcagaagacaugucagucauuguccuucacugauaagcuuuacuaaauaggcucauagcccggagggacaugggcaugaaauaaauugcucucuauagccguaugacauuuuaaaaaauacugcuuuaacuauuuuucauacauaaaaugucacaauaugauagugaauagaaaauuaagaugugcugucauucugaaggauaggcauuauagaacauugaaaugauauuauuugcuuuucuuugggagugcaugaaguuaaaaaaauuauaaucauuuuaggagagucagacauuucauuuuccaguucacaucucauuuaaaaugccuccuuuaauuggaaucuuuguuacaaacagaaaaaauaaucugcaaaucaagauauuuaggacagcuuugacauugcuuauguguucucuugauaauagcuaugaugcugucaaauaaauauuauaaacagauuaaaauuuggcaguugauaauugauuaauuugguuuagagaaguuuaucaaguuuuauauuagugagauuuauuaauaaauaauauuaauauuagaaaucuaugaugcuugcccuucugcauuaguagcucaaucuuuuaacagacagaaaauguuuuaaauuauuuuauauuuuauuuagagguuuggaugcuauaaaacaaguuaaauuguauugaugucaaacaucacuuuuauuaaaauaugaaaaauaauuuuuuuuacuguauaggcggucaucaccucaaaaucuagaugccauccaaauuugauccaggugugggugaggccccuuagguauccauacaaucuuuaacuauaauucuucaaguaugcuuccucuuuaucuguagaucugugaaaccagagucaaauuaccugcccucaacacagccaacauauggugguaggacaggcauaaaauaccuagauauuccuguuuaaaaaaaaggcagaaaugugagaaaaauaggagucaccugucaauaggaauuugaagucuguugaggcaagugcuccuguaguaggucucaaagccugggaauaguucuccagggcucuugacuguaccauuugguuucuugguuccacucugagucaucuuuccuuuuucgugaaagguggcauauguuugcagcugagugguuuucucagccugcuuccuaccgguagaauuuuaaggacccguggccuuuuuaaauuuaguacugcuucuaccccuuuugguccaaauaggcagugguucugcugauacaaucuucucaaaaaguuugugggucuccugugaaacuucuuugaauuuucuccauuagccaaaagccacauucauauaucucuuggagauaagucuucucuacuuugggcuugugccaagaucggggagagacaaugcaugcccuuaaauuucccaaaggcucauuaugaggcucugaggaacccuuaggagguucugucaucugaugaaauaguacucugagauaucacuuuugaucauuccaagauuuuaacaaaccgauuuuauaagacacccuccgcuuuugucuuuagaccauguuuuucugauaguguccuggaauugaucuuaucuuaaaagcuguuucuuaauuucaacauuauuugcugucuagagaagcuaagaauuuucguaacuaucaaguccugccuccuuuuuguuuagcaguacuucccccaauguaucucuuucuucucauaguuuaccauaagacaguaagaagaaaccaggugacaucuucagcacuuugcugguaaauguccuuaacuggauaagucaguucaucuggcacauuuuuuuuuuuuuaauuuccauguaacuauaagugacugcuggucacauuaacuacaccuaagugugguuauugcuaaacuuuagccacuacauaauuuuuaguuuccauaaacauuuucucacuuucauuuaagcccuuccaucagccuucuuaaauuccaaaauucuauguagaguguguucgaggcacauucucacuaacacuuuucuuaagguccacuacacaguuccaaagcuacuuccaccuuuagauuuuuaugacagcaccccauuucaaaaucuauauuaguuaucuuguugcauagcaaauuaucucaaaacuuaacuguuguagaacaaugaacauuaucucacaacuucugugggaaaggaaucugggcuuaacugggugacucugccauggucacucacaagguugcagucaagcugcugaucaguguuuagucauuuuaaaacuugauugggauuaaaggaucuacuucaaaauucacucaggugguuguugauaggccuuagaaaauccauuuccaaucacacucaucuggggccugccacaggaauacgucacgauaucauaacugguuacccccagggcaaguguauuagucuguucucacauugcuagaaagaacuaccugagacuggcugguuuauauagaaaauaggcuuaguugacucacaauuccacaggcuauauaggaagcauggcugggaggccucaggaaacuuacaaugauggcagagggcaaaggggaagcaagcaugucuuacucugguggagcaggagagagagggugaagggggaggugccauacaccuuuaaaccaucaguucuugugagaacucagucacuaucaugagaacagcaagggggaaauccaccccgaugauccagucaccucccaccaggccucuccugcaacauugggaauuacaacucagagccaaaccauaucagcaagagauccaagagauugauaaacaguguaagcacugaagauaaaagugaagguguuuuaauaaccuaaucuuggaagugguaucucaucacuucugccauauuaucuucauuagaauugaaucucuacauucagcacaugcugaauucagcacaagggaagggcuuagugagauugugaauuacagaaaguggagaucauugggggcagccuucguagcagccuaccauaaggugaguauaguuguuugaguauuauuauugucauuguuggcaacaucauuauucccaaaguugucauaagcuaacauucauugagcacuugcuggguaccaaccacugugcuaaaucauuuuucuugcauuaucugacucaauacuuuuguaaaaauguuuuacuacauucuaaaaugugacuuaccauuaaauuggaaauauauuagcaagaaguggcauuuaaaauuauagcuucacagggaaauuaccugguauuuaaaccguuugaccugggaaaauuaaaaauccacgugacucuuugaauaaacccagucaguaguucauuaaguaaaauacccaaguggaagacaucauguccuugggaaguuucaaaacccauugauaauaugcgaacuguuucuuuggcaaguagauaugaaugcacugcagcauguucuuuugacuuuauagacugcaguccuuggugaaguuuuauuugauaggagauuuuuuugauacuuuuacuggucuuaguaagauauuuuugauuuaaagaaagcauuaauuguaacugguaauuucaacuuguucauucacuccuacuuugaaagucauuuaaaaauugcaauauaugaguauucuuuugugauauuaauaaagucaaaaguagaauauaagaauacguuaugaaaaggucauuaaguguguucugaacaguuauaauuccacauucauaguaugucuucauucaccuaaacauaguuuaguuauuacaaauacaugagaaaaauauucuuuuuauuugacuuccauuguacuuuccaaaacauauuucuauaagagauuggauugggaaguggauagauuauauuuugucaaaauguguuugaggcuguauuucauucaagaauuaaagauuguucugcucuugucagugagaaguuguuguugaauuucuguagaaccaguguuucucuuccugccccauugcuguguguaugggugccagguuucugccaugauguucacuggcauucuaaguugcugugaacuccugcucuuggugguauucauauugacaccgucacccucucuguaacauguauucucuucucuacuuucucuuugacaaaaccaaaaugaggaaaauucccugcauguucuauaauguauugauaaagugccuugucguucuuagagagacuuacauacuguucuuucucucguaucuuuugcacugaguucgagcaggguccaugugaacugagccuagaguaugcucccuuauguugaaacuguccaagggagcagaagcuacuaguuaccuagaaugguaguauuugugaguacauauguggcccuuuauagggagacucuaagaugucuucaucuaagggucucacaguaacaauauuuugaggaggggcugagcuuuaaagaaagucggcuuugucuuuacuguuggcuuccagcuguucuuagaacugccuccuauccagcaccagcucauugccuaagaccacacugaauguuuuuccugugauccugucuuccuuaaggguagcauuuucaaguugggauccuuggcgggggugguucaugaacguccugaagauauaugucaauuuuguauaugugucuuuuuccaagacagaagccauagcguuaaucaguuccucaaaacaucauugaccugaaaaagguuaagaaccacugcuuuagggcaaauuccuccugaggucuuuucaaguccaucuuggaauuugaccucccuuagucccacuccaugaacccccucuagacaugacuguaaguggcagaguuuguaauggaguagucaguguguuugcugcuguuccccuuaagcccugacuauuaacccucuuacccucccaucuccaaauuaaagaauaauucugauuggagacuuaaauggcuuuuaauaaauugcauuccuagaauccauuaguaauuucuuaguaaaauaaaaaggucuugcaauuacaugagaaauguguacuuucugaauugccuuguauucaugauauuauuugaugcugaaaacaacccuguguuacagaguaauaacucuguguuauuaccauuauacuguguuauuaccauuuuaaauuuaaggaagcagaagucacacagcaagacagugacacaugugggauuaaugcucaguuuacuugaauccuaacuccgggcucuuacucacacaauccuguuuccaaggcuuccuuauccuggagcuaaacauagguuuaacaggacuuacaaaacugaguuucugacuuugccaccucugagggcacucuaccuuuuuuuagauucugccaaacagcuaagaauauucccaguccaucugcuaccccuuacccccuucccaacccugccuacuauguccauggaagaugcugauggcugcucaugcuacuaauuucugcuucaccucugcagcuuuccgcugucagucucacaugugcuggaggaucuaggcaggcuccauaaggauugggucccagggugacaagggugauagucacuggggagaauucagcuucacuacccuuucucuuuguuaauaucucuggcacauuguccuugauccagaauuaggggauugggcugucccuucccuuaguaugauuucuuuucagacuugucugcauucugggguguaaguaggacuucaucucaugcuggaauccugcuaacauucaccacaggcugcuaccugguagcaucuuuagcuugucuugacuucacaguggggugguuugaugcucacuacucaacugagucuccagcuguguguuuuagauuccaggugucaaagucaaaucacuccuauaaauaaaucagagcuugguaaaagcaguaaagaaaguucuuagagcccagguugcacauaccagcauauagguauguuuugguuuagcccacacagugcuuugaaaaauuucacaguaguuuauguauggaaaaagaaaaauauuuuauauaaacaucuagauuuccaacguuguggggaaaguccuauugcaacacuggaccugcauuucugugucaggugagugacuugcugccuauuuggaauggggcgugugggcuucaguuggccaaaacucccacugccauugauuuggucauuuauguuaauggccuggccuauagaagcaccuaaguuugaaauucuuuaucuugacuaacauuuuuaguuuaucaaugaagaaaguaagccuuaaagagauggaaugacuuggcgacugcgcugucuaauacgguggccacuaggguccuguguagaaauguggcucccagugugacugaggagcugaaucuuaaauuuuauuuaauuuucaugaauuuaaauaucaauuuuaaaacuauagcaucaggaaguauuuuucuguuaaacacaacucucauuuuaauuguguugugucuuacaagauauuauugauauauuacagugcacaauuacuuucuacuuuuuaaaauggggcuaccagauauuuaagaguuacagacauuucagagugcguuucuguuggacagcagugaccugacagaagucucccagcuuguuaauggcaggucuggaauuugucagaagaucuccgcagcucuaaucauauuuuuuuucuccauuauuaaaauguuacccaacuguucuucuaauucuugaaacuuuuuguuauuauauacuuccauaggaauuaguuuuuccucauuuuuacguagcacaugacagaaaagagauuuuauguaaaggaaaauuuagcaucauguauuagcaacaauaauacaaagguaauuuuagagauuaauuuuaaacuuaauauucaugacaaagauuuuuuuuuacuuuaagugacugacaauuuucucugaaauaucuauuuaagaaaacaauuucagcauguucaaaaugacauuguguuugauuuuggagcagguauauauuaaaauauaguguaaaauuaaugauauauuuuauuguagcuuuaaaacuagacagaaauuacuauuacauuuaauauauugaguucuuauauuuuauaccuaagaaaucuuucccuuuuuuaaauuuuguauuuuuaguuaucuaaaugauaagauaaaaagauuaaaacccugaacaaaguauugggcauguguauagcgcaaccaaauauaacaauuuagauaaaauaaaauuguuuuugacauuuuacuuauucaacuuugaauuguaacuuacauacauaaaagugcacaaauuauaagcaaacagcuugaugagacuucacaaacacaacuguauaaccagcaaugagaucaaaacacauggcaagaccagcaccccagaagcucucuugcacucaucucauucaaaaauugucuuccaaccucaaagaauaagcaccaugguuuaguuucaccuguuuuuguacuuuguguaaauaaaaucaaacaauauaugcucuugugucuggcuucuuuugcuuaacauugugagauccauccagacuguuacauguaguuguagauugcucauuucuauuacuauguuauuaccauuguguaagccuaucaaaacuuacccaauuuacugcugauggauauuuggauauugauugcugccacuaugaaugcucuaguucuuuuaacucuuuuuuuuaagggacuagcagcuuuuugauaugauugaugacuauuuuaagcuaaugcaacauaaggacuauuuugagugcauuuacaaaauuuauuauugcuccuuuccuaguguuacuuaauauccucauacaacccaacuauaauuccugaucuguuaguacaaauuuuaaaauaugaccaaaaguaaaaacaacugaaacuuaaauguucaaaacacaagcauuuguagcauuguuaagccaggggauaagcugcacagaggacugcuuagacguauaagcuggcuugucuguucuuuguuaaccauuauucaugcuuacugggcaugugcuuuuucucuuucuauauucuaaaggggucauuuuaaaaaugauuauuuauuuauaaaaauacaauaacaacagacccaccaauuaccuuuuguuaaaucaguuuccugaaacaaguuaacaaaacccugguuuagaaaugcuaccucuggaaaaaugcugguugagaaauucuaccacuggaaaaauucagaauauaacugagcaguugagaggaauauuacagaguuaauguaaauaucuagugagucguuaaacuagcuguaaaaguguuucuaaguuaaaauuuuaugauuuuuaaauucugaugugcuagcugaagugaacagugaugagaauaagaauuacauauagugacucauauucagcaauuuauuacauacauuguuuucucaguagucuugcuuuauuauagauaaauggcaaaagggcaguggugaucuuugauguauaaaaauguaauugauuuuacuuuuauuacuugugauaauuuaaaguuugcuaccauacaaauuaugauagaaaaaauuaacaaaauauuuguguaaacaaaaauauguccuauuuaauuuuuuauuaaaauaacaauguucuaaauuacuuaagaacauaaaaaggaaaggucuauucauuauauucaaauaauuaacaggggauuccuaucuaguaauugagggagacccuaaaaauauugguauucaaaaguaguaaguuguaccuagugacauuuuuuaaauucaagauucauacugguuucaccucccaauacuaguuauacuugugaaguuuggagguaaacugcucaaaaauaaauaaauaaauaaauaaauauaucuagaguauaucauacauuuuagggagguguguuacauucaguucauuugaaagacuguaaauuguagaaacauuuaaggauaccaaauuauaaguugaguuuaaguguagcuuauucuguauauuauaguuuauuuuuggaaauaaggccuuagcaauagaaugaauuucuuucugugacaacuuaaaucuuuauuaaaaaaauucucauucuguuuucugaaauacaauauagccaaagaaaauuauuauuaguugaggagagguaaauuuaaaagguuuaguuugaugcaacucguguuacaugaguagccauauaaagauauagagucaauauauuaguuuuuguugugugucaauuucagaaucuuaguggccuacaacaacaaacuuggaauaaugaauauaauuguguucacaggucugcaguuuggcugugguuuggugauggugggcagggcuuggcuggggcugauuugccugggccuggacaccaggucuuugaucaguuucaggucagcuccacaugccuccauuuuacaaccugggcugaaaggauugcauuaccuggagaugcucuucagauggugggucauaggaaccacaaaagggcaaguguuaacacuugggaacaggcacaccauuauuucuguccacauuccauuggccaaacguuaaugggauggugaagaaugcucugccccuccgagugguaagcacugcagaaugcauggcagaauguggauguaucauuacaguagugagggaugaagaauuuggcaugaugaguucaucuaccacagucaacuucaaaauagguacagugugaaauaaaagaagaaaacuuccuuauuugaagaaucauuuuauagugauacagacuuuuaaaauauuaacaucaacauaauuuuagucacauuuguguacuuuuaggcggaggguaugaguuaauaaugaauaagcacuuagcauaaauucuaaacaaaaggcaauaaguaaaucuguccuuuaauucagcaaacuuccugaagcaccuaguguccauaacuuucugggauaauauaaauuugguuauucaagugcugcuaucaaguaauagaauguaaauaaaguagucuguuaaaaacuuucauacuggauuuuuaugacuauucuuucagugacauagaacaaguagaacauuuuuacuuaaguauuuugacauuuaauauguugauuuuagcagcaaaagaugauaugauuaaccauuuuauugauugauugauugauugauugauugagauggagucucacucuguugcccaggcuggaguguaguggugcaaucuuggcucacugcaaccucugccucccagguucaagcaauucuucugccucagccuccugaguagcugggacuacaggugugcgccacgacgcccagcuaauuuuguauuuuuaguagagacggaguuucaccauguuggccaggauggucucaaucucuugaccucgugauccucccgccuuggccucccaaagugcugggauuacaggcgugagccaccaugcccggccaggauuuauuuuuuuagguacuaauuuauguggauuaaaaacaaagaaacaaaacaaacaaacaaaaaacagaacaaguuagagcauggccccacagauaggcuugagcauuuuaaauuuuauguaaacuucuggugaacauauguaaugcuuuacuuuuaaaaaauuaccauauucacuuagauucuuuuauuuaaaaauuaagugaaaaauaugucaguaauauuuaaugauuuagcaccuacuguggcaacuauaaauguucauacccaagacuuugggaaaagguuguggaaaauuuauaaaggcagaugucgucucucuguuuuuaagaauguaucugauuguaagcauuucuuuuaaacacucuuuucaaguugcacauucauuaauuucuuccauuuaaugugagguuuguguguguauauauguauguauguguauauuauuauauauguauguuuguguauaugugagagugagcaagugacuagucacuuauuauauuggccuuuagaagaucaccaaauagcaauuuguuuauauuucaucuuuuaaaauuugauucucuauguccccuuaagaaugucagaaacugaaaacuggucuuuagguccaccaaacauagacuugauuugucaguggcuguuucccaugagucgucuugacaugcuuuuuaugcauaugauagaagaagcaaugagaaaagcagguguguuuugacaugaucuuuuugugaacagggcuugcucagaauauuuccagaguaggaacuuguagauucuuguuaaggccugauaaaugaagcucuaaaggcucuauaaaacuagugaaugcuguaaucccagcacuuugggaggccgaggcaggcggaucacgaggucaggagaucgagaccaucccggcuaaaacggugaaaccccgucucuacuaaaaauacaaaaaaaauuagccgggcguaguggcgggugccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaacuagugaauguccgccaauuaccaguguauuuguuuucuaacuuaaagaaauacuucuugucauuaacuuugucccuuuagaaauauguuuauguggaaagaauauuaguuuuauuuuuguuuuuucucaucucuguuuuauuaauuuuuuuuuuaacuucacugguugauugcuuaagcacuuacuuuaacagucugguuggcaucaaucagaacaaaaggaacauuucuacugacuacuuaauucuuucauaaaaguccuccuuucuaggcuccacagcauuuuaaugacaagaguuauaauuuuuaacuauaacaccuacaaauuauuucuugaauuuugauuuaugucucacuagaucacaucuaauuuccucucugucugggacuauuccagugguaacugggucacucaaaaaacagaaccuauuggcaugaugugggccacauggauaaguuuuucauauaauuguguuuacuguuuuccaaauacauaucuaggaucuucccaaguuguaauauuucuaauguccuugucugcguuacuagauaugacagcuauaucucuuggcuucacuaauguaguagguugucacuugguuuuccugcuuucaccccaaucuuccacauaguagcccaguagguuacaaagaugauucuuuguaacauauaaauuaaguaauguuacuucccaucucucuuugaaggaaauuuuaacucuucucuuacuacuuuguuauacuucuguaacaagauugcugugaugugggcuuuuuagcuguucucaagcucacgccuuucucaugaucuuuauaacugcccuuauuuuugucuggaauguacuuccuugaugucuguucaucacugguuccucuuuauucaggccucugcucagauuucaacuauuuagaaaggcuuuuuccugaaaaguugacuaguuauuugucauguaacaaauaacuccaaaaaccuagcaccuuaaaucaacaaacauaaacacuucauauuucacacaguuuccugagagucaugaauccagaagcagcuuaucuggaugguucuaguccuagguuucucaggaaguuguaaucaagcugcagucuccagggaggauccacucccaagcucauucacguggcuguuccucacuguuguccagauaccuguuucucucugugugcgccccuccucggguugccuacauguccucauaacauggcagcuggcuucccacagaaugaggaaucccagacaggaggagcccaacauggaagccacagacuuuuuuauaaccucaucuugguggugacauaacaccacuugggacauaggcuguuagucagccagccccauuaugguaccauguagaaggggaguacacaggaugugaguaccaggugcuagaggucacuggggacaaucuggaagguuagcuccuacaguagcccugccaucccuggagaucucacagcugcuuuuaagaagccgaugccuucuauguuuucaccucugaacaaucuauagaaguuauaccucuuccuuuguguauaagaaaauacccuauauaagcagaaaaaugauaauaguccauccacccaaguacugucuaucccauuauccuacauuauuuucauauuugcacuuauuagcugaaaucucauuuuguauuuccuuguuuauuauauaucuuguuugucugucuuccaccaugcgauuguaaggaccuuuaauacaaaaacugguauuucauguccaugcccacuauucuaauccuugaacuuaaaacagugccugaaauauaguagguaaucaauuauuugauaaauggauaaaauaguuggccuuuucaagccccagaaguuuuauuuuagacauuuuauauggcuguguuuccacaugcauuccuguauucuaaaagaguuuacuaaacaugaauguuauuacuuuaacucauauuuacugguuuaucuuauauagaaaggcacuaugcuagauacucugaaguuacaaacacaaagaagacacggucccuaccgucaagaaguccuauugguaaggaauggcagacuaugauacggaucauaugagaacaaguaaaauugcaaggcuggggaagugugaaacuuggagaaggcuacacaguagaaugccuucuugauauuuuaggguuagugcaguuauuauuuuguccuggaauacuguguuccuuuuaacauccucagaauauaagaaagaaggcaaccauauuuuuuuagcaacaacaaaaaaauuaggaagccuggucuacguaaguauuauagaaaugguaaauuauuuaaucauauauuuuuaacaaccaccucacugaaaugacuaaaaauacaugaaacuguguuucauuacauaugaucaucauauauagagcaguuugcucauacauuaaauagcucuagaucagugugucuuuagaauaaguucucugaguagugauuguuuuuuauaguauuauuugcuguuguuagcuucuuacuguaauaauucugccuuccucucauuaaaguugcuucaucuaauuuuucuguggacuugaaagccaaauaaccaaccuggauaaaauuauauauaaaaagaauauaaaagacacccacccccuccaaaaaguuuucuuuucaauuaaguuuuagggagguuuuauuuuuagucuagcuauuuauggcccauuuuuacaucugucugauauuccccuaugcuuuuaacaacuuuucuuaacagaguguuauuuuacuuaaguuuucuguugaacuuuuugccucuguucaauauacuguaguuggcuuuggagucagaaugccucauagcucugccaaguuuuaguuuuauguccucaggcaaguuguugaaucuuucagaaccuuuuuuuuuuuuuuuuuaaaucacaucuucuuuacaaaguugguauacaaagucaaugaauauguuaaaggcuaggauguuacuuggcagucuguuuccuuccccagucauucaccagguugaauugacuucccaccccaucacugagugaccagugacaaaugccuuggugaacagcauccguaaugaauaccaguuucauagaaaugucacaguauaucuccugcaauguagggcuggcccaagaccacuccugcaggcacuuuuguuuccucagaucaucagugcaauuuggggcgugauccacguugaguuucaccacagagugguaccagaauuuggcccuaugggaaauccagaguccaagacuggccauaaaauuaaacuuuuucucuagguauccuuccgagauuugacgcccagaagcagauuuaagugcuauguuguauuucacucccugccuggaguucacaacagggaaacuccgucacaggcguuucagccuuugaaaagaguaagaugaugggaguuucauagggggauguaucaguuacuguggauacuuaaaguuaacaaaacauucagaguaaggaauuuuuuaauuaaaguaaguucuacagcauccaugaauuaccuacauuuuuccacucccucacauacuuucucaaguuacccacccuugugacucauucaguagcaaaaucagugaagucggcauucucuuuuagucaucaagcaaaaaugggucaucucccuggccuacuagauugucugguuugccccagaaaaucucuuuucaguuuggcccucuuucuguugccauguuuccuugcuuuuccuggagguaggggggcgccggggaaagugggggacaguuuccaccuaucaucaagaacuugccaugacagccagcuucuucacuccagguugcucucuucuuaauguuauauuuauuguauucauucaucauuccugccuagagagcagugcuaagauucuguccuugucuucuuuuaaauucagcugaaauucauuaucuguuaugugccaugcacugaauuaggcccuuaauuuaacauuauggauuuaaaaaaaugaggcuaagaaagguuauguguccaaagugacaagguaguaaaagauagaaggaacuugaaugcaaaucuguugacucaaaauucaguuuucucucuacuuuagcaugacuccccuuuccuccaugcaugccaagagguuaaaaaucacugacgaugggaugcgagcuggaagccuucauuaagucaugcuugagccugugccacugauauccucccucccaggcucaggugacugcuguaaucagugugccccagguacuauucucuggguccaguuugacugugaauuuccagccacuggcuuguagaauagacaaaaaagcuaucaccuuugaauuaaaaaggacuaaucuuagaauagauuuagcaaguuagaguagaaaacccccacuaacaaagaagagcgaacuuauuauuaaagguauagaaguugaggaacucaccucugacuuguuuuuuaagauauggauuugaucuuuaaucacaaaggcauuacauugaauaaauaaccuuucccuuucaagcuaaaaagcaacaacccucuucuagaaaguucacagaauuuaauauuucuuucuuuuuuguuugaacuucuuuaauaaccuuaaugaaaauuaagguaguuuccauggguugaaaccauuggcaauuauugauuaauuguauuauuggaagagaauaguaaaaacaauucauuuggguuuuauaauguauaauuuuacuuuaccuuugagucuguguuucaccagauagaaaauuacuuuagagacuuuaaugaugccacagugugaacacccaucucaggaagaugaagaaacuauguauuuucccaauuuggaaugguguagaccugaguucaggucuauaaaauuuggauuuuuuguuuguuuguuuguuuuguuuuugagacggagucucgcucuguugcccaggcuggagugcaguggugcaaucucggcuuacugcaaccucugccucccggguucaagugauucuccugccuuagccuccugaguagcuaggacuacaggugcgugccaccacgccagucuaauuuuuuguauuuguaguagaaaugggguuucaccauguuagccaggauggucuccaucuccugaccucgugauccgcccaccuaggccucccaaagugcugggauuacaggcaugagccacugcaccaggccuggauuuuauaguuaaauaccuggaugaccuuugguaaguuaccuagcuacuuggccuuugucguugccuaguaaaguaaggauuauguuucuggaguuauguguguaaugguaaguuacaacuucuaggaaaacaaguuagaguauuuaccuuacuaauggugaauuaguagcaccaucuuucuauacaaagacuucauaguugaaaauuaacuauauuaaugauuuuauguaacacuaaggaaauaaaaauagaagugacauaaaucacuaaugauccgcuuuuaagauuuccuuuaaggaaauuuaguuuagcauauuacaagauauuuuuaacaggcauuuuuauuucucuuaugcaguauauuuugaaugcucuuugaaaggcugcuguuuccauaguuaauucauuuuauucaaagacagaacaucaaagcagcaaaacucaauuaaguggaauagucaggaaaugaaauauucuggugaauuuagguggcaauguuaaauagaaagcuuauuaccuucucuacccauauggcuucuggucucuguauuuaaaucauuccacugaauuugaguuuuuauugaaaucucugcuaauuuuuuuccuagaaaaaugaaggaaaaucaauuaaagaaacuucuuguuucaaauuauauuauugaaaagcauuucaaacuguauuaauugcuugacuucauugguaaaaauguucaucauuggaaacaucaguucucuuccaguacuggcaauacagaucagauaggaagauucaacuaaauguguauugucccuuggaccuagcaauguuccggccauaugaguacauuuuuaucuuucgcuuucuuccaaaaauugagugugaaauaaaacuccauuuauuuuaaaugagcaucauuuagugaaaagaaaaucagcauauuaauugauaugauauaaacuuaaaaaaauaguuuguguagcaauuuuaaaagugcaggccgggcaugguggcucacaccuguaaucccagcaguuugagaggccgaggugagcagaucaccaucaggauuucaagaccagccuagccaacauggugaaaccccaucucuacuaauaauacaaaaauuagucggacaugguggcauucuccuguaaucccagcuacucaggaggcugaggcaggagaaucgcuugaacccggcagguagagguugcggugagccgagaucgugccauugagcuucagccugggcaacaagagugaaacucugucucaaaaaaaaaaaaaaaauaaaauaaaauaaaauaaauuaaagugcagaaaaguuuuaagagguaaaauaaggcauucacaauugacaaaggaaucucuauaaaauuuuaguguuuauucuuuauuuacagaaucaauggcaaauggguaugcaacucuuuuuuaaaaucuaaguuguuuuguuuugcuuuuuauguauucuuauuuccauuuuaaauuuuagagaaauaagaaaaaaauagaugaacagauaugaaacuucccuuuuuaguauuaaaaaaaaacuauccuuaaguuaacauugcgguaucuuacuggauaugcagaaaaaaagaacaaauuguuuuuaaacauauuuuuauccugcaagaaguugacguauaaacaguaaguugcauaccuguuuuuuaaaauucagaaaaaaauugcuuuaaauaaugugacuauucagaagccacauuuuaagagauuuuuuuuuuaauuuuauuuucuuacacaaaguguugaaugagcaguauuugucacagugauuuuuguguugguuugcuuucaguuauuuucgucacaauagggaauggaagccuaacagaaaaaugcauccaugaauuuucaauauuuguuuuaucuuacauagauuacuuacuaaucuauguuuuguugaaaucuugugaaaguuauuuuaauucuguagugcaguaguaucacauauauauuuucaucaaauauauagugauauuguauacauuaauuuaaauucagaaugagaaauuaagcuccuagcauuuuuuaauuuuugaguucugaaguuaaaaauguguaaaauuauuuuguauauuccuagugaaacaccagcccagaaaauauuaauauacucugguuauauuuuguuucuguucagauucauuaaaaaaaacucugaaagaaaagaugauggaaauacuuucugccccacacaauaaauaucagguauauuuugcauaucgauaauacaggguuguuguucuuucugccuuaugggaauuuuuaaugaauccuggccuuguuuuuauuuuucgaauggcuguguuguauucucugaugcauuuaauauggggaugauuugcuggcuucuguccguacuuuggcaacuacguucauucauuuauucauucauucauuuauauuuccuauaauuacuuuuauuaacucuacuauaacauuuaguguguuucaguuuagaaaaauauugauuuuuaaauaaacaaugaaaaacaaaauacacagaauaaaauacgccguucuaucucauguauuuuuuuuuguaaaaagauaguuuuguguguguguguguuuuuuuuuuuuuaauuaaaggcaacuacuuuuagaucagaagaguuuuuguugguuuuugcucuuuuuguauuguggugugugugugugcguguguguuugguggccccugaggaaaagcuaauaaccucucuauuuuuuguuugccuacauauacugcuaauuauguauccauuuagauagcugcuuaauguguauuccuaaguuuguugcuuugagucaagggcuaguauucuucauucauaaauuugugguauggaagagauggacuaguuguaaguaugguaguuuuuauuccaucauugaauaacuaauaaaguagucacaaaauuaugcucauuaggaguggcauuuaauagugggcacuuuaaauuuuuaaacaaaaaauuuacccaguguguuuucaagauucuaaagcaaaagugaaagaacuaagcaugaauacugacuaaaaacugucuuaauuaucuuaguuacuuuuauuaaugcagguuuauggaggguaggaggauagguuguauaaaggauuuaaaaguaaauuucaagauacuaguguguuuauccuacugucuugaaucacacucacaagaacuaccauguuaagugauuuauuuuucuuaugaaauaacucuucagaaauucagaacauugaaagaagaccauacuaaaucaccaaaaaaguuuaauguuuuguaaguuaaugcauuuuaagcauugugcauguaagauaaacuaaggcuacaaaaaggucacuagaucuucuaaugaauagauacuaguaauuuuaaaucagcaccucacuuguucaccgacaaaguacaugugaauuggauguauaaguuauuuguauauaaacuguaaaggacuauaaaaguauaguuuguuaugauugauacuaaaguagguauuaaaggacacuuuuuuucugaauauaugaacacucaucuacaaguauacuuuaccucauagugacagguuaucugcaaggugauaaaagauagaaccaagaucuuuaguggaauaacuguucucccugagaaguucuuauuuacauuuugucaaugaaaaaauaacagcaaauaaagguaaaaugucuacuauucuaaugggucuuacuugaaaaggauaguuauaguuuuauucucuauugcuugaaaaugaauauguaauauaauaauaaacaucagcuacucauguugaaauuacuaugaacacugaauuauugguggaaucuggaacuagugagguuauucugugccugaacuuccuguuuucaccuacuucccaauuacuugcagcugucaaaauaauuuuaaucauuuucagauacuuugcagaaaaaaaaaaagaucuuaagcccuucggcccuaaucaagggccauaaguccuucagcuaaaaagauguuaccccuucucuucuugucuucuuuuguaucccugcugaguccuucugucuagucaggucaguauucuuucugaacaucacuauuauguucuaagaucuuaaacauuuauucaggucacucacaauucugauucuguauccuugucuucuaaaccagaucagagaaucagaggauguuagagcagaaagaggcuuuagaaaucaguugauaagcucuuuuauuuuacuaaugaugaaauauuaguuaugaaauacuuuucagauuaaaaauuaaaccagaucucuggaccccuugccucuggccaguuuuucuaugacauguuguuuacagaaacaugcaagcagacaugcagagcucugcugaguccauggaggaaccuaaagguuggauucuuccaccucuguguccagguuguccaccaaauaugcuuguuuauuucccaguauguggaagaguuauuaugggaaaagugaauggaaagucauauacaagacaaggaaaaccaagcaagcaucucauuagacccauuugcaauuagaguggcaguuguaugcauuuacugccuuauuauuuauucagugucagaaaaggauaauguguucgcauuuuacacagucauacauacagaaaaagagagccucacuguaggacaccuuaagcauggggcagggucuuaguuuauguauaauauuuuucaaguuauugaaaaucauaggugacagauaaaaaauagucuucuuuugccaaaaggcuuuuccugaaaaaucagaaccuuucuuagcauugugcuaaacugaaucuuuccucucuuacuuaaacuuaagucacugagaguauucaaaaccaauuuaaaaugaauuauguauagcugaugccacuacucuucuccuuuacuauaaacaugaauauuuaaaaucacagaauuuuaacaucaggaggacauuggugacuuaacucuacaacagcuucauuuuauuacugaggaaaaagaaggugaaguuucuuaguugugaacagugaauuuguuagugucaggcagccaggaggucaggguucuuaggccuguguuauuuuccccaaacuacuugaaaaauccucauuaaauuaucucuuggcaccaucuguuucucuuugucuuuuuuucucuccuuuuuuuuuuucccuucugggauaaaccaucucaguccuauuuaaguuauauucgguagcuuuaaucuaaauucuaugaauaagguugaaaagaaaaaucuggacgucuaauuagaauacuuauauguaucaucaaagauuucuuuuucuuuguuuucuuuagcauccagucaugcaccuuuccacagaucuggacuguuuauugauuuuacugugcuucuuuaaaaauuucucaugaagccaggcauggauuuugccuguagucccagcgacucaggagggcgaggugggaggaucauuucaggccaggaguuugagaccagccugggcaacguagcgagacccugucucuuaaaaaaaaaaaaaaaauccccaaguauuuuguuaaacaguacagauguauucucugauuuucauguaaaaacuuagagguugccaaugaauuccuaugcauauauugguguaagucaggcuaucaaauucaacucuucuuauaacggacucaaaaguuuaucuugguauguaaccauuaacacuuuucuuauguaaauuucaugaaauaauugauaggaaaaguacacuguuaauaugugcugucuuggauuuauuuguuuguguaauucagucauuuaacaaacauucagcagguaaccacauuguaccagacucgagaugacaauuugcagaucauaaagaagcugaauuucucauaaguagccccacaguguaguagugggagugacaaaucucuaccuaaaguauuauaaaaagacuguggacagagauaugccuauggccugugggagaauaucccauaggauauuuaaacuggacauccagggacauccacacugccuggggaagccuccugggaccauggugaaggcaaaugccaaucucaccuuuaccaucuugggugauauuaugaugcagggugguauaguggaaguaucucaaggccugcuugccagaauaaacuuucacaaaauccuccaaauccucuuuaugucacaucauccucagaaguauccugcuauccaccuaaaacccacagucccauaaauacuaugccgcuucuuuuuuuuuccuucaacuuuuaggcucggggguacaugugcaggaugugcagguuuguuacauggguaaacgugugccauggugguuugcugcacagaucaacucaucaccugggcauuaaguccaguauccauuagcuaugcuuccugaugcucucccaccccccucccccacuccccugcccuuucuuaaaggaugaagaaaggauaacucuuauauuugaccuuugagggucucacccagugaucucagccuucuacucuugaaggcuuuuacaugcuaugcagugauagugauuaaaauauucccucuucccccaaaucaggcaaugcccaauaucucaguggggaagauacccuauucagagucacauguauucuucauagcacaucaggaaaauauucauuuucuguagccaguaugaagaaaggaaguauauggggaaaucucuguaccuuucuuucaauuuugcuaugaaccuaaaagugcuauuaaaaaaauaaaaucuuaaaaaaaguauacuuucacuuucaucccaaaggagagcuugaaguaucugaaagugaaaagaaaguguaggauaucacuaagaauucuagucaaacuggggaagcagauuuuagaugucuaguguugaccuuauccccaguguugacuuugucuucauggucuuuaggaguaacaucuuuuuaaguuuccucaguggcaaauguaagaaguuaaguaguuuggugguguugggaaauacaauucuaggaagaguuagagguggcaguggugggugggcagggguuauuuuggaggagaacuuguguuaggccuuagacaugcagguggugguggaagcaggauuccagcugugaccucuagcuaccagcaacuugcuucuuagauuaaaugaucuaagcuucuguuuugaucuugauaacucuaucaagcauuagacauaucuaaaauggaaggcacgguggacucucacucccuccgccuuggagcuggauccacauuuuauacaguagcuaagccggaaauaccggcaccauccuuagagcuacuuucauaguacacuuugaaucaaucucucaggcauuuugauucuauuuccuaaauauaguuugcuucagugcauuccucgcccucugucaaugauuaccacgugugccugaauaugaggugagguuccccuuuuccugcaaaauuacuccucagagaagagggagucuugagguggagucaaugcaaagccucugcuauuacugggugcuuucuccaaggcuuuauuuuaaauagagcauuugugaggaagacacauuagccccacaugacccuguuuaaugcgguuagguauuauggagggcaccugacaaaaucuuuuuaaaaaaggguauggcagcuuugaaaauaguguaggaauuuauucuuaggaauguguccucacaguuguaaaugcaaaguaucuuuauaaacaaaccuuuccacuaaaaaaaaaaaaagccccaauacauucaaauuagggauauagaaagcaugaauguguuccuacauuacaaauggaaauggcaacuauccugauuuuuaccaaauccuaucugaggcuuaggacaagauuuccagugauggcaccagacagagauuccacuaaugcuuuaccucgggugaugauggcuaugcuugggaaaacugucagaagcuaaaaaccuaacuugaguugacacagacacagaugucagacaugcauguguagaguuuggaccaaaguguuuugggagauguggauguagaaaaaaagugacauauguaaauuucuugcauauuucacuauuuuauuuauguaacuaaaaauaacaaaugcaugaugugauauaaacagguagcucuuucauacagucuguaaauuuuugguaaauguuauugaauuauacauucacaaaaguacacgaaucauaaguaaacagcucaaugaauuuucacaaagcaaacaguguagccagcucucagaccaagaaucagaacaccaccagcaugagaaucagaacaucacuggcacucaaaaaugcucccucuuacucucuuccaguuauugcccgaccgcugcccccaugugcacagugugaauaguaucuugucuucuaucaucagagauuaguuucacucgugccuguuuuugaacuuuuuauaaauguaaucauucaguaaguaccacuuugcugucuggcuccuuuccucauauuauguuugugaaauucaucuaugaauuauuuaguuuguucacauugcugaaugauauuuugcauuuugaacaaccacagcuuauccguucuacuaugauagaugugguuucaguuuggggcuguuaugaguaaugcugcaauuaaaacucuccuauaugacuuuuggugaauaaaugucaaguacuggguuggguacauaccuaggagugggauuuauaggucuuaggauaugccuucaucagcuuuaguuaacacuaucaguuuucuaaaaugguuguaccuuuuucacauccauuagcaaaguagaagaguuccuuccuccacauucuugccaacuauugguauuuugugucuuuuucuauauuagcuguuuugaugggagaaugguaguacugcacuaugauuauaauuugcauuucccugauaacuaauuuaguugagcacuuuuucauauauuucguggccaguaggauauauuuaaguggcuguuccuauucuuugccccauuuuuuuuuuuugcuucucuaaaaucuuguauauuuggcaaaaaaaaaaucaacucuuuaauaugcuugcuuuauuggcaaaacugaaggucauguuauauucaaacaauauguaaguuuaaccuccaucauacuuuuuuuagguugcugcgaugaccugcuaaugaauccauuaaccucuacucuuucucagaugcucuaucuucuacacauacaaaguuaauuuuacaaucaugcagaugugaugaaguucuuuuuagcccuaucucauucauucuucccugcuguuauuauccaccuuuccaucaauccuaugcuaaacauaguauugacaaaacuccccuagaaaagcucauggggagugggugaggcacucuuacuaaacuuucagauugccaguaaauucggauucaguagauuugaguugggcccugggaaucugugcuaguaacaagcacuccacauucuuauuuuaggaaaguuugaggaauaccgcggauuauuuuugauuuuguuucauuguucccacacauucccuauccacugucuggauuuuucucuauccuuccugcauugucaucugucaacacccaaucaaauguaaccucugggagucuaacuggacucuuccaggcugagcacaucacucuauaaucauaucuuacuucugaucuuccucacaaaacuaugaugucauuggccuuccccaucucagcugauaacaugcaguaguuugaucuugaguauaaauguagaaucugaauauuauauggccuccacagcacgcacacugguccucuucuuccauuacccucaugccucaauuacugcagaacuaguuucccugcuugcaucuuguacccaugcagucugacuagagggaucaauauuuaaaaccuaagucaacaucauuucugcucagaucucugcacuggagcuggcauggugguaugcaccuguagucccaccuacuugggaggcugaggcuaaagccuaagaguucauguccagccuaggcaacauagugagaccccaucucuaagaaaaaaaaaaaaaacucucuaaugguucccaauuucuccaagaguaaaaucccaaguucucagugggcucugugaccauugcacucugccccuuccccuucccuuaugcuuugacuuuccgggcucacccugccucagucacucuagacugccuguuucucugaggacaucccagugugcuugcacuguacagcuuuccuauggguuacucccucuauuuuggaagagucucccccuagauaucuguaguacugacugaccccuucagucuuucaagucuugucucacauguccccacugaaauauccuucucagugaggccugcccucaucacucuauuuuaaaaugcagccuggcccauucuccccacgccuccagucucuuucgaucucuuuuacucuacuucuuuagcaauaauuaccugcuagcauauuauuuauucuauuuauuauuuaucaucuauaucucucugugagaauaaaauccuccuaaaggcaaauuguuuuuuauguuuuacuuacaguauguccccauauaucugaacagugcuuggcauauaguaggggcccaauuaauauuuguuugauuuguugaaugaaauauuugggaugcaguaguaaccuuaaauaagacuaagagaucuuaaauagcaucuuuuuacaagacuuacuuuuaugaaccuuuuccaagauauguugcauauuuuaauuuugaaguagaacuugaaauuggaaguuugaaugaaggugaguuaacuuguguguacugcuacauugauuugaaggagaagacagugguaguuaggugcauuccaaccuaguugaggguauucucugcaauaugacauaaaacuuuuagggguuaauacuugaguauuggauuuuagguuguuuccuuuuugcuagcauuacuugcagcguccguaaaggcaaguuccuauuaaaaaaucagacaacuuauggaaauuagaugucuuuuagguuuguuucaagcacaucaauuuugaaaacuauucauaguugcauuuuaagagcagugugcuuuugcauauuuuauccaucuuaagggcauucuuacacauguuugcaucaauuuugggagcaagaaacaacccccucuucucucgcuuccccucugccucucuuuuucucuugugcauaauuuucugaaauacuaugaugcuguccagcugcaaucugauugcuagauaagaggaauaguacuauacagguucuauuuauagauaucuaauuuuagaauaacuuuuauuucuauuacugugaguccuuaaguuuccaauauauauguauauacacuuauacaugucuuugagaauauaguauuugcuuuguagagugcagccuuuuuauggaagaggaggauauuauuccucucagcucucaaagagauucuguuuaagaaucugcugacucagcaguucauuaugucauccuagccuggcuaaccuuuggugaucucuaauugucuuauguuuuaccugucuuagccucuucucacaacguguauuuauuuguuauaagcuuuuguauaagaguaacuccuauacuuugguguuucccgaggugccuaggccauugcuggguuauaacauaauagcucagggcagcuaagagaagaauccuuucaugagaagugaauagacuucaucugauaaugagaaugauuauuaguagcucagcacuugaaagaaugccaaaaagaacagcaugaagaaauguauguuaagucagcucauauaauacuuauuugaaaaagccaaaucucaauuaguggcaugaggaaaagccuggguauaguuuuauccacaaaagaaaaggcaguuaagcaccaauucaagucaugguuaaaauuuccauauaagcuacuuuacaaaccguaugcauuagcaaacuuaaaaauggacacuugugugaacuauuacaguaacuuuauuguacaguaaaaaaauacugcaauugccaggcaguaaaaaaauaguuaaucugaauguucuuuuuuuucucagcauucugaaaguguccguauuucaggacuauuauuuaacuaaugcuaauagugugagccuacacaccaacauauaaauuuaaucucuauucuguuaucuaucucuuuucugggacaugugguacuaaugagccuacauauuugggaauuuaguuaaagugcuggggcauagaagauggcagggaaagguggaagagaaugaaaucucuuccaagugcauucaaucauugaacaagugcugucgaauaucacuagauauuaggaacugagggauugagacugaagugguagugaggggcuaggauauagaugaaaaggaaaaagguggcuagucccaaccuucaagguacuuaguuguucauuacuucacucacucacucauuaauuuauucaagaaguaucuauugaaugccuugcucuguguccccacccaaaucucaucuagaauuguaauccccaugugucgagggagggaccuggugggaggugaguggaucaugggggugguuuccccaugcuguucucguaauagugagggaguucuuacaagaucugaugguuuaaaaguggcacuugccccuuguaagaggugccuugcuuccccuucaucuuccaccaugauuguaaauuuccugaggccucccuagccaugcggaacugugagucaguuaaaccucuuuuguucauaaguuacccagucucagguaguaucuguauagcaguaugagaauagacuaauacaugacuacaauucaguguaccaggguguauuauuucauuuucaugcugcugauaaagacauacccaagacugggcaguuuacaaaagaaagagguuuauuggacuuacaguuccacaagucugggaaguccucacaaucaugguggaaggugaaaggcaugucucacauggcagcagacaggagaacuugugcagggaaacuccuuuuuuuaaaaccaucagcucucguuagacuuauucaccgucaugagaacagcacaggaaagaccugccacaugauuugguuaccucccaccgggucccccccucaacauaugggaauucaagaugagauuugggugggggacacagccaaaccauaucauuccaccccugaccccucccacaucucaugcccucacauuucaaaaccaauuaugcuuucccgacagucccccaaagucuuaucucauuucagcauuaacucaaaaguccacaguccaaagucuuaucugagacaaggcaaguccuuucuguuuaugaaguuguaaaaucaaaagcaaguuaauuacuuccuagauacaaugaggguacaagcauugaguaaauacagucauuccaaauaggagaaauuggccaaaacacaagggcugggggccccacgcaagaccaaaauccagcaggacagucaaaccuuaaagcucuggaacuaucuccuuugauuccaugucucauauccaggucaugcugaugcaagagguggguucacauggucuugggcagcuccgccccuuuggcuuugcaggguacagccucccucccagcugcuuucaugggcucguguugagugucuguggcuuuuccaggugcauggugcaagcuguuaguggaucugccauucugggguccagaggacaguggcccccuucuccccaguagggacucuguuugggagcuccaacuccacauuucucuuccacacugaccuagcagagguucuccaugagugcccucccccugagcaaacuucugccugggcauccaggcauuuccauacaucuucugaaaucuagguggagguucccaaaccucaauucuugacuucugugcacccacaggcucagcaccguguggaagcugccaaggcuugggacuugcaccuucugaagccauagcccaagcucuauguuggugccuuucagccauggcuggagcaucugggacacagggcaccaagucccuaggaugcacacagcacagggacccugggccuggcccaugaaaccacuuuuuccuccuaggccucugggccugugauaggaggggcugcugugaagaccucugacaugcccuggagacauuuuccgaauugucuuggucguuaacauuuggcuccuaguuacuuacgcaaauuucugcagccagcuuggauuucuuuucagaaaaugggauuuucuuuucugucacauucaucaggcugcaaauuuucugaacuuuuaugcucugcuucccuuuuaauacugaaugccuuuaacagcaccugagucaccucuuuuuuuuuuuuuuuugagacagagucuugcucugucgcccaggcuggagugcaguggcaugaucucugcucacugcaagcuccgccuccuggguucacaccauucuccugccucagccucccgaguagcugggacuacagguaccugccaucacgcccagcuaauguuuuuuuuguauuuuuaguagagacgggguuuuaccauguuagccaggauggucuugaucuccugaccucaugaucccuccaccucggccucccaaagugcugggauuacaggcgugagccaccgcgcccggcccugagucaccucuugaaugcuuugcugcuuagaaauuucuuccaccagaucccuaaaucaucuuucucaaguucaaaguuccacagaucucuaggucagaagcaaaaugccgucagucucuuugcuaaaauauaacagaagccaccuuugcuccaguugccaacaaguuucucaucuccauuugagaccagcucagacuggauuucaguguccauaucauuaucagcauuuugcuuaaagccauucagcaagucucuagggaguuccaaacugucccacaucuuucugucuucuucugagccuccaagcuguuacagccucugcuuguuacccaguuccaaagucauuucuacauuuuuggguaucuuuucagcagcaccccacucuacugguaccaauuuacuguguuaguuuguuuucaugcugcugaaaaaaacauacuccagacugggcaauuuacaaaagaaagcaguuuauuggacuuacaguuccacauggcuugggaggccuuacaaucauggcggaaggugaaaguuacgucucacauggcagcagacaaaagaagagaauuugcgcagggaaacuccccuuuuuaaaaccaucagaucucaugagacuuauucacucucaugagaacaguacaggaaaaaccugccccaugauuaaauuaucucccacugggucccucccaccacaugugagaauucaagaugagauuuggguggggacacagccaaagcauaucacagggauacgauaaugagauaaaguaauucagaaauucucgcccucaaucgagguucuguucuuuugugauagacagggaauuaauaaguaaaaauuauuauuuuacuuauuuauaacaguaauaaaaauuauuauuuuauaauuaauaaauuauguuuaauuaauaaguaaaaacaaagcaugaugaucagcacuaaagagaaaaauaauguaggaaaggagacgaaguauugagggcagaaagcuaguugcaauuuuagacaggauguucugggugugaacgcaucuuucuagugaggaucugaaggaaguaagggagcuaguugcucagauaccuggagcaagagcagugaggcucaaggaaaggcaguaggaggggcugaggggaaagugugccuggcauguucaagccuaacagagaggcugcuggggucgggcaggaugaacgaugggguaaggcccugugagggccuugugggguuucacucccgauguggugagaagccacugggagguuuugcccccccaggccugggccuugaaugugugggaaagggcuuauuaaaaauuaaauucagccauaaauuaugaagcagacucaaaagauugaauuuuauugaaggaaugaaacuggaauugagugagaaguaaaaucuggguuucaugguuugggagucaucugugagagguuguaguuaaauuuugaagauggaugcagaacucugaggagacguuuuugaaggaaacgagaggaggaaccaaagucugugcccuagcgauguccuucccuacuucugggcacuggagggagaguccugugucagccuuaaaaugguaauagugguccaccuccuuuuucuuuuuauuucuuucuuuuauggggguuguuuucuaggagaucuccaguauucugucuuagacuucuuguaagguaaaauuauggaagaaggaaggaaaaguaauugaaagaaugcaugauguugacuuuguguugacccaucaacuuguucuuuuauggaggaaugggaugggcagguggcuggcuuccaccccaccucuggugauuuagaauuacaaccaaaaacugucacauaaaggcucuuaauuucuaugacauuagccccaaagaaacccucaaaaguauugaagucugagacguauauuaauuucaauuuauucuccuuuuugugucaucuuucuuaguauuaagcuuaaacauucuucaaucacaauuaucaaaagcauacuuuguucauuuuaauuuuuguuuuauauauaagaagauagagguacuugcaaaucucaauguuuucacaaguugaauugugugacuuucauaccaagcuucuguuguuuguuguuuguuuuuuaaaaauaaaacauuauguuauagucgggaccaaaaacaaaauuucacaggcuauuucuucugccaaagaaacauugcccucucuugguuuaagaugucaaaacacuuagcaguguuuucugccuaauuuuggaguguugcuuucugauuaugaauuggagcaguuugccuugaaauugcauagauaugcauuuugcccauaagugaauguauacagcugauuucucgugugacuuucaaauggaagucagaguuaaaauggaaaauugcuguaggaagcuggcacguuuuuaaacuccugagugcuuuuggggggaauagaaccucuuuccauuccugguugcauggaaaauauuaaaccccuuuuaaguaagcaggagaugagaugaguauuauggauuuucaucuuuuucuccugaguucuuggauucaaauccuauuccuguugcaguguuauucugcauuaaagaucuugacugcugagauugaaccauuauuuucauacuuauuuuuccuuaaacuuguuuggugcuaugagaauauucaauauauagcuuuuuguugcagagauuuuagcagcauuaguucaucuugacugaugcccuugacuucagaguauaaauagaaaaauagagauaggugacaaggauugauuagcuauccucauucuaagugaaacaguaaaccuagcuagauaaaucacagcucaaaagccuggagaaugcaugguaaaagaaagaaagguagugcguauguguguguaugugcuuaauagugaaguuuucuaaaagagguacaagcacagaaauucuauauggucuguucuacugucuuuccguuuuuauuuucaaaaacuuaaggguuuaaauaacauauggaauuauuauuugcuuuuucuuuuauuuaaagaaauuuuuuaaguaaaagaaaacugagaccaaugucauugccuuuuuaagucagauauauguguguguauacaucugugugugugagagagagugugugugugagagaguguguguauguguauauauauauauaugcacauauaugcauauacacauacauaugauuacuuuguuauuagacuuuaacuguaggguuggaagggcucaggggagaucgccugauuuuuuucucuggcacuuuuaagcuauuuaagcauuuuaauaguguuuacucugugccaggcaguauucuaagcacuugauauauaugaacucauuuaacucugacauucagccaaagagauacaucuauuauuauccccacaaaccguacaaggaaacugaaguucacagaaguucagcagcucaccucaugagaaaugaagcugggauuuuaacccaggcaucaaggcugugucuucagcccuuauauuagcaccugccucucucccucuccuccucuucuuucuagauuuuucaguucgaagggccaguuuucacucugacuucccuuuaccugaugugguuucuucagccuauaguuugagccuuuuucaguuuguuuuccuuuauucuuuucuugagccuggugaagaacaacccuucuccaugucuccauccgucaccgcugcuccauucuuucacccuccuccuccucggugauauucuccagccuucaaaccauuucugaauucuuaaguuacauuacaucaggauuagaagcugcuguuauaacgacggcuuguccaguucugaguaagauaguauuaauagcacaauuaccucauaguuucuacauauauauacucuauuccuguuugccacaucuuuuuucuccuguauuugcaaaaauacauucuucuugcguuaacaguuugcuauuaugaugccaugcauguaaucaugaguauuucucagcuuuucuaagaccuuugaauuuuaacaauaauucgcaaacacgcuugccuuucuguggacauuuuaugggauuuauucagguuauuuaugaaaguuuauaacuguguccuaugaucuccuggcucuugagacacacugcuguuaauaugucaaauauguaaauuuccauuuaguguggaacugucaaagacaguuguaugauucaguuugauaaauggguacuuugggccagcugucaggguauuaucuuccugacugaauccaagggaagagaauaaagaauggaauaccauccugcacccagcacucuucacccauaucccccacacucccucucuacuugguuucaucuagcagagccuccauucucuuacugaagaugaaaucaugcugaugaguucuguccuuccuaagccaaagauaauuaugaccugauuaucugguaccacacaauauuaaguuugcaaaagugaguuuacccugauugcugcugcauuguauuaaguaaacagcaauuccaccagauuguaauuuguaaauucagcuuuuuuccccucuauccuugaccuucuacaauaauguuuaauauuuagucugaggugacuggggugggugaugaacagucugccuuguauguuuuucuugacuaugcugcuagguuuuauuauuauuauuauuauuauuauuauuauuauuauuauuauuauuauagguguugcuagguuagaauuguuuccgccuauacuggggacuuugcugcuguaggaucuuggauaguucaccuguuccuuucuuugaaaguuuugcaugauugcugaaauucagucuauaauauguccauuagugcaaucagauucacuuuuaacuggcauauuuaugcccuuauaacuuucuacccagacggugagaacuuuggccaguggauuggcggugaagggaguguuuuuccuuccagcuggggagcuuacguguuccugagcauccuauucuugccucuguuuuaucaugauaguauuguaauuuagcucuuucccuauauguuucccccaccucagugaaauucucaaagacugugagugcacaguucagggccuggcuucgugauguucuauagggcuaaucuuacacuuuccuuucuuuauuccaaacuuaauuuaagauggggcuauuaguaguaauccaaggaaccucuuaguuuugaaaggauuuuaguaauuguccaaggggcuuacacuccauacauguauauguuugaaaaaaaauuacuuuuuagcaguggacuuggaaccaaacuuuuuggaacacaacuauuuuuaucccaguuuuacacuucuguccagguacaugguagagaugccauagauauagaguuauauugaauuccuuuauaauaauaaugcagggggaaaggaucaucuggugaauggaaaaggaacccugguagaggaaggggauggggcagggauuauugcaaugacugccuacggaugagggaaaaguugagauugggguaugcaugucaucagaggaccacaccauacaaauuugaguggucacaggcauucuaggaguuagagacggagauguuagcagaggugugaauagagguagggucuaucgugauaguagauggaguccugagaauggaaguuuuauaugggaugacaagaaaagacacaguguggggagaagcuauagaacgcaggagaugauggccaaccugaaaagaggacaauggugguuguuggccaucauaacaauggagaaagggcaagaagagaggcagggaaucccuuaagcagcaagggauugcugcagggauggggaaagggaguuuucugggacccugaugacuuuggcagcagccaguaguguuggggcuguucugugaauuguauauggucaaccagugauugaugcuuaaauuguauguagucacggggagcuugugacuggccaaagaauggaguaacacguuuggcuuagccugccaagaaugagaucauauuugaccauaaugcugaacaaacaggauucaaaggguagaucagaauuuuaauuuacucuguucucucccucggugccuauucaaaccauuuuguggagcugaguuuucuguuccuggaugaaaucuuagacaaacuuguuugcuucacuaacuucucucagauuaaaagcaaaaaauaguucaaaacuuguauucauaaacacacagucuugguucauuaauuguuaugucuggucuaguccaggacaguuaauucaaagguaaggcuucucccuccuguccagcuucugcuugcuguagguguggagccugcagugggaaggaguguugugguaugccucuucucccuuguugucugccagacaugucugcucuuccuccccugcucaccaggcgacucuggauucuucagaguagacuggguggggagggaggauaaagggcagaaaggucuuacagaaccgaacaucgguuugccgcugguuucuucuggcuguggcugauggugaaccugacuaguucuuuuguggacccuuuuauaaauucuuuggagagucccuuccuucucuauuucugugcuucucuagucuguuuuccuugacgugggaggagggaggagauacaccuccucuuucauuccagugguaugcugcugaggucuccuuauggauccaggcagccuuaauucagaugcagaucauguugacuuuguaguacuuauggaauauuuaggagaaaauacccuucuagagucagagagaagccagagguggaaguguagauguggggguaacugcuuugcagaugaugguuaaaagucaggagauugagcaagguugcccaggaagacaggaggaaaaagaucucaaaaagacacuugcauuuaagaggccuagaaggaaauggagcuggcaaagaagguggaagcaucauucagaguacuggcuuuagaaaagggcaggcuggaugggagccagcccagaauaaugccuauuaguaugucuguucuuuaccuggaaaggggaacuuaaaacacauauguuuuuauuuaaauuguguaaagacucuacacuguuuucuuccuguuuuaaaaauugauguuaauuuuaguuuuaaauuucuaauucuuugaagacaaaaauguuaacuuuuuuuccaguuguauaugaacacagaucaagauuagagaaauccuugcaaaaagaaagacuugaacauaaaaaagcaaaggaagguaaguaaauacauaauuuguguucuguguuuuuccaguacucuucuuugacguaucauauacuugguuuacaauuuuuuuuuggcuaagaucguucucaaaucaacccaaagucagauagguggacagagaaagacaugucaaguaauauauuaugcauugugcaauaaucccuauacaagauuggauuuagaauacuguauucaguuuaugccaccuugugauagcucauauauugguuacacuuauuauuucaggaauaacauauaauuuuucaucugcauauuaaacggguauauuacuuacaccuggaacuucuguccacagauauugagggggcugggguugggggggaaguaacaggaugcauuguccagaauaugacaaauuuuauacacauacauauauauuuauaccguaaugaauugaucccauuguccauuauauuuuaaguuaugcaccuguuuuuaccuugugaaaguuuuuauugacacaucaguugauucaguuugaaaguuuacauuuaggacagccacugggcaaugcugucaauuuuuaucagaauuuuuccauaaaacacaggccuuauacagcugaugauuugaaguuaucugcauucugauauuuauuuauucauguuuuaugauaaaucuugaaauuuaaauuacguguucugucugccuaccuugguaggaaggaagaggauagcagaggaggggcaguauugguuaggauguuuuacugacccuuggauugagccugugugaagaauagaaguucagcaucauuaaaugcuuugauaagauuuggagucuccuugccuucaaaugcagagugauuuuauagagccaucuaguggauaauaagguuuucaaagcauuaaagauggcuuggcuggcuugauuucuguuuucaggaacugaaugauuuuagugugccaucuaguggauagcaauaaaucaccuuugucuucagaugugcuccauuuuuucccuccuaaauuucaaggagaguuaaucagagauauucuaaaagcacuuuuaaucaauuggcuauaauuuggauuuuguggaugcaagauuuacagcuguaagguaaagaggaagcuguauguuuuuuccaauucuuucuaaagcaaugagagccaaaauaaaguauguaaaucaccaaguagauuguuuuaaaccuaaaacacuuuuguaagcaugagugaaguuugccuuuauuucuuuagauguuuaaaaucuguguagugaauuaucacuguuuuuuuccaucuuguauuuucuagauuuucuuguuuauaaguuagaagcacaagaaacauuaaauaaaggaaggguaaguuuuguuuuuuuuguugugguuguuuguuuuccuuaauuuguuuucauaaaacuugaaagagagagaaauacaguugcgaacucuuuuacuuuuugaucccugggauuauaggacugacacccccuuuuuuuuuuuuuggcugccaaaaaauucuaagaggaagacuuuaaacuuaccuuuacuuaucacauuguugauaauagggauaaacugggaauaaccuuaauguucaacuauaaaaagaagauuauuucauuuauuuguuugcagucucucuuuuuuauagaauguaagauuuauuuugguuugccuucacauguguaacaugcaacacaggaccuggccuagaguuuucauuuaagaacauuuguggaaugggugaagggaugaaugauacuggcauuuaaaaauauuuuacuugaaggcagcaugcucguuaagagucaucaccacucccuaaucucaaguacccagggacacagacacugcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaauaaaaauuaaauaaauaaauaaauaaaaauauuuuaaaguccaaauuaacuggauaaaagcuacucuuuucuuacucuaagaaaaguauauaagcauuaauugaaaaacauugauauuuugggguauuaaaacuaagaagaagccaagugaguuggcucacaucuguaaucccaaaacuuugggaggcugaggcaggaggauugccugaggccaggaguuugagaccagcccgugcaaaauagcaagacuucaaaguacaaaauauuagcugggcgugaugguacacaugccucuauucccagcuacuugagagcugaggcagaagaucacuugagccuaggaguuuaaagcuucaaugagcuaugaucccaccacucuacuccagccuggacaacagggcagacccuaucucaaaauaaaaaaacugagaagagucacuucuuuggauagcccaggaggccaucagcuuucaacucuugcuugcuuuuaacagcacuaaccaaagcugugugcacuuguaauuuccuuacaaauuaaagcaguaaagugaggaagcaaaaaugcaguucauuuuagaaguuuuuaauaaaaauaugaaaaaaaaugcaugaguguauacuugugcuggcaggguaaagugagggauaugguaccuaaacauaaacaacauagcauagagagggaaaagaaucagguguguuuugcauacugacugguuauggcugcccgggacuauuggguccauaugugaagauaccccacaggaacacaaagauauaccccuggaaccuggagcucaggacacgcaguucagccagagacuuaggcucaaguuucaauccuggcucugcuacuuaaugaaauauuugcucuuggcagguuccuaaucuuuacucaguuucucacucugcaaaauagagccucacugggguaaaaucauguauauagaauuucuuacccgcugaaguucagggaaagaaagugccuuuucucuucccccuuuaagccaugcucagcuugugaggcccgcuccucaucgguuuauuucuucuucccucuuaccucaagcacccagcgcauauauuagcccugcgcggugacucugugucucaggacaaguucguaugucugggcuccaguucuucugaauaugaaaguggaaggaaaucaucucuaagggcucuuucaagcuacuguuuuaugauuucauauccugcuuuuuuacucuaaaaucuagcaaacuaaggggaauguuaaaacuucauuucuguguuaaaucgauggcuccagcgacaucuugguucaaauguagaauucauuuuacuguacacaagugaaauaaauaaaguuauauuuuaaagugcuuuaagcuguauuuaacaagagagccauauuuaucuuuguguuuucuuuuuuuuuuuugauuuacagcaagauuccaauagcagauacagugcacugaauguccaacaucagauguugaaagugaguaaucuaaaguuguuauuuaugaauaaaagaaaggauuaacuaauacuugaacugacuaauggccuuuaaagugauuaaagaaaguuuacagaaguugauuuguauuguaauauggcauuuuaaaaucuuauuuggcuaaaaauuauauauaguuguaauggcuugucguauuuaucacucgauuacauagaacauuuuaauuauuacacauuuucuugcaaaucaggcucucgguuaccucauuuuuaauuuucuucuucucucuauccauuaggguuuuauguucauuuacuuucucacagugguuuuccuuagacauuuucuuuuaucuuacacagauuggaggcuguagaacuauuaaaaugcuuccuucuuguuacuaauauuuaauaaauguccuuuuacuuaccacaggaacacaaauuauuauuuaaagauucugcuuccuugguccuugaguaaaacucauuauucugugucaggaagaggaucauuguuucugucaagcuggaagagacgggcagcaugcaguuaugcccuucucgcaggaugcagaucaugccggcaucuccaccccaccgugccucccccucgcuuucuguuugcuauugucuuucccucugauaucaguagggcaugcacuuuuuauugaaaccggaaucuuuucuuauuaucaagagagcaguaaaugaauuaaagcaaaccaugcuuucacauuaagcacuuggagacuguaguguuuaucuagaucaugauuacauuguaggauuauaaucggaaauaagguaaauaaaagucaauucucuaaacaguugauuacuauucccaaagggaaaagucucauuuacucucucucuuuuaaacugaguuaccagaaaggcugaaauaccaaagaaggaaaauuaaaugcauugcugggaaaacaucagaucgaaagaggaaauccauaauacccagggagggauaauuuugccauuagcuuuaccuuguuuccacaguaauaugugucccugggaauuuucccacauuuuuucccuuuccaucucucaugcuaacuucuuaaaaauuaaggggaaaauuauuuuuggcugugaucccaacuguucauuugaaauccaggggaaauggagggaagcugcacaaauuaaagcaacuugagaaaaacaaagccuauuucuucauguguuugugcuugcuugcuuucauuuguuuuuguuuacugugcugucaagaaauagacucucauauaauucagagaauguauauuucuacucaaguuuucaucuuugcagagccaacacgaggagcuaaagaaacagcacagugacuuggaagaggaacaucgcaaacaaggggaagacuucaguagaacauuuaaugaccauaagcaaaaauacuugcagcuccagcaagaaaaagaacaagaacuuucuaagcuaaaagguauuuggaaaucugauuagccaguuuaucucuaaauaaguacugauauuaauguuucagugcaacuguagacuguuguuuugaguggugaucgauuuacauuuaucaugugguccuuuaccagucacuuuuucuuuguaauguuucacauguaucuucaucuauuuggguugguuuagggaagcagaauagaauaugucguguguucuguuguaucguaguguauucucuuguaucucaguggggcacauggcccuguugggcaagacgauucuucucuuaacuggguugcgagacagauagcaucucugauccuuaccuacuaaaugcuauaaugcuucucaguuauugccacaaucaaaaauugcuccauauauuucuaaaaaucuccaagggagcagagacuugcuguugaucgccaguaguaacugaaaaaagcucaaguucuauagucagacugcccaggugaaucuuggcuucuucacuagcuaugugaccauggguaaguugugugacaacugugggcuucauugucuuaucugugaaauugagauaaucauaaaaauaucaaccuuguagaauuggugugagaaauaauuuacauaaagcauguagaguaguugcucauaaauuugcuacccaucaacaucugugucagguauuuucauaguaauaugaaacaaaauaugucacuuuucugagugcaugugaguccuggagaaagaaaccagugcauucugcaaucaaauauuuaggugaacuccagauuaaucacaagacacacgucuuccccauuucaaccggggacgguggcucacgccuguaauccuagcacuuugggaggccaagguggguggaucacuugaggucaggaguucgagaccagccuggccaaaauggcgaaaccccaucucuacuaaaaauacaaaaauuagccgggcaucguggcacaugccuguaaucucagccauucgggaggccaaggcaagagacucgcuugaacccgggagacggagguucuuacagugagccaagaucgcacuaaaauuaaaugcauugcuggggcacugcauugcuggggcauugcacugcacuccagccugggugacagagagagacucugucaaaaaaaaaaaauaggugcuaaauaaguuuaaagugagauaauugguuuuaagaggcauauggugcaugcaaaaacaguggucaagcccaaaucaaguuuguagucuaguucacuguacugaccccaacaguuuccugguuuugguaauguacuguauuuguauaagaugucaucaugaugggaagcuggguguuguguccuuaggaccacucuauauguuuuuugcaacauuucucuauaauauagcauuucaaaaaaaguaaguuacaacaaaaagucaugcaggaguuaaauagucuugaggcaguacuacaaaggguuaagggucuauacuuucugauuauuuuauuuuuauauauuuuuaaaauuuuaaauuauuuuuaaaaauuugacugaaaugcugaagcuuuguuuuuaauuugugaagagacucaaaucugaguacaccuacgcauuauauuuuauuccuaaggguaugcuuauugacauuaacaucucauuuuuaauuccuagguaacaaaaauuccuuaucuuuugucugucaugcaaaaguuguuuaaaagcauuuaaaguacugaaccagaguggauugagauguccagcuaaaaccaugcuacaucccaauacaauaucauuuuuguugauuuugaauauuauauugucugaguucaaaauaaauucuaaaauaaguuauagguggcuuuagauaugaaaauaauagaaacagaauccugaaaguuucaaggcuuuaugugugauccuucuuuuucuaaaauagagacuguauacaauuugagagaagagaauagacaacuaaggaaagcacaccaagacauacauacacagcuucaagaugucaagguaaaagaaaaccaaacguuucacuauuuaguguuugccugcuuuauuugguagaaugacuuuaaaaagucauucccuaauuggccugcuuuacaaauccacguuguuauugugggcuuugcauuaacuagaguguaccuaauauuuuuaccacuucagcauuguaagcuaaaagauggucugaaaaucugaauauucucauuaguacugaaauuauucucaugcuaguuacauauuaauaagcuuuuuauuuauaaaaguuuacuaauaaugagaaauuuguuucuuugguuuugauuucauuguaaauaaaugauuaugauauuuggguagcacguuuuagauuuuggaauacuacauaaagcguaguguucucucuacgaugauuuuuaaacuuaacacaugcugcuacaacaacaaauaaacaagcaaguaacauuuggguagccauaucacgaucagccaaagaagaauuugucguagaauguuaaagcucaacauguaaaauucuuuuuuguguagcaacagcauaagaauuuacucuccgagcaugaacaacuuguagugacuuuggaagaccacaagagugcacuagcugcugcacagguuagaaggguagcagccucuguggguucuuuuacaagucugcuuaacauuucucaauuccuuuaugcauguagucucuuacaagccaaucuucagugaguuccuuaggacagagcuauccuaauccugaggaucaugcaugcuuucaaaauucaaucaguaagauauuaaacuuuugauuauuuuuugcacugguugugcgguacauaaaugaucauuucuuuccacucucgucccuacaugcaguagucuaauacuuguuuaaaucacagaaaugaucucacauauauagucuuuugcaacuaucugaucuguguugacucuugguguaguaucuguaggauuuuaugcugcuagcuaccuaaaacuauugucagacuuuuucuucugugucugccuugcucccagaauuccagccuacacacccuccuuuuggaacgaggcuuauguguuguuggucaaauuacagaaaaguagaagagucaacagagaaggaaaaacaagagucauaagcuccauuuguucaaaccuagaacagcuccuggcacaaggcaggcccucaguauauauuuacugaaugaacaggggaacaaauacaaguguuggagagcuuauuaaagcgauuucaugcuaaguguuaugcagauuucuagcagaaggaaggaaacaggaauggcuaguuuaguugcuguuguaaacuagaucuucacuuuuauucuuacuggaggaauuaugauaaaagaacaaagguaaacgaucuaugcucaucaggaaacccauguugguuuucuuuucuuuauaaaauuauuaaaagguauaauuuucugucccugacccaucucagaggcuguagcaucuguguuugugagauuccuuuucuaaacagucauugauuaggugucuccuccuaagcuguagcuguguagugauuuuuuacauguguauaaaugaaauugacgucagggaucauuucauuucacgucuucuuuauaaaaauuuuugucaaguauuauuuuauaugaggcuguucuucauacuauaaaugugacaaacugauuugagugcucugugugcuguaacggccauaaauguaagacugagcaacaauuugaaaauccauagaaagauaaguaaaaucauuuauuugaugaccaaaaccaaauucuggaguagaacucugacaguauuacucacaggguuuuauaauagaaaaaaaaauuuuggccgggcaccguggcucaugccuguaaucccagcacuuugggaggccgaggcggguggaucaccugaggucaggaguuugagaccagccuggccaacauggugaaaccccuucucuacuaaaaauacaaaaauuagccaggcgugguggugugcaccuguaaucccagcuacccaggaggcugaggcaggagagucacuggaacccagcggggcggaggcugcagugagccgagauugcaccacugcacuccagccugggugacagagcaagacuccaucucaaaaaaaaaaaaaaaauuuuuuuuuucuuaauauauaguuauaauuuucuauuuauugaaauaucuuuuuuggcgaggaugcucaagguuuguccugccuuaaaaaaaagugucagaacuaggugcaauccuuaauuagagccauauguguuaguuacuuugggcugcuauaacaaaacacccuagacugggugucuuauaaacuauggaaauguauuucucacaguucuggagacuggaaguccuagaucagggugccagcauggucagauucugguaagggcccucuucuuccagguugcagacuguugaauucuccuuguaucuucacauagcagaaagagaccaagaaagcucuccuggaucccuuugcaagggcacuaaucccauucuguagggcuucacccuuacgaccuaauuaccucccaaaggcccugccuccugauccaucacauuggagguuaggauuuuaacauaugaauuuugagaggacacaaacauucagucuguaauacuguauuaagacuuuccccaaaucuccuuuuaaaaaaaaugcuguuucaggcaccugcauuucucauguaaaucaucuuaggagauucugccuugacaaccugauuuuuaaauguaguugaguauuuuauuuaauccucacaaccuugugaguuauauaauauuguacccuuuuauaacuaaauaaacugagaugaaaagggaaguaaaguagcuggcccaaaaucaaugaccagaaccaagguugaagcucagguuauccugacuuugaaaucacgcuuaacucuuaagugauauuuuuugagacuuccugcaucacagguaccugggccuuguccuagaccuguugaauuauaauuucaagaguaggggaccaggagccuacauuuuuaauauggucccuaauugugcaacacacaauuacugccuucaaagauuaugugucuaggagaaagaaggaguagaauugaguuuuguguauugcuccauauuuaucuuaaaauauuaaaagcauugcuauguguaugucauuuauuuuuuaccuccaaaguugguuugcaaauauuuagauuucucagauaaaggccauugcuagucauauggugcaccuuuguacaaaauuauuaaaaggcagugcccugggaauuauuuagcaagcaaacuucauuacccuaguguacacuagaaagaagcaaaaaaagcaccucacucuugggguggaagagcagugugccauggugcauagcuauggcagcaggaaugcugguggguucuggcuccacucaccugcugcgccccacacacugcggagcuggcccugucugggaagcuuguugagaaaaagacuucuguguucucugcauguguuuauaugucuguuuacacacacaacauuucuguuuucaggauaacaguguugguguauagaaugagcaaaguauacacaaugccucuugauuuuguuaauuaaaguaauugauuuuuuucuaauuuucuagcuccuuguauuaaaaauauuacacagacauccacacaucccaccccauguacacacaggugcagcuguaugagcagauucuaguccuguaccuguguuaguaccuuugucacuuuagaagaaaagaucauucacaaucaaggauaaaaaaauccagucuauaucacagcugugccacuguuuuccagaaaccacagagcacaguguaggaaacauucuagccaauuagggauucuauuugagcacaaauuaacugagggggaaaaugguagccugaguauuuauauguguguguguuuguguguguguguguguguguauguguauuuaaaauuuauuuuaaaccuaugacuccuuucuacugaaagauuuuauucagaucauauugguaaaagguauuugcacuuguauuuuuauaauuauaugaguuuuuaauggauuuuuuaauaugauaaaacaucacagaacggucuuuuaauagugauauuuauauuaguaaguuauuuacaaaaguucugacuucaguguaguaugggaaacuaacaucugucuuagauauuuuuucuguuuccuucagcucuguuucuaauuugcaugcgcucaaaaaugauuaagcaugcccaaguaagaauagugaaugcauggaaacaaucuguauguuuuucuaacuuguauuuagguacaauauuuuugucuaguuuuacaguguacccaaaugcccaucuaugaaugggcauucauagauucccuccucaaauugugcaauuuauaugcagacucaaguugcagaauauaaacaacugaaagauacucugaauaggauuccaagccuucgaaaaccugauccagcagaacagcaaaaugugacccagguggcacauucuccacaagguuacaacacagcaagggagaagccaacccgagaggugcaggagguaaggggcgugaacugguaaucuaugguuaggucacuuucucugucaaguugccaagaggggaccugcuuuuaauauugccaacuuuucugggagagcaguaguucucaaauuuuaguauaucagaauugccaguagggcgugauaaaacacagauuacugggucccaggcccagaguuucugauuuaguuaauuuggagugaggccuaaagauuugcauuucuaacugauuuagcuggucugaguagcaaacuuugagaacugcugcuaguauuuucuuucuuuuuuucucugagacagugucaugcuacgucguccaggcuggagugcaguggcacaaucuuagcucacugcaaccuccgcuucccggguucaagcaauucucccugccucagccucccgaguagcugggauuauaggcgcccgccaccacgccuggcuaauuuuuguauuuucaguagagacaggguuucgcuauguuggccaggcuggucuugaacuccugaccucaggugauccgcccgccuuggcuucccaaagugcugggauuauaggcgugagccaccacaccuggccgcugcuaguaugucugagaaaggcuuuaauggcuuugucuuuauucauguagguuuauuugucuucaaggaguuguaguaucugaguuuuucaagguuggggauuuugcggggguuagggugagaacguuaaaugaucaugaggauuuuaugugacagucaacccacucaaauauuaaaguuaauaauauauuuuaacuuggagcagugcuaggucuacacagagcaugucaaaauuugaauuaaaugaccuguuugacacuccuacggguaugagugcuagucaaauaauacaccuuuuuauauucuuguucuuuauaaaaauuaagccuuaagaauaucucauaagugagacaucagaaguaguuaccauuaccacuaauuucuacaaagguuguuuuuuuuuuuuccaaucaucuguaauaaaaaaauaggcaauaugguuaucuuucugacaaagugguuguuuuaaacuuuuaaguucagggguacaugagcaaguuuguuacguagguaaacugugucaugggaguuuguuguaaagauuaucuuaucacccagcuauuuagccuaguacccauuagcuauauuccugcuccucucccuccaccuucugauaggccguacaguguguuguuccccucuaugugcuuaugugucucaucauuuagcucccacuuauaagugagaacauguaguauuugacuuucuguuccuguguugguuugcuacagaugauggcccccagcuccauccaugccccugcaaaggacaugaucuuguucuuuuuuuaugacugcauaguauuccaugguguuuauguaucacauuuuucuuuaucaaagucuauaauuggugggcauuuagguugauuccaugucuuugcuauugugaauaguguugcagugaaugugucuuuauaauggaaugauuucuauuccucugggcauauacccaguaaugggauuuugcugagucaaaugguauuuauaucuuuaggucuuggagcagucuccacacugucuuucaugaugguugaacuaaucugcacucccaccaacaguguauaaccauuccuuuuucuucacaaccucgccagaaucuguuauuuuugacuuuuuaauaauagcucuucugacuggugugagauaauaucucauugugguuuugauuugcauuucucuaaugaucagugaugcugaguuguuuuuuuuuuuuuuuuguaugauuguuggccacauauauguuuguguuaguccguuuucaugcugcucauaaagacauacccuagacugguugauuuaaaaaagaaagaaguuuaauuggacuuacaauuccacauggcuggggaagccucacaaucaugguggaaggccaggaggagcaagucccaucuuccauggauggcagcaggcagagagagagagcuugugcaggguaacuccucuuuuuaaaacgaucagaucuugugaaacuuguucacuauugugagagcagcacgggaaagacuugaccccaugauugaguuaccucuaaccggguucuucccacaacacgugggaauucaagaugagauuuugguggggacacagccaaaccauaucagugucuucuuuugauguguguguucauguccuuugcucacaaagugguuuuuaacauuaaagagaagacugagaaaacuuuccuccaaguuaugggaauaauuaaguugauaugaguagacuucauauaugagccucuucacucuguucaggguauuccuucaacagacagguucaguaucuucauggacucuuauucuuucucaggcucuuauguuaauaacuaaagagagcaugaccagaucacuggccuggcaguugguucuauuuucugcccuugucagacugccaguuuacuggauuaaucuuccagugacucagaucuucaguuuuuccaucucugagguggagauaggaguuaucugcacuaaccuuccucacuaggauauugugaagauaaaugacaaguguuugaaaguacuuagagcucuuuagagaaauauuuuucuguaaagccagggcaguauuaugucaaacuugccagauaugugaggaugucgguggaaugugcaacuccaguuguccucaaaugucugagaaaggacuuuucuccccaguuuauuaauacaguccaauuucucagauuugauaauuauaucucugcuaauuuaagaauaggauuucacauuuauuucaauuuugggagagcagucuaaccaaagaagauuuuuuuuucugaagguuaaagagaaaaaaagagugacguuuguuucuguugauauacuauauucucuuucuuccucacuuucuagguagugcagaucauauagagaucgcugaaacuuauagggagaacugauuugagucaacuaauuuuagaggaggguuauucugaaaaagccauuucuucuuuuucugcucaggguuuucaauauuagcaauaaaaaauguuuacaaaagaguccugcugguuuacaaauaauuacuacuuuaauacauuaaaaauauuuuauuguaucuuguuuaacaggcacuguguugaacuaacauggauguucauuaguaauggcauucuuuuuuuuuuuuuuuuuuuuuuuuuuuuuuuuuuugagacggagucuugcucugucgcccaggcuggagugcaguggcgcaaucucggcucacugcaagcuccgccucccggguucacgccauucuccugccucagccucccgcguagcugggacuacaggcgcccgccaccacgcccggcuaauuuuuuguguuuuuuuaguagagacgggguuucacuguguuagccaggauggucucgaucuccugaccucgugauccacccgccucgaccucccaaagugcugggauuacaggcgugagccaccgcgcccggccaauggcauucuuuuuuaaauuaguaaaccaaacuaguaaaaacuaaacccaacuccucaauuuuauuucauccuucucuuuucaaauaauuacugaaaacaaaauuuacauugaagaaaauuauguaaacauuucaucacuugaaguuugagguuuuguuccuuuuuauucuaagggaaaauaggaauuagaguacuucugagauauugguuacuuggagguuuuauuuuccagguuauuuacuguauucuucacagaugaaguuuugcuuauauuaugucuauuuuauaagugagauuacacaguaagaaacuuaagugacuccauugcagccauaaagccaggacuauauauauuucuagacaccuucuucuguuguagccccaugccccauagacauggaaaucaagaaauuacaucauuacuuuugaaauuggaagagugucauucccagugaugugcuuggccuaggugucucgaaauaaugauguguggcagaaccaugaagcaguuccuggaagagcagaagacacaaaacucuaugcucccacccauaaggaggcagaauuucaggcucccccagagccaauccaacaagaaguggaacgcagagaaccugaggagcaucagguggaagaggagcacagaaaggcccuggaggaggaagaaauggagcaggucgggcaagcagaacaucuugaggaggaacacgauccaucaccagaggagcaggaucgggaguggaaagagcagcaugagcaacgagaagcagccaaccuccuggaagggcacgcgcgugcugagguaugaagucacccgcuucugguaugguguacugggauggaaaaccuggcuuuauuuuuacauauuaagguaauauaucacaaucucuaaaauagaaaugugagugauucuacuaaacauuauaugcucauauuuaaguuuucucuuguaauguuaauagcauagcuauucgcauaccucagaaagaugauuggugaugagagagcacagcuguuguaugugugcauucuucuuuuugucaguuguacacagucagagauucauucucacaucaccuuaauagaguagaacaggugaguaccugauggggcaccuucccagcuuguacccaaguuuugucuugagcaucuugaggcagagaaaaaucucauuuucuaugaucaggcguccuccucucccuguucauuuauugucaguauguugccuuuuguauucaccuucaaggugguuauuuaauuaucaaaaaucugauuuuacuacuuggagauauucuacuaggugagcauaucuaaacagccucugcucaggaucccuuacuggacacgccacuuacacguaagacuuuucccuuucuuaaaaaaaaauggccaggauuauuauaaaugaugcuuuaaaagaaaacucuacccuuucuucuuuuaaaccaacaguuagugcagcuagaugccuuucuuuuacugucucuaaacugagucucaauaguagguuaccuggccuuuacauggguguggaucaccuucuauuuauaacucugaaguuuuauucggccucagauuuucugagacuucaagccgcuugaggcuuuaggcuaagcaggugugaagaccucuguaguugcccucuuagguaguugcaaacuuaaccucagaaagcuucuuccagucuuguguccuuccccaauaggggaaguaauuccccaccagcuuuacuucccaacccucuaccucuuuccuuaagugagaauugugugugcuuuuguuaguugggguauggcagggaggauggguaguagcucaaugggguacagacacuuuuuauugaugcauaauauauguauauauuuucagaguaugggcgauauuuugaaacauucauauaauguauaaugaucaaaucuagauaacccaucacaucaaaccuagauaacccaucacaucaaacauuuaucucuuuuuuauuuugggagcauucaaauucuucuagcuguuuugaaauauaagauagauuauuguuaaucguagucacccuacugaacuaccaaacauuaggucuuauuccuucucucuaacuauauguuuguaccauucaucagucucucuucaucccccuucccagcuucuaguaaccaccaauccacucuaucuuaucaauaucgcuuuuuuaagcuccuacaugaaugagaauaugcaauguaugucuuucugugcuugaaguuuuucacuuaacauaauggccuccaguuccauccaugucacugcguaugacaagauuucauucuuuuuuaugacuguguauauguaccacauuuucuuuauccauucauccguugauggaugcuuagguugauuucauguuuuagccauugugaguaaugcugcaauaaaccugagagugcaaguaucucuucaauauagcaauuuccuuucuuuuggauaugugcccaguaauaggauagcuggaucauauggugguucuauuuuuagcuuuuugaggaaccuccauacuguuuuucauauuggcuauacuaauuuacauucucaccaacagcguacgaggguuccccuuucuccacauccucacuagcguuuguuguugccuuuuugauaaaagccauuauaacuggggugagauaauaucucagggaagcagaguuuuaagaauugcuguaucagauuucccuuuaaucagaaggcaccaucuucucagccauucuuaguuucuuugaaaaaaaauugaauaucugcuuuuccacuauuaccuggaauguggcuuuuuuuuuuuuuuuuuuuggcuaugcuuagccugggauugguauauacauuacuagaguuaauuagcaucccucggucuuuaacuguucauggaaaaagccuuaggcguagcauaaggucacagauugcccaguuaaugugaaguuaccaaaguuaccaacuacuuguuuauaucagagccuugugaacauaaauuuuacaguuugaaacuguuaucuucgguugucccuucuguuccauuugagaagggagcacauugaaaaucugccuuaauagcaguaguuggaaauaucagcugcuaaaaaagccaagggugauucagagaaaguugggaaauaggaguuuuuggacuucauguauaaucacaguucaccugacaaauagucguuaauaaaccagcucugccuccugaguuugucaggagaaacaaaugaagagaaaacccagaggagcuaaccccucuugcucugcaccaacucuuuuucacccuagguguacccuucagccaagccaaugaucaaauuccaaucacccuaugaggaacaguuggaacagcagagacuggcagugcagcagguggaggaggcccagcagcugcgggaacaccaggaagcuuugcaccagcagaggcugcaggggcacuuacuacggcagcaggaacagcagcagcagcagguggcaagagagauggcccugcagaggcaggcugagcuugaggagggccggccgcagcaccaggagcagcuccgguagccuuccccuuccuuaaugaacgaagacagccccugcuccaguuuucauacgcaaauuaaaaacaguuuugugcauuugugauucaugaaguuaaggggcucauauugcucaaauagccaaggcaggacagcuacuugaaaauuaaauaccaaauauuuaauuuuaaaaauaauauuuuuuuucugcucaaaagugguagguuaggucuccaaauagccuugcaggcuuugugccaacuuuauuuuauuuuaucuuuaaaagauauuuuaucuuuuuaagauaccuuuugaaaguguaucuggaauuuuuauuauaccuaauugcauacauaagagguuuuuaaaaauuuuucauggcuucuuaaaaauguugagaaacauuacuuauuacugucuuuaaagauaaaugaccuaugucaaacugugccucugaauuuugucccacuggauuuaucauguuugugucucuuguaggcagcaagcucauuaugaugcuauggauaaugauaucguucagggagcagaggaccagggaauccaaggagaggaaggagguggugagacuuccuagaugaugaauguuuuaauaaauuacuugauaacauuguauauuaucagugagccaauauuauauaacaucaaugagcuguaugcauaccuaagugcaaaggagguuugugaaucaugucuuuuucuuaauccucuuaaacaguacaugcugguagugaaaaaugcucaagauaaucuguuuccucucuaucauuuucccuguaguuuaagcuuuuuauauacuaaauauuuauaauauuucugacaaauuauuauaggauuauuaugcuuugggaaacaucugcauuuucuccuuaccuuggaaguccucacaucauugccuuaaaauguuuucaaauuaagucaauaguagcuuucauuuaugauaagcacuuaauauguaauuuaucaaauauugcuuacuguuauaauagaaccagaauguaacuuacugucucucuggcaccacuaacacuuagauguguaucuuuuucuaaaaagucagaaagaaagugauuacauacaaccucccucaauagcccguugugauaucuuacagcucuuacagucaagaaauuguuuuccuuauguccgccauguggcacuuuaagcuuuuuuguucucauaucaguaagacuagagaauggcuuguccucuucucuauguaguaaaccccuuugugcacuugaaggcugaugguaaguuaccccguaucaucauuuucucuaggcuuaguacacuccauauacuuaaacuuuccucuucuaucuuacuuguuuuaaaaagugauuuguucuucucuuuuugugcucauacaauucucuuuaucuaaauauuuuuucaaaaagcagcaaguaaaugucugaguaugaaugugugcuguuucugggcuguggcggucaucaucauuacugugaugacaucagaaaacaugugaugggcuauauuuguuucugagcuccacagauggggcaguucuuccuugcauuuccugaaacuaucaauuucuucuuuuggagcccagcuacuuccucugauauuaucaaacauuaguugauuucuucagcaguguccaaucaacugggcuuucuuuuauugagagaguuuugauuguuguuguuuucuugcauaugggggaaaaauuacagcuccugugaaaaauauuuauuuuagaagaaaagugucugacccauaucaucucucuagacacacagucugugaagagaacauaaccuuauucagaaaagccaggacauaggccuuauguugaguuaacagagguggagguauuguagucuguagaaaaguccacugguggcuuuucuuugaguugaaagggaaauccuguuugauucauuuugggcugauuuuaguuccuuugauuugcuagccuaugaaagagacaaccagcaccaagaugaagcagaaggagauccagguaauagacaugagccucgugaacaaggaccccgagaagccgacccagaaucugaggcagauguaaguauccucucuucugccccugacacauguaaacucauaaggugggaaagagaguugaaaacuugccugaugccagccuucagccccagauauuucuguuauauccucagcccagaaggaaaauggcuugcauaauuauauaugggcaguguuuuuaacuguaaaccaugguguacguguaugugaugagcugguuuaaaaguugcucugggggaaaaaaaaaaacaaaaccaggauuuuuuuuuucugaugacuuuuagauuaauaaaacuaaaaccuagaaaagcaaaacugagagacacugaaauauguaguaacucugaaagcuaggaggaauaaaaggcaaguguggaaguuggagaugggaccagagaaaggaaacuaacccuuccugagcauguugagcagucugcuagaguguuagguauuugugugacucucuguaaucucuuagcagucuagugaccauuuuaauaaauauauggauaaggauauguggucugagacaugaagaguuguucagguaugcaaugguacagaaaauuuauaauauaaguagguagacaucuaauaaccagcauuguuguuuguguuuaccaaaaaagacugagaccucuaguucagcugggugggcuagauccuuggcccugccuacaagugaagcaagcaaauguuuagugagucuguuccugcguguaugcguagaugauuuuuacagcuuauuuuagcugcccugucaucucuugcuaauagaucaacuaccauguuuauaacagucggucugugcuaugucacaugagcccugauuaaaaggaggacccauguccuugcuaaucaucaagaaagucauccugcuagcuacuuaaagcccuuuugcuggaaacagcuuuuccacuuaacuugcacugagauguggcagaacaccuuucccuggcauuccuugcaucaagauuucugaaaauaugcuccagggaaccuaguccugaaauauuuucaggaaaaggcuaauacuugagagcagaaacauaugagagagcaagagacuauccaggagagagcaagaaagcaaguguacaaaggccugcaaaugugcauggggugggaggaagggcauuucagucacuuguuugggaacugcuguaggcuuugauuucuugacuauaugauccuuuacuuuccugucaucuguuuguuuguuuuggggaacaugcugggaaacauuggccuuuguaccauucuuccuuuuaauuagaaaugguuaaucccacuuguuccucucuuucuguuuuauuugaacguaacaacugugccugcuaauucauaccuguuacguggucggaguugagcuagucaauuuuaugaacguuugcaaaagauauuugguacuuuuuucugaaaagaauauguuacauuuuuccuguaauuccauacaaauuuuugauagugcacuaaagaaaauccauaugacaagagauuguggaguaauuagaguuuagugugaaggugguaauuugguagucucuacguucccaagaauagugucauuugcacuggaguaacauucauggccagggaugugcagauaauagaucagcugagauggcagugaacucucaaacauguucaagacuccuaagugaauugaaguagaaucuugucuggagaauacugauagagaccaaauccuacucuguggcuuuacugucucuuagaagcauuuacagcuuaguaaguguccuauugaugaccugcgagugauuggggaagcucaugacaagcaucacuguuccucuccaucucaggcucuaaaaucuaaaucuuuauuaggauguguauuauuuggaaggugcuuugggagcuuaaguggaaaauugaaauaauucuaaaguugauaauaugaagggccuuuguugagcacaguaauuugggagaugaguugggaggacauuuuucauaauauauugcccuauugggcaguuggguagcucagcccuuuuuaacucccaucccucgccaguucagcaucucucuguuucaugggaaugauuguuaauaaagaaauuggauccauacuagaaaaugaccauuuccuuuugaauuagccuuuuucuugucuccuuuucguauccuuuuuauggguccuuucugguaugggccuucuuucccaucaacaacuuuucaccugcugacauguuaaaaauugcuugcacagggaaguuacuauaaaaaucaacauagcaaaaagaguuaauugcccaucuaaaucccccaccuaaauuaguauuuuuuuugucacuugguccucugacuuuuauuaauuauuuucuuguuuauucaguucuguucacauuacuugugucaguagaguuuugagaacuauuuugaaaucacuugcaggaaagaagugcuauuugaaccucauucugauucaucaagccucugacaaguaaagcaggaguuuucucuuuugacagugugaugcuugauucuugugagucuuggcaaggauagaucugaacaauugagggaaggacaauuucauuuucugccagugggcagccuuuucaaaugaaauuaaacuugauccucaguuuugaagugauaguugcuuuuuauuaaaauuuuacagagggcagcuguagaagauauaaacccagcagaugacccuaauaaucaaggugaggaugaauuugaagaagccgagcaagugagagaagaaaauuugccagaugaaaaugaagagcaaaaacaaaguaaucaaaagcaagagaauacagaaguggaggaacauuuggugguaagcagaugccacgaggaaggguggauuuaacugggcuauuuuaagaaacaucugguuuauguaaaagguuagucauauuccacauugacggaagguuugccacuucggugguuuuuaggccacuuuaugacaugauaugccuguacucugagagagaggguaacggacauccugggcuuuguauugggaaugauuacucaucauuuccuggccacagacgcuuugaaagugcccuuuucaugguggcaugcuuguucuuugucccagaguacuguguaaaaggcaucucugauguacaguaacaugaaccugcccuuuuguuuccaacagauggcaggaaauccagaccagcaggaggacaauguugaugaacaguaccaggaagaggcagaagaggagguaguaaggauugaaucccagagacugaucagauuggucugucacacacacuaaccuuaaacaaaccucagcaguauugacuuugacaugccuuccacagaaauguucagaaaaauuuaagcaggauaagaaagggugguuuaaagcaaaaauggaucauggcacuggagacauuugguuagaagauaacaaaagcaggguaauagaauccaucucuuugguucucaccugaaauuuugaauuaagaaggcauuuggcuuuccaggaaugguggacuuagauuugugcaaucuuuuguaagaauauuuucuccucucucccucugcacauugagggaaucuggacugccccuguaacuuucucuucaggcaucuccccagugccuaccucacaggaauaccccauagugucuaucggaauccacuuaacacccuccaaacauuuuuguaaauuuuacagucucuccuucuggccucuuccuucuuaagaauucaguaucuuaauuaaauuuaacaauaaaagaggaggaaaaagauguaaagagcucagcugaauaaaaugcauuuggauagaguuucuuaauauuuuaguuugcuuuucauuguaaacuucgggcaucuuguuguuaauuagauauaaguagcguuuauuguggugcugcuuacgguguaguugauuauuguggugcugcaugugguguaauuggugaaugcugcuuguuguagccguuuuaucacagcauuccgcugcauaaacaacugcaauauuuaagagucugauacaaauuaggccaagacccuguauuuagucucauuauggaccaguaaguaguucccaaauuaaaacccugguucagagcugcuucucagccaggugucuugcaaaugugugguuuuaucccuauggggaaccccaugggaggauggacauauggcagacugaacagacacaccccaucacuggagauccugugcagaaaucaugagcugugcucucacacacacaguucccucgacuaggucugcuuucuuguucuuacugauuuuguaagcuuuucagagcugaugauaaaauuugugcuuauaccaggaaaacagaaaaggauguugcucuuuaaggucacuggcaacauuucuaauaacaugcacuuuaacuggcuugaucuuuuuguucuuugguuucucauccuaaucaagacccuuggcugucuugucagaaagagagcagcagagaaaauagugaccuugaauauuaagacauugggcaagaaaaagauauucauccaggcuucucauauaacaggaugucuagacuaauaccacuuuguuuuauuauguccaauacuaggaaucuuugagggauuaaaagagaaaaguucaccuuggcuucuuuuuuaaaaauucagaagauuaaacauaaaauuuuaaccaguguuuacugauuccuuuucaauuuuauauuaugaucaguuaagguacaggagagaaauccugagauccaagaggaaucaagaguagaaagagaagaaagaggcaagaggaaaggagaaauggugcuaagacagaggagguugcccuggcugagugcugccuaaacucagcaacugcuccucaucccaccagucauccccuucagaucugcuggacugacaggacucuuccucuugcugcaccuggccccagguccuaauucgguuuaccugguucccugccaaaaauucuuaaagcaguguucaggccuccuccagcaugugcuccagguuaccaccccaucacugagaacuguugcuccaugugcucuuaguggaagucccacgugccuuuuuuucuucccaguguaaacuuuccucucugcccccgagugucccuuguucauguuguguuguauuuuugugugugguuaugagaugauuaauguuugcaucuucccaccucuguccaucguucccaggucuucccuugagagaggagaagagugguucccaaauaccauuuaagcacuagugauagagacaaaguucuugucagacuauggcaaaaugagaaaaauaaaggggaacauagaauauggaaacacauacugcauuguuuauaagugcauauguguaugaaaccucauugguggaagcacucugaaaaaccaugaaauguuguggaacugugcauuauuguuguuguuguuuuuuuuuuuuuaaucuccauuuaaccuuagagucuugcagcugccccagcuaaccacuagaaugcaaggccuguggcugccaucgcuucccuuccucuccagcgcacaaacuuauuucugucagcauuuccuccuggggaagaauugccucuugccugggccacaccuguucagagguauagcccaucaaacuuacagacuuggccucuaagaggacccaaaagaaguaugauuuuaggaaauuuauacuacucugccuucuuuuaucuuagugcaguaguguuaucuuucuaagacuuacaagcauuucuuguuucuuguuugggauuguuugaauggaaggcaugaucccuuccuuacguugcuuacauuccaaacguuuuaucgccuuguaagcaaacaagacaauuuauggcauugccaaaaagugccguguaagcuuuaaaauuacuuacauguucaaaaauauauagauuaaaugaccaagaaaucagaauacuuuaauuucccucaguguaacugaaaacugauuaaucugaacaugcagaagagaauaaguacaaggcauuuguucaccuucacuggccaaauauguacguacaccuacaugagacuaccagccugugaaucaccgugucaagaagcuuuucuuuuuuuuuuguuuuuuguuuuuuguuuuuugagacagagucugacugucacccaggcuggagugcaaugaggugaucucggcucacugcaaccuccgccuuccggguucaagcaauucuccugccucagccucccgaguagcuggcauuacagacuucugccaccauacccggcuaauuuuuguauuuuuaguagagaugggauuucaccaugcuggccaggcuagucuugaacuccugaccucaggugauccucccaccucugccucccaaagugcugggauuacaggugugagccaccaugccuggccaagaagcuuuucgauuggaagaaacucucuuguuaaagcaggguguucgucacuauagcuaauguugcugaaggccuuuuguucaucacauucuaucuaucucuuuggauccuacuguucuuaccuacuugaggcucagcucucugcccuggcacacccauaauaucuucaauguguaaaagaaagguguuaauagacaccaagagaggauaucuagccaaagcccauuucagacucuucucaguggaccuguuuuauuuuggauuuggccguuuauuaaacuuugugucaucagauaaggcucauuucuaaaaugccuagaacauauuucaguagauaaaaaugaguaacaagaagcauuguuugggaaaucugacaaagcauugugacagcuuuagcagguugcuaagagggccaguugugggagacauaaucuguaugucuacauuauaaaagaauaucauuuggcuucugcuuauuauucuagucauauuuuaaagaucaguuagaaccuccauaucauuuuguuccuuuacauuacugagaagcauuacuuaaaggcauuacugccuuucagaugaguuugcauugcuuuugccccaaauaucaguaauauauuacuagaauaauaauguguauuuaacuaagaguuuguucucuauauguguggaaaauuacaaaauuuucauuuguggguucccuaaagagucguugaaaucaguggucucuaaauaagauuauauugacaacugguaaacaagcuaaauuuucuauagcccaucuccagagacuaaugagauaaccuagcauccauuacucaaggaaauaguucuuugucuuugcugugaauaaggaucaccuugaagaguuuguggcauacacagauuucuggaccagacccuuacccuugagauuuugaucuuaucuguuauggaaccuaggaagcagaguucuucauaagugccccuucacccgcccaccaccagcugauucugacggcucaggaucauacuguuuagagaaauaguccuagggcagacaguuguggauggcaucugggaagucugaaacuccuaucuguguauauaugcccauuugcuaaagacuuucuaaccaaagucuuaaaaggguccaugacuccccaaccacacauacauacaggaaauuaaggaucauugauuuuucacccaaugcuauuauuuuacauacaagaaauuugggcuucagagggauuaguuaaaaauuggaagguugcauagcuuuuauuuauuguuagaaacaugauuagagcucaccuaggucugauuuuaaaggcuaccguaauuaaguguaccaugcacaguaacuauauaguugauguggggaaguucuuuauagaaauuagugaauauagacagaacaauggaaauacaaagugaccauuuuuuuuuguaaccccuaauugaagcaauugaucuaagcaacagucaucaaugaaugauguuacuagaugaacagaggucagggaacuuuaccaugaagggaucaggcugucaccaccugagcucacuggccaaccuuagccuuacuaaaagugggacaaauaaaugugugugccuccugaugugauuuaaaaaauaugugugaaauauacaccaucaccucugaaauacccuuauuuuuaaaaucgaaccugaguucauucaaacuuuuaugcuaacuuccauuuauaggaaauguugagacuagagaaaugaguuaagugauauaaagaagcaaauaaauucagaaugugggucauuuuacaguacugcaaauccauagcaguagggaaaaaaggggagugaaucccauguuauguguucuuuuccuuuaaaucaugauuagaauauaccaacuguaaacaggcauuaggacaaugauaaaaauguaaguauggaugagacaucagaugcuacuauggaauuauuuuaucaggugugauaaucacaguaugauuauauaaguuguuuauuguuuuuagauauauauacugugauacgugaagguaaaauuacauaucuugaauuuuuaagaauaauucacuguaaaaaauagaaaagugauagaugaugcagguguggcaauauugaaauagcuuuugaacauuggagguggcucuaagggguuuauugaaugauuuucuucguuugcaugugcuuaaagauuuucauaacaaaaacaauugaccuuaugauuuauacagucagaaaaguugcagagccaagucuuuaguccaggucuuucugacuccauaguauauguuaggaguuggcaaacuacaggcugcagccugguucauaaguaaaguuuuauuggaacacaaacaugucugcuuguuuacguauugucuauaguuuuuuguuuucuuuuuuuuuuuuugugcuacauagaguggucaaguuguauugugagagaccuuauggcuaagaaagccuaaguauuugcuaucuggcccuucacacaaaaaguuugcugaucucugauuuagauauucuuccugccauacggcauagacucaaggcuguuuuuucccccagucucaacuacaacauuuuaauguuuauaaauaauauauuuucauuauuaaggcuguaaaagacaugucuuuguuaaucaaaauugacagggacacuucagcaauuuaaugacguuucaauuagucagaccuuaagauaggccugaaguaaguacuucauuguuuucaucccaauguccuguggaaugucacuaugagguucuacgacuaugggcagaggagauguuauggaccacugauagaaccauaaggugagacaagauaggucuuuagcucauuccaccaggaaauaugaauacaauagauauucgaugccuuuguccucaaaauguauuuauuuugagguuaguuuagaggcugugggucaaacuggcguuggacugguuagaagagguucacaaugguuuggcucugcccaggguaucuuugaagagucaccuuuguaggcucucgacaggccaaguuuuguccaaagcucuucugugaggcugcaguucauucuugucucaccugggcuguacaccuucaggcagcacguaauuuguuucuucugaauuauagcaucuguauacuuuucuuccguuguucauuucuuagauuuuuccacagucuccuccacuccccccaccaaaauaagugauuuuuguguuauucaaggaucuuauucucugauccuagaaaagaucggacuuucuuugguauuaggagacugcauuauacuuaaccgauguucagcaguuuuuuugaaaugcauucaagugacuuaaacauuuuggcauauguaugguuuucaaaauaguuaacaaguuagaaaaugcccuacccuguauuucugugagauaugaucauuaaauagagacuauuuagcacaaauauuuggaugcuugcuuuaguuuacauuuugagauaaauauugggaucauuuacacaguaauaauagugcacaugaaugaaaacuacuuaaaacagaaagguuguauuagaacacuaaagagagagaggaauuuuugaggcaguucaauagacuauuucauaaagaaauugaaaugauuguauuuuauuuucuagauaucuuagccagagaaauauauucuuaaguauagaauagauacauaaaauuucuacuauauuguauguaggcagcggugucuauccuuugugccuuuacagaggauuuacagaggccacagguuggacaagcuugaucuagauagugacuugaauaagacaggcaguuccugccuccauagaacuuacauugugucacagcucucaaauuucuacaguucucccauauacagaaaugggaauuuuaauuuuauuauuuuauuuuuggggagacagggucuugcugagucaucgaggcuguugugcagugacacaaacauagcuuacugcaacuuugaccuccagagcucaaucgauccucugccucagccucccgaguagcugagacuacaggcgugcaccacuaggcccagcuaauuuuauaaauuuuucuuuuuuguagagacagggucucacuuuguuucccaggacucaaauuccugggcucaagugauccucuugccucagucccacaaagugcugggauuacaggugugagccaccacgccuggccagaauuuuugauuuuacaagcuaaaugucuucagauguuuuauauuuggaauuuuaaccauuauucagauaaaccagaaauucaaacagaaaaguccuacauucaggaucaaucacauugauuuuuguaauagguguauuauacauuucuuuuuuuuauuauuauuauacuuuaaguuuuaggguacaugugcacauugugcagguuaguuacauauguauacaugugccaugcuggugcacugcacccacuaacucgucaucuagcauuagguauauuucccaaugcuaucccucgccccucccuccaccccaccacaguccccagaguguaauauuccccuuccuguguccaugugaucucauuguucaauucccaccuaugagugagaauaugcgguguuugguuuuuuguucuugcgauaguuuacugagaaugauguuuuccaauuucauccaugucccuacaaaggacaugaacucauacuuuuuuauggcugcauaguauuccaugguguauaugugccacauuuucuuaauccagucuaucauuguuggacauuuggguugguuccaagucuuugcuauugugaauaaugccacaauaaacauacaugugcaugugucuuuauagcagcaugauuuauaauccuuuggguauauacccaguaaggggauggcugggucaaaugguauuuccaguucuagaucccugaggaaucgccacacugacuuccacaaugguugaacuaguuuacagucccaccaacaguguaaaagcguuccuauuucuccacauccucuccagcaccuguuguuuccugacuuuuuaaugauugccauucuaacuggugugagaugguaucucauugugguuuugauuugcauuucucugauggccagugaugaugagcauuuuuucauguguuuuuugucugcauaaaugucuucuuuugagaagugucuguucauguccuucgcccacuuuuugaugggguuguuuguuuuuuucuuguaaauuuguuugaguucauuguagauucuggauauuagccauuugucagaugaguagguugugaaaauuuucucccauuuuguagguuuccuguucacucugaugguaguuuguuuugcugugcagaagcucuuuaguuuaauuagaucccauuugucaauuuugucuuuuguugccauugcuuuugguguuuuagacaugaaguccuugcccaugccuauguccugaaugguaaugccuagguuuucuuccaggguuuuuaugguuuuaggucuaacguuuaagucuuuaauccaucuugacuugauuuuuguauaagguguaaggaagugauccaguuucagcuuucuacauauggcuagccaguuuucccagcaccauuuauuaaauagggaauccuuuccccauugcuuguuuuucucagguuugucaaagaucagauaguuguagauaugcgacguuauuucugagggcucuguucuguuccauugaucuauaucucucuuuugguaccaguaccaugcuguuuugguuacuguagccuuguaguauaguuugaagucagguagugugaugccuccggcuuuguucuuuuggcuuaggauugacuuggcgaugcgggcucuuuuuugguuccauaugaacuuuaaaguaguuuuuuccaauucugugaagaaaggcauugguagcuugauggggauggcauugaaucuauaaauuaccuugggcaguauggccauuuucaugauauugauucuuccuacccaugagcauggaauguucuuccauuuguuuguauccucuuuuauuuucuugagcagugguuuguaguucuccuugaagagguccuucacaucccuuguaaguuggauuccuggguauuuuauucucuuugaagcaauugugaaugggaguucacucaugauuuggcucucuguuugucuguugcugguguguaagaaugcuugugauuuuuguacauugauuuuguauccugagacuuugcugaaguugcuuaucagcuuaaggagauuuugggcugagacagugggguuuucuagauauacaaucaugucgucugcaaacagggacaauuugacuuccucuuuuccuaauugaauagccuuuauuuccuucuccugccuaauugcccuggccagaacuuccaacacuauguugaauaggaguggugagagagggcaucccugucuugugccaguuuucagagggaaugcuuccaguuuuugcccauucaguaugauauuggcuguggguuugucauagauagcucuuauuauuuugaaauacgucccaucaauaccuaauuuauugagaguuuuuaguaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuguauucguuuugccaguauuuuauugaggauuuuugcaucaauguucaucaaggauauuggucuaaaauucuuuuuuuuuguugugucucugccuggcuuuguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauugauuauugccacaauuucagcuccuguuauuggucuauucagagauucaacuucuuccugguuuagucuugggagaguguaugugucgaggaauuuauccauuucuucuagauuuucuaguauauuuguguagagguguuuguaguauucucugaugguaguuuguauuucugugggaucgguggugauauccccuuuaucauuuuuuauugcaucuauuagauucuucucucuuuuuuucuuuauuagucuugcuagcggucuaucaauuuuguugauccuuucaaaaaaccagcuccuggauucauuaauuuuuugaaggguuuuuugugucucuuuuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauucagugcuauaaauuucccucuacacacugcuuugaaugcgucccagagauucugguauguugugucuuuguucucguugguuugaaagaacaucuuuauuucugccuucauuucguuauguacccaguagucauucaggagcagguuguucaguuuccauguaguugagcgguuuugagugagauucuuaauccugaguucuaguuugauugcacuguggucugagagaaguuuguuauaauuucuguucuuuuacauuugcugaggagagcuuuacuucccaguauguggucaauuuuggaauaggugugguguggugcugaaaaaaauguauauucuguugauuugggguggagaguucuguagaugucuauuagguucgcuuggugcagagcugaguucaauuccuggguauccuuguugacuuucugucucguugaucugucuaauguugacagugggguguuaaagucucccauuauuaaugcgugggagucuaagucucuuuguaggucacucaggauuugcuuuaugaaucuuggugcuccuguauugggugcauauauauuuaggauaguuagcucuucuuguugaauugaucccuugaccauuauguaauggccuucuuugucucuuuugaucuuuguugguuuaaagucuguuuuaucagagacucggauugcaaccccugccuuuuuuuguuuuccauuugcuugguagaucuuccuccauccuuuuauuuugagccuaugugugucucugcacgugagauggguuuccugaauacagcacacugaugggucuugacucuucauccaauuugccagucugugucuuuuaauuggagcauuuaguccauuuacauuuaaaguuaauauuguuaugugugaauuucauccugucauuaugauguuagcugguuauuuugcucguuaguugaugcaguuucuuccuagucuugauggucuuuacaauuuggcaugauuuugcaguggcugguuccgguuguuccuuuccauguuuagcgcuuccuuuaggagcucuuguagggcaggccugguggugacaaaaucucucagcauuugcuugucuguaaaggauuuuauuucuccuucgcuuaugaagcuuaguuuggcuggauaugaaauucuggguugaaaauuuuugucuuuaagaauguugaauauuggcccccacucucuucuggcuuguagaguuucugccgagagauccgcuguuagucugaugggcuucccuuugaggguaacccgaccuuucucucuggcugcccuuaacauuuuuuccuucauuucaacuuuggugaaucugacaauuaugugucuuggaguuggucuucucgaggaguaucuuuguggcguucucuguauuuccugaaucugaacguuggccugccuugcuagauuggggaaguucuccuggauaauauccugcagaguguuuuccaacuugguuccauucuccccaucacuuucagguacaccauucagacguagauuuggucuuuucacauagucccauauuuguuggaggcuuugcucauuucuuuuuauucuuuuuucucuaaacuucucuucucgcuucauuucauucauuucaucuuccaucgcugauacccuuucuuacaguugauugcaucggcuccugaggcuucugcauucuucauguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucucucagcucgucaaugucauucuccauccagcuuuguucuguugcuggugaggaacuguguuccuuuggaggaggagaggcgcuuugcuuuuuaguuuccaauuuuucuguucuguuuuuuccccaucuuugugguuuuaucugcuuuuggucuuugaugauggugauguacagauggguuuuugguguggauguccuuucuguuuguuaguuuuccuucuaacagacaggacccucagcugcaggucuguuggaauacccugccuugugaggugucagugugcuccugcuggggggugccucccaguuaggcugcucagggguaaggggucagggacccacuugaggaggcagucugcccguucucagaucuccagcugcgugcugggagaaccacugcucucuuccaagcugucagacagggacauuuaagucugcagagguuacugcugucuuuuuguuugucugugcccugcccccagagguggagccuacagaggcaggcaggccuccuugagcuguggugggcuccgcccaguuggagcuuccccacugcuuuguuuaccuaaucaagccugggcaauggcgggcgccccucccccagccuugcugccgccuugcaguuugaucucagacugcugugcuggcaaucagcgagauucugugggcguaggacccuccaagccaggugcgggauauaaucucguggugcgccguuuuuuaaucccgucggaaaagcgcaguauuugggugggagugacgcgauuuuccaggugccguccgucaccccuuucuuugacucggaaagggaacuccccgacccuuugagcuucccaagugagacaaugccucgcccugcuuuggcucgcgcauggugcgcgcacccacugaccugcacccacugucuggcacucccuagugagaggaaccugguaccucagauggaaaugcagaaaucacugucuucugcgucgcucacacugggagcuguagaccggagcuguuccuauucggccaucuuggcuccucccuuauacauuucuucacaccuaguagauaaauccuugacauauuuuuucaauuguauauuuacuuuaauuuugcuucugcuauuuugagugaacuuuuuggaaaucaaaauauauuauugcaagucuuuaaaugauaacagugucaaaauauauuaucgcaagugcuugaaagacaaaaguguuuaaaugauaucugugguuuguuuuagguucaggaagauuugacugaagagaaaaaaagggaacuggagcauaaugcugaagagaccuauggugaaaaugaugaaaauguaugaccgggauacauauuucuauugagcacuugaguguuugugggugugcauguguauaggagagauauauguauuugggauacguaccaguggguaaugguaccucugaguuaccacugaauuuaacaggcccaccugaaauuaggaaaaguugugacaacaugaaaaguaggagagacagcagcacuguugcuuacauaucauuuuucuuccuuuuuuuuccuccaaaaaugaguaauuuuucauccuguuuuuagagagaauuauuuaucacuaacucuauacuaucucuuaguuuuucuuuuuucuuuuaauuuuaagacugaugauaaaaauaaugauggagaagagcaagaaguucgagaugacaaccgccccaaaggccgagaggaacacuacgaggaggaagaagaggaggaagaagacggggcugcaguugcugagaaaucacaucgaagagcugaaauguagcggcacccaauuucuagacaacgcucagccaacggauucuuuucaagcugcucaaacauaaaucugccuacugaacucuaggauauuuaauuacaaaaauuaagaacuuagacuuuuuuaaaacuuuuguauuagaaaugcgcauacauuuauaugaauauauuuugauaacguaggucuagagcuucuuuuauauucaagcuaaacaugaaaaagaagaaaaacaauaaaguaaaccugagcccccacgucccaauuuuuuuaauagauuaugugauguuggaaagcucauugauuuuguauauguuucagcguguuaccuuucuggcuuccaguucccagguguucuuuguuugccuuugauaaaauacaggauuuaagaacagagaguacugcaaaaugccaugcagacuuuaaagagaauggccuguuuacuaauugcugcccuucugaugucuuuauguauagcucugauagaauuuucaccagucuauguaucucuggagugagaucuauguacaaagugacauacaauuggaaauccauuuuuguuguaaagacauuguuuuucagacuuuucagaucaauuagaaaaaugucauugcuuuaaaaucauagcuguucuguuuaagaggaauugaauuuaaaaaugagagaguauuaaaacucauguggcaguauccuggucuuaaucagguauugcaguguucaaacaagguauggacacaucaacauauucaccuuuuggaaggacuagugacuugguuaaaaacuaaugaguguuugcgugugguguuucuaugcgagcacccauucucaauuuuuuuuuuuuuuuuuuguuugaagccauugauugauauucuuguuucagugucugguucccuauaaguaauauauauuuccucuuuaagcucugugccucaauaugcaaucacuuugauaauaaguauaaauaugaagacauaccaaacugcaaauaggauuauuuuucaaaacuauauggugaaacauauggugauaugauagacuuaugguuuuucuguuugcugggauugggucugcuuuuugccuauguguaaggcauuuuaaucauugugaauauaauagauuccuuaaaauaagaaaauuaaaaaucagaaacuucccuuggaguagagacauuucaguugcaagcauaaagauuuuuaaauauauaacacuagguuauauaauucauauaugugugguuuuguauuaauaaucaaauuaauaaaaacauuucauuuucuaccauuguaugaacguaauuuuauuuuuuaauaaccacacucauagaugguuuugauuguuccaguugagugauuguguauguacgcauaggaauguuuuguucaguuguacuuuguauuuccaauaaucagaaaucuuaccuuuauguauaaaaacccauuauguaauguaaaauguauaauauuguacauaauauucagaauacaauuauuuugguaaauuagcuuguauuuuuaaugucccaguugcaguauuuaauuauuugaaccauacugaaaguugguaauagucaauaaagcuaaaaaaaaaaaguggcaaaucuuuuaaacuauguggucucuuauuaguuuaugaccuucuaacauucuucacuucuuuuucauaaaaagaaaaauuuuaagagauaccaauauaaauuaaugaauuauaaagugccuuuucccaccugcuucuguuuucuguaucuuucucuacuuggauuggcaugugauuuucccuucuuuuucuaaagaaagagcuaaagauguuuauuuuauuugagcuagcucugagggaagaaaaaagaaauggggcagaauguaugagagugucaugugcaugcacacacaaaaaauaaaugaaaaacuuuaaauccccuuaggaaagcaacaaucacaaacca

SEQ ID NO: 13648 - RNA, 1722 nt, Homo sapiens
cagcgucuggaaaauccgcuucugcuuucgggagcacaucccguuucccauagucccgccuggacccaaagccgcggccgcccccgccgucuccuccccuugguccgagcgagcgucucagcagcggccgccgcaguagguggccagacgcagcaugaggaggagaugccagacacaaaagccggcccggaggggaaguggcgcccgcucagcccccgcgcggcgcggggcgcgcagccaucgacgccgcccgggcagcugcagccaaacuucugcgaggcucguucuccgcgaaugcccggggccgggaggaggcccuccgcauacuucagagccggcugcccucgcgccuguccccagaugccuccugccuuuuuuccuucuucccacuuuuuggccccgcugcccccgggcaguucuuggagucccgcccuggccacuccccgcccuaucgcggcggcucccacugcacgacuuuguugccaccuaagggagggggugcgcgcccaacaaagggaccaggacuccgggccgcgcccccgugcggccugcccaauggguggaagggugggggccagcugucucggcugguuuuggggacggcacagcggugucacugacgggucggcuggugccucugccgccccgccaccuccugcccaacuuacgugucacccacggcccggcuauucuggccaacgggauuccgggaggaagucccacucggccuccuugcucauugggcccguccgagcagacgcucccucccuucggggaggcagugccgggcucgauuggaugccggcuuuguccguccgaccccagggccgcaccuucccucccagugccggggccggcuaggggcucugugggcagcgcggccgccuggcgccggggugcgcccacguggagucggagagggugggaagaggcaggcggaagggcgaagggcggggagcuuugggugggcgggggacuuguccgggccugagucugggugagguucggugaacacguguguguguguguguguguguguguguguguuccaguucucguucggaacgcacguggagagcggaguaaaauguguguaugaacgaaagaauggauggcaguaacugugugcacucugcugaguacacuuucuuucccuguccaauaaacugaugcggcagacacaugggauagcuacauagcacaaucccgguagucaaaccagagaugccaugucgacugccuuaccccauccaguguacuagccuagaugugugugugcccacagauggcccggcaggagucgggagacuggaagcacgcuagacuuaauguucaauuguccacgugggcuggggaaaucggcuugccauuggcagagaggaaagaaauggucucacauuucuccucuagcugcaaauagaauaauuuaaaaacaaaucguacagacugaaaugaguauccauucauuuugucauauguauuuguuuuauugguggcaaaacacaucaguuacauuucuaaauuacauuuuaaagggcaacaaagguucccuauguaaaaacuaguacagcacaggaaagguaguaaccacaaaccucuucgaagaaauguauacugcauuuauuuuuucuguguacuugaggggaauaauuaagguuaugcacaaaugauaauuuuuguuucugcuguugaccugaauucuaagaaaaguaaauuuuaucu

SEQ ID NO: 13649 - RNA, 1722 nt, Homo sapiens
agauaaaauuuacuuuucuuagaauucaggucaacagcagaaacaaaaauuaucauuugugcauaaccuuaauuauuccccucaaguacacagaaaaaauaaaugcaguauacauuucuucgaagagguuugugguuacuaccuuuccugugcuguacuaguuuuuacauagggaaccuuuguugcccuuuaaaauguaauuuagaaauguaacugauguguuuugccaccaauaaaacaaauacauaugacaaaaugaauggauacucauuucagucuguacgauuuguuuuuaaauuauucuauuugcagcuagaggagaaaugugagaccauuucuuuccucucugccaauggcaagccgauuuccccagcccacguggacaauugaacauuaagucuagcgugcuuccagucucccgacuccugccgggccaucugugggcacacacacaucuaggcuaguacacuggaugggguaaggcagucgacauggcaucucugguuugacuaccgggauugugcuauguagcuaucccaugugucugccgcaucaguuuauuggacagggaaagaaaguguacucagcagagugcacacaguuacugccauccauucuuucguucauacacacauuuuacuccgcucuccacgugcguuccgaacgagaacuggaacacacacacacacacacacacacacacacacguguucaccgaaccucacccagacucaggcccggacaagucccccgcccacccaaagcuccccgcccuucgcccuuccgccugccucuucccacccucuccgacuccacgugggcgcaccccggcgccaggcggccgcgcugcccacagagccccuagccggccccggcacugggagggaaggugcggcccuggggucggacggacaaagccggcauccaaucgagcccggcacugccuccccgaagggagggagcgucugcucggacgggcccaaugagcaaggaggccgagugggacuuccucccggaaucccguuggccagaauagccgggccgugggugacacguaaguugggcaggagguggcggggcggcagaggcaccagccgacccgucagugacaccgcugugccguccccaaaaccagccgagacagcuggcccccacccuuccacccauugggcaggccgcacgggggcgcggcccggaguccuggucccuuuguugggcgcgcacccccucccuuagguggcaacaaagucgugcagugggagccgccgcgauagggcggggaguggccagggcgggacuccaagaacugcccgggggcagcggggccaaaaagugggaagaaggaaaaaaggcaggaggcaucuggggacaggcgcgagggcagccggcucugaaguaugcggagggccuccucccggccccgggcauucgcggagaacgagccucgcagaaguuuggcugcagcugcccgggcggcgucgauggcugcgcgccccgcgccgcgcgggggcugagcgggcgccacuuccccuccgggccggcuuuugugucuggcaucuccuccucaugcugcgucuggccaccuacugcggcggccgcugcugagacgcucgcucggaccaaggggaggagacggcgggggcggccgcggcuuuggguccaggcgggacuaugggaaacgggaugugcucccgaaagcagaagcggauuuuccagacgcug

SEQ ID NO: 13650 - RNA, 139243 nt, Homo sapiens
caccgcggccgccgcccccggcugcgcgcugagccgccggccccccgagcgccacggccggagcugcggcggcggcaucauggccccgacccugcuccagaagcucuucaacaaaaggggcagcagcggcagcuccgcggcggcgucugcccagggcagggcuccuaaggaaggacccgccuuuaggugagggggcgccggggggcaauucuggcgcgggacccgaguuggcuucggugcucgccggggaggggacggguaggggaaagggaagggacuguccaggacggcgcugccuaucgccggcaccuggucccgggcuugucagcguggacgcgccugauccgaguguggcuccggacccuccgugacccuuccucccgcucuuucuccacaacucaggguccuuccccauuucagaguucucuuguguuccuugggguucccgggcgugcgcugugcuuggcuguggcgaccggagauucuccgguuauuggggugaaccccuuccgggcagagccgccugggcaccucugcgggcccagcaaagcugugagcugucauuuugagggcagcuccaaccuauuguguacgugacaguguuuugaaguucugaaggagcaacagucacgaaaaaggcaucuuucuucuuucuugccauauaugacaagcucucaaacggaugaaugaaaguauguaauuuccacaucauguggaagguugaugccgcaugauguguggaaagggggaguaagaugcaauuaugaaauuuccgagauuucaauugaucaaagcugauauguauauuuaauagauuugaucucucgaacacauaccuuugaauauugauagcauuuauggagagcuuacuaccuaaaaugcuuuauguugauuucugucguuuacuuuucugacaaugcggugaggugggugcuauuauaauucccauuuuacaggugaggaaacuuaaagucacagauaacuuaggcggcuugcccaaaauccagcugucagugguagagccuguguuuugacccaagcaguuugaccacagauuccagucuuuaaaaucccuaugcuauucugauuucaagggcuaacuuuuaaaagacgccuuaaaauguccuauauugccuuugagcacagguauguugagaaguuuauuuaacaauuuuucaacacauuuuaaaauugagcaccaacucccaauucugacacuaugcuaggugcuuuuuggccaaaaugucuugcaaaaacaguucacuguuaaacagaucuagacccaguauaauaaaccuuuaaaaguuucaagugaaacuuugaaauaaauucuggauuaaguuuuauguucuagauuuugcuuuucuugaauuccaucauuuaaaacagucucucacuguggucaugugaaaauuaaacgugugugugugugugcacgcgcgcucauggaaggcauauugugaggaccuuaaacuccccaaguuaaauucucauguuuucuuuaggcuaacaagccuuauaauuugagugggaauucuaugccuuuuguuaggcugaguauuagugaugccauguaccuucucagaaugguagaauuacuucggaccuaagguguguaauuucgucccuucccucccuguaacccagacuccaucagggguacaaagccuggagcggaaggagcauguuacaggugucuguacuuugacagcucuugccaaggacauuuaaagccauuugaaugcaggaggagauaguggcgguuacuugucauuguuuucugugcuccuugccuaauugccuaccaccauuuccgcuauccacaaguuuaacugaguguauuugaacaaaaaaaauauggcuauauuuaggguuuugggccauauuagggaaauugauucccacuucaugggaacauuuucaguaguguucugacuucucauuuguguauaaugaagaacagaaaaucgugccaaguacggucuuuuuuuugaccucauugggauuuucuacaagaauuugagaucgauguuuuuggagaauuuggggaucccaguugaacauccuacuugaugagggcccccuucaauagugucccugauagaggucaccauggaaaagaaaguaaaguagcagaugugagcaaggaugcuggacgaugggaacaaaccauccugugcucaccagacugacaaaggagaccccaagcaagucuuuccuuuugcucuuuucaccuggcuuaauucuaagaugcuguguagcuggccugggaaaagcuuccaggaaaauuuuucucucuaccuaaaaaauugugaaccuguguuucauuuuacccagauuuugccaaauaggaguugguauguacuuugaggggaacaaggugccuuauugcagggcauuagcugcccuugggaacuaccuuguaguuaaauagaguuuuagaagugaagcuaaaacccuuagauuaaaaaucgaguauuccuaacaugaauuuguauucuuuagugcauuuaaguacaggauguaacuuguuuaucuggagauugaaaauucacugaggauucagguagacuuuuggggcaguuuuguaguguauaugggggagaaucuaagauccaacuuuuuguuuguuuguuuuagaguuuguauaucuucuguuuccaugauggacuuucacugguuauuuuaaacuucucuucucagaauuguuuugcccuuguuguuagucuuuuuacucuugugcacuuccuagucccuucgcugggcuuaugacuguucucauuccuccaguuuuuacacacuugauuagagaggaaaucuguuguccaauauaacuaguuuaucucacaggucauuuucaggacuucauguuuccuggcauuucaucuaaaaacaggaucaucauagucaagauuucuucuggaguauuuccuuuaggaucuugacagaaagcccuuuucauagcuuugaggaaacagguugcuaggaaaacaaaaggaaucacgauugaccaaacuuacauguuugggagaaguagucaggaaugcuauaugauuauggcauuuacauuugaauaaugcuucguaccagaaaaauaaauuaggacaaaaaaaaugauguguacagugacucaagucagaaauagaauuauguucuugguuaccuuggauuuaaggccaggauguuuucaagccacgcuauguccagugacuuacaugugugguucacguuugaagcauuaucuuaagguuguucuuguuguuguuguuuuuuucuccaugucuuuuguaaauuaauggagcaguuucaaaccccuaaaauguguauuuagcagggaggugaaaagaccuugggcuaccagauguucuuuuauuuuggagcaguuaaaugaaguagggaagcauauauauuaucugggauaugaagaacaagugaaggcauugcagcugcuuguuagcuagcugugugaaugccagagaagaguauaccuaaggccaaauggccuaguaagugcugauccccacuguuuuguuagaacaaauuuaaucuguuauagaguuaguauaaguauaauuuaauccacuuaucacauagcaucugaugccucugugcuuguggcuuggcgcucuaccuguauaaauccaggcaggacacccacggucucaccuacuggaguuuacaaucuaaaggacaacagauuauacacuaagaugaauaaagagcagacaacacauuggaaacuauaacaaacagauaaacacugauaaagaguagauuuuuauauaagcacagaauuaagaacuuacuugcuguucuugugcuuggagugacuaagggccggauugugauuuacucuucccucacauggagggaaauuacacagaagugcuuccuccgcucccacuaauaagucuccagaugcaaguauuucuaaugagauuuguucugagguaggguggauaauauuuuggaaaaaaacaguuuuguucuaguacacucaacauuuuuaaugccaauaauauaaaacaugacauauaaauagcaguuuugauuucuuuugacuacuuucuaaaagaaagucuuucuguagauuuuucuugcuugcugccuuggaucuauuggcacacuccuuacaucauaucuccuuguccugaaagauacuaugcacugguuagugauuuuuucagaggugaagaagggaacccuuccuuugaaugcagugaguucuauuaagagcacuuggaacacagauugaggaagccauugauuuagcccugccucauguaccauguugaugggagacccaacaagacuccauuucucugauccucagcuuugucauuuguaaagugacagcaucagaccuauguaacaaaguugugguaaggaaguaaugagcuugaaaaucuuuugaaaagaauaacaugcaauacaaacugauuuuaaguauuacuaagcaucuuuuuuuaggucauggaguucaguauuauuccuguugaggcuuuacgaaaauggaaccauuuuucagaggcuguuuucuuucuguagaugagaguugagacagugcugaauugaacuguuuucacuugcauauuaguuuuuuaaccuugauguagucauucaugaaacagagaccuuaaguuuucagaggggucuuaaagauguucagcggacacucacucaaaccugguagaggugacggggugucagaaagauucuuagaaauaugguguguuuguuuuuucaaaguuauuugcaaguuuuuauuauuaagaauaaaauugcauuuagccaaaaaaggaaauugguuaagcaaaaugauauagucacacaauggaugacauucuauagcauccaaaucauaauuuuauacacagacacacaaaacaaaagaaaaauguucucaauagaagaaguaaaagcaacucuaauagccugacuucaccacugugcaaucuaugcauguaacaaaauuacacuuauaccccauaaauuuauauaaauuuuaaaaaguaaaagcaaguuauaaauuuaugugaaaaacauuuaaaaauaggagcgauuaugcaugugcagaauaggccagcaacacucuacaccaacauauuauaacagugguugccaagagguaggugaaaauuuuauuuuaauuuuuuguguuuuauucuuguugguauuuuuggauuuugcucuaaugaauuuguguuacuuuugugauuuggauuauuuuaaaccuaaauauucuagauuauuuaacuauuagauuauuuaacuauuuaagauaacuuaaauagcauuuagcauauucuacacugugagggaauagaguaaggauaauguuuauggagaaaucugauuugaauaaauuucauagaaucuuucuucuucaucaaaauaacuguuagcuccuauuauuaaaaguaauauguuuguuaugagguuuaauguauuuaaaaucuaaacucauuauaaaccucagaggcuaaguuaauuggcagugucaauaaugauaggagauauguaugugcaaaauguuuacuaguuugacagggucgcuacuucaccugagcuucagagcccaguguagucuuccugggggcucagaguacaguuaggagcugcaugcagcucaagcuuuauuugaaauauguuuagaaaagacugacacagcccuuuggauuuugagggaauguggauaagaggccuggauuagauguuuuaaaagcuaaaacauguaguuauaauuuuaaguccugaaauuugaauuuguuguauuaugcauuauuauuugauuuaguaggugguacuaagagauggacggaggcauguggucuuuuaaugcauggaguauauagcuccaaaaagagcauugguuuuuguuguugcuuuagguuguguuucucgugguuugccuguaaggucagccuaaggaagcuacuuugccguuguguuuccuuggaaaaggaagcuguaaaagauuguccuugccgucaugaaauacuuuggcugccagcaugaacuccuggugugugaaucugauuugggaacugguaaugugcuuuauuucuccagccacuguuuuucuuggugugggugaaaaggaacaaauguuuuguacugauuguacaagccccuugcuuagugugaauuguuaggccuggacuaugagaucauauacuuggcuguaaaaguaagucuuuccuuuggauguaagagugcugaaauauuuggugaguuccuacuuaccaagcauucuuuaucucagauuuaugaaaaaugauuauuauguaaaaaaaggaaaaacaggauggacuuuuccagcuaacugggcauguaacagugauuucccucaaccccaccccaucuguaaauggaacauccaugacucacuacucauggccacacagacacuuuuguaaccagugcuugaaugggagggugggauggggauggaaggagaugggcuggcaccccacuuguguucagccagaaucuguccagcugccuuuauaauggacuucugaaaaggacaaugugccuucucaugcaucaugcuacauauuuuuuuuuccuuauugcacuuucuguuugugccagaauaauacaauauauuaagugcaauaaaauguagccauuaauacuauaauguuguggauaaauguuguauagcagaguacucuuucuguuauauaagauuuuaguauuagcaugaguuuggauccccgauuaucauauuucugucuccugaacugugugccuucauuucuaggaauuauuuuucuaguuauuugucccuguaaacuuguuuaauuuguagauuauacuuuagaauuuguguccaucauagugcuauaagagauuuauauauugguuuaugaagaugauuuuauuaccacaccuaagacuuuuuaaucauaaauaagagauuucuguauuugauauauaucuuuaaauaaaugauugguguuugguuaugugcugaugucuaauugaaaaugacaaccaauucaugcagggugucuaagugagaaugaacacugaggcaguaggaauucaucccaaaagcugaggggggcuaauuaagaaccuacauaucugguggggaccucagccugauucccaguaaggauaguugcauguugucauagcaacucuuucuucacaaguugaagacaaguuagacguuaaccugcacauuccucaagagaugaaacagguguugauuuaggauguguuaggaagcagcagcaaauucaccaguucaauugauucuggcuuuaacaccuuauaaauacuucagacugccaacucucucucugauaugccuggaaaauuggacauuuuuugucuuauagucaaaaccuuugggguuauggggggaaaaguauguuaucauucauuucuucauuagcuauccucauuuacucaaguucuuuuauaaaauaugauuuaaagauaguuacaaaaauaccuuuuaaauucaaugccacaaagucuuuuaaagcauacauuugaaauaacuguaaaugaaacaagaaaacguacaugugauaguuacagcauggcugugagaguucgucuaaauccuagccuugccauugugucucugcuuuuaaugcagugcuuggcaggaaguuggcguuuaauaaauaccuguugaaugaaugaaugaauucaagaguuuugaacacugaugauccuuaaagagucucuaguauuccagaaucugaucucuugaaauauuucuugauguuucuagcaugcguugugacauuuuagaaaaugaaucuuguuacagacaacucaaagaaauuuccuccuuuuugucaauauuagugaauuauuuuccugguaucaaaaugauaggguaaaagugcucuaacaguugauugaccugcacccccaccucccuaaaaaaaccuuuaagaagacacuugccuaaguaauauaucagagauccaguuaugaaaucccacagcugucagaaaugaccuacugaaaaaugauuuaaauauuuaugaagcuaugaaauuguuagcuguggguugaugauguagaacucuucucuauauacuuuucagauucauuugaauucuuguauggcuugguaaaacugaaauacauuauggaaugaaaugagcaaauugguucucucaaauuuaagauaauaguacacuuaauugugaaaacaauauugauauucugaacccugcgaagacuauauuugcauguuaaaugaaguaagcacuuuagaaaaaagauggaaucaucucugcuuuccauguaugauuuuuccauuugagaaacuaauuuagaaauggauuugcgaaucugacauguucuuuaaaaagaaugugccagacuaacauaucauuaaugguggccuacccugugugaggaggugagccaugaguaaacauuuucuccaagcauaucaggcaaugacuguuugcuuuagaaugguacauugaguaaguuaguugcuagggcagaagggggcggccggaacuacuggcccugcccuacccagagggcagagauggaccccugguagccacuuggugcugagugcacaggcuccacggaagaccauguggacgcugguaacuggcccugcagugggguugccauauauugcuuagugccauguguaccugagaaauugcuuauacaugaaauuaugauuuuauuuuaagauuuuuucaaacauaucugguuaaaaguucauauaaaauauguugaaauguaagccuuuucacaccccaaucccccuucccaaaggcuaccauugcuguaccaguuucuuucguauccuuuuggaaauacucuaugcaaauacaggaaaaaaaauucuuucccucagacagagugguaguugcugccuacacuguucaucauuuugcuaaaaguugcuuuguauuccuuugaauaaauucauguauaacacuuaacccaguaguucucaagucuggucagacacuaaagucaccuagagagcuuuaaauguccagacugcuucucagagaucuugauuuaauagaucugggcuggggcuuuauguuugucuucaugaaacucuccuuggguaauuugcauaugcagccaagcacacuacaauagucuucccuuaucugagguuucacuuucugcugucaaccucagucugacaauauuaaaucaaaaauucaagaaauggagcaacucugggugcacugccugugaguuagcucugcucugcaaggagcaguaccauuuaaaaaagaagaaagaagauuccagaaauaaacaauuccuaaguuuugaauugcacaccauucugaguagcacaauggaaucuccacugucacuucaucuuaucauauaggcauuugucaucucacaucaucucaaggagaaggagggugacuauaguaugaugagauauuuccugagaaagagaucacguucgcauaacuaugauuauaguauauuauaauuguucuauuuuuauuauuaguuauuguuguuaaucucuuacugugccuaauuuauaaauuaaacuuuaucauagguauguaugggaaaaaacauaguauauacaggguuuggcauuaagcacuguuucaggcauccacuggaagucuugaaagguaucgccuguggauaagagggcacuacuguaauuuuaccaguccucuacugauggaguauuuacuuucaggcuuuauuguuagaaauggugaacuuccugguugaaagauucuuaugccauaagcucaaguauauuuccaggaugagaacccagguuggaauuucugccaaaccgcacuccagagagguugcaccuguuuauacgccuacuaacagcauaugauagcggcuguuuaguggagaugauuuaaaguacccugaagaaauagcagugguagggugguggggaaacuuggacccuagcucauucuuaguaguuguugaucacuugucuaguucaacaugugugcagauuguuaaacucuuuuacagcucaauuuggcugugcuuuccagacuuaaaaaugcucauacuuuuuugacucaguaacuuaagagaaaaaacuuuugugcaugaaaauguuuaaaaaaacaaauguuugugcacaaagauguucuuuauauauuaucauuauaauguuaaauaaaaggaucuuaacaauuguccagcagcagggaaguaucuaaauuguuaugucagcuuuguaggauaguaauauaauaguuaaaugauuaugaagacaguguuaauauaaaauguuuauguuaaaugaaaacaaccagcaacaguugguaucuacaagaugaauauauuaguaaaauaugcaaauguaugaccaagaacuagaaagaaaaacagaaaaauaauaaagaacaguugacauuauggggugaugagauuguggguaaauauccuuuguuggucgugguuuuuuuuuuuuuuuuugagauagagucucacucugucacccaggcuggaagcagugguacaaucacaguucacuguagccucaaccucccgggcuuaagugacccucccaccucagccucccaaguagcuaggaccacagacaggcaugcaccaccauacccaccuuuuuuuuuuuuuuuuguagagacgggagcggggguggucucacuguguugcccagcguagucuugaacuccagggcucaagugauucccccacccugagccucccaaagugcugggauuacaagcauaagccaccuugccugaccauaaauauccuauaaaaugugugggcaaaaaauaaaaauuagaggccaggcacgguggcucauguuuguaaucccaguacuuugggagacugagguggaaggaucucuugaguccaggaguuugagaccagccugucaacaaaaggagaccccaucucuacaaaauaaaaaauaaaaaaaaaacuagcuaggcacaugccugugguuauagcuacuugugggucugaggugguggaaucgcuugaacccaagagguugaggcuuuagugagccaugaucgcaccacuguacucuagccugggugacagagggagacccugucucagaaaaaaaaaaaggaaaacuauaaaauucuauuauaauacaaauagccacuuauuuaugauuauaaagauguuguaaaccuuguuaauuagugaagacauaauuguagaauauguacauaaaugacuucccugaaaucuuuuagaaaucuuuuagaaugcuuuuagaauagcuauuucucaagaauuuuaagggagcccauucuaacauuuaaaaaauaauaguauucuuuaccauuugcuagccccuauaccaagagcuuuuuacuuaaaucauuucacgcaugucucauaguuauccuuugaugauagauauuuuuauuagccaauuuauagauuauaaauuuaccauaauuuauggaugaacacuugaggcuugccugaaauugagugguuuacuagugacccugggaauucaaacugaagucagucagcucuuauuaauauaugaucuguauucucucucugcagaugaauauuugaaguacuuaagacugagauucagugguagauuuugugagguuuauaagaaaguaugaaguguagcugagugcgguggcucacgccuauaaucccagcacucugggaggcugaggcaggcagaucauuugaggucaggaguucaagaacagccugaccaacauggugaaacccugucucuacuaaaaacacaaaaaaauuagccgggugugguggcgugcaccuguagucccagcuacucaggaggcugaggcaggagaaucgcucgaaccccagaggcggagguugcagugagcugagaucgcgccaccgcacuccagucucagcaacagagggagaguccuucucaaaaaaaaaaaaaaaagaaaaaagaaaguaugaagucuaaguacuauuucuagggagcuuacuguuaauugugcaauuauauaugaugugugaaaaacuaauuaauaauacaaaacaguaguucaggaccaagucucuaaaguccuauuaagaugaaaggaaggagugagggagggcucuuuaaucugggcuaguuagggaggcuuuauggaggagauaagagcuaauagguagaauucauagaggugaaaaacuuuuuaccuuagagguguuccugaguuaaaaauggguggaccggucucugugaaaucagaguguucuugugaggcaagauacauuuggaccgaauugugcaaguuguugcaagcauuauuaauuuuaaauuuuaaauuuagguaaccccaaaguguagauggggagggaccccagucuauacuuugagucuuauuagaguagggccuuuguuacagauuuacauuuuuuguuuguuuuuguuuugagacagagucucacucugucgcccaggcuggagugcaguggcgcgaucuuggcucacagcaacccccgccucccagguucaggugauucuccugcuucagccuccugaguagcugggacuacaggcgcaugccaccaugcuuggcuaauuuuuguauuuuuuugguagagacgggguuucagcauguuggccaggcuggucucgaacuccuggcuucaagugauccgccugucuuggccuccgcaaggugcugggauuacaggcgggagccacugggcccagccuggauuuacauuuuugaauucaaaccugacucucccacuuacaauguggggcacauuauucucucuaaaugaguuuuuuuuucuuuuuuuuaaucuguaaaacagguguaaaguugccuuucuugcaaguuugucugaagacuagagauaauaccuaucaauccuacuacacaguguuugacaacuauuagacauucaauauguagugacucuuauaacucucagagacuuaaauauuaugucuuucccuccagcucuuucccuguauuaaaugcaucucuacugaucucaagguuguagggaaauggcaaguagcuugucuuuaccaaaagguggaguuccugcucugaaggcaauguggagccacugagguuuuaaguaguggauugguggagcagcuugcuaaacacagggacccuaacuuaaauuuuggugcugggaugcaaguuagugcaguuuuaguguauaugauauaugauaucagcaaguaaaacauacguguauuccccagucuucccuuucuuuccccuaucccagaccucucuuaucuucaaagggaaaaaacaaaacucuuacaagcugacagcuucaugcucccagccuuuaagcuuucccuccagccuauggcaaaaucuguacuugguaaaccuaccagauacauaacuaucucuuuuuguaucuuuuaauaucaggagcuuccuuuuuguuuuuuuuuuuuccucaaauuaguuucuugacaguucucuugccucuuuugauucauuucacaaacauuuaugaggagucaguuauggcagcuaauccuaaaauuccagacuuauugcgaggaaaggaguuuguguuugaaggcucuuacuaauucaguucucacgauuguuguauuuuuacaaacagaaaagggagaggguuggaaaaagggagggagagggagagacauuuguaucagaaacuggggguggggaagcucccaauuguccaguaaucuuaucuacagagugcuaaauacugccuguaauuguauguagggggugggugcuaguuuagauaaugugccaagggaagcgcacaaccucugcuugcuccaacuaaagcuguuaaaaagcagucuaguuccaguaggugcaaauccacacuuuaauuuguucaucauuuugucuucauucuucaaauccaguuuguauuggacuuugaucuuauagcugauuacugugccaugcugcucuuuaguuuacuccagcagaguauugaguuuuacagcuuggacuguuaaagucaauauuguguuuaacacagcaguagcagagugaguugucuugagcuugccgugaccugcuagcaugcuaagcuagcaugcuuaaugcuauuuaagaggagaguuccuuucagaauuaugucaagauuagcaauugauggugagaauuguugugguccaaucaccagaccacaguagguaacuucccuggggugaaagcauugccauaguguuuuagaccugugcucugcucuccauuuauuuuagaaaccauucuguacaaggcacagggccuccaacucaucauuuucccugcagagguuuaccucagagauguuuuuaguuggagaggggcaaguuaccuucaaggagaaaauaauugggucucucuucuuuaauucaaauuccaaaguauuguaaaucucauuuauuaccugucuguucugaagacuccacuuuucuuuucaucuuagaaauauuuggcauguggaucuagaccaacucugccugaagcacugaggcaagcaggcuugaucuuuuuuucuuuuuugcuuggccuucucaggaguccguucaccaucagauuagugaaauuucacacaaauuagugaauuaguguggccuugucagggcaggggacgaggacauuugaacugcauugcucuaggcucuagguggccuaaaguccucacagcuggaauucuccaucugguuccauccaguuccagagccuggaccaguucagcuuccuagacugagguuugcaucaaaacuuacaaguaaugaaggguuuauuaugucuaccauugcuuucucuuucuuggggaccuaaccgguauggauggaggaauguacaugagucacauuucagaggaaagcuggacaggauguggaagugauggggagauacuuguaaacaaaaagaauagacaaaaucaugauauauaaaguaacuuccaaguuuugagcccgaauaauguggguagcauaauuaguggaaauagggaaguuacaaggagaaguugguuuuguacauguugaauuuaagguguaguugaacacucuaaguugugauauucaugaagcuguaguugucagaagauauuaagccaauauuugccaaagagcccagaaaauucaucucuugcucuuuaagacuuuucuuuuucuauuccguccuccaaaauuacuucuguagaaauucuguuccuucuuccaaacucgguuuagaugccaccucugauuaucuuugcugauugccccaaaugggcaugcugcucccuuuaaaccagugguccccaaccuuuuuggcaugaggcaacaguuucauggcagacaauuuuuccacagacaguggagugggggaugguuuugggaugauucaagcacauuacauuuauuguguacuuuauuucuauuauuauaacauuguaauaaauaaugaaauaacuauacaacucaccaaaugcauaaucagugggagcccugagccuguuuuucugcaacuggaaggucccaucugggguugaugggagauagugacagaucaucagacauuagauucucauaaggagugugcagccuagcucccucgcgugcgcaguucauaauaggguucgcacuacuaugagaauccaaugccaccacugaucugacaagguggagcucaggcaguaaugcucacucgcccaccacucaucuccugcuuuguggcccgguuccuaacaggccauggucugguaccaguccgugacccagggguuggggaucccugcucuaauucuucuuauauggcaguuaccacauucuacuagcuguuuuuuauuuauccaaauacuuuaccagauuauaccuugacagcaacauuguauguaugucccuguaguguauagcauaauacuaaguacaguacguuaguaggagcuuguuuaaauacguuuauuugaaccugcauuguuuucagcaacuaccaguacuuaaaaauaugugaauuuauuagccaguauauaaaguuccucuuuuuuuuuuuuuuuuugagccagagucucacucuguugccaggcuggagugcaguggcacgaucucaguucauugcaaccucaccuccuggguucaagagauucuccugccucagccucccgaguagaugggacuacaagcacgugccaccaugcccagcuaauuuuuguauuuuuuaguagagacgggguuucaucuuguuggccaggauggucgcgaucucuugaccuugaguuccgcccaccuuagccucccaaggugcugggauuacaggcaugagccaccgcgccuggccccucucuuuuuuaaaacauaaauuugucuccaaauuugaaguuuuaagaacaucuccauuauuucagaauuuaauaaauguguuuauccuacccaugauucguucuuucuuuaauuuuaaauuuaauaagagaugaggucuugcuauauugaccaggcuggucuugaacuccugugcucaagcaguccucccaucuuggccucucaaagugguagaauuacaggcgugaggucccgcgcccagcccuacccaugcuucuuaacuguauuuacuccauuuuuuucuuuccaguuacaggguucuuucuuuuuucuuuuucuuucuuucuuuuuuuuuuuuaacuucagagauucuccucuauagauuguuuaauuuucuauaccaguuccaguuuagaguuuugaaauucacugccaagaaauguaugggguauuuuauuaaaaauacacuguuuuacauaugaaggcaaaguaauuuucauuuuguuucugaggucauaucugauuuacucagcauuuuguuggcuccucccagcugacgucucucuuuaguaaauuauuucuguggaacaaaacuuagaguuuagggucugucauaagaauaguuugaagaucuuuuuugccuaaaccaaucugaccuuugccuggacugaaacucauuugccaucugucucuuccuagaaccuugaaagaucuuacuguuuauucucuuuacuugggacuuaccuggugaaaaacuauuagugccaucaucuacagggauggcccuaucuaugaccagucucguccggauuaauuaugaaaauguuaaguucagucuucacacucauugcugaaaagaccacucuguuuauauuucuccuuccagagaaaugcuuaucuguccuuuuguuuucuggaccugauccaguucuguguccaagauaaauauucuacuggcuucaugcuguuuuaucuucauaaaaacaagucaccaaauaccuguguacuaaugcaguucauauaguaaaaacguuaauugcacaggagauucagaugaauaaaagaacacuuauuuuggugucucauggccagaguuaaaaaaagaaaacuagauuuacuagugcacaggucauaugcuauuacagcuucaaggagcugccagaagcucauuccuuccguuugcauuuuugugaaugucaguucugaaauaaaugaacaaacccaggacuugaaaauaauuauuucaacuauaaauugugccuguccucauaugguaaugagaguucacagugguuuuuauuuuuaaaaaaaacagcucgguuugggaaaaggugccugcagucagccuuugcaaacuucuuuauucugugagauuuuuguucccuguuuucuaaagacaauagugacaaauuaaccagagucaaaggcauugcaauuuuuauguaggguuucuuuguccuuaugaauuuuuugugauucucucuucaugaugcuauauuuuuaacuugccacuuuaacugacuaggaugaaguaauuucuuagcagggguggggauaggaaacaguagugggagagauuaucuucagagucuguauugcuuuugggggucucagcuuuuuuuuuuuaaucucuaagucugugacuuuuugaauuuuacaguugggacagaaggauccaugacuucagguagcugauccaucucccaaagucuaggaggggaggaacuuggauuuagcuguuguugagaaaguucagaguauuuucagcccccaugagugcaguuaaccagagaucuuuuuaauggaaucauuucuuuuccuuggcaaauacaaagauuuguuuagccaaugaaauguaguggggauuucaaagcagaaaugagcuaugcauuuuggaggcuuaggauacugaaguugggaauuacauguuguacaaaccaguuuuucccauaguuuucuuuucuaaaaauuguggugggagagaggugcauacugguuaaacgugcugcucugcgccaacgacugguauuucaaaguauaaaugauaaaaggaacuuaacuguaaacuugauauuuacaugaguuuuauuucccaaagcaguuauauuuauuuuauagaauaggaaaaggcucacucaccagggcuacagagcuaguuacccauauggauaggccaagaugggggacgcagaccuuuugauuccugcaucacaccucagccaauuuuuaguccuaugaguauggcaaguucccuuguuguguaguuaaaaaacuguuaugaauuuauagcuaaaauacauuuuuaugauucuuaauuaucucacaacuauauucucuugcauguuguuggacuuuuuuguuauuuucauuagacuuuugcuucuuucuggcauugagggacugagacguaaauuauguaacucugaaaaucaaguccagccucuuucguguggcggcccugccucauuucucuuugcucuuccccucauacucuuaaguccagucaaagcgaauuugucucaguuccucaaagaaucuugaguuuuuucuuuaugaagauuucuuuguuuggaacuuggcuccuccuuuccuccuuuaaccugacucacacuccuaacuaguguggugauuaagagcgggagugggcuuggaauuggacuucagguuucgaacccugacacuaucacuuaauagcuguauggucucgaacaaguugcuuaaccaugccgugcuaugcugccuuuuucucuuugguauguugggaauaauaguaaccaccucaugguggugguaugagauuuaagugggugguucuugcaguuacgaccgugcugggcgcguaguaaguacucugauuccuggaagccuuugccgauaaucugcucuuucacagacucauugcacugagcacucugucccccuggaguauaauugccugugcaugacuuacuacuccccucugaggacagggaugaccaugccgaaucuguauucacuuugcaauauaagcacuuggcauguauaggcacaagacaaaugucugaauaaaucaauaagcaaaggcccgcuuagcucaugcuauaaucuuauguguuuaaccuccacuuuucuuucuuuuugugaugaucuuuuugccuuuuauuugggguuuuugaugggugauuuuaggagaagggagcuaauagggaaguuuaaccuagguugcuuuauggcagcuucuggaguuguaacacaugauugcuucauguuguuuauccccuuugggagaagaagccguacauauggacaggccucuugaaaaguugcuguauucuuuaagaaaaaguagguuccacauagaaaaggcuagacucacaaggaacuugcagguuaacauugaccacaagucuggauuuaaucuaauaacugcuguagccuccugcuccccagcucucuaaaggcacacucacaggauuuccuggcacuuuguuuuguuggucaucaguugugcuguggccauaauguagcaguggaagccacuugacuccuuaccuuccaugcuucaucuuuaggcaagaguaaaaacuaaaagcaauguaaaaggaaaagcuuaugcgagagcaggauaguuucugacuaaaaguaaugagaguccauuuuuuccaacuccaggggcugugaccugguuagguccuggcagugguggauguguucuaggugaaauaaugccuuaccuaaaggaaaaggggagaaggaguuugcugugcugcugugauuauuuuguuuaaagucauuaaagguuuggaggguaguacaagagugauacuagcgaauaagugcuguagaauccaucagauuuucaaggggcaguagugaaacacaaagaucaccugaucccaagcuacuuucacagcugagcucuucuauccuucacccuccaaccucagagccucuaaaagcaguguguguguguguguaugugugugugugugugagaaaucacaggcuuuuaccauucagaacgcauuuuuucauaccuaagauacuauguuaugaaggacaguucauuuauuuauuagaauaauggcuguaaguuaaccugguuuuuauaggauggccagguacucugacugcccuuuauaaugauguuucugaugugugcucugagcucuaaaaguaaacuuacaaaugaauuuauaggauccucaauaguaaauguucauucaaaagcaucuguugacauuuuccauauucuagguacaaagcauuguuagaguacaagaaugaauaagauaacacccugcccuugaggaguucgguucauggagguuugcucccuauucuucuguuauaacgugcaacaggagcuaacaguacagaugaaguauuccuaauccaaaaaucugaaaugcuucaaaaucggaguaguuucugaguaaacgcaaugagaguccauuuuuuccaacuccaaggguugugguagccuggcagugguggauguguucuaggcgaaauaaugccuuacccaagggaaaaggggaggagggguuugcuguacugcugugauucucuuguuuaaagccauuaaagguuuggaguaguacaagagugauacuagggaauaacuuuugagcauugacaugacacgucaagcgggaaauuccacaccugaccuuaugggucacggucccaacacaaucaaaacugcuacauaugcaaaauuauuaaaaauauuauauacaauuacuuuccggcuauguauauauaaaguguauaugaaagaaacauaagugaauuuuauguugagaccuggguccuauccccaagauaucucauaauguguauacaaauauuccaaaaucugaaaaaacgccaaauccgaaacacuucugaucccucgagggauuuggaguuuuuucagauuuuggaauauuuguaaauacauuaauggauccuauacuaaacuauaggauccuguuaauauccuauuaauaaauccuggccauucuauaaaaaccagguuaacuuauagccauuauucuuaauaaauauuuugguucagauaagggauacucaaccuguauaccaaaaaauaggcacaaggagaccuuacagaagugcucaguaggcugggcaugguggcucacgucuguaaucccagcauuuugggaggugaggcaggaggaucacuugaggccaggaguuugggaccagccacguaaugagauuccaucgcuccaaaaaauuuugaaaaucaguugggcauggugaugcaugccuguaauucuagcuacuaaggaggcugaggugggaggaccacuugaucccaggaguuccaagcugcagugaucugugauugcaccacugcacuccagccugggugacauagugagaccuugucucuaaaauaaaauguaaaauaaaauaaaauaauaaaagugaucaguaaagguuagaugacuuaagugucuaagcuuaguaguauauaccuuuaauuuucacuuuuuuuuuucacuuagcacuuucuuggauuuguaucuucuuauuuggagaguuagaugcuaaauacacauuuuaaaguuguuuuuauauuugugcucauaauuuuuaaauucuugucuuuccauuuuguuugcaggugauuuucccaaaauaaauaccaggcuaucaugauuagaauuaaacaguuuucugaaaaccuaaccuaauuuaauggaauggagagagaggggugaggguaacaagggagguggaggaggggcguagcaauaaacgagaagguggaauuuucugauaggaauuugugauuucucccuuaacauuuucaggcaguuuugcuuccaauccccucuauaacuucauuuuuauuuuuagugccuacagacacucuagucuuuagauguuccuucugcacugaggauccuuuuuuuuuuuuuuuuuuuuuuuuuuuuucuuuuugagacagagucuugcucugucacccaggcuggagugcaauggugcgaucucagcucacugcaaccuccaccucccagguucaagugauucuccugccucagccuccugaguagcugggauuacaggcaccugccaccaugcccggggcuaaguuuuguauuuuuaguaggggguuucuccauguuggccaggcuggucucaaacuccugaccucaagugauccacuugccucagccucccaaagugcugggauuacaggcaugagccacugcacccagccugcacugagaauccuaagagaauuuucauguugguauguuuguaauaccagaaauguuaccaguuauaaccagcuacuguugaugugcaagaaauucuauuuuggaaggccaaaacagaggauaaugccucccugcccagacggucugauaagaaugucaguaaugcccucuguguuucauuuccuguguguucucuacauucggcauucugcagucugaggguuauauacaucaguaaucucgagugcaagcaugacacauauagaaggcuugaaaauagguaaaacauggugguaggggcagcugauagcaggaaaacuguccuuaggggauaacagacaaugagauccggagaguggugaucuggagaaauuagccgggcauaguggugcacaccuguggucccagcuacuugggaagcugaggcaggaggauugcuugagccuaggagguugaagcuacagugagccgugauugcaccacugcacuccagccugggagacagagcaagacgcugucucaauacacacacacacacacaucaggugcuaaguacaguccucauuauuugcagauuccuuauuaguaaauucaccuacuuaccaaaauuuguaaccccaaaaucaauacucucggcacuuucauggucacucauggacauaugcagaguggcaaaauauuugagucacuuuacacgcauguucccagcugaagucaaacaggguaacccucugcuguccugugucagcucuucuauaaacaaguguccuuuucacagugaauuuagugcuuuuuuuuuuuuuuuugcugcuucuugguaaugucacucuuuagcccccacguauagugcuggagugcugucuagugguccuacuguaagaagcugugaugugcguuacaaagacagugucuuuagguaagcuuuguucaggcaugaguuaauagugcuguuggcuaugaguucagcguuaaugaagcaacaauaugcaugaaauaggguaucuuccaacagaaacacauauacacuauaaaccaagguauguauuaaucuguugaugaaaauguuguaaucagcggcuuucaggaaccuaacccuuuauuucccccuagaagcagugguucgguauucacuaauucaguguucauggugacuuuauagaacauaacugcuucacagaaugagaaugggcugcacaguagaagcccucugcagcacucugcagccuuagaauggagaagguaaauggguggcuucauccuagaaugaguuuuggaggccagucugauugaaggauagaaugagguagggaauuaaagugaugacuuguuggcuuugaaagauaaagaggugaagucaggauggguuugauaaaggaaguuaucaagggacuggaagauuguaugaagucagagggcaggccugcagggaauaauuacagcugcaaggaucagaggguauagucaaagucuugcuggaaaaugggggaagguagaaaugagggcaauuaaagaaggcagagaacaacacauuuguuuuuggauagaccauucaugggaacuuugagcucuagggagugauauagggauacuuaggucagaggacccagagugcugauaaagacaauuggaaugugccuacaaggugcagcugucugugcaaauuuccagaaauuccaagaacccugagacgugaucuaggaauccuaaauguccagaugugaaagcagguauaaacaggccuaugcaaaguaucacaugaguggcagguucuugacuacacagaauacaguguacuuuuucaguuacaggacccacagcauuuuaccauggaaagauguagagaaagaaucaagauuuguuuacugauuagguuuagggagaggaggggaggacaggagugaauagucaagaguuguuccaguuugacuaauugcuauaagaugcuuuuuguucuacagaguuuaauggauguuuuacuuccagaguugucuuuguuauaucauaauucuucaguuuucaguucccuuaucaugugauuuuuguuauuaugacauuuaagauuggcgaaugagcauacuuaugguuugguaaauagagguaaugauuccucucaguucuguuugcauggggguuguggagcuaggucagcuuccuccugacugucuuugaaguuucacugacaauucuggacacucagauuccagcuuuccaagcuuuccuauuggccacuggguuagguuucauacuccuucuauugguugcugugaugggguuuguaaauggaacggaggcaaaucauacuuguacccuacuauugucauuuaugugaagaguugucuagaacuacgcugcccaguucaguaaacaccagccacaugucuagucggcccuugaaauguggcuagccugaauugagacauucucuaaguauaaaauucacauuggauuuugaagaccuagaaugaaauaaagaaugugaaauauucugugagaaaguuaauaauuuuaauauugauaacauguugaauuaagauuuuguauauguuggauuaaacaaaauacuaaaauucauuucacuuguuuuuuguuuguuuguggguccugcucuguggcccgcuggagugcaguggugugaucauggcucacugcagccuugaccuccuaggcucaagcaauccuccggccucagccucccaagcagcugggacuacaagugugccaccaugccaggcuaauuaaaaaaaaauuuuuuuuguagacacagggucucccuauguugcccaggcuggucuugaacuccugaacucaagugauccucccaagugagccucggccucccaaaguacugggaucacaggugugagccacugcauccagcccucacauguauuuuucuuguauguuuuuuaaguucuaggguacauaugcaggaugugcagguuuguucauaggugaacgugugccauggugguuugcugcaccuaucaacccgucaccuagcuauuaaaaaaauauggaacacuucaugaauuugcgugucauccuugugcagaggcccugcuaaucuucucuguuucguuccaauuuuaguacaugugcugccaaagugagcaccucacauguuucuuauugcaguuuuaaauauggguacuagaacauuuaaaauuauauuuguggcuuauauuaucuuucuguugaacagcacugucucuuugaguuauuuuuuggauuuccauggaauaauuugaaaaugauuguauuaaaugauauacuucuaaagaaaauucuuggguccaguuacauuaauccucucgaaguuguuaguauaccugaauguaucccuuauaaauaaaacgauuacugucauaaguacuaaacaccccucugcuaagagaaguuuauucauuuuccuuggaaauuccucuaucauaaauaaaaugaagucaacauuuaugacaguucuacuggauggaauauaacugaauccguuuaagaacugguaucaggguuagcauuagcuuggauuuuggacuaaucaaaugcagucauauuuuuaaaugugcaguucuuucucaaaggagcauuugaaucuaugucacauugagccgugguauaaugagguuuuguugucccugagagagugacuauuuucagaacuuagaugaacagcuauuugcaaggcagccuuaguaaauaugacagaaaagagguucauuuaaaagcagcuaguuuaggaaccacuuacuaacugccugcucucugcucaguguuaguauuaacugcacaagcaaaacacaaaagaaauuaaaggugugguccauguccucgaaguucauccucuggcucagggauuccuaacugacaucuacauucugagguaucugaugagauguaaagagagauuaauaccuuuauaauagcagcuaaagcacuaaacuuugaaaauuauuucuuaaaagucgcagauccaaaguuacuugaggaaacaccacuuccacacauguucuguuacgggaauugugcauggcuugcagguauucuucccuaaaccagggguccccaacuccuaagccacagaccagccacacagagcagcgggcaagggagcgaagcuucaucuguauuuacagcugauccccaucgccgauguuaccgccugaacuccgccuccugucagaucagcagcggcauuagauucucacaggagcacgaacccuaucgugaacugcgcaugcgagugaucuagguugcgcgcuccuuaugagaaucuaacgccugaugaccugaggugcaacaguuucaucccgaaaccaucccccacccccaguccauggaaaaauugucuuccacgaagccagucccugguccuggaaaagguuggggaccgcugcccuaaaccgugguugguggcaguguguagacucggugacuguuguuccaagguauagccaaggggaaaguugaaccauaguuguaguuggggagguucugagcuacaagaaagguagagaauccuucagaggcauuguuuauagaguccguucuaucuuccuauuacaaauauugaaacguuuucggaaagggaccauuugggaaguuuuuauagagcaaauggcccuugguuuggguccuaaaagaacuuagaggauucagcuuguaaaguuaaaugagcgguacuuuagaaggggaaauugaugugacugaggauauaugggguguugaaaggggauuuaugaguggaagagagaauaccuuauguuaauuugaaagauaauuguuccacagauauaauuuucuaacuguugugcuaauuuguucuagagcuuauuguucccaaggaacuuugugaugagucuaucucagaguguuuaauugccuggagcuuccagagaauuggcuauguuuuugggggagggaagauggggugggaaggugauugaccuucuugggcaaaaucauuauuugccagguaucauuguggccaaaguuauuuaucuuggcuucauguuguauaaauacagugcaaucaucuaugaguuuagcaacucaaauaggacagugaguacuuuugggcuuguguauauaaaaauuaacacgucgcauuugucuagaauuuuauaguuuuucaaagggauuuucaaaugcucacauuuaacaucuccaacaauucuugucuauuuaugguuaaggaaacugaggcccagagagucuagugucuuuccccaaagucacauagguaguggaugacuaggccagaacuagacuuaacucuugccuugucguccaagguucuguucccugguaugacacccucucucagcagggacccugcugacagugacuacgcgcugguggcuggcgucuccugaguuccuuguacucagccugaucaugaggaacugacucagagaaaugagagucugcugauucagagcugaauauccuuucccagucuuucauuucccagcuuucucuucuccuaaauugauuucugucagcucccaagcagcuuucuuaguugucguagcuauuagaacucuuagagcacuuuaagagucuuucugacuuaauuuacuagcaaugaauguauugcaugagaaaccuuuaauuauagcuauauuuuggguagguaucacuauuuuugccugucaaaccaaaacugaaggagaacugucacuaacuuaaccucuacauagauuuccuuuaauaauucucauugacuuuguuauucuguuauacacauugacuuccauugaauggauuuguagcaggccaagaaugagugagauaccaguacgaaggcuauuacgguaguccuggcaaaacacugggcuuugcugggcaugguggcucacaccuauaaucuuagcgccuugggaggcugagacgggcagauugcuugagcccaggaguuugagacuagccugggcaacauggugagaccccaugucuacaaaaaacacaaacauuagccagguaugguggcgcaugccuguagucccagcuacucaggaggcugaggugggaggauuguucgagccuagaggucgaggcugcagugaggugugaucuugccacugcacucuagccugggugucagagcaagacccugucucaaaacaaaacaaaacaaaacaaaaaaccccaaauccaccaggcuucgauuagggugguagcaguggaauuugggauggaagcugccaucucuccacuggcaugagucaagagggagccaggagugccacaggcuccagagaaaacuucuugcccagccuuccuaucacuaguguugagagaagagaggggcuucuggcaagaccuucucccacaccacugggagaccuguuacuccaucaccacaucugcuuugagacuguuggcacacuaauuucauuuuccucuuuauccuguuuacaacuauuuacacugacagccuuuaaaacaccaaggcuucuagguuuuuuuguuuuuguuuaaauuuuuguuguuguuguuuuuuagagacagggucuugcccugucacucaagccaaagcgcaguggugugauuauagcucaccgcagccucaaacuccugggcucaaaugauccucccaccgcagccucuugaguaguuagcauuacacgcacgcaccaccaugccugauuacuuuuaaauuucuuacagagacagggucuugcuguguugccuagggagcucucaaacucuuaaacugaagugauccucccaccucggccucccaaagugcugggaucacagacgugagcuaccacaccuggcccuucuagauuuuuucuuaauccaagucuuuacucuccauauauaagagauggauaauuagauaaguuucccucccacugaauauucccuauugcuuacccuuccccugcuucaucuucugcuauagcacucaccauuuguuuuggcacacugaauauuuuucugaauuauugauuuucuucugccacuaucauguaaacuucauaaagguggcagggguuugguucauguaucaucagcauccuaacagggucuggcacaugaaauauuugaaaagaugaagugaguggaguuuuaagucuuuagauagcacauuuuaaaagugaguucauaaauuauucuacaaaagcaaugaaaugccuuuauaaacuggaagaaugucagauguucuuuguuuuguuuaaucccauuugguggcuuguguaauuauaacacagauuaaugaauaacucuuaguaauuccaaaauuacccuaauggcaauaauauguauuuguaugaugccauuuacaguagccugaaugaauuuuuuauuccucugucagauaaauaguuguaucucaauguuauaaauguuaaaaauuauaaaugcuuaaaaauguuguaaauguaagagagaaggcuauucacaaaaacauuccuuuccaggaaaacagagaccagucuagugugagacauagguguguaguugguuagagcaaggcauaugagaagguacagaaugaugagaagguuuuaccuucaugcccaugagguggcuaaauugucaguaguaguuuugggcaugugagcugcugcuucucaauacugacagcauuuuaggggacuggacuuuguacagcucugcauugccugcugaggaauccaggcaucagcaacagaaaguuccaaagcauuaacagaagauuuaauuauguuauagcuguacauccaaauggaagggagcuggagauagccaagaguucucugcuagguguuuuucagacaugcuucucaugaauuaaauaauuuuaguccugauguggagauugggagcacugaaaagugguacuaccauagagcaguuuucugugaugaaguagguagaguaagcaaauguguuacauaagaauuucugcagcaacucuuccagacaccuucuaccuuacuugauaacagaguguccugaucacaugauuugcagagaaugagagaucugugaaugauugcugagaugauggccccaacccaguagcucagcuuccaacuucuuaagcagcucuagacuacugauaccuuccuuuccuagguccaaaugcuagggacaaccuggcucaaaaucaaaguuaaacuuuaaaaguuauguaauauuuuguugcugauguguuucuaacuuuuggcagucuucaaaaaauaaucccauagcugcuauuaauuucaggggaauuaaugauuauaugauuauaauuuaaucauggggauggguuguaaaaaucauucauaaggaaaauagguuguagauugaguucugauauuggaccuuuaaacaaaaaagucaugaaagucuuuauccaaauugcugguuaucucccugauucuagaaagguugaaucauuuuaccgagacaaauagauacgcagugccuuuucuuguggguggagaguuacacugccggccugaccuggccaccucuuuuugguguuaaaguuuagauaugaaguaguuacaaacacagcuuuauuguagcucuucugggccgcuguuucguuuaucagguuggggauuuccuggagccuuaacuuucuuuuccuuaucucuguguugucuggaugcugguaccuggucagauagccuuucgguagcacuuuuucaaaaaaacguauaauauguguacuuuaaaaauuccucucauuguuauguauauugcauugcugcuugauacuacacaaaguuuccaaauaaagggaaauuguggagcuuuguuuagauacuuuaagaggguaauggcuacggcuauauacuuuugcugguuuuuauaaauauuaaugauagcaauuauguugaaggaaaaauugugugagucaaauugcacccuuccagggugagugcuuugcuuuuccuuucagcugucagaaauuguuuugccucugaugauucucuuaaaauaaagcuugcagaauuauuacagauuaaggaaaucaagugaucauuaauggcaagaauuuuuuuuaaaaauaguuuuucccauuguuuguaaauaauacaugccuauuauuagaaaauucgaaaauauaaaagaauuuuuaaaaaguauccugaucauggcugcucaaaagcguucugauauuguuuuucuaugcuuucuuuuuucuguuuuaguuuuauaaaacuuuuucuacauuuaguuuuauaaaagcauacuuguuaucaaacugcauauacaauuuuuaucccauucuuuuuauuuaacauaagaauuuucuauguuucacagauuuuaugaagaugugccacucauucauugauucuuucaguuacugggugccuucucucugugcucugggugccaaaugcuuugcuuuuuaaaguauggagacaugggaguagaaaauaaucuagauuauaauuaggaacugcacaucuuccugaauuuccauguaacuuugaucuggaucugaaaguuaaauuauuucccagguaguuccacauuuuaagucaaaacaauaauacucauugguuuguauuauauauuuaagcuaacuuuguguggauuaaaaaaaaaaucacucugccuaggagucuuucccuagcugaagugcuggacugggaguggagggcagagcagaauccuggggaggcgguaggggccggugugcuuggcuucugcacaggaauuguuuauaggggugagugaguagggcaggguucauggcaagguguccgacaagauacuuagucacucacaaagcacaugacuugggccuuguccucagaggacugaauuagugagaaucuaaacauucuagguggcacggaauuugagauguagaagaaagaauuugacuuaucagucagugauauccaauugccuccuccuuagccccuucccagaucugucccaguggucaggcgcagacgugguaugagaaugagcagggugggccugcuccugagcaaggaugccuggauuuaaggccuggcucugccacugacaaacuguauaccuugggccaguuccuuaaccuuccugugcuucauucuccucaucuguuaagagaagauauuacuacugccuacuuccuaugguuaaaugaaacacauagaacgaugcuuggcacauaaaagagcacucaguggaucuaacuaccuaccaguauuuucuacccuauaugacugaauuugacauauugacacauuuccuuagcgcugagcucgucagaugaguuuagauggcauuaagguagguauguuauuguuugauugcacacugaacugguaucgugaggauggccugcugcuuagcuagcuguuaggaacuauccauggucauguuucugaaaacagccaaguauugacagacuugguucugauccuggaucugucuccaaagcccauuccccuaaaguagacugcuucaaaaaagcuugcacacccccuuaccuuaaucuacuggcugugggcuaagaggaggaccuauuuuguuuuuaauaaacuuugauugaauuauaauauacaaaacacuguacauauucggguugcuguguguucacaguaccagcacugggaucaagaaacagcaucccauaaccuuuuugugucuuucuggggaccgugcuucgaagucucugguagaaagauuugugaucauuuguucuugugcaaggagaaggcauuauggaagauagggaauuacccggauaaagaggaggaucauuugugaugcuguggaucuuaaaccucccccacucccuccuguccuguauuuauuucuccuuuuuuucucauuaauguaaugugaauaucagagaaagagggauucuuuuuuuuuuuccuuucaagauuggacauacugagaggagaaagauucauuauugcaagauucauuaaaugagaauaaucagaauggacuuuuuagggagcuguauuaagucuuagauuuuucuccuccaagcuacguuucucaauuguugcuucugaguuaauuuuucauuacauaucaugaucauugcuuuucaucauuugaagaaugugaagucaaggaauuacagaaaugcaugaauacuuaccuagaaacuuucaugacuuuaauucucccaacucuaaauuaggcaugggaaugggcuuuuucucaggugucaaaucuuggauuggagguggguccuggcagcacugcauccgaagguuuuggagaggagucugggcaucacaggagacaaugugauuguuuagagauuuuggccacggggaaaagagguuggacuugugucuugaguaccagauauuugucuuuggugaucuaaaugauacugugcuauuuauugauucuuaaacuuggcacucuucuguaggaccacuuaauaccugguacaugagauuggaaacaguacaaauagcagcuuuaaaaaauugaaguaguagucugccuuccuuacauauaccacauggauucaucaugcuuucauacuucugugguccucccuuccagugucuuagaaaguucaucaguuuugugaaaguagcagugguggcaacagcaguuccagucaacaaccuauugaaccgcauguggaaugugggagucuagucagugauugcagacacuuuuguaaauguguaaacuuuggauaacccaaauuaucuucuaugauacauggaugaacuguagaaaggaaauagauaacuuggccauguguaggguuacaaauaggguggaugauaaauuguaauaugcauaguauuuaauauuuaagagcaggcacccagcaugauaaugaauaacaaugugaauaccucucuaaguguguaauuacauuuuaggaaagugaagaucgagaaaaaagggagauuggauugagggagagaacagacucuuaagcauaaaagaucuacacauaccuccucuuaguuacucucugaguugcucuaaugucucagaagagugguugugaugauacaauuaugcuuuuuccacuuacugaagaaauuuuagagcuccuauuuaaacauaaggaaauuugaagucauguagagacauccccuuuaacauauaauaguugugguuuuuucauaucuacccuauuacauuuuaucagauuuugaacuguggaauuaaggcuuauuaguuggguaacagaggaaauggcauuuucacuuuuaaaaaaaucuaaaaauccuuucuguuaagauaucauguuggucucacugauuggagugaucccaagauauuaaaagccucuaugggagcuuuugcuauaguaaacgagggaaagggagaaauggagugugaguguauaagcacccuccugaucagacuguaugcaucugacuaucaaagaagcacacugcuuguuacaguuagauucauaucauaguuuuuguuuuguuuuguuuuguuuuuagguggagucucgcuguguugcucaggcuggagugcaguggcacgaucucagcucacugcaaccucugccuccugaguucaagagauucuccugccucagccuccgaguagcugggacuauaggcauccaccaccacaccuggcuaauuuuuuuguauuuuuuuaguagagacgggguuucaccauguuggucaggcuggucucaaacuccugaccucaaaugauccguccaccucagccucccaaaaugcugggauuauaggugggagccaccgcaccuggcccauaucauaguuuuaaugcaaauauuuaguguuauuaaaccaaucagaaaguaucugauggacaucuaccauggauaaaaccugcaugagguacaaaaaugaaugucaagacccagacuaauaugcaaauaauuuauaaucuaguuaggaucguaagagauguauuauacacuuuuuuuuuuuuuuuuuggacacagggucucucucuguuguccaggcuggaaugcaguggugcggucauagcugacugcaguccugaacuacugagcuaagugauccucucaccucagcuuccuaaguagcugggacuacaggcgcaugccacuacuccuggcucauuuucuaauuuuuuguagagaugaggucuugcuauguugcccaggcuggucuuuaaauccugcuucaaguaguccucucgccuuggccucucaaagcacugcgauuauaggcuugaucuacaguaguuuucauagugcuuguauaaguaaucuuuugguucucuguuaaaaagagaaagugacuuuaaaggcaguuuaugggaagaaagaacucaugaucaguggccaugucaguucuaagcucaaaauguguucuucuuggagaaaggaauucauuuucuccuaaucugguuuuaucuugauacuaucaauuuagcaugugccacagagaauucaaguugucauauguguguugcaauuuuuauuucucaggagagggugaauuucagcuauuuuuugaguuuauuuugaaggaauuuuagggauuauauauauaagauugucuuaagguaauugaaggcccugccaugacauuaguuuuucucacacucauggagugaaauguguggauaccguacauuaaaaguaauggcaaaaaccgcaauuacuuuugcaccaaccuaguacaaaggugcauuuaaaaauugcugaagccaaaggaccagacaagaguucaucagguuuuaggaauccauuaauguuuucuucaccaaauuccaggacuaagaaaaggaaaagaauuggggcaaucccuuguaguuuuguauguaaagauuugaccuguauuccagggaucuugauuuuuauuucuaauaaaagaaaaauguuuucuucgugaacccacagaaucauauugauucuguagcauuguucuccuuuuucagaugaagaauauuagugucagaagucaaaauugagcugcuuuuguccucagguugggcuuucucauuugaauaugccuaggaauucagugcaagaguucugaggguuuauggcugcucguuaucauuuuuuuugcuuguauuaaagcaaggauauaucccuaaucugugucccaccuccccuugucaucuauacauuaaguccuacauuuggcuguuguggguaaccaucccucacuugcuguggguagaauuuugcaagauugcagaguaagaccugucagcugacacuggcucacaugagagccauuaagagggugguguggccaaugucagaacaaccuugcagcugaaggcaagucacugcauugcccagagccauaugaacaggucuugugaccaauuaauugacuacuacauaaucuccagcuagggugcacagauggagugagucaguccaagcugcucaaccuguuaaaugucuuuucuuugcuaacuggaguauaagcuuaagaacaaaaguaggacuugucuauguuuguaaugggauugcagacagcguguuuuguaaugugauagauggaucugacuuccuaaauuauuggcaggcuuaauuuacguaacaaaugaauguuccaccuuuuuuuuuuuuuaaaccuuugaaaggggaaauuaguacacugcugucaaguagcuuuucucacauacuguauagggagugaaaugauuguuuagaacugcuggucauuacagaauguuccucacauaacaaaggaacuucaggauuugucuccaaguccauguuuauggucaggauaaaccagaagaacauuaaaccguucaggagaugugcggcggcacagcgaacaccacaaaccagccagagagcuggcaagacucugccagaugugugagugaugcuguuccuggugcugggaggauuuacagggcgcuuuuaugcacaaagauuaaaaaacacaccggaguagacaggagcacugaccacacggaacucgacaacagguuugaaacuuuaguuguuucaaagucucagauaauuuuuuauuuaauuuacuguguaguaaggagauggaauuguauugaucugaaaguuguuguuucucauaagugcuucuaaguaggagaaaugggguuauugguggaugugcagagucaagucccuucucuuacagaagagauguaagcauggguauuuuuuagugacuauugugacuucacuacccaucuguuuucuucuuuucauuaccucuacuggagccaacuuauaagaaguguguacaucuuugucccaugaagcuuggaugaaacuguucacaguaauuaucaggaaaaaaaggugccguccugaaguagcagcacaguuaguagauggggcucaggccugggcguuuucacuucauagucugcguggcagccaggugguugugcuuuuccaguuggaagcaggguggucggggugacccagucuuccucuggaagacccuuuccaugagaaggauguuaugaacagcaaauuuuaauaauggagcuugucuaaaaagaauagcauacuuauaauauucuuuuugguuuauuucauccacguucuuccguuaauaaauuuggaagaauuuauuaauuuuauuauuagugguacuuaauugaaaugcuauuuguaaagaauuuuauugcauaucaauaaaaacaaaaaacuguuuugagaauuacauuucauuccagauucuuccauagauagauaguaaggagagcuaaaaguuaaugauuaguguaaaagcaaguuuauaagugcauuuaacuugggcaugguggcuuaaaccuguaauccaaacacuuugggaagcugaggugggaggaucacuugagccuaggaguucaagacuagccagggcaauguagcaagaccccaucucuacaaaaaaauuuuaaaaauaauuagcagggcaugggggcaugcaacuguggugccaguuacuugggaggcugaggugggaggaucgcuugagcccaggaguuguaggcugcaaugaauugugauuucaccucuguacuccagccugggcaaccgagcaagacucugucgcuuuaaaaauaauaauaauaaaauaaauucacuuaaaacauuuuuuucuuacagaaauuuucucaaaauuaacauaucucaucaacuuuaucccauaaguaugcuucuuaguuugguuaaaaauaaucaggauauaguuuuugucacguaaaaaucuuugucauuuuuuaauagaaacaauaaaacagggcaacagagugacacuucuaucucuaaaaaagaaaaaagaaacuuaauaaaaugggauguaguccauuacagcguaagagcacaguagaccggagagugagagagaagugaggaaguuauuuuacaaguguuaggucacaugcuuuucauucaguuaaagagaucuguuuguagaggaggagguaaugauaugguacauuagaaaaauacauuugaguguucagauaagaauuucacuuuuauacuaucuguuuuuaucuguuucuuaucaagaaagggcagcugagugauaggagagaguaacggagugacacucaaguuuaucugaaucuugaucccuagcucugcugcccaggagccucuaacccugggccagucuccaggcuuuucuuaaucucacucucaacuguuaaacuauguaauuggcucggauuauuuuaaaaauucuuucuucuucugagauucuuagauguaguaguagggccuucuguauuccguauuuuuguuauucuauagaauucuagauccccagauaguuauuuaggaugaaagauggggauugaauguccauguaaggacauaauaugcagggccaauuuuuuaaaaaccucuaaaauuuuugauaugagcugcugcuucucaccuucgaagugaugcuuuaaauuuuaacauuuucauaccuguuauccucuuuccuuauuuuaacuuccuuuagauuuacuucucuagugcugagaauuuuuuuuuuuagaacuuuguacaaugaugacauauuugucaauuaauuggaauucaucucuagucagacaaugugcuguaguagaccucaucugcuuucucuucuccuuucuacgaucuuggaaacauugcuuacuugcaguauugugcuugguuuccagaacuucuuuaggacuugggccaacuugaggguagaagugaauuauugacaggcgcuugcacugaaggaccuggcuccagagugcucacaguuaucuguuuguccaagucauauggcagucagguagguaggacuuccaaucucuuuuugcucuuugauaucuuaaaucagucguuccaaguggucuucuuaguugagcacacugacaagcagggguuuuguuuuuuuuucuucucaugauuuuccaguaacugaaaagaugaagagaaagauuccacaauuacaguagaaucacguuguauuaugugaugauggccacaguguaaaacagacggaaacagugcagaaagaaacauguugguugucucauugcgguucauguagcaugacacauuucaggauaggaguuguccucugcaucuccauuuccauucccccuaaccucuauaaaggcagauguugggguucaauucauuucacaaaauucuagagucaacaaaaaacuaccaaguuugaugagaggcaucuuaaauggcuugucaguaaaaauuccuugcuaaaacucccuucaaaucuagugacucuuugcugggcaugguggcguucaugccuguaaucccagcacuuugggaggcugaggugggcagaucacuugaggucaggaguucgagaucagccuggccaacauggugaaaccccaucuuuacuaaaaauacaaaaauuagcuagaugugguagcagguaccuguaaucccagcuacuugggaugcugaagcaggauaaucacuugaaccugggaugcagagguugcagugagccgagaucgugccacugcaccccagccugggcaacacagcaagacuccaucucaaaaaaauaaaaucuagugacucuuaaauaugaugccagguauaugguaucauccucaaauaauugcuuucaauccucuuucuuaaaauauugacuauagcaaagcugccaacaacuuuugaguuuuucaaacuuucccggcaaauuagcaaacaaaauucuuacggcuguuuauaugagaaaucugggacuugccacacauauuugugaaucauuguugcucugguggcaagagaaaacuugccaugucuuuaaaguauaccccuuacacacugaaaaggaacugaaacagagcacuucagagucaauugugcuuuacaguuucauaucuugaaauuugaauucagaagaaauucucuguacugcuuuagaaucaccaggaugauucuaaaugaguauauccauuuuauguacauuuuuagaugagauaauucuauuaaaaaagggaaguccuuagauugucugugguaguuacuuaacaagaaaguaaguacagaaacuugagugcauuguucccuggugagcugcuucacauagauaagcugaccaugauuuuaugaccagucuuuauuuauagcaguugggauuacugacuaggaaauauaaaaauagucacagauuuagagagagauaugcuaaggcaacagaccaaagaauucugaagaguauaauaaaaggucauuaaaaguaagcguaaugcagguuuguaggaauggaaagaauguuucucacugcugcuccuggaaacagugugaaaaccacucuacccugaugcuacuuaauagaaaauguagcaguuggacagguugaaugaaguggguagagagaaaaaacaaacccuagucagcugauggucuugugcuuugugacaagcuucacagagaggucguaaaugguugggugugacucugauggguuggguauuguggucacacguucuucugcgcuuccugcauuccuucccuuuuuacugauuuuuacguaccaugagaauuuuucuuugacuaguuagaagaguuuauuucugcuggcugaggguagagauuuugagauauaauuccagacugauaagagugaaugaaucaaggaaugcaguguugugucugauuuaggguucaagaacauuugucuuuucccucugaggauacaucacuuacuaggaauaaaucagcaaucuuaauauaggagauuuucauagacgcuaacaacugacaucagcuuuugucucggucauauuuggauaagcauugaugacauaacaggguaaagcacuuguuauuaaucaccauagcuaacuguguccagaaugacaguguuccaggcagaagaugagguuaauccagcucuggagucugcaggccagucacugacugggcagcuucugaagccuuuuuuccucaaguucugcucagcucugugcugaagcggaaugcuggcugaacugguccccacaucccugguucuccuguuaugacuccuguggugagucaggcucuggcuuagccuuauccuuuuauuguuacaguaacaaaagccaaauaauugcugaacagugauguagcaagcccuggugggaauuggagagagcaauaacuugugacccaucuaagauuauaacugucaaaagucaccaaagagaauccacccuguggguuauaaaaacacccaagguuccugggaauauucuuaucuuuuaugaguucccaaggggauauuuagguaucagguguacacccauccaucagccuuaugucuuuaaggguuuaagaaagguuuuuuaaaaaaacuacuuuagguuuuuacagaacagaugugaaugaaaauccuuuuuucucacuaugccauauccuuucacuuucaugccucacccuguccaaaggcagaaaaaggaacuuaguuaagcuauuuucccacuuacugauuuucagcucuagcauaugagaaccuagacuuaauaccagauaaaauggaagggacuuugacuuggggaucuucucuacccugauuuuaugaucugagggucuucucugccuuaaaaucagugucuuugggcacaucauuucaucucucuguuuuuguuuuuuaaauaauauuaauuaauaauaauaaugaugguagauuggaaugguguuuccugagccucaacuucagauccacugaaccgaauuccuagagguagagcuugugaagcuuuguugauuacacacacacacacaaacacacacaaaacuucugggguaauucuaacaaugagccaaacaacuuggaaccaguggacagguagugucugaagucccuuccagcuaacauucugauaaucugucagugauccaugagucccgaaguuagagaaauauaaaggcugggccuuggguaaucaggggaguuaaaacuagcucagugguaaucuuuucccaugugagcgaacaagccacgcggguguuugaggaaguacauuuucaacagagagaacaggaaguacagagaucuuaaggcaggaacaugccuggugugcauccuaaaaagaauauugccucagggcaaagaugauuuggauucagaaaguaaaugauccuucgugggaaugugaaugggguggagguguacugguggaugguuuagcggcugcacacugugauaugagagggaggcagaggucacugccccuaauaucuuucccacuggaccuugcuugauggcaaaaacuccuauuauuaaauucucauuucuuucuauuuaagcauuauucucucuaggcaguaacuaaugucuuacugugaacuaucuuaggggaacauuccccucugucaguaggagcaagaccacaugugacaguuggguacauucuguagagcagugugugaggacugacccuccuuuuuccagccggguagauagaacaaggaggagacggccuguaauucugcugaacagggacagacuugauagcuacaucugaagcucaaguuauguguccuugguucucaucuuuacaggguauucuguagcugacuguaacagacaaaagugaucuucagaaaauaauccugucacaaauuuuuaaaccagugcuuauuccugaaaguuucuauaucuuaaaaguuccuuugacaacugaaauuaaaagaauuuuuuccuucaaaaaaauuuuagagcaguuuuagguucacagcaacauuaagcagaaaguacagaauucccauguacaccuugcccccacaguaucaacaucccacaccacagugauauauuuguuaccacugaggaaucuguauugacacaucuuuaucacccaaaguccauaguuugcauuaggguucauucuugguguuguguauucuauagguuuugacaaaaguauaaugacauguauccacuauucauacuagauaguuucacugcccuagaaauccucugugccuugccuauucauccuucccucccucucuaaccccaggcaaccacuugucuuuuuacugucuccauaguuuugccuuuuccagaaugucauuugauuagaaucauacaguauguacccucuucagauuggcuucuuucacuuagaaauacacauucaaggucccuucaugucucuucguagcaugguaguucauuuccuuuuuagcacugaauaauauuccauugauuaucucuuugcguacugaaggaugucuuggucgcuucuauguuuuggcaauuaugaauaaagcuccuauacacagcugcaggcuuuucagcucauuuggauaaauaacaacaagucccuuugcuggauuguaagguaagaguauguuuaauuuuguaagaaacugccaaacucuuccaagacaacugcaccaccagcaaugggugagaguuucuguugcuccacauccccaccagcauuuggcauugucaguguuccagacuuuggccauucuaauaggcauguaguaguaucucuuguuguuuaaauuucuguuucucuaaugacauacaauguggaucaacuuuucauaugcuuauuugccauuuguauuaucguuggugaggugucuauucagguccuuugcccauuuuuucaucaguugguuugauuucuuacugaguuuuaacuguucuuuauuuuggauaaaacaguucuuuaucagauauauuuuuugggaauauuuugucucagucuguggcuugucuucucauucccuugacagugucuuucuuagagcagaaguuuuuaauuuuaaugaagcccagcuucucaaugauuucuuucguagaccacgccuuugguguuguaucugagaauccuucgccaugcucaaggcugucuguauuuucuccuguguugucuucugugaguuuuguaguuuugcuuuuuacacuuaggcuuguaagccauuuuggguuuauuuuugugaaggauguaaggucugugucgagauucuuuuuuuugcaccuggauguccaguuauuccagcaccauuuguugaaaagacugucuuugcuccauuguauuacuguugcucuuuugucaaauauugauuuauauuuauguggauuuuuuucugaagucucuauucuguuccauugaucaguuucccuauucuuuugucaaugccacacuuccuccuucuccuccuccuuuucuuccuccuccuucuccuccuucuucuuuuaagagauggagccucacucugcccaagcuggagugcagguuuuuacaccucagaaggacaugcagaggaagguccuggaaggaagagaauguuauccuaacuuguuugcuacugguaucaaggugauagugcagucgaguuggaugagcacagaauuuagagccaggagacugauuuuaguccugacuuagccacuuacuggacauaaccuuguuaaagucuccuaacuuccguguaaaacguuauauaauacagacucucacaggacauuugagaaggucagcucaguugaauucuguaaaaguguuugguaaacucuaaaauauuaggcaauuauuugugcaugugcugugcaguucuuaucaccagccuuccccugccuacaugcaaacaccagaccuucuggaauuggugucucuaggcucugcaugaauuaugcaguaaaaaaggcaguuauuuaauaugaugggaauccaucugauacaccacuagaacagcaaucauaaacugaaagacauacauggguuuaaucaaugagaaaagggguugcuuuuuuagagagaaacuuucuccugucuuugggggagggaggggaugaaggacaggaaaauguaguguacaaguguugagaagaaagcucaauaaaugccauugucuaggccaaacuacauauuugaaaacugaaucugaaugccuggaauucauuaaggugguuucccuguaggaguucacccacugccucaugcuuuagcuaccaagaagccucuuaaaggaaacaguaguuaagggcuugucuuaaagcaaugauagauucuuuggguuuaaaaaaauaggguguuccuguuguaguccucaucuuuguuguuuguuuuuacuuuuucaagagacaauacagucacacggcuuaauauucaaaaggcacaaaauuguggugcauguuuagagcacagucagcgugccugacuccguguuaagugcuuuacauuuagucaccaaaacagcacuuguaagguugguacuauuauauuaucuccauuuugcagaugaggcuguugaggaacaaagagauuagguaacucaccaaaguuacauagcuaggaagaggcagagguaggaccugagcccaggaugucuggguccagucuacacuccuucucacuaugcuguuuugauggauguuuauuacauggugcagagaaagccuuucccuuugcucuguaaagaguguagaaugaaaagucuucugcuuucuuuuucaucaguaauccagcuuuuuuuuuuuuuuuugagacggagucuugcucucucgcccaggcuggaaugcaguggcgccagcuccgcucacugcaagcuccgccucucggguucacgccguucuccugucucagccucccgaguagcugggacuacaggcgcccgccaccacgcccagcuaauuugacgggguuucacguguuagccaggaugcucuugaucuccugaccucgugauccgccagccucggccucccaaagugcugggauuagaggugugagccaccgcgcccggcccaguaauccagcuuucuacuccagagucaacuaguauuaccaauucauuguuuuucuucuagagauagucuauacguguauaauaaaacccagaguucuuuaccuccaauuuuuccuuuuucuagacuuaugguagcuuucuauacacaauauuuuauacuuauuuucguuccagucaaaaauaugucuuggaguuuauuacauacuuaccuaaggagcuuccuuauucuuugcugugucaguauagcacucccuuguauggauguaccauaauuuauuuaaucauccugcugacaauuuguuuccaaacagugcugcagucauuaccuuuuuguacauaaucauuuugugccugugcaaauuaaucuguaggauucauuccuagaagugaacuugcugggucacgaguauauauauauauauuuauuuuaaccuaucucuuuuagagauaguauuuuacaacccaaaauaggugacaauugucuauuuauuuugguucuuucaucuugcaaacgagagaccuuacacagagaaucaugcuuuugaccucuggaaacuucuuggaaaauggaaguauuaccuuaucugcauacgguuuaauuagaucuagaagugaauaacauauaaggcaaugucuuggguauuuacuuugaaauuuauuccguugucuauuauuaguauaugauuucccaaaaugagggaggggaaagauaugaaaucaucuugaugcauguuaccuuuuauaauugcagaccaauauguauuucaguaauccaggaauauaauaauguguugacggcuuugauuaugcugacaaggguguaaaagaauuagcucggccaggcgcaguggcucaugccuguaaucucaacacuuugggaggccaaagcaggcggaucaguugaagucaggaguucgaaacuagccuggccaacaugcugaaacccccucucuacuaaaaauacaaaaaaauuagccaggugugguggugggcgccuguaaucccagcuacuugggaggcugaggcaggagaaucgcaugaacccaggagguggagguugcagugagccgagauugcaccacugcacuccugccugggagacagagugagacucugucucaaaaaaaaaaaaaaaaauuagcucagugauuauugaauuaauauaugcauggagaugaacaguaaagcucuuuuuuuuuugucaguuuggcuauuuuuaaguacaaguaguuucuaguuuauagauaucagaaaagaauaaauaaugugcauuuaagaauuaagggaaccauuuuggggaaaaaugggccauuuauagagauucuauggggguuuuuuguuuuguuuuuguagagucagaaucucacuauauugcucaaacuccuggauucaagcgauccuccugccuuggccucccaaaguguugagauuacaggcaugagccacugcaccugaccucuguggguuuuuuaagcagaaaaaaggaaggaacuauuaauaacagcaacaacaacaucagaaggcaaggggcagagucuugacugccacagugaccugcccacucagugucccucucaccucaaaagaacuuguacuuuucuccuucagauuuugugagcaccuuuugaaaguucuguugauuagaguuguguugauauuaagaugcuuaucaaagacagauuauguuuagcagguuuaagggauaccauguaguaauaauguagguuaauucauuaagauugcuuuccuuuucguaccuggcugagaucaucuauucuaaaucacacugugcacauuuaauagauaacuugggauuauaauauguuagaauuggaagcaccagaccuuuagguauaauuuuagucccaccccauuucccauuuuuucuuuuuucuuuuuucagacagugucucacucugucgcccaggcuggaguacaguggugugaucucagcucacugcaaccuccgccucccggguuuaagcaauucuugugucucagccuccccaguuagcugggaucacaggcgcccaccgccaugccuggcuaauuuuuauacuuuuaguagagaugggguuucaccauguuggccaugcuggucucagacuucuggccucugaucugccugccucggccucccaaagugcuaggauuacaggcaugagccaccaugccuggccccaccccuuccuuuuauagaggaggagacacuggauuaagaggugaagaagugacugagaugggacugugggauggcugccuccagccuaggcaaucugacaucccgugcagugcuccgcuauuuugucuaugcugugguggccccagggcaguggcauguggguaguggugcuguaagugccacacacaaacuucaucuguuuuagaguuucacuugaugugauccugaacucagaaaggaaggaagaaauucugucuuuuccucucuguacuuuguaguuccuuguucauagcacccaaaccuuaggcuguauugugacacauacgauaauguuuugucacugccgugugaacacauuauuuaaagacuuaugugguuuuaacuugugaccuuugcuaccauuuacauauuguuuuaguggcaaggagggggaaaacaaguucagagcuacaacuaaccuacuuacacauaaacuuuuggcuguuauuuuuguuagagaucaguuauauucaggaaaauauggggaaccugaaaguuauuucagucuuuuguccuuuucucagacaugguaaucacuaaagugaucaacaaugcuuuauccuauaauuccaaaauccuaaaauuucuggaaaaucuuuuggaauuaaucugaacugaugugaggcuguuuauagucucuaucuaauccacuuagcauaaguauucauaacuugggcuggugaaauauuaauuuguuuguuuuggggguuugauuacaucucagccccuggaggaaguauuauguaauauguaguguagcaucuuucugauuucuaaaaaaaauucugaauucugaaacaucuagccccaaggcucucaguuaaggaauuguguaucugaguagaucuuugaauuaugcucuacagcuuuaaaagugcuuucauaacuuaaucucuguuuuucccaacagccuugugagguagauaaggcagaugcauuuugggaaagcucagcgcuaggguuggagcauucuaaaaucaucuggguugaaggcagcagagcuagaguuagaagcccuguuuacccuggugaauccuaauccgugucccaagcaucaugucuucugugacucacauccaucacucacccaacuguguggacuugaccucuuuauccuguagaguccccauaagucccuauagacauuuaucuuggcaccuguaaaaauauaguuaacuuaauauuuauauguuggccuuucccuucccaguuguaagcauauugagguaaauacuggauauaguuaauuucuguuccugguaccuuucauggugccugugugaagccacacacucaaaggugugcagaaggaaugaacucagaaguaugguuccaugcuuuugcugcugaucaaacauauuuauucuuucauuccacauuuuccuuuacaaaaggaauaaaggauuuacauaucaccuacuuucuuaaagauggaagaauuguaaccaacaugcaguauagcucuguguugguaauauaacaguggacuacauuuaauuggaauuguuuguaaauuaauauuaauaucuuuauguuaucaauauauauuaaagcuucugauaagaacuuuaagcacuuuucacuauacuccugaccacaggauagcaacucaguggugauuuuuuaugcaguuccacugaaauugcuccaggcaauucacacagcugaggcuguauaagugcaaaauaggggaagaaaggagagccaacacagucuuccugagaguacuaacauagcaaaagauaaaugaauuccaaaucuguuacugccaucuauuuacguaaguuuuuucuugaaauaaacagcuuuuacugggugggaaauaauguguauuuugugcugacagggugaacucucauugcuaugucaagcuuaauuuucccuuuucuuccacccccagucuucauuuauuuucaggguguaacucuuugggucuccccacucuucuugagcaaaccuuuugagagauuucuguuuguacuuagaagguguuuuuugagagaauaaggaaacgguggagguuggcagagaaaaaagaauauagaauaggguuaaagagugguuggaaaauguaacugcguuucauaggagcaggguuaugguuugcucauugcuuuaucucagaaugcuugccaaguaguaggcauacaggaauugcugguuaaauggauaguauuuuugccaguuuuuguugucaucauuauuguuuguuuuuguuuuguuucauuuugccuuuucuuggaccauugaaaguuuccuaucauuccugacuguuuaaauauuuaccuucuuggaucacaagacuguucuuuaaacucuuuauguaaacuuauuuuugacuguguggggaggcuuccuugugugagaccaggaggaaaaacagagaucaugcuuuuuccacauggggauacccaugaccacuucuacucugauuccuguaaaaguucaagagaagaaacaacacccacacuagaacuggucucaaaggauauagcaaaucacccugcaacauguuauacaacuacugcucuuuugcuuauuggccauuacuccuugaaacccaggauuuacaagucacuacuaccucugcauuugcccugaaaauggucuucucaaaucacuuuaguucucuuccuaaaacacaggucagaucgugucauucucuuucuugaaaucuuggaauuggcacaccacagcuuguagagcaacagaugcauuccuuggcauaaaauuuaaaguccuucacaaguaguccucaggugccuuucuagccucauuugcugugugguucuucuguaggagacacaucccaagcacccagugauaacugucuuuuuguguuugugcugugcccucagucugcagugacuucccuguucauuauuccuucugugucuuuguccaaaauuuucuccuucuuaggaggacaccagucauuggauuagggugccuacuaauucaguauggccucaucuuaacuugauuauaucugcagagacccuguuuccaagcaaagucauauucacagguauaggaauuaggacuugaacauaucuuuuuuggggacacaauuuaaacuacaguacauggcucuagauauuuuaaagagaauucuguuuucuguguuucagaucacuugaacuagugucugucauguuucagggaaguaacugagacuuugguuccuugcuuuucuaaucuugaugaguaguuucagaaaugaggccuggcuucaaugcuaaccaggcaaauccuggcaucauggaauuuuaaaaccaaaaagagucuguauaagucauuuugcuuaaauuuuacaauaagaaaagguagacaaaucaucuucucuuacugugccugaaggcauaaaguggacauaaauaauacccugaugccaaggacaguguucauucuuuauguucagcaaaaacagaaaugaaauaauucagauuagaauacauuucccugaaguggucagcuauuuuuaggcaaaagccccaaggcuuguuuucauaccccuuuugaaucaugccgaguggccccagucauaugaagagaugucaucaguaaagcaccaggaacuguggucagugcucuuggaagcuccacaguaacuguugguugaauguagaagugaaugugaauaugaagagaauaugugugccauggagcuaccaauagcucaaguccuguguauaagggauggcagggaaaggggcugggagugugcugggaauuuccauagauuaucucuuuuaaucuucacaacaggaccuauaaguacuccuaggggagaaguucccaaaacuauaaaaccggugggaagcagagcugagauuugaucccaagccugucucauucugaagcacugguggccuuuguccugcuucuguuuccuuuaccaaauuaugcaacuguuuuuuccucuacuaauacuaaaaugucagugucucaccgcacuuugggaggcugaggcgggcagauugccugagcucaggaguuugagaccagccugggcaacaugguaaaacccucucucuacaaaaaauacaaagaaauuaaccaggcaugguggcacaugccuguagucccagcuacuuggggggcugagaugggagaauuucuugagcaggagguugaggcuauggugaaccgagauggcgccacugcacuccagccugggcaacagagcaaaaaccugucuccaaaaaaaggaaaugucaaugucaaaauuauauuuauguauuaaaccaaagacaguauucauauguaagaagaauagaguuuuccucuuuuuuuuuuuuuuuuuuuuugagauagagucucccuguguugcccaggcugcaaugcagugaugcgaucucagcucacagcagccucgacuucccgagcucaggugauucuaccaccucagccuccgcacuccaguagcugggacuacagguguguaccaccgugcccagcuaacuuuuuguauuuuuaguaaagauggaguuucacccuguugcccacaaacgccugggcucaagcgaucagccggccucggucucccaaaguccugggauuacagacaugagccauugugccugaccguuuuguuuuguuuuguuuuuguuuguuuguuuaacagacgggaucucacucugucaccaagaccagagucggagugcagugguaugaucauggcuuacugcagccuugaacuccuaggcucaagugauccucccacuucagcuuccuaaguagcugggacuacagguguauaccaucacaaccagcuaauuuuuaaaaaauuuuaaacagucugggucuugcuaugucauccagucuugucuggaauuccugggcucaagagauccuuuuugcuucagcaaccuaaguagcugggauuacagguacgagccacuguguccaucacucguaucuuauaaaauacuuuuaaagcauuuggaucaaaaaaugagacaaucugaaauacauacuuuuccccucugugucuuuuuaaaaauuuuuaaauuaaaaaaauuauuuuuagacuccugaaucagaacaauuguccaugauuuuuauuuccauccuuuuuucauugaaaaauaacaugaaacauuuaauaagguguuaugaucaugauuaaauuuuaucucuucuaaaguagcuguuuucaguuugauauuugaauauguguuauucuucaaaaauaaggauugaacaacuugguuauaaauuauaaugcugucuuggcaaaauguaauuauuagggcaaaauucauuuaaaagaaaaugcaaggcaauuaaaucugauuuuuuuuacuuuuaacaaaaucaacauauguacuauguuauaauaauauauagcuucagagccuuuuuaaugaccucauuuuauuuauuuauuuauuuagagacggaaucucccucugucacccaggcuggagugcaguggugcgaucucggcucacugcaaccucugucucccaaguucaagcgauucuccugccucagccuccugaguagcuaggauuaugggugcccacuagugcgccuggcuaauuuuuguauuuuuaguagagaugggguuucaccguguuggccaugguuggccagguuggucuugaacuccugaccucaaguguucugccugccucggccuuguguaauuuuaaaauuuaguggucugggucauagucaucagacuguguugauuguaagugacagugaacuaauuccaggaauagugcuuacucaggaacagcuggcuuuggguacugccaggaaucuguuucauucuauugcucaccucuacuuuccuccacgcagacuuuugcugacuucauuuucagacaggcccuuacuucaugauggcaaaaauagccaccaccaacuccaggguuaccauuuacaagcugaacaacugaguuuuggggcuggcucacacagccagcuugggucauguggccaugucucauuagccagaccugaaacauggacucccucuggacugagaguagagggaagaugguuugaaaauaaacuuggcuuauuauuaucaagauuaggaggaaaggaugcugggcgugauaacuuagggcacagcuuguugaaagaagguacaaccagaacuuuauauguuuugccguagggauuuaagaaaacaaaucugcuacccaaaaagaacauguucaguauuaacugccugaaaaaggaaaagaccaaaaaugcacaauuugugauugaguaccagacacuguauuaauuuucuuuaaaaaucauaacauuaccaauccucugaggcaauuauugccauuuuggagcacuuacugugugucacacuuugugugaggcacuuuacgcuuuguaggacagcuuugugagggcagccuuaauauucucauuguacugaugaagaacuaggaggccagaggcauuuggguuugaauccagaugugucuuauuucauuuauaucaucuccuaguuuuacaguuugcuuuuguuagucugucuguguguccaucuauccuccucuguccugucagagcucccccucagcuucucuaagcaaggcccccuuucaccucgggcaccucuccaguccauugggaaaccggcucaacucuguccucugagcaugccaccagugucuguccccuuucccccaccucugcugcuggagcucuagccuucauuaugaagggccagaacucuuauuaugaauucuguuuggccuuccugcuuccagucuucaucucuuccacccccauuuuccuuaacagccagauugaacuuucaaaaagugcagaccugaucuuaucaagcgucuguuuuccuuggcuucucauggagggagaacaugauccuggccccugccugccguccuuuccaccucacggcacucacucucuggccuuuuuucuucuuccuucuccagugcagcagucuuacaccuuaccaccuccuucucuguuccuauggugcgcaucauuuguuuugcuucuucaggucuguguuuacaugucacuucaaguccuuagggacuucucugucccuuuccccuaccccuucaaucuggaaaucugaagcuguuuacugcuccuuuuuguacuuuucacaguuuguagugauacauucgucugugauuauuugccuaacauuccccacugaaucaugaacuccauaaggguggggaccaggucugucugguuaauuaauugcugagucucuagcagcaaccacagugccuggaacaucacagacacucaaauauguguugacuggacugauggguuaaaaacugaguauauccaaagcagugcacuuuuaaaugauuaucuuuucuguaguucccucacucuguaauuuauuaagaaugaaccuauguuuuccucagagcaguuuuaucccaguugcuuuugguuugcuuagaaacaugcuuccuuucuugcugacuguaauugcuagcaauuccagugcucuacagugaugcacuugguuucugaaacuccuggauuagagcuagccauaaucggggaagauaauaaauuuuaggguauguaauuccucuuaauuugaccugagugugggugagggaaagaagagaaggcucuaccgacuugcuccaaaugguucccugcccaauaacacagaagccuuaacacuccuuuaacucggauaugcuguccccagaacccaggcauccaaauuuagucuucucugcauguccuugugauuucugacugccaucuguguccaaauuggcuuuggaaggagaagcuuucucuccagugauuuauuauuuaaagcagucuucucagcccuuaucaugaaaacuggcaauuuucauauggcccuuuggaauccacauacaaggcuaucugucccaggcucacuggugccccaguucugaggggaucacuagcccugcaugcuuguggccuuuugaugugcacacaggcauggugacugggaagcuuaucugucugugaucaucucaugugcugcagauaacauaacuucuuuugcccuuuuuaauccacaguuggucauguucggaguuugaccugaaugagauucgccugauaguuuaccaggacugugacaggagaggcagacaagucuuguuugacucuaaagcuguucaaaagauugaggaggugacagcucagguaugaaaugcugauuugcuuucuccuuuucuuuugugcuuuuaaccacccuucugaucaaucauuuauuaaucuaucaucuucucuuugaguuauauuauacagugccauuaaugguucagaagaaacauaagcaagcauugaauccuuuaaucaaagcccuacccccaacaggcaugaguaugcucacugcuaaacacaagugaaacuguuagcaaguaaucauggcaggagcuaagcaguguacuauuaauaguacuagagguaaauuugcuggugaguugcaauccaguaagauuuugaugccaagugagugccucaaauguaaugggaaagcagaacucuaaaauucauaaagugauaaaguguuagugugaagaucauucuguccaguguuucucauggauaauaauaaguagcacuggguuaaacaaaauuaaacagcuuugcuuauuuacaggacuuccauaugcaaaccugcauuguuaucuucaaaaaggauuguuucucaaacccuucugaccaggggagcuuuuauuuauuucccauuuuuuuuguggagaguugggugguaguggugguggugguggugguguagggugggcgacaagcaauggguagagugaggauagagcagcucuugaucccuuggaaccagaaugggaaugguaaaguaacauguuuaaggugaggagagucugauccuuucugggucuuuuuuggauaugauaccaggguacuuguaaauucacuuuagaccuuucauucucuuuucaguauuuguucagaugccuacaaauuaaauaaauccacuuguauucauucuuuuuauguucaauaaguugcuacccauacugaccaaauacuggcaguuuguagaaugugcagcuaaguaaaugaacaguuuauaacgcagucuuugucucaucagggccaagggguuguuuuccugcuuuugauaaggaucauuucugcaggaaggaaguguuugguuaaacacaguuuagcuggguggauuccacaguguuuuaaaguggaguucugccagguggcuaaucauuacaguaguuguugggcuuguuagguaggugaagggagggagggggaaaccaagaaaucucucaggugauucacuguaggcuuuccagguuagauuuguaacagaaauuuaggugagccagcacuugacccuuugguggacaggagaugguuuaccucuuaguuucuugaauuauuucccauuucucugaaggccucacauggauggucuaguugagcagcuaucacuggggcugcucauagugguggcagguggaggggaaaagaaacacaaguuuucaaaaggaacuggaaucuucaguguaccagagcacugauaaugcuggaaucuggaaacauaggcuuucuuagaagcauucaucuaaccaaaaaggcaucuuagguucaggagguuuguagcuugcccaaggcuacaaaagaauccagucagugcucuauucacuacaccaggugguuucuccaauuauagacuguucagcauuguacuccagccaaagggucuagcagucugaagcaguggcaccucgugucacuuaggcccucugaggggcuguguuucuggcuuaagugagauugaguaacagcuuuaucuuuagcguguugagggagugcugggugcucaggaauaaucaagugccacuuugaaugccaucauugcuggagugacaguugugguccagcacauuuuguguuuuccuuacguucuuuucccauuuucaguccccaccgccccagccucccuuggcaagcacaaaacgucaugaguuuguaucaagcacaugacugcaggcauuugcauuagaccaccagugugacugucacauuggagauuagauaagcugcaauugcauucauguuuuuuuccaagcaaaagcuacacaaggaaaaaaaaaaggcaaagaagacucagaauagaaauaacuuaucauagagggugcaggaagcuucuguagggaguaauauguuuggggagagguaaauauuaauaaagguuuauccuuauacguuugucacugugauaaaaauuaguggcaaacucuagggaauguauaguagagcauccucuguugucuuuaaccuuugaagaccauauuuccaucacaugcuauguaauucacaguagcuccuguuucaggguuuugguuucaucccuuacaaauucaaccucaugauuuuccuuccuguuaccuuuaaaggaguaguagaggaggugugucauuaaaaacacaaguaggccgggcgcgguggcucacgccuguaauccagcacuuugagaggcugaggugggcagaucacgaggucaagagaucaagaccaucuuggucaacauggugaaaccccaucuccacuaaaaauacaaaaaaauuagcugggcgugauggugggcaccuguaagucccagcuacuuggaggcugagacaggagaauugcuugaacccgggaggcacggguugcagugagccgagaucaugccgcugcacuacagccuggcaacagggugagacuccaucucacaaacaaacaaacaaacaaaaaacccuacgagccagucugcccaaauuaauaguuuuguuuuauuaguuccauuugcuuaguaaaaauuuagauuugaagccucaucuuucuccucaucaauguaauggauuaugacucuacauaauacuaaaaagcuaauaaucaaaacucaaauaaccaaaacagaggucaauuaugugaauugaaguguaaauaauaguuaaauuauuaaaagaggauaaagucuuaauacauaaccuaccuccuuuugucuagaacccuucuucagcauucugccaucccaaaccauguuuuugucauuauuggggaaaaaaaaaagcuucuguuuuuuaaugcaaccuaggcaccagaaugcuuuuaaaaaggaauucccaaugaagaacuguugacgaaccugauauacuuaguaaucuuuuaccuugccugucucucuuaaccuagaaaacagaggauguuccuauuaaaauaucagccaagugcugccagggaagcagcagugucagcagcaguagcagcagcagcaucucuucccacaguucuucugggggaucuucacaucaugcuaaggaacagcuuccaaaguaccagguacaaccaucccuucugugggaauagccccugagguuaaaguuauuuacuguaauuucuccuugggaaauaaugccugcucgagggcucuacuccaggaauaugaggacaaguauucaacagaguacucuuaaauguuucacaucgauguuguuuuugcucuuuggcuuuuaucuccaauaaaaacuguaaucaagcagagguaauacagccuacugugaacuggaugaggaagaaauauugccagucagguaaauuaccuugcuuuguuuccuuugcucucugauccagaauaauaaacauguacuuuccaguuuuguuauaagaauuccuaaggauucugggaauguauaugggcauccuaagaaaauagaacauaccaguaaaaggaagaaagccuuguaugggaacagaaagaaauggcaagaucuaaucugaguaugaaggauaaaaggcugauggcauuuuuuacacugugugugugggguguguguguguguguguguguguguauaaggauagggguuaagguuauugagaaauauuggcuaacaagauaaaaaggaagaaauguuuuauaaauauugaauggcaaaagaauauuaauugauggaggauauauugaacuuuuucuuaaacccauguagaaucuuuucuacuauuuugcuggaaaaacaauacuagggaaguuaccagcaaaugggucuggagaacuuuguuuuuucauaguuaggauuugugccaugcauuugcccuuuuugagacacagugcuccagggucucacagcagucugcaguuuaaaaaguauggaguagaauuuucagcagguugagaaucacaguuggcauguggcccuuguaccccaagaaaaagcagauuauaaaugaaggagguggguggaaguuaguaauaaagaaugugaaaaccaguugguuucugucugcauauagugggaagaaguugguuugagcuauaacgagagagaggaaccuagcugagcagggcugauagauuuaucuuucuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgagcagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggaucacaggcgugagccaccgcgcccggcccagauuuaucuuucucuuuccgccucugcaaccgugcauaaguaaguguguauuugugcgucagcguauguaugcuugugugucuguguguguguauguauuuggaguuuuaaaaaaagauuuggaagaguauguuaagggugauucccauguuuuuccuuggguggaaagcacacugacagagaauauaguuggcaggucggggugcagaaccaugguugcuuugguggcacacugguuugcucagcauucauaccuguccuguucaucauugugucacuagcacuuagcacgggugcucagaauucugcaucccaagacacucauucagaugucacuaggugaaugaauguauugggguauacgauucuagagcuccaggagagcucuuggucuagagacaaagauguaggagguauucuauguaaauaauaaucaaaaucaaaagaauaguugaaaaggcgggcaguuaguaggguugaccuccaggcaaaaccacaguaagggaugaucugagaaagaagagagucaaaauggagagucaugaacagcaucaaauauauugagagaaguuuaauaaagcaaacuggaaaggguccauuggauuugaccaagagggaggaggucaucauuggagcaguugaacuaguuugagcuaagagguaaagucaggcugugguagauuaacaagccagugagaguagaggaagaggaggcaggcaguccacucuuugguugguaaaggcaugagaaagacuggucagaagcuagaggggucaaauguuguugaaauacuuuuguaaaacuucagaguuaucagaccaucuguuaucuuuugggcccucauaaaacccuaucugcagcaaugggcauuuuuuauuccacauuguuaauuauuuggcugaauaauaccgaaccauauuuuuuucaggauguuuucuuaguaccaagagaagaguuacaguuauuuucauaauuuaaucuuuguauuuagaguuuauaaauggagauaauaguaaucuuuguuucucauaacacaaauaaaaaugaacucuaauaaaacacuuggauccuaggugaugauguuguguacagagaagaaaucacaaacauuaguaauacuuugggggggaaaauaggcaaucgccauuauaaguuaagauuguaagaugaccacuugaagcuuugagaaauaguuuuaaucaccgaugacacuaacgagauuaauaaacauuauuuucuguugcauugcaugucauguuccauguacuaacuuugauuuuguuuucuugcauguaguacacaagaccagcuuccgaugucaacauguuaggggaaaugauguuuggcucaguugccaugaguuacaaaggcuccaccuuaaagauacacuacauacggugagucugggcuuccuuuucuacuaguuuugagaaguggaacggugguauugacuccuuaacucauaaauuuauuuuuccccucuccuuuuuuccccuccacaguucuccuccacaacugaugauuaguaaagucuucucugcuagaaugggcagcuucuguggaaguacaaauaaguaaguguaggauuuugcauuccccacccccauuuuuuaaaguguguauuucuagauagacuaauucuuuaagggccauaaggcauuuugaaaugacaagcagaaugaguccaaauuaacaaaggggcuuuaaaaguggcuacuguccuauaaacagugagugggaaaagaccuuugacuuuauuagguggcccuaaagacaaauggcugucuuuauauguuuugagucuccaucuguuacccagucaccaauuuuuaauuuccugggaaaucaaaaauaaagaacaaaagggaaggggcuacauuauucugaaauaucugagaacuuaaacucauuuuggcauauucauucauguauuuugaacuuucaagcagaaauauuucauauacuucauuuuuuaaauaaaacaacaaaacaccaguuguacuuugauaaguuugaaagaagcgcuuguuauaaauuaaaggacauucuuaggggucaaguaaaagcuguuuuuucuuauccugggaaauuaaaaauauuucucuauauauuugaauaccauuaagugagucuuggcuuacucuucaacaaaacaguuugaacauuuaacauuggaaugucaugacuuaagccaauaugagaauuuuuauuuauuucuugcgagauuuguuuuuaacagacccuugggauuaccugaacguuuauugcauuaauucccuuacgugcagauuuaaguaaaaauuauuuugccuucauuaugcuguauuauucucaaagucuuucugucgucguuuuugucagcucuacacacagcaaaagucuuuaauuguuaauaaauacaauaaauuauuaaaaucugcuucccucacauuuuuaugaguaauucuuuuuagaaguugugaaaugaaacuccuguaagaauuauaauuucuguugcauuuuauuccugaaaaaaguugcugaauugcucauugauguuaaccaagaguaaaaauuaauuucauuuugagaguuuauguaaaauacuuaaaaugaaugucaacaaguuggcugucaguugcuaaagcaaaauguagaaaugaauaacaguaucucgggugucagucacugaagcaaaauuuagaguuuggugucucauuauauuauaugaaauuguuagaaguacaguuguuuaguuacacggguugagcuaccuccaaaauagcuuuuguuuucuuccaacaaauucaccugaaguugcaaguuuaauucccuuugguagaugugagacuuuguuuauaaagaaaaguauugagugacugaucagucguugucuauauuuggaagucuauuagaaaacagcuuuaguagcuucuugacguuuuuguccucuuucuccuuuucccccccaucuccggauauagcuugcaagacagcuuugaguacaucaaccaagauccuaauuugggaaaacugaacacaaaucaaaauaguuuggguccuugucguacuggaaguaaccuagguaaaaucagagauacaaacaaauucuuucuuucugaauacacuauuguggguguguguuuugcuuuauuugaguuugucguggguuuuuuuuuuugcguuaucuuuaaucuguguuuauuuuuuuuguauguguacuuuguuugcccucuucuauguguuuccaucucuaggucugcugcaagcaugcagcagcaaacugcugcaggggguagcugaaggaggaccucuccggcucacccggagugcuucuuucuuugcagguuuguguggaaugcugaguacagugugacccacacauauuaauaaauccugugcagguucuuaggaaaaauccuacuugugccucucuagaaauccaaggggcucuugugaucacagauauugguuucaaaugcggccaaauccaugguguuucgaaaauucugccaaugaaccucucuuguaaaugucuucgcuaauacucuaguguaagcugauuuugaucugaaaugagcccuuaguauuuccaagaggauuguuuuuuucugauuuuucugggccucuucugcuacuaugaacuguuucccuuugccuuggugucuuuuauccauuuauucaacugcauccuuaccugcacggaguuucauuaaaagucacucuaauaagagcauggaagacuucucucucucucucucucucucucucucucucucucucucucccucucuaaguaguguaaauacaauuucuagguuauuuacagguauagucaucuuggugucucugagauuuaacuugucuuagcaugauuaaacaugugaggaaccuccauuacuaacauuuaaaguugugaguauagcaaaugguauuuuccuuucuguucuuuguagccugaaauaugcuaagcaccauaguuaacugacacccugauaaaauugacacgcuccuaccuacuuagagugaggaaaaugcauuuaaauacucucuuuaaaauugugaaaauaaacaugcuucaaaaaaauagcugucaaguauaauaaucaggcagagcacugggcugcuuguccauuuaaaacuucacuacagcagcagcauaucuaccuucuagcacaauaaguauacagcuuaggucaaucugaagcauuccuagaagucuguaauacuucagaguguuuuccacaguucaugccagaacaugaguuuuucuaaguaacucuacaauaauacuguguauggguguauauggaaagaaauggaggaagaaauauuugaaaaugaguauaaauguuuucuaucugccaagagaguggguuauaaacagagaaacauuuuuugaauuuaugaaaugguuuucaaguauuucucuucccuaagucgccuacaguuacuaccaaaacugauuauaaagcauuuugaaauacauugcuauuuaaauacuacuacuaaugaggaaaauggcuaaaaaaaauuaccugagaauguuuauucauugcaucaacugcacgaaucauuuauuauucagaguuuuuuuuuuaagaguugaacaucacucagaaaaguuuguaugcuuacaauugaauacaggcagauuuuuaugagaugguuacuugguucucuuuucuucucaucaucuuuuuauauauuuaauuuugccuucuaguuaaucucuauuaaaagcuuaugccaaucaucaguagcaguagccuacuuugaaauuuaaaaauuacugcagucauuuuaaaaacuuuaucucugaagagcccaauaacaugguuuucuuguuccuuuaucuuagcacacagcacaccaguugauaugccaagcagaggacagaaugaagacagggacaguggcauugcucgaucagguacuuguacucuguuuauugguuuaacuaacagagugaacuaucuacagugguguggaaggugggaaaguagaagacagguagauaacccucauccuguucuuuguuuuuuccuuccuaagauagucugacauaucuaaagaucugaaacuuuaauguacaguauccaugagugauugugcaacauaaacuaguuuuuucuaacacucaaauuuauaugagacuaauguuuguuaagaaauuucuuuccagaaugaagcuuccuugagcccauuguacuaguaaugugcuugcuugacuguugaguauagacucagaggaagagaaggguuuguggaaguaaaucuguccugugacagugggaggaccagccagcugaccuggucaccguuucuucuguucuagagacaugcugaucuagauuuuaucagguacccuucucuccuugccucaaggccuaaaccuuucuguuacugcuuuuaggaucuguugguuucaccuuuuguaugugaccucuuuugaguuuugacuugugguucagaucugagauuuuguauuauaagagaaggguggugaaugagugaacugaaauucaaggacuggaggugguguguggugcucugcuugaugaauacauaugguacaggcagccccuaccuuccagugagacuaggagcacccugcugguuucuccugugauacaugacaccuucaacaaaugggccagccaggcguugcucagacuggaugcaggccucacaugauguucuucuuggccuuucacucauuucucuguccacacuacuccaagguccuugugcuccuguguagccucagagccuuuuaacccacucugugcaacucugcucuuguguuaauaaaugaaaugugauuuguuacugagucuccaguuugguuuacauaugucacauaauguaaaguaauagcauuuuauuuaugguuaaaaucgauguguuuugguguucauaaucuuuucuguaaaguugagcugggaaccuuuggucagaaacucucauugaucaggccgagcacaguggcucaccccuguaaucccagcacuuugggaagccaaagcgagcagaucacuugaggucaguuugagaccagccugaccaacauggcgaaacuccaucucuacuaaaaauacaaaaaaaaaaaaaagaaagaaauuagccaggcgugguggcgcauaccuauaguccuagcuacucaggaggcugaggcacgagaaucauuuguaccugggaggcggagguugcagggagccgagauugcgccacuauacuccaggcuggacaacagagacuccgucucaaaaaaaaaaaaaaaaaaaaaaaaaaagagacucauugaucagaccuguaucauuuucacuuacagccauaacauaaagucugagaagauaaagggaaacuuaugaagcacuaaguaaacuguuuugcuuuuguuucuguuuaauggugcugaagauaacuccuccagucuuugugggacacugucagauaacugaguuccaucaguuacucaaggacaauaagcauguguuuacagagcuuagugucccaaagcucggcucccugccuuuguaaccaccugcgacccagccccugacaggacuggcacuagggcuuuguuaugguugacuuuccuggcaagaagauguaugugggccuuaccagaagucgcagagugggaagcacagccccuagaaccaagaucacucuuagucaaaauggcugucuuagugggugacagaauuuaacauauuugccucuguguggugggagcucuuuagcucucugugaaagaaagaaagaugagcaacauucuacuggggcccguucugaacacugacaucacaguuucugcacagcuguaaccuuauuuauuuguuuaugccccuuuuuguuguggagaaaagauucagggaauuugagggaccuaacaaagaaacauuauuaggaaaaguuuggauuuuccuagguaacuuuucaguuuauaauauaguucauauaaaugguucauguuguacagguugaaaucuuacuuguuuuguauucagauucuaaauugcuccugaaacuacuuuuccuugcucuuugagaaacaggaaaguugggaagccaaguucaaauuaaaguagaaagucagauuaaaaguaaagauucagccagaucagaaugcuuuuuugcaguccaugagaggaacuagggacugaccagauuggaggaaaugggggauagguguugauaccagugugaauuuugaaagcuggagaaggcuggcuuuccuugguaguuugacuucuauucugggcagucuuuacuuccagucucugguucuccuguugggaggaagggagcacagaugguggagggggcugcaaauggcccugaguggcauuuugcucucccugcuauccugguagauguguuuaccuucagauaucauaccuaggagugguucagaagucacagaguccacgucaagacuagugugagcuucacaccugugguggcauuuagcacucuuuuaauguaagaacucuuuauguucacacuguaauuuguucgcuaagauuucaucuccuuauacccaucuaaaauuguguagggaugaaggcccaaguucugaaacagagcaggagcuccaagugugagaguuaaguuagcaguagaagauguagagaaauuaaagacauaaagauauuauuuauucucuuuuaggccugcuuuuuuuuuuuuuuuuuuucuggcucuguugcccaggcuggugugcaauggcacagucuuggcucacuguaaccucugccucccaagcuuaagccauccucccaccucagccucacaaguagcuaggacuacagguacauaccaccacaccuggcuaauuuuuauauuuuugguagagauggaguuucgccauguugcucaggcuggucuggaauuccugagcucaagcaguccacccaccuuagccucccaaagugcugagauuauaggugugagccaccacgccuagccuaggccugcaauuuuuaacuuccuguccaaauaguugauaaauggggaaauuuuuaaaaauaguuuuauuuucuagaaguuuuagacuuacagaaaaauugagaagguaguacaagaguucccauauaaccugcccucaguuuacccuauuauuaacaucuuauauuaguaugguauauuuguuacaauuaaugaaccaaugcugauacauuacuauuagcuaaaguccacaguuuuuuuuauuuccuuaguuuuucaucuaauagccuuuucugguucugggacauuacacuuaguugucauguucuucaggcuucucuuagcuguggugguuucucagauuuucuuuguuuuucguaaucuugaggaguacugguuagguauuuuguagauugccccauuauuagaauuuaauguuuuucucaugauuacacugagguuguggguuuggggaaggaagaucauagaaguaaagugccauuuucgucacauccuauaaggguauauaucaccaacauuauuuaugacuguuaauauuggccuugauuaccuggcugaggaaguguuugucaguuucuccacuguaaaguuacucuuuauuuccuccuguccaggcuguguacuuuggagagaagucaggaugcuuaccccauaccuaagggguggggaauuaugcugccccuccuugaggacagaguaccuacauaaauuauuuggacuucuccuguguggagauauaucucuucucccauuuauuuguuuagucauuauucuacuauggacucaaagauauuuauuuuucacuuuuggcuaaaacccaauacuacuucauuucuauuauuuauuuauuuauuuuuuggagacggucuugcuugucccuaagcuggagugcucuugugugaucauagcucacugcaucacugcagccucgaacuccugggcacaagggauccucccuccucagcgcccugaguagcugggacuacagucaugcaccaccacacccagaauuuuuuuuuuucuuuuauguagaaacaaggccccacuauguugccccggcuggucucaaacuccugggcucaagcaauuuucccaccucacacucccaaaauagugggguuacaggcaugagccacagcaccccacaacuucauuuauuuguugcucaaauuguuucgguuuugaccauugggagcucucucaguaggcucccaugcuccuuuaacauaccucuaucugugagggguuggggugaguauuuugagcacuuccuuacuuucuggcaagacaagaugcuccagagucaucuuauguauuuccuaucccuguccuagaaucagccauuucuccacuuauagaaugucuuuggaaaaagcagcacaagcuggggcagguauggagggaaaugcauccucauuguauucucuuuuggauauuuugaauaugucuucuuuacauauacagauccaaaagauagcuuuuuaagggguuauucuagugguucccauuagaaauuuucaaguagggucuugggagagaagaggguugggugucagccauacuaggagguugcaucagcaaaguucagugauuaaugggacacagguuauggaggaggaaggaggaaccaaggaugcaucuccaguuucuaaccugagaaagcgaguggaaggugagcauuauccaguacagggaaagcaggaggccaggucagggagacagauacugagauaauuuucuagcuacagagauugggauacauuuuuaccuagaaaugucuacauguucuccaguugugcauagucagcuguaauuuagaaauaggaaacuggcucuagugagauggguuggaguagaagcuaaaauuuguuuuuuuguuguuguuuuuuuuuugagacaagguuucgcuuugucacccaggcuggagugcaguggcgcaaucucagcucacugcaaccuccgucucccagguucaagcuauucuccugccucagccucccaaguagcugaaaucacaggcgcacaccaccacacccagcuaauuuuuguauuuucaguagaaacggaguuuugccauguuggccaggcuggucucaaacuccugaccucaggugauucacccaccucagccucccaaagugcugggauuacaggugugagccaccgugcccagccagaagcuaaaguuuggaagucuugaguacaugaguagaguaagguucagagggcugggauugagaccagugucaucaagccuugucuauugaccugaauucagcuuuaaacucuuccucgucaagguguucacaucauugauaagaaaaauacuuuuuccauucugucugcaacugcauuuccucuguucuuaaaagugguaaaauaaagaaagucaguauaaggagaacuuacaauauauacuuuuaaacauuuuuauuuaaaugcuuugaaaugaacuuucaggguaagaaucuacauuaucauaguguucaaauaagacauguguuuuggucacucugcagauacaggauguauaaccauccaaaauuugguguagaugucaagauugaugacucuacaugcacacaccaagaggauaugaaaagguuuauuacucacauaaugaggcuguucuggggagacaacagggugggggcuucucaagcugguuggagaaugucuucagagaaugggacaggggauuacacuggggauuuuaugaugguugcgagauaaggcuggggugaggguuccugcauaugguuugaaauucucacugguaccaaaggagugagcaccugggcuuuccucaucaguuugcccagguguggagcagaaagggaagagggagaggaggguaaagcuuaaaagcuaucaggaguugaacaucaagaaacaagucagguucuuuauuacagugugggaccauugaauaaugaaggauggcaucccguuuguacgugaacccuucaccaacugaacugauagagugcuuuguagagaggagcaagagcaaaggaggguacuguuuuuauuuauucuuugugucagggaaaaggcugugacaccccauugaccuugcacaauuccauacaggcaaaggcuuaagcugcaucuuaucugagcccuggcaguacaacuugauccucuuggaacacuucccuaacuuccccgggaggcugucaugauaguuucucauccacuccagaguucugaugagguaugggacuuucugcccuacccgccucagacuagagcugcaguauauaaaagcauguagcugcagucuagaacugacuccccagcaacgggauaucccacaacuugccuuguaggcaucuggccccuuuuguguugguguuguccuuuuugauguauggggcaaagaucacugggagcuggcaccuuuggcuuauucuucuuuucacugucuauguaaguaauaaacuauccaaaucuaaaagugccugguuguaucuuaaccaucgaaucuuggccuuggccuuagccuugcuuugccuugucuuuauauaugugagcuugauaaucuguaguguggcucaguuucuuauuucuuuauauuucuccuauuucagauguuugguauuuuccuggcauggauauuuaucuuuuucauuuccacaaauuuacuuggucuuuugccuuagcuuuuuccuuucuaaauuugcauucuuacauaccuguuaaagaaaaauuagaaaguaaugaagauagcaauaaaaacuguaagggauaaaggaauaaaucuaagaaaaaauaugugauacugguauugagaaauuguaauaacuuauauuaaaagaagaccuaaauaaauggagcgauacaucaaauucugcaaauuaaucuauaaguuuaguguaacuugaauuaaaauccuuugugaagccagacuaaauaacuuuuacuuaaaugaaauaauaaaggaccacauuuuuaugcccuccguaagucuuuuguagacaccucuuucuuagagcccaaacuauaaauaaaagacacaguacacuagaauaauuugacauauaaaugcgcagagugaguugguuaccaagguggcuagcauuuauaccuuagauaaauuaaaauuuaagguguuuuagcauacaacauauccacguaacaaaacugcacuuguaccccuuauaaauuuuuaaaaccuuuguauaaauuuuuuuuaauuauacaaauuuuuuaaaaaggaaaaaauuuaagauguuuugaaaucaaggugguaagaacauuggcuuuuuauuaaagggccuuuauaggaauuuuauuaaaacuuuaaaguaccuguuuggcuuuugaggacccuuuaaaguccuaaaaucauuuugugauuugggaacuauaauguauuccuuauaauuugauuuuccuauuaacauuuuugguuuauuuuaaaugaaauuuuccugcuagacaauaauuacagcuauacucauuuaccuuuuaaaugcuccuguguuuguguguugagaaauacaauugcuaaacuucgaggaaccuuguauuuuugccaguguuucaagcuaaaacuugaagauaaguagugucauauuacaguaaacaaagaucauuauuguguuguggauguaauacccccugcgucaaacauauauaaaaagugcucagauucagagccauacuaucacuuaugccauccaaaaaauuguuuuuaaugaagacaggggaaaaaagaaaaucuaaaugccguauauacuguguuggccacaggaaacuuuuaacaaauucaguauuugaauucuguccagaaauguguuucucuaaugcuucauuucugucacacuugaagagauggguaucacugucauccugcacauacuguuugcucauucuucauccagcagcguuucuugagcaccucauguggcggacauuuuuuucuaggauaugagaauagaucaguggucaaauggauauuaucccugaucucacagauuuuauauucaauaaaggagagacagauaauagacaauaaaauguaggcaaccacuuaccacugaggaaaagaaaacuuauggaaggccucucugagaagaugacauuucagcugagacuugaauggcaguagggaccaacuaugugaagaucacaacaaagagcaucuuagguacgggaagggcuagggcuagugcaaagauguaucguggggaugggagaguggugcagaaugagccuggagaggaaauaaggggucugaucccacugcuacauuuuuuauuuugaugggauuguuuccacauguauuugaauggcugcugaagacagagaagaguuaggaguucucugcagcauccuuucccuagaugucuccuugcaaaugaaaaugcuuggcagggcauagaucuguucuaggguccugcccugaucauuugcuguagcccuauuuccuggacaaagucugagggugcugccuguuuggaaccgugaucacauuuuucggcagaauaaauaagccaaccucaaaacuuuuuccuuugaagaaacuggagcugcuucugagugcuugacuucugcaccuucuuucucgacuuaccacauuaugugguuauguuguuaaauccuugaagacuuuuguuuguucuucuucucccucagagugugagcuccaugagggcagaaaccuacccaaucugucauauuaacagaucuguucccagcagcucauauaguaccuggcauauaguagaugcucaaugaauauuugaaugagggggggaaaauaaauccauccauauauauaaguaggaguaugcuuggauuuuuuuugguaaauauugauauuaucugguucuuuucauauaggaugucugggauguccucccuuugagccuuuuccauggcuggcuuuuguuggcauuuaagucucaguugagaugacccauuuucauaaaggugaugucgaccacugauuaaagaauuuaugucuaccacccccaaaaaccuuugugcuaguuauuuagagaaaaucaugguaacuuauuuuuauaguaguuaccacugucugaaauaaucuuauuuauuccaugaguguaagucucuuaagggcaacuacucugccuaugucccuucaguuuccauccuaggucccuagcauggugcaggcacuuaguaaguguucaguaaauauucguugagugaauggauuugauuuaagagcuucagggccuuauuuggucaaaucuaaauucuuucaucaaauaaucacuacaguguuuucuaguaaacugucacaaguagcaaaaauuuuuuuucagagaaaguuaaacauuaaucuugaacuugauuggcacaugccaggaacagcagcaagcagcauuuuaaaaucuuuagauugauucucuuuucuuguuguuaaucucugcagguauaaauggaugcuaguugaagauaccuccuuagauaggaggguugggacaaaagcacaguuguguuuaagcugggcguuaaccagauauaaaauguuaacaguaaucuggugaugggacuaguguuaauuuuaauuuucuucuuaaugcacaaaacugccaaagucuuugcaaccuauaugcauuaacuuuuuucuaauuauaaaaguauuguaaaagaaaagcuccuaaaaauauuaaggaacauuuagauauagcacuuuugaaacugaaacugagccugugaauaauuuaacuaaaagucuuggcauuugauaacugagguaccaauuggagaauuucuuuauccaguacacagaguuaacuggaggcacagcuagcacugaacucaugcaaaaguucuuuucauuaucauguagaugcuaggccguauuccaaagguagugaaucaacuaggggagagcccauguugcugucuugucuuuuucuuuuuaaagagaugaggucucacuauguuguuuaggcuggacucaagcuccuaggcucaagcgauccucugggcuugagcuauccuccugccucaggccaccaaguuacuggacaacaugcuugcaccaccaccuucaugaagcuuucuuuuuaaacaagcuccccagguggcucagauguauacuagcacucgagcauugcaugcauugcaucagaaggcccugccauucagauagugagccaggccaacauucagauacacugauguugacugaauccacccuuuugucaugaaaauggcaguuguuuucagguuaagguuaguccucuugcauuugaaaguuguacugaauuguuaucuagaguauaugauuaacaaugaugugccacagcacuuuuacauaaaaaucuuaaaauacuuuugaugaggaaacgcuggauagcacuaagccaacacuguaauauaaacugucucauuugcaugccauaaaaagugucauucagcaggaaaaaaggaauguucucuuugauuuuuugccuucucuuguuaugucucuuuuacaaguuauaaguucuucucauaauuaacuaauuagaacuaauaaucuucuaguacaccaaguugucuuacuuggcccaccuuuuccgagaaugauuagaaggagugaaaagcuaacauuuaucgugugggugacuggguuaaguguuguauguguauugauuuguuuaaucuucacaggaagcuuaugaaauagcuguuuuuucagauuuuucuuugaucugcaacccaugcuaaugcauuuuacaucaugaucuaguaagaaacaucuuuauauauuacagagaauuuucauggauuaauauuaacagugcaauauacucuguuuucuuuucuguuuuuuuaaauguugguuuugauccacuagacaauucagaauccgcuagcagauagcagcuuucaugaaaaauacugaggugugguacuuuauuguccccguuuuacagaugagagagcugacacguuaaguaaacugcuggccaagugucacagcuacuagacacagaagcaggauuugaacuaggagccuggacucuuacucaguuugcuaaccugaauuauauaauacagauaauuuccagaauaaauuggaccucagggucuucucugucuuguguuguaggggcagaaagguugugauaccuuuucucaccccucuuaaggguaauagcugacacaccuguaacaaaauacagguuaacaagagaaaagcguaacaaaugauuuaaucaaaauuuuacgugaagaggaggcagagcaagauggcugaauggaagccuccaccgaucguccucucugcaggaaccccaaauuugaaaacuauccacacacacaaaaaaauaacuucauaaaaaucaaaaaucaggugaacgaucacagaaccugcuuuuaacuucauagagggugggaggguaggcgagacagucuugaauugccagcgccaccccuccccaauccccuggacguguggugcagaaagggaaucugugcacuuggggagaaacuuugcauuggaaugcagugcugccaacaccaggcagagcucagcuggugcccacggagcacuuacuccagcccuagccagaaggaagcgcccaucccagcagcuggaacuugaguuacagaaagccuugccaccacggacuaaagugcucugggguccuaaauaaauaaacuugaaaggcugucuagaccacaaggacugcaacuccugggccaguucugaugcugugcugggcucagagccaguggacuuggggugcacacagcuuagugauacaccagccggggcaacuaagggaaugcuugugccaccaaucucccaaccccaggcaguguaguucguagcuccaggagagacuccuuucuuccacuuggagaggagagggaacaguaaagaggacuuugucuuggauaccagcucagacacaguaggauagagcacugggcaaugucaugaggugccuauucuaggcccuagcucccagacaacauuuucagacacagccugggcacaaaggaacccgcugccuugaagggaaggacccaguacuggcaggauucaucaccugcugacuuaaggcccugggugagacucugagacgugacaugaccuagcacagucacugcugugguggcuuugaggagaggccccuuaugcuugagaaaacgguaccagguuggccauagugggguagagcaccaagcaggcacuuaggguccucaguuccagacauuggcucuuggacagcaucuauggaccugcccugggccagaggggaccccacugcccuaagggugagucccaggccuggcagcauucaccauaagcugacugaagagcccuugggcguuaagugaacaucacuauaggcuggcaguagccacuaugggcccgugguggugguggacauggagagagacuccucugccuggggacaggagagggaagaguuggaaugacuuugucuuguggcuugggugccagcccagcugcagcagaacagagcaucagguagauucguaagguuucugacuccaggcauuggcucacagcaucucuggacucaccagggggaacuugccaccuuugagggaaggacacaagccuggcuggcuucacaaccugcugauuuuagagcccuaggucuucagcaaauacaggcgguaaccagguaguacuugcagcaggccuugggcaauacccagugcugugcuggcuucaggucugccccaauacagucucaauggugguggucacagggauguuuguuucacccuuccuccagcucuaggcagcucagcagagagagaaagagacuccauuuguuugggacaaaguaaaggaagagaacaagagucuuugccugguaauccagagaauucuucuagaucuuauccaagaucagccaaggggagcacagugucagcuggcuuguucagauacagcugcagugaccaaagacuuagaucacaauacccaagucccuucaaauauuuggaaagccugcccaagaaggguggguacagacaagcccagauugugaagacuacaaucaauaccuaacucuucaaugcccagacacugacugacaucuacaagcauaaagaccauccaggaucacguuaccucaccaaauggacuaaauacagcaccaggggccaguccuggagagacagagauaugugaccuuucagacagagaauucaaaauagcuguguugaggaaacucaaaauucaagagaacacagaaggaauucagaauccuaucagauauauuuaaugaagaaauggaaauaauuaaaaagaaucaagcagaaauucuggaguugaaaaaugcaauugucauacugaagaaugcaucaaaauuuuauauggcaugggagccuucagagauacccaaagacccaagggaaaacugucccuuuuuaugcuuagauuugaugaaggaguggguagccagguagaauuguaauuggacaaaaggggguugaucuuauagucacagaccaaaggggaaaacccaccuagcaagggcccauccugauucuucuugaucucucuguguggcauuucuuccugucagguauaggacuggaccccuucuggaauuaagggucuuacgaucuacuuucagauaaaguaggccuaagaauuuccuuauagccagcucuuacauagaaaggcaagggaauguuaaaguaauauuucuagguuucauggcgggcuuugggggaaaaggggaucuaguuucugugacuugccuuaaugaagaggaauuuuaguuucugugguuugccuugcagggaggagggggagcaggagaaagaaggucaggagaagaucugagacagacuugacuucugaggccuuccaguguccuuugguucaaagugcucaggaugccagggcaccauauuuugggguaucauuuucugagcccuaauacugugacaggagaaaaguauuuauccagcaaguaccaucugucaaccuuguucucugccugccagaaguugauuugcucagcauaagggaaggagagaggcaggacccuagagaugugggagggggcuucuggauucuguaggggacuuuaggaacuagggggcaggacagaaacgucuaauuaggauguuuuauuaaguaauuuugugugacuccaaggaaaagcucucuucuaacuccuuucaaaauucucagaaaaauuaccuguucacugauacuugaaauguggauuugguuuuggggauuuaagucuggucucaagauggcaaccaggucagcuuacuggggccagccacauguaacaguuugguuaaaaaaaaaaaaaagugccauacguucaggaagcauuugcuaauugccuacuguggucaaggcaccguuauggguacaauggaugcaaagaugauuaagaccuaccaaacaaauuuucugugaauaucagcuagauaaaaggaaaagcaucucagagaccucugcuuuggaaagaaacuugagucaucauguucauugauacuauuauagacuuguccaccacuuaccccaguugccuaccacaccuggcauuacuuauuaguugauagcaaaguaacuccuguaguauuuaagagcucaggucgggaagucagguuauuuacauuugccuacaaaaguauaaauguaauaguucauguggagacacugcuuuaucaagugauauucaugagcauaguauacuguauuuaccaaaaucaauuuccuuugcccugugauuuguuucagaaaauguugacuggccaucuguagcacccuauuuuauuuuccacuggacugagugacauuucaaugucuaauuccuuagccuuagggaaguaaaagcagaacaagucuguuuucuuccauucuuucaaaccaguagauguucaucaagcagcuugacuugaaagaaacccuuugccuaccugagagggacuagucccuccucccugccuguuagaaaagucugggauggcacugucagcucauacuuccugagacacagguguaggcaucuaauauguagcaggaggaagcagagaaagguucagaggcaaauaaguaauccaagcagaaagcauauuggagaguagagguuucuuuuucacagacaacagaguagcagugggggcuggagggaaggaggauaaguauuguauauauggagaugaaguuugggagacaggauacuagauggggaaaaaacuuauuugccuaauuuuaccucaaaguauagagugaaggauuacuaaggaggaaauauguguaaaguaagcauuauguauggcauuaguuaccugguggcaauauaguuauguuguguggaccauuuuaguagaaaucugcaaucuacagucugagcaaugauuauuuugcauuuguaauaugggccugcuaauuugugcacuugcuacaucugugacucuuauuucguuuaauuuguguuccuuuuuaaaggauguuuucuuugcuguucagaaaucuuaggaagagagaaauuauagucucccccugcuggauaugacugguagaaccugaaauuuuagauuacuuggcauagauauuuuuuuuccaauuuuuggauuguauuaaaauacauauaauaugaaauuuaccaucucaaccauuuuauuagguuggugcaaagguaauugcggguuuugucauuuuuuuaguggcgaaguguacaguuuagugauauuaaauacauaauaaauguagaguucagugauauuaaauacauucuuaauguugugcauuauguagcuacaugaggacuaauugaccucaacuuucaaauuccaaauucuuccuacagccucacuaagcagucuuuugaucacaccuuucccaucuccaagcuccucuacaucuucuuccagcaguuaccagcgccgcuggcuucgaagucagacaacaaguuuggaaaauggcaucaucccaagaaggugaguugcaaguuuccucuugcugagaaaaguaggaguguaggcagcuugaugaaacuggcagggaggcuguucgugccuauugucaguggaaaaaaaaccaaaacuuuuuuauuagcuucagcugagccugaaaguuuacaaauuggaaguucuaaagggaagaauaaauaaaagcugaaauuuuaaaaucuccuccuuuggaagacacuggggaguaucuggguaguuguaucauguugagcuagauuggguguucauuuaaaauggugugcucucuuuaaaaugagucccuuccagauguagcuuguauaaguaaugaaggguggaucaaucucuuccuuggcuacagugauaccagugugguauucaaaaauauaugaagucaaggguuugugauauauucucuuuguaaaauguaaauucuucaacuaaacagauaugaacaugauuuuaaauagagauggcaucuagguauuuucugucuuuauuucagcugguuuugugugcaaaauguacauuugauguuacauucauagcuuccaacuuguucuuccuacaauccaaauacuugaaguggaauuuuuauauguaccuauaaaaauucacaugucaauuaacugauuuaguaaauugacuaguacucaacauacguagagauccgugaagguauaagacaguucagcuaugugccuguacuuggauaguuuacaagaugguacaugauaaauaucacagggagacauaaagugccaugagacucaggauggagaaaauacagugauggucauggggggaauuagggagcccuuccuggaagagaugacacugcagggacaagcugagaaacugaggggucaggaugugugagcagcacaugucagguggcuugccucgcuucuguuccuuucacaauccuagggagcuagcuggaaagaaaaaauuauagcuuugucacccaucaagaagcugcuuuuugguugguggacuuugaaugagaugauuaaaagcuuggaauuuugugugaacacaaguccuagcucugucacucacuagaugucugauagaauaaguuaaccuggauucugaguguugcaucgucaucugcaauaugauaauaauacuagcacagcuuccgaguguggcugggaggguuaaaugagauaaaucaaguccgguguuuagccaagacauaggauaugggcaauaaaauguggccaaugugaauuauuuacuauuauuauugcugucauugucauuaccauuacugcaacugucaggagacggcaucgccaccauccucacugucauuaugacagcuucugugauuggaagagauaggucuuggaaaccauccucuuucaacauuucuuuucugaaaauguuuuuuuaucccuucagguuuaaauccaaaguugaaauaauacaccuaaaauaaguaucuuacauucagaaagguugugaauauggucaaggcuggcuaccuaguuuaugggccagugcaaaauaaaaaugugguccucuuacccaaaaaacaagaaaagaguuauuaaagggacuaaaaagaaaaaaaguuuuucuuuaagaauacuuuauauguaagauauaauagagaugauagugauagaugaauaauaauauaaacuaauaaauuccaaacauaauauuuuugaugucauaauuuuauauuauaauaucauuaugugauaucuuguguuguaagccuuuucugcaaauacauuuguuuagucaucaaaguuuauaguuuuagcaacuuggcuuucaguggauauaauugaaagugauagucacuccuggcaaaugcaagguggcaaauaauuuuugauaauuuuuuacuuggagaaggaucuuucugcugaugcagucuuacauagcuuuauggacuaugacaacaucuggauaaauuuuuuuuauuauuauuauacuuuaaguucuaagguacaugugcacaacgugcagguuuguuacauauguauacaugugccauguuggugugcugcacccauuaacuugucauuuacauuagguauaucuccuaaugcuaucccucccccaucccccuaccccacgacaggcgccggugugugauguuccccacccuguguccaaguggggacauuguucagugcccaccuaugagugagaacaugcgguguuugguuuucuguccuugcgauaguuugcucagaaugaugguuauggauaaauuuuugauaaacuuucaagauguaaauuuuaguacaucuggaucagaugauucuuguuaaacaguuuuuuaaaagauuuaauucuucacacaaauccauuuugaguaagucugaauuuaauuuuagauguaaauuuauacaagcuuauuuuaauauuucuucugacauuuccuguaacuuguggagaucuuacaagaaacuaaaaauguucucaugaguuauauauaauucaaaaagccuguuuaugcauucuaucacuguguccucaauuacaaggaaaaauuaauuuuaaaauggccuuccucuuuaauaauuuguucaucugaagcuucauaugaaaacaguguauuuuuuuguccaguauaacaaucuuuacauucaauuucuauuucuaugccuaugaauauuuacuuugcaguguugcagcaguuuucaaaaacagagacuaaacucucugcagaauuauaauaacucccugauauucuuuauugcaauguccccauguaggcuuuuacuuugugauaauuuacuguccuggugcucaggucauagaguuaaauaucugugcagacucuauagggacaggcuccggugacugaugggcaaacuggccucccacccugguuccuggagcuaccagagucccuccucucuccucuccccuaucacccacaaccauggcuacugcagcuucuguugucaccacagucacagccauuaguguggguccaagaccuggcagugccgcuuuagagucuucuaacaccguguccugccccaggcuuauggguaugugccugacugccgggccaguugcucggugucugggcugcaagcccuggguucugaguucauccgugcccuccccaucauaagggucauggcuccuguaacaaauacagguuaacaagagagaaacauaacaauuuuauuuagucaaaguuucacaugacauggagccuucagacaugaagauugagggacccaaggaaaacuguauuuuuaugcuuaaguucaacacagaauggacugccauguagaaaugugauuggacaaagaaauaugaucuaaugguaauagacuuaagcaggaaaacccagcaggaccugucuugucggaauucuuuuugaccucucuguauggcauuccuuccucccagguagaggguaagaccccuccgaaaugggagggucuuaugaucuauuuucaggcaagguaggucagagaaauuauuugugaccagcacuuacaaaggugggagaaaguuagaauaguauuucuauaauagguuuuacaguuagcuuuggggaaaaaagaggcucauguuuuuuugauuuaccuuggggaacaggaaucuuaguuucuaugccuuuggggagaaagaggaguaggagaaggaagggcagaauaaggucagaaaagcaaggucuugcuuuugagccccuguccuucaguucaaaguacucagcauaccaaagugucauacuuugggguauccuuuucugagcuucauugucucauuagacuucauccgaacacaugcuucauugucccauuaaacuucacuuacagcacaaaaguccaaagauaaaauuauuuaaaauucaaaaugguaaucacagaacauuaaaugaagccuggggcccuugugagaggggggacgcugugcguguggggucgcaugcccaugcagccagcccuuaauagaguacugcugaacaccgagaacaugaguguggcagacguuuugaauugauuacugugcccgugaagaucccuuuuuuuuugagacgggaaucucacucugucaccaggcuggagugcaauggugcaaucucagcucacugcaaccucugcuucccggguucaagcgguuccccugccucagccuccugaguaccugggauuacaggcgugugccaccaugcccagcuaauuuuuguauuuuuaguagagacggaguuucaccauguuggccaggauggucucgaucucuugaccucgugauccucccaccucggccucccaaagugcugggauuacaggcgugagccacugcacccggccuaagaucccuucauuuaaaggauuuguaguugaucucucccuuuuggcagauaugugguugggaaaauuaguuuuuuaugcuagagacaggagaauaguggguaccaaacacuaugauugcuucuggcuuugacagaaaauucaugguaauuaaaaauguccuuccuaagagaguuaaagguagcagggaugauagucacaguuucuguuuuuuguuagaaucgggcaacacuuuauucuauaaaauagaaugaauguuuucaguauucacaauucuuaacaguuggcuccacgcugaccucagagcccccugcugugccaagugguaggcuuugauuacuggauggggaauggggcuugggcaucuaacagcuaaccucaaggauuccaucacuuaccgaggcaauugaaacccuaaagagcaagguguaaugucccaggaagccuuuugauuugacuuauuaaauuggaccaacuuuauaaaguugcugaugggauguucuuugaccuacaaaacauuaauuucauauaguccaauguaauacauagguucaguauaaguucaaaacugacauaaauaacaauuagacuaaggaguccugauaccagugauagauuauugagauguacuuaaauagccauuuuugcuuuaauuauuuaugaucuugaaguacuuacaauguauauaaaugauuaucgauaaguguuaacaaaauucuauuugauuucuuuauuaggaaaaaaauuguauguagcugcagccuuuccuugacucucagggcugucgguugaucagacugcuuccagcuccuuuccucagugcucugcguggcaugaugcauugacuagcaugagcaccagcagacagauuaggcauggggucagaaucccuggucauugccaguauccaagucaugagccuagacuagaagauaggaauccuggguucuaacuccagcauuguuacuaagaaccuuucuguuccugaggaaaguugagguagaacucugccucaguuuccacauuugcaguacagccuguguaccuucucuggugacauggagauaaaguacugaugaaguacugggacacacacuuaaauuuuugaaaacauucuuaaacaucauuuuuuguagaauaauuucuaaauuauaaguaagauacuacgugaccugauuuauuccacguugcaugguugaugcaagacuacagaaugaaacucaguugauuuagaauucaguggaggguuauggugaagcaaguaaguucuccacucuauuauagcuauggaaguuuuucagaaauuucagcagguggcacucucuccuacauuaaaacugaugagagcauuggcuauuguuuauaggguggagauguugaugagaaacuguauuggguucaguguuuauuauaauuugauuauuaaaggucaagcuggccuaaagaugaguggacugauacagucauuuuacuuuugaaaaagaagggaaauguaagaugacagacaaaguggaaaggauugcaagcaagccuuauuguaauauaaacucagaagaauuuccuauacagaacagaaaucaacuacuguagugcaagaaaacaaggcuuuagugccaguaccuugguaaagaagagagaacauuguaugaaauugugugaaguucuaaggaaaccucaagaauuuucucugaugauuagaauccgggaauuucccagggaaagcaauugaugguuuauuguaauguguagcauuuauaacagcaccaugugccaucaguaacaucuggagugaaaaccuuuuacugauuuaccaaccauaccuacaucuccaggaucuugcuugaaguuaagggaaauaguaacacauaaugagguuagaauaagaugucuaucuccuuuccuuuaaaaauaaaauagccaggugcaguggcucacggcuguaaucccagcacuuugggacacugagguggaaggaucacuugagcccaggaguucaagaccagcuuggacaauguagggagacuccaucucuaccaaaaaaaaaaaaaaaaauguauccgggcaugguggcaugugccuguagucccagcuacuugggaggcuuaggugggaggaucgcuugagccugggaaauugaggcugcagugagccaugaucacaccacugcaccccagcgugggugacagagugagacccuguccccccaaaauuaauuaauuaauuuaauagcuuuccugaccauaacacuuuuggcauauguauguuuaauaauaaaaucuagguuuauuugaaaucauacaagcuaugaguagagcccuaaguaaauaaguugaagaccagggggcagaaggcuaauucucauauucugcccagcaugaguaauuguuauguuguaauuuauaguaaagaaaauggaggaagcaguuccuuucuauauuuggcagagauaggagacuagaugauggaguuagaaagagaaaauguaucgccagucuagggcucucauuugcaauguuagguccuuuguguugguguuuuuguaggaaaaaacuauuuuauuuguacucuugcuguuaguagcuauuugguagcuacacuggcuuuucacaguaguuaaguaagagacaugguuaggccauuuuugugaggcuuaccccacaagacaaauuaaauauauauuuagaaguuuugggcuucguggcugucaucauagaagccgagucucucaaaagaaucagguuuuuugaaaauuuuacuguagcagaagagagguaaguguuucugcuuggaggauuuucagagagcuuaaucauauggcuuaaucugagcauuuagaagaguuacuugaucuaguaguuuuaauagcccugggaaaguaauccuggaaguaccaguacauguucaaauguuuacucuuguucaauagaauaccacguaguaucauuccucuuuugaugucuuaucuauugguaucugacuauguuuuggauaaacagauauuucacauuccuuccuaaauaucaucaauuugacauaaaacgauucaaaggaaaaggacaagaguaacaacgggaaauuuaaauuacuuguagcuuucauuugagcuucuuuccauguuaggauaauaccguguggcaggcaagcugauguucucaucuucaugccagggaauuauagaaaagaaugaacuaaaggcagagauacucuuaguuaugacugaauguucugggugucauccccagucauuacaguugaccuucagugugacucacugaugcauggcaacuuuucaaacuuauauuucccuccaggucaacugaugagacauucagcuuggcugaagaaaccuguagcucuaauccagcuaugguuaggaggaagaaaauugccauaagcaucaucuuuucccuaugugagaaagaagaagcacaaaggaauuuccaggacuucuucuuuucucauuuuccccuguuugaaucucacaugaacaggcugaagagugcaauugaaaagguaauaaggauguaauccaaagucaaauagagaagugauuguggggcuuugaagauggcagaauuucuuugccgauguaucagaugucuuuccuaaggaaguuaaaucaccuguagcagugauaaauuuuaggcauguugauguuaguuaccagauacuggguuaccuuagggaaggaaaugacugcuuuuucgugacugaaggcauuauuaccuugaguguuguuaauugauuacauaauuuuuuuuauuaauacagcccaguagauaaguuauaaaauuucuucucaguaauuugacuugcuuucucuucaauaaaggcuaugaucuccuguaggaaaauagcagaaucaagucuccgaguccaguuuuaugucagccguuugauggaagcucugggagaauucagguaaaguggcaaaguuuggcaaauccaacaggagauguuuaugagcagccauggauaaagauaaacugugacuuggaagaauugggggccuggcaguuauuccucacuuuugugguuccgcccuucaagauggaaacagaacaaaugaagcaaaaaauuuaaauaauuuaccgcugaguaauccucacuauugcucaaccgacagucccugauaggauuguuuuuaacaggaugaauggggaaaacuaauguucagguaucucucaccagucuauucauuaucuuaugucagccucacaaaagcccuaagcacuacuaaccccauuuuacagauguggaaacuugaguucagggaugcuuauucaaagcacagauggagagguuaugcaugucgggaagacauacauuccaguuugccaggacaguccuaguuuacaccaaguguccucuggaaacuggugucuagaguccuugcuccuaguaucuguguggaaagguaaauuguguuggguagcaggugggauccucucugaucaugcugaguugggauuguugcaccauuuagagccacuuucuugauagggaauggaaucccacuccaaagcagucaugagcgaaugagucaaacuguuauuccauagaggaaggauaaaaaaaaaauuuauaauccuuugaauguuagaacacuuuuaugaugcuuaaaguauaugcugaugaacucaguaaugcuaccuggagcaaaaucgcaagccuuuuuuuuacuguggauuauguguuaaaguacucaaguaacauguuacuuauuaucuggugauugcuaagacuuaagucauauauuugagaaugacauaaaguugugcucuuugauggcagucugaugauuaguaaaccuuccauaguuuuugggaaagcacuggagauuugccuguugcucugcuguggucagacuggacgcucacuggcuugcgcuugagaaucugggucccacuuuuuuuuuuuuuuuuuuuuuuagacugagucucgcucugucaccaggauggagugcaguggugcgaucucggcucgcugcaaccuucaccuccuggguucaagcgauucuccugccucagccucccgaguagcuggguuuacaggcgcgcgccaccaugcccagcuaauuuuuguauuuuuaguagagacgggguuucaccauauuggccagaauguucucuaucucuugaccuuguaauccaccaccuuggccucccaaagugcugggauuacagguaugagccaccacgcccggcugagaaucuggguccuacuuuaaugaggugucuauuuuucaaaggucaagaagcugaaagugaggcuuucuaguucuguacuuucaguuucuguagagucucuguaguagcaacugaacuuagccguugucccacagaagcagccauagacaauaaauaaguaaauaaaugagcacggcugugacccaguaaaacuuuuuauuuacaaaaaaagguggcagucagauuuggcccgugggccauagugugcaaccccuguuauguguggagcuugaaucuuuuaaggacuacauagauucaaguuguuuucuccuuuauucuuuuacaccaagauuauccaaaauaguauuucugacacuuuuguguuucccucucuuucuguucuauagaggaacuaucuggaacuuauauucuguuccaaggauagcugaaccuguauggcuuacuaugauguccggcacuuuggaaaaaaaccagcucugccagcgcuuucucaaggaguuuacacuucugauagaacagauaaauaaaaaccaguaagcuucaacucucuggagacuuguaugcaaaucucauggccaauguguguacugcauaggaugugccucuuucuguauugacuaaguugguuguaucuuuuuccauuucuccaagguuuuuugcugccuuacugacugcgguguuaaccuaccaccuggccugggucccaacugucaugccuguggaucacccucccaucaaagccuucucagagaaacguaccucccagucagugaacaugcuggccaaaacacauccguauaauccucuuugggcacagcuggguuaguaccuaauuugacuauucagagaauauaugggauggaauaggaaaaaaaugcuagaauuuguaguuuauaccggcucucucacccaguaauucauagguugucuuugggcagaugaggaauaggaaguuggucccuggauucuaauuguagacccacgaccuuccucucuuuuuuccccuacuggcagcuuugugcuacacucuuaaagcaguauaagccaacuguguucucccauuccacaguggcuguucacccuagagcaggauuucuuaaccucagcacuguugaccagguaauucuuuguugguugaguuguuguggggugugggaagagcucucuuacgcauuaauggauauugaguggcauccuuggccuccauuuacuagaugccaguagaacugccccucccaccucccgccccaaguuguaacaaucaaaaauauccacagaaaagcaccucauccuggaaagcagcaugcuauaauaacaauaaugaaagcugacacugugagccaagcccugguuuuacacauagucauuagauucucaucccuacccuuauuacucucagccucauuuuguaacaauacagauguugucuuguccuugugcucuuggucgugagauguauaaaugaauacaagcucccucaugguuaggggguaaaaggcguguucuaaaucaauuaaagaauuuguggauauuuaaauggaauuaaggaaggggagauauggagagaggcuaguuaacaaauauaaaauuacaacuggauaggaggaauaaagucuaguguucuuuagcacuggauuacgauaguuaagaauagcuuauuuucagagaaagcuagaagagagguuucaaauguucccaacacaaagaaaugauaaaaguuuggggugauggauaugcuaauugcccugauuugaucauuacucagaacaugccuaacucauucuuggucauacgggaaguuuuuccuggggaagacagaacaugguuguuuuguuauggaauaauaauagucuugaaaaaaacuuagucucauuaaguggagaaggaaagggggcuggauauuaaggaaacauuguauuccaugcugcuggaucacccauuuuaaaacaaugcuaauuaaguagugugcauuuaguuagauaaauguauucauaauuaggugugcuucuuauuugaaacauaacugagagccauuaauucccuauguucagcauaauaacgaagaguuuuuuccuguggguucacaauccucaucuuucaggggagaucauguauuguugaaagucuucaguccucccuucccccaaacaauccaucaggggucuggcuauugacaagaggagugugaggaggggacgaggacgaggcccuggucggcgaaggccugugauagcuuuguaaagccaaguguaagugauggccgaguuuccauuauuacaaagaagucgggggccuucaauaauuugacagguagaagcacuugcuuugcauuuuauuguuuucauucaguauuuagcaagucacaguaaacaugaaaauagaaacugcugggaauacacaaugauggagauaaaauuucaauccagguuccuaaguauagagaagacuaucuggaaucauuccaaagacuccucugagagcuuuccaggacaggugccacugugcguucccccuccauggcugcucagcacuaccagggaagagggagggaagccggaugccacuuucacggguuugcugcucaggagcucggugauccuugcuucugcccagccacuucccuguguacaaugugaucgccacccauuagugggcugcagaagcaauuuaguggguuuaauuaaaaagcauuuaauugguauaauagaauagaaaauaucagugauuuacauguauauuuuguaaaaugucuguuccaaaagaugcauugagguugcaguauaaaauguauuucuuucuuggcauagguauacaaaguuuaaaugccacugucuacaccacugacugaaguaguuccauauaggucucuuuuugaccuaaugaucuuaaggguuuguagaaaugaaaaggagcuuuucuacccaaaagagauuuggaccacugauuuaauauaaguuaaaaugugugaaauuuuuuucucagaaguuuacauuguauuuuucaaaacacaguggaauuagacuacaaaucaauuuuuuuuuaguucucacuuucucagaaaucaaaccauguauuuuuguuguuguuguuguuuuugagacagagucucgcucugucacccaggcuggaguucagugguacaaucaagguucaccacagccccaaccacccaggcucaagugauccuuccaccucagccucccugguggcugggacuacagaugugcgucaccaugcccagcuaauuuuuguaaaggcagaguuuugccauguuuugcaggcuggucgcuggucuugaacugggcucaagcgauccaacugccucugccucccaaaaugcugggauuacaggugucagccaccauacccagcugacaaccacauuuaaauaacccacaagccaaacaaauugcacaaaagaaauuagaaaacauuugaaauaaugauaauaaagaugcaauaaguuaaacuguguaggguauaaggagacacuguugaaaggggaauucuacaacauagacguuauuagaaugugaucaggaauaagugugccuuuaagauacuaaacucucuucucgucuccuuauuuuuguucucucucagcuucuccugguuuauuuuuguuucugucuauauaguccccuaccucucuaacccccuuucuuucaccaugcuuccuuuacagggcuucuaaauucucucagcuucuccaccucauucuuuccucuccucuuucuaguuuccaacuuuucacuauuguuccccucaacaguucuuuccuuucuucucccucuuccucccucuuuguuuucuuuuucucuacauguuuuacccuccuggcuguuaucuccucuccuucuccauccucuuuuggcuucaccccaguucucuaucauuuugcaccucucuaacaucccaucuuuuuucuuucugcuuucccuucucucuauucuucccucuuucuuccuaaguuucuucugucuguuccucugcucucuccgucucucccucccugagucuccacucuguguccccauuugccaccauuccuuucuguguccuccuuuccugugaccucuucuccuacuuuguccagcaccuuuccugcuuccaugcacucugucuuuggccuauuucacuuggaagcacgcuugacuccuucacuuuuucuucugcuuuuuccccauuugccucucuuuuaaauuuuuauuuuuaauugagguaaaaagcauauaacaacauuuauuaucuuaaccauuucuaaguguacaguucagucauguuaaguacauucacauuguugugcaauuucuacauuuuaaaaaauuauauucaugaaaacaaaucuauucuaaaaauuagcuucaauuauccaagacucaaaaaaaaauugaacuuccaguaaauauuuaauauuaugggucuacuguuuuaaaaaugcuuuauuuuaugaaguuuggcuauaauguaauagcacugguuccacucacauugcacucauuauuuuauauaguuuaaaugauuauaaauuguauuuuuaauaaccuuccuuguuuuaccauuuccauuuguuccuuaguuauuaaaauauacaauacucaaaugcauugcuaaaaaauaauauucuaaguggucuuuccccuguaguuuguuauaccagauuuuggauaaguaaugcuucuucuuuauuaauauugaaacugauuuaacaaaaaauauuucaugaauuccugaaaugacuguugauauccugcggcaauaggcagauguaaucaaaguguuaacaguaaugagcucuuagaaagguuuucucaaacaaaaguccuagcuucagccuacaauucugaguuacucucuugaauucuaggcugauuucucagucacuugcaaacgccucucaguuaaagcucuaucagccuauaaucuagucauuuuauagagaggauuguuuauuauuauuuaugucuugccauuugaauguucuuaggaaccguacacaagggaauacucgcagaaggagguauuucuuaaugggucccagggggagguacuuuccgaugguucucauaacuuuuuucccauacucaucuauuuuaauuaguuuuaucuaguauaugcccuuauaacugcuuucccuccucucuagaugcauuccucagaggguuucuaacuuccuacauucugauuuguacugauuaccauguaucaguucuccuuuauuuaguaucuuuucagcuuuugauuuguuccaauauucugguuauucuuuuuuuuuuuuuuugagacagagucuugcucugucacccaggcuggagugcgguggcgugaucucggcucacugcaaccucugccucccgggcucaagcgauucuccugccucagccucccgaguagcuagguuacaggugucugccaccacgccuggcuaauuuuuguauuuuggguagagacgggguuucacccuguuggccaggcuggucucgaacuccugaccucaagugauccgcccaccucggccucccaaagugcuggaauuacaggugugagccaccgugcccagcccucugauuauucuuuaauggguuucuaacuccaguuugauuauacaaagauacaaugagacacaucuuuuuuuaugagauggaguuuugcucuuguagcccaggcuggagugcgguggcgacaccuuggcucucugcaaugucugccucccggguucaaguuauucuccugccucagccuuccuaguagcugggauuacaggugucugccaccacaccuggcuaauuuuuuguauuuuuggcagagacaggguuucagcauguuggccaggcuggucucaaacuccugaccucaggucauccaccugccucagccucccaaagggcugggauuacaggcaugagccaccgcacccagcugagauacaucuuuagggucuuaacacagugccuguccaguuaguaaacauagguucuuuauuauaauuguccaucuucuuaucaaauguguaacuuauuauaaaauguaauaaucaaauuaucaaaugcaguaguuuuaauaguuaggcacugaaguacuuuugaugaaaagcuuauugcugggugguuggaugacacauuugcccuuauugucuccuccuuaagcugacuguagagcucacaguacauuagucaguuuuuaaucaacuugucaggauauauaacuaaugggacauacuuuuuuccaguugaauuuucuuuucuguuuuuuucugagacagagucucaugcuguugcccaggcuggagugcaguggugccaucucagcucacugcaaccucuggcuuccagguucaagcaauucuccugccuugaccucucaaguagcugggacuacaggugcacaccagcacgcucgccuaauuuuuguauuuuggguagagacgggguuuugccauguuggccaggcugcucucaaacucuugaccuaaggugauugccugccucagccucccaaagugcugauauuacaggcauaagccacugcgccuggcccaguugaauuuucaagcgaaaugaaauaaaaccuucagacucauucaugacuaagugauuuucuucuuguuaaucaagcugauucuacuugguguguguaugcguauuaagauaauucuguguagaccaccucauuaaguauuuugaauuaauucacugcacuucuguugagaaauuccuaaauuuggauuuuaucccaaggcccaauguccugggauucuuccaacaaauucuuauuauucuaguuuccaagauauaguauuagaucuggucacauauucagagcucuggcuuuagccuucuuugggccaucucauuggcugacccacugagcugcagggaagacccagcaggcaaugggaggggcugugggcacagcagcacgacucccacacaccagggguggugggccacagccuguguccagacugacucacuuacaguggcaaaacuaaaacgugguccuuacuagagaguagaaaucaugagucugaagcagggacuccagauugggaauauaaguuaucuguuuugcucuuguaaagacggauauaucugugacaugcuaaccccagagaccacugccuuuguguccaccuuugcucucuaggugaucuuuacggagccauaggcucuccagugagacugacucgcaccguagugguagggaagcagaaggacuuaguccagcgaauacuuuauguccugaccuacuuucuccguugcucugagcuacaagagaaccagcugaccuggaguggcaaucauggugaaggugaccaaguuuuaaaugggagcaagaucauaacagccuuggagaaaggagagguggaggagucugaguauguggucauuacggugaggaacgagcccgcucuuguaccccccauccuaccaccaacagcagcagagagacacaaccccuggccgacaggguuuccugagugcccagagggcacugacaguagagaccugggucuuaaaccugacaaagaagcuaacaggaggccagagcaggguucugaggcuugcagcgcagggugccuggggccagcaucagacgcuuccuggaaaccucagaaugcauuuuguggggaugagaaaaauaaagaggcaccgcaagauggcucuucaagacuucccagcugugaaguuuugggggcaggaaugaagauggaccagcaagcugucugugagcuguugaaaguggagaugccuacaagacugccagaccggucaguggccuggccuugcccugacagacaucuccgggagaaaccuuccuuagaaaaggucacuuuccagauuggaagcuuugcaucuccagagucugacuuugaaagccgcaugaaaaaaauggaggaacgggugaaggccuguggccccuccuuggaggccagugaggcugcugauguggcucaggacccgcagguuucuaggagcccuuuuaaaccuggcuuucaggagaauguuugcuguccucagaaucggcuuucagagggggaugaaggcgagucugacaaggguuuugcagaggacagaggcagcagaaacgacauggcagcagauauugcugggcagcucagccacgcugcugacuugggcacagccucccacggugcaggaggaacgggagggaggaggcuggaggccacuagagguuuguaugugaaggcugcggaaggaccugugcuggagccuguugcccccagguguguccagcggggcccuggccucguggcuggugcgaauauccccuguggggaugacaacaagaaggccaacuucaggacugaaggagacauuccccgaaaugaaagcucagauagcgcccugggagacagugacgacgaagccugcgcuucagccaugcuagaucugggucacgguggugacaggacuggaggguccuuggaaguggagcugccucugccaagguaacuccagcaggcugggaaguagagggaacuggguucaaaucccacuuuccuggccugacaccugugauguuguuagccacuacuauugucugcuuuacacacaguaucuuuuuuuccacaaaguacuagaaguauuauuaauucuauacaaacgguuucccaccuguccuucuuccaaggauggucacuggcuuagcaccacugagcucacugggacagguggccagugguugucuuugcagcuaucgugauccuuuggggaagccuaagggaugugguggagaugggggagggaauagggaguuuaauuuucugucaacugcagagaagguccguggcuggcagcagaugccuugcuucagaggugguggauuacacucgccguguggccucucuccugccgaucagagcagcgugaggugguugggaaacaacaccucuuucuuaacacuccaucagguugauuauuuggucuguaaugacugaaagcaguaauuagaaauuucuucuguucuuccgcacugucgugggcaccacucugugcagauaugucagauuccuaaagccaggcuuuuggcaagagcccuuccugaaacauuuucuuuggucaguauuuugacacagacugccugguggauguccaauaugagguacaaaaacaaacucauaacuagccauggauaguuuuuuuuucuuccagccuuccacuuuaaaaaacucccuuuucucccaccugugauccacuuacuugaggguuggugacauggaccacccugaaucuauuuuauuuaccuguaucauuggagugcuuguaccaauuauaaugaaagaaaaaaguacauuuuuagcugugcauuuuaaugggccacauguuguuuuaggucucagagcaucagcacccagaauguaaggaacuuuggccgcucacuucuggcgggcuacugccccacauacaugccugaucuugugcuucaugggaccggcagugaugagaagcugaagcagugccugguggccgaccuuguccacacaguccauguaagugaucccaguguggagccucuggcugcugacagugugucagucaaggucuuggcugacaacagguguuuagacugaagagagacuaguuaagggguuguuuauggagaugugggcaggguuaugggaaccagcuagggcuagugaggcaccuggggccuagcagcagcuggaagcuagaaagcacaccugggccugacagaguaaggggagggugcgugacaucagagcccuggagaaccuaagccaggacgaggggcggccuggcugcaggagcagugaggagggggugacuuccugccaucccuccucccauucucuggucucuuucuggugccucucauuggcugagcccggcugaaagccagagagcaggggcacagcugaugcagacacacagccuuguggugcauagaggucagccuccuggggcccagaacagaacacagaagggcaaggagcugcucugggggugguggguuagcagauaggcugggcaaauggaauaaacagcacagauggugacaauuauaugccgucacggugaggaccgaagaggugucacaugugguuuguuuuuuaucugaugcuuaaacaaguuccuaaaaguaauuuauuuuaacugauuugucauuaaguucacuuugauggcugcaugaggaugacuguauaaagauuaauaagucucacugaaaaaauugccucguggcugcuauuaagugcuuuucugcuaucugcagggcaacaggaacuaagcaguuaaggaaacugucaaucugaugggccuguuuuuaacugagcuguuauugggcagaugugcaaaaauagacauuuuguauuagaaacauuuuguaucuugugcaauagggaaaguccucaucgcauuaagaaaaucagaauuuggccuguuaccuaccuccuuggccaacaaguauuuuuuuuuuugagguggaacaaaaggcauugcauguuaucuuuggccuugagcaucuccucugugaagaccaaacaucaggcacaggcuaaacaggcuaaguauauuuaugugaagugggaaaaaaacucaguagugaagcagaugucaacauaaccucccucaauggggagggcuaagagaugaggauagggccaucagaagcuggggaaagccagcccaguguacacguguguggccaaacguuccuaaccccaccccugcuuuguggucacaugccaccccucaccaggauacuccugggaugaaacuaugaaguugcuuuugucccuauaauaucauaauuauuuaauaucauaauuucucuuuauaguuaugaacaccauauagucauuuaucauuucaugaguccaugcaucaaugaccccuguaagaaaaaugcccucauuguauaaugcuaaguuguccaaaacgaugucugaugcuuuggcaauuucacaggcuguauuuauguguguuuaguaacugccuauaacauuaaggcaccuuuucuguccgcuccuauuguuuauauucacacaugccaaacugugaguuguuuuuuuuuuucugcucugcuaucauuuugauuucuaacaauauugguguugguuauuggaccuuccuuccaugaagcccagugagcugcuucugacagagguaccaagagacuacaggggaacuaaugggauuguccucagugacaucaguuuuaccagcuggggacuuuguuugaaugcccuggauuuacucacugaccacucuggaaaugcaaucuauugauugauaacccuccuugaacuuaucuguaaaaccauucaugaaauauuuuauguuuccauaggcuggcaaguucucauuuuuguguguuagauuuucauggugacccucuggcucuauaauucuuuuauuugaaaaaacacaaccauguuuacucugucauuacucuucaagcuuuuucguauuucauuuucccuuccuuuuagaaggaguguuuucacacuguagcuuuucucauuucuuuaugcaaucacccugagagaucgaaaguuauuaagcauaauaaccuauauugugucaaauuguggguacauccaaagugcagccaugcguggguguuaauaggaaauuccaaaggguucauaaaaauaucuucagaaguuuaauacauucagaauauauccaauuagcauuaguggauuucuaauuucacuugacacauucaucauaaugaauuuugcuuuugaaguaguguucuguuuaaacuggcgcucuggucuaugguaguguuuuuuuuuuuuuuuuuaaaaaacaggcuuacuuucaacauccauuuacaaacauuuguugaaaaauauuuuaggaguauuuguuuaaacauuauuccgaauuuacugcuccauaaagccuagugaauauuuaaauucuugaauauguugccagaaaaagaagcagagauccaaaaacaaguauaugaccagaguuagagcugaaauaauagcuuguugaagaagagaaaauuguaauaaauugcuuuaucaaacuugcuuucaaaaccuguuuuuuaaguugggcacaguggcucacgccuguaaucccagcacuuugagaggccaagguggguagaucacgugagcucaggaguucaagaccagcuugggcaacauagcaagacuucaucucaaaaauaaaauagcguuaaaaaaaaaaaaagaaaaaacaaaccuauuuuuugaacauuaauuucagugcucaugcuagauuucagcaggcuuugguacucauaauucuuuuuagagaaggauuuuuaacuguuuaaaagcaauugauuccaguuauugaucucuuuucuagaccugugcacaauuuggauuuaauaaucugucuuauguaaauuaaauguggugguuuuuuuuguuuuguuuuguuuuuguuuuuguuuuuguuuuuuuugaggugggaucuuccuguauugcccaggcuggacuugaacugggcucaugugauccugccucauucucccaaguagacaggauuauaggcacaggccacuguaccuggcucuaaauguacacuuuuauaacugcuaguuuggaguuuuucucucauugagagauugcuuuguaaugcuuccaauguuaagaauuuuuuuguacuuuucuuauccuagucucuuaugaaagaaagauauaguaacuacuucaucaauuuucauuuuuauuacugacuuucacauaucaagauucagaaguucuuuaaauauuuaaacacguauucuuguuuaguccauauacuaccucuuuucugucauuugaacucucucugccuccuaauauauagguuauacagcugccuuaaauuaguguaaaguaauacgguuucaguuuuuuucuugccacaucuugugcauucuuuccucuguuuuccuuuugacuuuaaauggaaagagagcaggcguaugcgccagcagcauucuaugccugugacuccugaguagccuuuucccucuccuuuuuccucuugugucuggccugugaauacagcugacuguauacaggguuacuguugggguuauuguggggcaguguaaggugaugaagaucucacugacuuaguguugauggcuugaguuugaguccugguauuaccacucguuuguugauaaucuuagguaaauaaacuggcauugcuaagccccagaaaaauguauuuaguggaacagaugaaauaugauucagugguuaggaaguuaacuucugaagacagacaaaccuaaguuugaaucaugguucaccccuuaguggcuuuguggccuugggcaaguuucuuuaauuuucuuaucuauacugugaacaguacuuacaucauagguuuggucugaagauucugugagauaaugcauaucaagugguuagcacuuugccaggcacauuguuaagugcccaauaaaugugggccaaaugugauagcucaccccuguaaugccagagcuuugggaggauccuuugagaucacccugggcaauauagcaaaaucccaucucuagcaaaaaaaaaaaaauagcuaggcaugguggcacaugccuguagucccagcuacucaggagacugaggcagaaggcuugcuuaagccaaauguucaaugcuucagugagcugugaucauugccacugcacuccagccuggguaacagagcaagaccucaucucaguaaauaauaauaauaauauauguaaaagugcuuuguaaaugauacagcaauauaucauguuuuuaauaugggagagcagaaugacaaccauuauuuucguaaaaaugaaaauuacugucagagauaagaaagcuauauaugggccaggcacgguggcucaugccugugaucccagcacuuugggaggccgaggugggcugauugccugagcucaggaguuugcgaccagccuggggaacacagugaaaccccgucucuacuaaaauacaaaaaaaaaaaaaaguugccagguguggcagcgggugccuguagucccagcuacuugggaggcugaggcaggagaauugcuugaacucgggaggcagagagguugcagugcgcugagaucaugccacugcacuccagccugagcaauagagcgagacugucucaaaaaaaaaaaaaaagaaaagaaagagaaaagaaagcuauaugcguauguacuuaaaguucuccuaacuagucaauggccuugucaaucccaggggacuacuguugggaaugauugaacagaaccuguacacacauucauugagugcuaaaagcauucacuuuugcuuugcccaggagcagacuggacagcucuaacucugcagggcagggucaucaagaccaaaauuaacacuacguuuugauguuuuuuaaaaaacaacuaugcuccagggcuucaagcauuuuacagaauaauuuauaagaugaaguaaccauuggauacagcagccucuuccauuuaauuuuaagcguagcaacagauugacuccagaaauaucaugcaggaaucaguagcacagauaaagagcuuugcuaaaagccuggcugugauauauauauauauauauauauauaugcucaugaauaccuaauuaguccaugcagugcaaucaaccuguaggacuauaaaagaacagcaagucccuucaaaugguaaaucauuacuuaaguaacacagauaacauuaaauaccucaggucagcaacaaccuuaaaaucaauaggauacaaagaaaacaucuauguaggacaaauccacuauuuuggaacaucucucguuguuuucuuuuccccauguuuggauaauaaacauggcagugccucaggccucuagcacugucuucuauagccacagcccucaauacaacacuaccuauguccacuggccuauggagcacuuuuaaaacuacauauuuugaccuauaaauggguuuugauuaccaguuuuuuuaaugauauagaacuaaaaucaucacacauuaggcuucuuauugauuagugaaaccuuuguauuauguguguguguauuuauacacaugugcacacaugucacacuuguaugcauauggcaugucaugccagguuaugucauauaagcauguaugccaggucaugauguuaaaauguauuucuuaucauggauugugguuaaaaaaaauacugaucucuggguauccccaacuccaaucugaaaucauugugauucucucgccuucucaaugugacuagucuuuuuaaaguuccuuuugaucuucccaaauggcaucccuguguccacuuuacccacuuccaccgccuugugcagugcugcaagaggacuuucuaaagcaugagacaaucauuuacucuuuugcuugaauagcuuccuauuuucuaagagacuaaacuguaaacuccauagcuggaauugccccuuuuauguccuucaaauauacacacauaccccuguaucuccucuuaugccccaguaacacuguuugccauucuuuaaauaguccaccuuuccucacaccucucugccuaucagauuaugcuuucuuugccuaggacacuauugaacaaacuuuuuuacauuuuugaagacccauuucauauguugccucuucuucaaaaucauuccaggccccauaucccuguucuguuccagauguguuccucuacuagggcuucaggugccuugaagcagaaagcagggacuuuauuuuccuuauauucccagcaccuugccuggugccuggcacauagaaagugcucacuaacguuaguugacucuuccccauaaaacugggguuagagucaugugugucuauuacuuuaguguggcccuuucuucugaaguaaagagagaugggagaugaucuuucuuuaaagaaacuuaaaggggaagaguaagauguuuagacaugccugcagcucuguguguucauugucguuaccuaaaggaaaauaaaagcuuauuauaggucucuugggcuucaugucucuugcaucgugucagaguuagacacaugucuaauuuugauguuuuucccaaaauguuuuacuaccuacaagauauuugaacaucugugccauucucugcaaaaaagcuaccaacccucucucauuuuauuuuggaguuccauaucucaucauguaacuugauucugauacccuuucugaccuugagcaccucuucucaacuuccgacugaauuuuacucagcaaguggccagccugaaagugcagccauuccagaaguuauguacgguaucuucaaggccacggauugaauuugggcccuaaucaggugagcacaggcacagauacacagaagaucagacauuuucccggaaccccuccagaccaucuugccacacuuugaacccuuucuucuuucccucuaccccuaagucuucauacugucuucauguauaccuacaaggaucccuuagcaaugucccaagguccaaaaugauuaauuuuccucuuccucuuguuuaccuuaguacaacucuuaagccuuuagugacugacauuaaaccuguuuccaagagaaaaauuucugauaagcaaaugcuuuuagaguuaugauaaggccauaugugauuguuaccccuucugguauuuucauguguuaaaaauauguuugaugcacuagaaaucuccagugguggcacuucagguggucgagauaacucgugucaccugauggggcagagaugcuuuuggguuagaguggggagagucacaccugagagauuuaucaguugaaaaauacuuaucagguaucuuuuaugugcuugguacuguguuuauagcaguagucaaaaucugaaguagaauuagcaggggcgugauggcugugugcccagggucccagcuacucaggaggcugaggugggagaaugauuugagcucuggaggucgaagcugcaguaagcuaugauggagccacugcacuccagccugggugaaagagugagaccccgucuccucccccacccccccucacccaccgaccagccaaaaaaaagaucugagguaggaggauuccagcaacauguacuaaacugguguggauggcaugccuccccucuaaaacuauauagugauggauaaaauaucaccauccucacugcugccccauuguuauaauuccugucaugaaaaaaaauggaaauccuuuugugccagagauaaauggaaaucuaaaccaaagcaguaagcaugagcugguccuccaggauuucagucuugauacagguccuaggaauugggugcugaguucucagauucacccgaggaugaaagacuguggucuugugugcauguaaggcuugagaccuggaaucaagccccuuaccuaaagucuggagcuucaaagaacuauucuuccaugaaaaggagacuagaaaucaccagacauaagcagugaagcagcaaagaaacaggcuggaaacagguuagggaaaauaaagucacccaugagaaaucaaaacccccugucugugcuauuuguggguuucagguccagauuuauucuacccgagugauuugcgaaucccuacccaagaaauaaacauaaaaccagaagcauagaaaccuuuaggacucuggcagaaggaagcacacuacuuuagacacuucuacaaccacaagcuuaugagacgcauauaggaaaaugaaacauagcuccaguaagauaggcccacguucagaaauuacaaacauaugugggaaaccaggaaaucaucaugaguggagggcaagcgcauacaagcaggagaaucagcacuccuccaguuggcaauaacuauuaaaguagccauguuuaaaguguuuacggugauaaaaagaaggaauuggaaccuuaaaaaaaagagaggauaaugugauaaaugaucauuuagauucauguaagaacuaaaaacaacuucuaaaauugaaaaauagucccugaaauuaaaacuccagguauagguuaaagaacagagcagauuaaauacagcuaaagauaauuagaauuugaaauggaggcuacuuaagaaauuauguuuuugagcucugagacaaaaagacaugaaaaauaucaaagagcaaguaaaagaugugguggccagagugaagagacuuuauagcauaugcagaaagagaauagagaaaaugagggaaaguaauauucaaagaaagaauggcuggcauuuuucagguuaaguaagcacacugacucccaaguagggagaauauuaacaaauucacacuuaacaacuggacaucaaagauaaagaaaacucuuagaaguagcuagagagaagaagacauggcaucuguccucagggaguuugcgaucuaacaggaaauagaaauaagucagcagugaaaauaguguggucaaguguguggcagcaggaggccagggugcugagaacgugcgcacaaggcggcuguggugaggacucagcuagggucaguagcagagugaggaugagaagcagggaagagugcagggcauaguauggcuuuuucagggaacugaagccccuuucgcugaugaccccuucagcauaucucagagcuggcuuugccaccaacaggaggucugucuguccccucuuucaguaaaacugcugucaggaaugucuacucaacaugggaucuaauuaaagagcuucugcauggcaaaagaaacuaccaucagagugaacaggcaaccuacagaaugggagaaaauuuuugcaaucuacccaucugacaaagggcuaauauccaaaucuacaaagaacuuaaacagauuuacaagaaaaaagcuaacaaccccaucaaaaagugggcaaaggauaugaacagacacuucacaaaagaagacauuuaugcagccaacagacacaugaaaaaaugcucaccaucacuggccaucagagaaaugcaaaucaaaacuacagugagauaccaucucacaccaguuagaauggcaauaauuaaaaagucaggaaacaacaggugcuggagaggauguggagaaauaggaacacuuuuacacuguuggugggacuguaaacuaguucaaccauuguggaagacaguguggcgauuccucaaggaucuagaacuagaaauaccauuugacccagccaucgcauuacugggcauauacccaaaggauuauaaaucaugcugcuauaaagacacaugcacacguauguuuauuguggcacuauucacaauagcaaagacuuggaaccaacccaaaugcccaucaauaauagacuggauuaagaaaauguggcacauauacacuacggaauacaaugcagccauaaaaaaugaugaguucauguccuuuguagggacauggaugaagcuggaaaccaucauucucagcaaacuaucgcaaggacagaaaaccaaacaccgcaugcucacucauaggugggaauugaacaaugagaacacauggacacaggagggggagcaucacacacugggaccugugguggaguggggggaguggggagggauagcauuaggagauauaccuaauguaaaugacgaguuaaugggugcagcacaccgacauggcacauguauacauauguaacaaaccugcacguugugcacauguaccuuagaacuuaaaguauaauaauaauaaaaaaaauucuagcugacuuuauauauuggaggagaugguuuaagaauaaugagugauaaccagauuucuuuucucuggauggauuugagacugaagggguuuuuugguuuguuuuuauuuuuuuaaaaacuggucuacaauucacacaccucugcaguccuuuuaguggcucucagucauccuagugggguguguuggccaaggacgaccuuguauggucugaaucuucaguuccaaggcuauggaggaugcaguuauauaggugggucuucuccucugaggaggcagaggaauaccaaaggggaucugaggaccuuuaagaguagugcugagaaggugacugucaucacauucaucaugagcucuuugcaugacugacuaaaggccuuucuuacagcuacauaaaagcuaauauuaagucauggugcuguaacauaaggagaauuauuguggaaagguauuuugucauguagcauccucuuauuaaaguacaguuuaauaaauguauuaaacuuaccagaauuauauaaaaugaauaacaaaugggaguucaaaugaagccaaagacucucccucucccucuccgucucccuccacggucucccucucccucucuuuccacggucucccucucccucucuuuccacggucucccucucccucucuuuccacguucucccucucccucucuuuccacggucucccucccucucucuuuccaccgucucgucucccucucccucucuuuccacggucucccucucccucucuuuccacggucucccucucccucucucucucuuuccacggucucccucucccucucuuuccacggucucccucucccucucuuuccacggucucccucucccucucuuuccacggucucccucugaugcugagccgaagcuggacuguacugcugccaucuccgcucacugcaagcucccugccugauucuccugccucagccugccaagugccugugauugcaggcgcgugccgccacgccugacugguuuucguauuuuuuugguggagacgggguuucacuguguuggccgggcuggucuccagcuccuaaccgcgagugaucugccagccucggccucccgaggugcugggauugcagacggagucucguucacucagugcucaauguugcccaggcuggagugcaguggcgugaucucggcucgcuacaaccuccaccucccagccgccugccuuggccucccaaagugccgagauugcagccucugccuggccgccaccccgucugggaagugaggagcgucucugccuggccgcccaucgucugggaugugaggagccccucugccuggcugcccagucugggaagugaggagcgccucuucccggccgccauccagucuaggaagugaggagugucucugcccagucucugcccggccgcccauugucugagauguggggagugccucugccccaccgcaacccugucugggaggugaggagcgucucugccuggccgccccgucugagaaaugaggagccccucugcccggcagccgccccaucugagaagugaggagccccuccgcccagcagccgccccgucugagaagugaggagccccuccgcccggcagccgccccgucugagaagugaggagccccuccgccuggcagccaccccgucugggaagugaggagcgucuccgcccggcagcugccccaucugggagggaggugaggggcagcccccguccggccagccgccccguccgggagggagguggggggcgccuccgcccggccaccaccccguccgggagguggggggugccucugccuggccgccccuucuggggagugaggagccccucugccuggccgccaccccgucugggagguguacccaacagcucauugagaacgggccaugaugacgauggcgguuuugucgaauagaaaagggggaaaugcggagaaaagauagagaaaucagauuguugcuguggcuguguagaaagaaguagauauaggagacuccauuuuguucuguacuaagaaaaauucuucugccuugggaugcuguugaucuaugaccuuacccccaaccgggugcucucugaaacaugugcuguguccacucaggguuaaauggauuaagggcggugcaagaugugcuuuguuaaacagaugcuugaaggcagcaugcuccuuaagagucaucaccacucccuaaucucaaguacccagggacacaaauacugcggaaggccgcagggucuucugccuaggaaaaccagagaccuuuguucacuuguuuaucugcugaccuucccuccacuauuguccuaugacccugccaaaucccccucugugagaaacacccaagaaugaucaauuaaaaaaaaaaagcaaagaaaaauuuauauauuacucauuuauuaauaaaucagaaacuacaagaagcuaucacccaaaaaaaauaaaauaaauaaauaaaaucaagcuaacacacacaaaaaaaaaaugaagccaaagaaucauguguuuuauuauccagaauaucucagagaaaaacauagagagaagugcuuccaauuaccugaaucauaaguugccuguucccuuuguguguguguguguuuuuuguuuuuuuuguuuuuuugagacggagucuggcucugucguccaggcuggagugcaguggcgcagucucggcucacugcaagcuccgccuccuggguucacgccauucuccugccucagccucccgaguagcugggacuacaggcgcccgccacuaugcccggcuaauuuuuuguauuuuuaguagagacgggguuucaccguguuagccaggauggucucgaucuccugaccuugugauccgcccaccucagccucccaaaagccugggauuacaggcgugagccaucgcgcccagccucccuuuguguuuuaaagaggcuucccaguggcuuaucccugauaguuaaacccacacuguuauaacuauugugcagauuuuagaucugguuaugaauacagaagucuucacacuccugcucucuguaauacacaugugggcugagacaucucugaagauugauaaagggucagugucaagcagcauaaagauggggaacuuguagcaacaugcaugauagaaguggcuguguuuucuccuaaugacaauaaauucagaccaucauucacacuucuugcacucuugucuucuaagggauuuccuuggauuuuauaguagagggcuugggagacucauugggcuaaaagucggaaacacuugugaguuccuagacuuuauuucuuacaugccaagauacuuaauaagcucuuuuuuuuuuuuuuuuuuuuguccugaguguuccuaucuguagagcaguacuguguuccugccccccuucaggagaaauggcaugaugaauuaauaaguaguuaugggaagcauauaugcaagaacggcauuuccucacucuucauuggguuaaaaauagauaaucacgugaaauacuagucauuuaaaugugguacauagaaaagaaauauauuaauuauggugcauuggagguauaauauugccagaaaauaagaaaugcacagauuacuuaauaggaacuggguugcauccaaaaauaaacuguucaccacagcuagaauguauuagauauuuugcacaugcccagcacuguguuauguuccuuucaaaggcugcagaagaaaaagaaaugugauuuaucuccuugaguuacuuauaaaaucacugaguagacaaacaugugaaaucaagaacaaguuaagacagugugugaugaagugccaaaaugaaugguguggacagcaaguauucucagaggucaaaggaagagcagugcagugcaugugggaagguuuccagggcgagggauggacucacgccagguccuugagggauuguggacuugagaugggguggcagggaaggcauucugggcacaaccugagguaagagcaggaaucuuuuuggccuggagaaggaggcuguacuagucccacuuucacacaacuguaaaguacugcccaagacuggguaauuuauaaaggaaagagguuuaauugacucacaguucugcagggcuggggaggccucaggaaacuuacaaucauggcggaaggugaaggagaagcaaguaccuucuucacaaggcaacaggagagagagcaagcguaugcgaggaaguaccacacuuuaaaaccgucagcucucggccagccacagaggcucaugucuguaaucccagcacuuugggaggccgaggcaggcggaucacuugaggccaggaguuugcgaccagccuggccaacauggcaaaacccuaccucugcuaaaaaaaaaaaaaaaaaaaauacaaaaauuagcugggcaugguggugugugccuguagucccagcuacucgggaggcugaggcacgagaaucacuugagccugggaagcagagguugcagugagccgagauugugccacugcacuccagccugggcaacagagugagauucugucucaaaaaaaauaaaaaaaucagcucucgugagaacucacuaucacgagaauagcaugggggaaauugccccaugauccaaacuccuccuaccuguccccuuccucgacaugggauuauaauuggagaugagauuuggguggggacacagagccaaaccauaucaggggucuuauugggaacugaauauguacagauugggugggcccaggcugugaagagcuguaaguguggaagaaagaacaguuuuaacuuaaugguuugggugaugugugcuagcguagauuuuagaguuggugaaggaaaugaucaugugguauuuuaagaaguuugagguuuuagguaaaguacauaaacuagggcaguguuguccacaguugcacuauuugugagcuccugagucugagguuucaggggacauggucaauacagagagagggugguucaggacagcaggacgaacauuugagcaccuaauguguuggguucuaugcuacacguuucaacacauuuuucucacagaaaacuugugcuuuaaauggcauuuaagccucacagaagcucugaacuaaguacuaucccauuuuacagacauagcaacugaggcccagauugaguugcugagguuccacagcugguaagugacggugguuguauucaagcccaaucugacuucagagcccuugcugucaucuuauuguugcccuuuguugaauuaucagaaccacagcucuugcgauucucuaaaccuuguagacaauuucuuguucguggaaguuuaaguuaagcagaagucauguguauaugaaucaaggcagcauauuuugugugugcggcaaucugaccuaaaaccuugaaauuggaauguccuaggcauuuaacacucccaggaaauggacccauccuuagaggcuacaaauuaaccaggcugauccuguugauucaacaagcuguaauagcaaagaaaacucaauaaucuucuaaagauuuauaaaacaagguauuucauuuguuacucuaucuugaaaaaucuucacaggaaaguaguuuggguaaacaagauauugacaagguagaaaugaauaaaugauuguuucuaacuucucauaugagugcagcaaggggaaaaugauaauggcauauggccucuaccuccuuucuuucuggagacuggcuguccaccuuaacaauugucugcagcuccuuacucaccucccauguucuucuauccgcaagucccugucagaaguuuccgaguuacccaauuaaguuucugugggaggcauguaaccugcuguuaguggucuggagaggguggcaggaaggugccgggcuggcagcucugcauugauacccuggcugccguuggacacucaguguggugugggcacucaggaggguggcgauagggcagugcuuuucucagcugauggaggaaguacaaacauaucgcagauccauucuaauaggagaauuugauaaauuauuuggacaggaaacguauuucaaaauugauucuccuuagcuugagagaaaagaggguaauugaugucagcauccauaagguuuguaaaguuucucaaacaggcaucuuaaguggaaugacuauauuuaauauuaguguuucucucagauuuucauuuggaacucugaaaugaggaccugauuaaucugagacaauaaugguuugcaggagaacuuuuaaaaaagguaacuauacaacguaggcuuuuugguuuguuuuucuagagauauuuagucaagguaacaaaacccuuugggaaaaaagauguuagcauuaagaagagaaauuuuaccaaguaaucuuacuaaacugacagguauccauagcauaucucccuuuuccuuaagguguaugggaggccaaagugaggcucaccaugguucaguugucagcguugggguacaggcaugccccaccuuccuauuccuuuucuuuaguucccaugcccaaacuccaaguccuaagaagagcagauaguggauuaggcuuuucauagguguuuaaaucagucaaucuuagguucguauuuuuuagaauacuuaauuucuuaaaaguauugcuacauguauguuacugcaaauaaguguauguaugaaaccugcuaugcaugugaacuugauaaaauugugaacuuaaaaaacuuacuugacagauuucacuauuuacuaacuucuacuauuaagguauggcuaguaagaaauaguauuauaaagaagcauacauauaauucaguguuuguuuauugugguucuauagaugccuaaaaaauagucuucccagccaggcacgguggcucacgccuguaaucccagcacuuugggaggccgagguggguggaucacuugaggucaagaauucgagaccagccuggccaacauggugaaaccccgucucuacuaaaaauacaaaaaauuagcugggugugguggugggugccuguaaucccagcuacccggagggugaggcaggagaauugcuugagcucaggaggcggagguuguagagagccgagaaugcacuacugcacuccagccugggugacaaagugagacucugucucaaaaaaaaaaaaaaaaaaaaacccaagaggaauguuaaauugaauuccagggcauagugugcagguauguauuucugugacaaauccaaacauaguuuucuagaucuuagaguucuuuaaauucugaaaacuuagagauugacugauaagccagaucauaauauguuuacacugcccagucucuaaugggguugaguuuccuuuggaaagaugaucagaaaucuccagucaccagaacuuuagcuucaacucucugacccugugcaaguucaggccugaucagggauggccagcaguggccccgguggcccuugaauuguaacuaaaaguaguugaugauauuuuuaucucuuuccagcauucauuucuuuucuugaauauuuagacuucccucuaguuuguucuuccuuuaaaagguguuuauucuuuaguaaauaaguaaguagcuacuaagugauauaguuagauggaggcaauuggauugauucagggaauuguguguuauguauuuaguagccugagaauauguaauucuuggaguuuuuucucuuuugaaaagguucugcugguucuuuucuguuccuggggccugcaugcauaaaagucagcaauccaugcuguaaggaacacaagaugcucaucgacucuugucauuugcuugugcuuaaucugucucauuuucauucagcaaguaacauuuuucaaaugccagcuccugugcuagaggcuaaggaugcagagagaagauucagccccacuuucaaggaauggacucccgcaaauucuugucaguuugucucaaucuguguacucauuguucuuucgucuuuacucaggucucuaccucagauucugccucuuugcuccagugauuuaaaaaugacuugugagccuauaaucccaacauuuucagaggucaaggcaggcagaucacuugaggccaggaguuagagacaagccuggccaacacagcaaaacccugucucuaacaaaaguacaaaaauuaggugggugugauggugcacaccuguauuccagcuacccaggagacaugagaaucgcuugaacgcaggagccauguguugcagugagccgagauugcaccacaucacuccugggcaacagaacaagacugucucaaaaaaaaaaaaaaaaaguaagaaacuuuggaggccaaauguaguggcucacaccuauaaucccaguucuuugggaggcagaggugggaggagcacuuggggccaggaguuugagaccagccugggcaacauagcaagaccccaucucuacaaaaacguuuuuuuuaauuagccaggugugguggcacaugucuguaguccagcuacuugggaggcugaggcaggaggaucacuugagcucaggagcuugagguuacuaugaacugugaucagacuucugcacuccagccugggcaaaagcaagacccugucucuaaaaaauaaauaaauacaaagacuugugcugauuuuucauguuaguauuuuuuaguuuuacauuucucuugcaugcuuacuuuuaaaauaauugagccaaccucucugucccuuuuuguuauugcauguaaaucuacagccuucugauauaaccuaagcuugcagaaucuuccauccaucaccuuccuaguaugccucuuggcccuuauuccagcaguuaguugcuuaaaacaaagcacuuuguguugguagugguacuauauaacuuauagucuaugcacuguuggggauugacacacucuucccuucccuaccacugcagugggaagaucauuuagaagacuaaguucgauuugaaccuaggguccaaauuaccuauugcaaaucaauccuccuccuccccuugcccuuugcaaaagcuagaauucacugugaaaggugacaggcauacguucaacucauugucucuauguugacauauggucaguaugagagaaaggucucuaauauagaucugucccguggcaugaccagcauguuguggauuucugacaaaugcaaagcagugaaggaguuugagcucaaaauacaaauauuugaaguguucaaauuuccuuuuuuuuuuuuuuccauaaggaccagacucauugauggcaagucgucaucaucuugauauaaauuuauaacacaggaugaacaagaccuuggaggagcuuguaaagagaagucacugaagccuuguaucuuuaguuguccguuuuggagacuguauauaugcauguguaagaagcguaggggugaaagggucaugaaaaccuuugguugaaaauggugauggggucauuauguguguaagaaaaucuuuguacuuuucaguuaacaauucuacaaaaugagaacugucuugggaaacugggcuuuaugaauucaaaaauauacuuuaucaaauucuuuaucucucauguuuaaaauuauuugaacagacaaauaaauguugaacaucagacuuugccugauugcuguuccuuucaaugggaaaaauauaaauccugauaauaggguuuauaucuuuuuaaacccuuauauuuuuauaaacccugauaauagggaaaaauauaaacccuauuaccaggguuuuuccuacuauuuuuccuacuauucccccuuggauaauaguaggaaaaaauguugguccgcacgaaguuuucauucaucucaccacucucuuucccauuugugagaaggaauacaaagcugcacaggacagaguccaagacuagggagucagaucaccuguuaaaauuacaguauugcaucaugcaucuuugauuuguauuugcagccuucccacuacuuggauuaagucguaaaaauuacagguaaccaugguccaguggcaaagcuguauaucucuuuggguucuuuguugcaauuagcaacucuuguuaacuuaaacaggagggacuuuagugaaggaauauuaggaauguauagaauugaugagaagucaaaagaauuaggguucaaauaggcaacaaggcaauucuggaguuccaggaaccauggacuacuugaagguguuuguacuaagucccaccaggccuuguacuaauugcugucugggcaggaauaugcuggugccaaccauuuuuggucuucugugcugguacuaacaaggaauucccagggaaggagcauccagcuggcauagcuugggccauacaaacacacugugauagaggaaggauggacccgauugcagucucaccgggccuugucuaagaaagaucauucuucaaaggaaaauucggauggauuuauuggaggaaguuauuuaagcagccaaaagaaucaagcagucaccccaggauaguagaaaggaguaaggacggaagcagccaguacuaauuuuccuugguaaaugaggguuagaagaaugugcauaugugcauuggcuuugaggcaggucucucugucucuggcucucucuauccucccccucccccacccaucccucccaagcaguuacacuuugauuuguuuugagaaauuaggucuuuaaaaaaguccuugugacugcuucaguguuuacccuauuuacccuauggcauaauuuaccaguuguuaaaucugcucuauccauaacugccuggcugucaagaauuuuacauuuaaauguauuuaucaguagugaaacuuugaccuuuuggacucaccuggauaaauaaacccaucccuuuguguuucuuuuucagcauccaguccuggaugagccaauagcugaagcugucuguauuaucgcagacacggauaaauggagugugcagguagcuacaagucagaggaaagugacggacaacaugaaacuaggccaggauguccuggucucuagucagguguccaguuugcuucaguccauuuuacagcucuauaagcuucaccucccugcugauuuuguaaguacugguucuuauaucaccaaagaaaucuaguuuuaaaaugcuuuuaacgacauuuugauuauaaaaucacaaauucaaaaguacuguuuuaauauaauuggagauuagcauaacuaaaacuagaacaugcagcauaaaacucgcaacaggauagauuucaguaguaauagcucuuccgugaaacaaauaacaaggagcggcacuggaauuuuuuggaaugagguauauggugcaguaaauaaggaauggguggagagaucaagcauaaaaggaaacuguaaaucauccacuggagaacucaugaguucuccuuuuauuagauugauauuuuaauaaguaggccaguuucugaagggauuguaguuccuuuuauuaagcaaacauuuucacaaagguguuaaggauaaaauagaauaucauuuguguaaacauuuccaacauuuccagcuuuaaaguacuauacacauguaagauuauaucaauuguugcuuuuuuuuuuuuuuuuuuuuugacagagucucacucuggagugaguagugcaguggcaugaucucugcucacugcaaccuccgccuccugggcucaagugauccucccaccucagccucuugaguaguuggacuagaggcaugugccaccaugccagcuaauuuuuguauuuuuuguagagauggguuuugccauguugcucagucuggucucgaguuccugggcucaagcaauccgcuucuuuccaaaugggauuuuaaaaucacuuucguaacaauacuuuaaauacaaacaacagacagagccuauacacucuuagaaaaguaucaguagcuccccccagccacuggaauuaacaugcaugacaaaaucuucucaguaucugcguaugugcagagaaauugaaagaaagagaaaauacauuuagagagggagggggaaagguuucaaaagaagaaaagcuuuuccaguggugaugaacacuuaaaaagagagagagaagcuuaagggcauauggcauauagcuggguagagcuuggaugggcugaccucagagacaggugugugaggaaagagucugcuuucucugcuguucccuccugucugcacagcgcuguucucugcagcacagccccaaaccaaaacaucuguuaucugcuuccuggccuccaaaaaugaugcaaaccuguuuacccaacaaagcaggaaguuuuuaaauauuaauuaccuacgcuaauugcuaauguaauggucauuguccuggguuuuuaugaccaaaucuauacuuguacccauuccucaaaaagagucuagacuuuuaugacuuugaagaaggugcucugaaauaccgucugguuguuaucaaagucgggacaguguggcaaggcaggaagaccacugagcguagcuggguuauggucuaggcuuugccguugguuaguuguguaacaauggacaaucccgagucucuccgaaccucagcuuucuuaguuguaaaagaaagauaguaccuguucaacaagggugcugugagaaucuucugaaaauuagggauauaacugcuuuuuacugcuaaagcaccaugccaauauuauaaaauacuuuaaaagccauauauguuagcuuuagagccccauaaccuggggucaaauccaaguucugcuacuuccuaaccauguacucuuucaaagccuuaauuuccuuaucugcaaagcuggggaaauaauagaaccuaucuccuaugguuaugaaauuauauuagagaaugaauguaaagcacuuggaauaguguuagauguuauaagcacucaguaaacagcuacuauuaguaugauagucaauaacaauuaguuucaugaaacaauauuaaugguugcaaagacugacaacaccuuuuuuccaaacuguuuauuugggcuuuaagcugaagcguacucuugcaagacaucuguccuggggcaauaugagaagcacuuguggauuauuaugaucuuauuuuuuguuauacaguaguaggcaguuucuccuucuaaaagcagguugaguuaugcugauuuagagguuaauguuuccuuuucuguaagagaaguaauguauauuagacuucauaguuuacuucauaaguauuugccaaacuuuuauauuucauucuauaauacauacgucuugucacaguugauaucuugguuaucaaagcaauaaauuguuauaguuaauucuuuuuacuuccuuuggacagaaguguguucaagcacuuacuagugugaaugacuuauuuaaccugacaaaaccaagaucaaagaaaauuuuaucugcaguuuaaaauucuccuuaaaaaaaaucacuugaaugaaaccugugauuaaauggcuuuuagaaccuucaauacaaaaagagaagguagcuauuugaaauuuuagaaguuaaaaauuggagaaauccaucucaggaauaaaaucccagaaagaggaguuuaaaaagcccccagcaugguucaauggaauaaucaagucuuuuaaaaaauguuuucuuuuuuuuuuuuuuuuuugagacagaguuucauuuugucacccagguuauagugcaguaguaugauguuggcucacugcagccuugaccuccuaggcucaagcaauccucccaccucagccuccugauuagcuaggacuacaggugugugggccacuaugcccagguaauuuuuuaauuuuuguagagacagaggcucacuauguugccuagguuggucuugaacuccugggcucaagugauccuccuaccucagccucccaaagugcuaggauuacaugcgugagccacuaugacuggcuaaaaguugucuaaaugcuuugauuucacgucuaguauauauuucauauagaccacaguucuuauuuccacacugcaucauacaguuuucauauaggcugugaacacuguaauuacuuuuuccaaacagaaaggguucaauguaauaugaauauuauuuuuaauauuuugugacucuuacuaaaaauuuucuauuucacuccauaaggaacugaaagcuaauaaagauccuuuuaccaccuuguuuacuuggaggagcauuuccaugagaauuggugaaauccuccuuacuuuauuacucuuagucacuuagcaguuguguuucauccaccugacacaauguauuuaagauuuuaaaccaaugaaaaacugaaaagauugcaucucugauagauauuuuuuccaugucguugaucagcccagauggucaagaucaacauuuucaaaugcaucuguuaaucuuuuuaccuugaaaauaacaggccuaauggucuagaagaaaauuagguaugauggaauuacccuugccaaagccaucaggugucuuacugaagaugcucggguaucugccugccaaaugcaaaagcauuugccucuggugaaagacacagaugguugcuauucucuaaaaaaaugaagcugaacacuauuccaaggguaaagauguccugaaaauaauugccuuuucuuuauuguuauuaaagaccuaguuaaaauacauucuugaaagcaaaagaaaaaaaaguugugggggagguucaaaaugaccuguucccgucagucuccucuggaaauguacugggccagaauaaucugagcuauugggggaaaaaaacaaaaaccauacuguuuacuaaauuauuuauaacaaaaaugcaauuugcuaugugguuacguguaaauucacauucucaauauuguuuagcuauaaaaauuauaucaagaaguucuuaauaugggaaaggauuauuauaaaguuuuuuaaaggcaagaaacacuuuuggaaugauuucaacuaugaaaaaaauacuuguuuaaaaagacuagaauaauacauauguaaaucuuaauaguuagcaaaaguaaacuuuguuuuacaagaaccuauucuuauaccugguagugguaggguuugagauggcuugugauuuuuuaaguguauuugaaacugaugagauaaaagcuguguaguuagaaaugaauuaagaaaauucugacucuuaaaauauuggcagagauuugacuucuagcccucauugugaauguucuuggcuuugcagugcaucaugcaucuugaagauagacuacaggagauguaccuuaaaaguaaaaugcuaucugaauaucuccggggacacacacgaguccaugugaaagaauuaggugucguacuggggugaguucugugaagugccgucacuugucccuuugauagguaucccuagcauuguacccacuaacguguuuagccugugucacccuaaaccucaggcccugguaacccaucaaaguauguggaguccaucagauacgugccucugcaacuccccaaugaacagcauguuccguuaucugauacuggguuucacaccuacaaucaaucgcaggacuuuaggcuggucgugcuuuguugcucuucucuguggauuaucuuaugcuugaaaagaaaauuuaaucccacacugcccguuucuaguaacugaauaagaugcugaagucacaagcugugggacaugcagcagcagcuuguguuuacauuucacuuccuggaggaggaguagguuggcacauuccaccugguggcaggaaaggcccuucuaggcuugaggagccugccugcgugucuguggggggacagugcuuuccuuccuuuauuauaagcccaccaaagaggagacuuguauguuacuaaaaaugccuaucauccuccagaggguauuugcuauaacuucucuaggggaaguaauucuuacuucuguuuuacugucagcuugauuuuucaaaagagaacaaaaagacauuguacauuuggggaacugcccccgcuuauccaugaugaugauuccccucacuugggagaagaaaauauuuauaaugucgacguuuaaauuaucuaagccuccuaagagacuggggccuuuguguuuugcuuagauuucucaucuuucacacccagaaugugacgccuguguuguucggcucuuggcauuuccugucauagauuauucuuacauacuuuauuuacaaaguauuucccccuuaugagguguuugcuuuugcaguuaacuugcaacaugucucuuugucguuuuuuuuuuuugcuuuuguuuauaucucucuaccagccucauacuucaauccugccuuauuaguuuuuuuuuuauuauuauuauacuuuuaaguucugggauacaugugcaaaacgugcaggucuguuacauagguauacacgugccauggugguuugcugcacccaucaacccgucaucuacauuagguacuucuccuaaugcuaucccacccccagccccccacccgccaaauaggccccggugugugauguuccccuuccuguguguguugucauuguucaacucccacguaugagggagcacaugcgguguuugguuuucuguuccuguguuaguuugaugagaaugaugguuuccagccucauccgugucccugcagaggacaugaacucauccuuuuuaugguugcauaguauuccaugguguauaugugccacauuuucuuuauccagucuaucauugaugggcauuucgguugguuccaagucuuugcuauugugaauacugcuucaguaaacauacaugugcgugugucuuuauaguagaaugauuuauaauccuuuggguauauacccaguaaugggauggcugggucagaugguauuucuaguucuagauccuugaggaaucgccacacuguuuuccacagugauugaacuaauuuagacucccaucaacaguguaaaaguguuccuauuucuccacauccucucaagcauuuguuuuuuccugacuuuuuagugauugccguucuaacuggugugagaugguaucucauugugguuuugauuugcauuucucugaugaccagugaugaugagcuuuuuuucauauguuuguuggcugcauaaaugucuucuuuugagaagugucuguucauauccuucacccacuuuuugaugggguuguuuuuuucuuguaaauuuguuuaaguucuuuguagauucuggauauuagcccuuuaucagaugggaagauggcaaaaauuuucucccauucuguaaguugccugcucacucugaugauaguuuauuuugcugugaagaaacucuuuaguuuaauuagaucccauuugucaauuuuggcuuuuguuaccauugcuuuugguguuuuagucaugaagucuuugcccaugccuaugccugaaugguauugccuagguuuucuucuaggguuuuuaugguuuuaggucuuacauuuaagucuuuaauccaucuugaguuaauuuuuguaaaagguguaaugaaggguuccaguuucaguuuucugcauauggcuagccaguuuucccaacaccauuuauuaaauagggaauccuuuccccacugcuuguuuuugucagguuugucaaagaucagaugguuguagauguguggugguauuucugaggccucaguucuguuccauuggucuguauaucuguuuugguaccaauaccgugcuguuuugguuaccguagccuuguuguauaguuugaaggcagguagcaugaugccuccagcuuuguucuuuuugcuuaggauugccuuggcuaugcaggcucuuuuuugguuccauaugaaauuuaaaauaguuuuuuccaguucugugaagaacauccaugggagcuugauggggauagcauugcaucuauaaauuacuuuggggaguauggccauuuucacaauauugauucuuccuauccaugagcauggaauguucuuccauuuauuuguguccucucuuauuuccuugagcagugguuugcaguucuccuugaagagguccuucacaucucuuguaaguuauauuacuagguauuuuauucucuuuguagcaauugugaauaggaguucacuugugauuuggcucucugucuguuauugguguauaggaacgcaugugauuuuugcacauugauuuuguauccugagacuuugcugaaguugcuuaucagcuuaaggagauuuugggcugaaauguugggguuuuccaaauauacaaucaugucaucugcaaacagagacaauuugacuuccucucuuccuauuugaauacgcuuuauuucuuucucuugcaugauuguccuggccagaacuuccaauacuauguugaauaguugaauaggaguggugagagagagcauccuugucuugugcugguuuccaaagggaauucuuccaguuuuugcccauucaguaugauauuggcuguggguuugucagaaauagcucuuauuauuuugggauacguucccucaauaccuaguuuauugagaguuuauagcuugaagugguguugaguuuugucgaaggccuuuucugcaucuauugagaugagauaaucaucugguuuuugucacugguuuuguuuaugcgauggauuaccuuuauugauuuguguauguugaaccagucuugcaucccagggaugaagccagcuggaucgugguggauaagcuuuuugaugugcugcuggauucaguuugccaguguuuuauugaggauuuuugcauugauguucaucagggauauuggccugacauuuucuuuuuuuguugggucucugccagguuuugcuuucaggaugaugcuggccuggccucauaaaaugaguuaggcagaagucccucuuuuucuauuguuuggaauaguuucagaaggaaugguaccagcuccuguacacucugguagaauuuggcugugaauccaucugguccuggacauuuuuugguugguaggcuauuaauuacugccucaauuucagaacuuguuaucagucuauucagggauuugacuucuuccuaguuuagacuugggaggguguaugugcccaggaauuuauccauuucuucuagauuuucuaguuuauuugaguagagguguuuauaguauucucugauguuaguuuguauuucugugggaucaguggugaucuccccuuuaucauuuuuuguugcaucuauuugaauauucucuucuuucuucuuuauuagucuggcuaguggucuauuuuguugaucuuuucaaaaaaccagcuccuggauucauugauuuuuugaaggguuuuuugugucucuaucucguucaguucugcucugaucuuaguuauuucuugucuucugcuagcuuuugaauuuguuugcucuugcuucucuaguucuuuuaauugugauguuagggugucgauuuuagaucuuuccugcuuucucuugugggcauuuagugcuauaaauuucccucuaaacacugcuuuaaauguguccuaaagauucggguacacugugucauuguucucauugguuucaaagaacuuuuauuucugccuucauuucguuauguacccaguagucauucaggagcagguuguacaguuuccauguaguugugugguuuugagugaguuucuuaauccugaguucuaauuugauugcacuguggucugagagacuguuaugauuuccauucuuuugcauuugccgaggaguguuuuacuuccaauuuuguggucaauuuuagaauaagugugaugaggugcugagaagaauguacauucuguugauuugggguggagaguucuguagaugucuauuaggucugcuugguccagagcugaguucaaguccugaauacccuguuaauuuucugucucguugaucuaauauugacagugggguguuaaagucucccauuauuauugugugggagccuaagucucuuuguagcucuuuaagaacuugcuuuaugaaucuggguccuucuguauugguugcauguagauuuaggauaguuagcucuucugguugcauugaucccuuuaccauuauguaaugcccuucuuugucucuuugaucuuuguugguuuaaagucuguuuuaucaggacuaggacuacaaccccuacuuuuuuucacuuuccauuugcuuguagaucuuccuccaucucuuuauuuugagucuguguauguguuugcacgugagaugugucuccugaauacagcacaaucaugggucuugacucuuuauccaguuugccagucugugucuuuuaauuggggcauuuagcccguauuugauuuaagguuaauauuguuauaugugaaugugauccugucauuaugaugcuaguugguuuuuuugcccguuaguugaugcaguuucuucauaguguugauggucuuuacaauuugguauguuuuugcaguggcugguaccgcuuuuuccuuuccauguagugcuuccuucaggagcucuuguaaggcaggccugguggugacagaaucucucagcauuugcuugucuguaaaggauuuuauuucuccuuugcuugugaagcuuaguuuggcuggauaugaaauucuggguugaaauuuuuuuuuuuuuuuuuuuuuugagacagagucuugcucuguugcccaggcuggagugcaguggcgugaucuuagcucacugcaaccuccgccccuccagguuuaagcaauucucugccucagcguccagaguagcugggauuacaggcgugugccacgaaaauucuuuuaagaauguugaauauuggcccccacucucuucuggcuuguaggguuucugcagagaucugcuguuagucugaugggcuucccuuuguggguaaccugaccucucucuggcugcccuuaacauuuuuuuccuucauuucaaccuccgugaaucugaccauuaugugucuugggguugcucuucucgaggaguaucuuugugguguucucuguauuuccugaauuugaauguuggccugccuugcuagguuggggacauucuccuggauaauaaccugaaguguguuuuccaacuugguuccauucucccugucacuuucagguauaccaaucaaacguagauuuggucuuuucacauagucucauauuucuuggaggcuuuguucguuuguuuucauuuuuucuguaaucuugucuucacgcuuuauuucauuaaguugaucuucaaucucugauagccuuucuucugcuugauugauccagcuauugauacuuguguaugcuucaugaaguucucgugcuguguuuuucagcuccaucaggucauuuauguucuucucuaagcuaguuauucuaguuagcaauucaccuaaccuuuuuucaagguucuuagcuuccuugcauuggguuagaacaugcuucuuuagcucagaggaguuuguuauuacccaccuucugaagccuacuucugucaauucaucaaacucaauucuccauccaguuuuguucccuugcuggugaggagcugugauccuuuggaggagagagcauucugguuuuuugaauuuucagccuuuuugcccagguuucuccccaucuucauggauuuaucuaccuuuggucuuuuacguuggugaccuucggauggggucucugaguggacguccuuuuuguugauguugauguggcuguuuucugcuuguuaauuuuccuucuaacaggccugucugcugcaggucugcugugguuuguuggagguccacuacagacccuguuugccuggguaucaccagcggaggcuguagaacagcaaagauugcugccuguuccuuccucuggaagcuucgucccagaggggcacccaccagauuccagccagagcucuccuguaugagguucugucggccccuacugggaggugucucccagucaggauacacaggggucagggauccacuugaggaggcagucugacccuuagcagagcucaaacgcugugugggggauccacugcugucuucagaguuaucaggcagggauguuuaagucugcugaagcugugccuacagccgccccuucccccaggugcucugucccaaagagauggggguuuuaucuauaaaccccuaacuggggcugcugccuuuuuuucagagaugcccugcccagagaggaggaaucuagagaggcagucuggccccaguggccuugcugagagcugcagugggcuccgcccaguuugaacuuccaggcagcuuuguuuacacugugaggcuaaaccgcuuacucaagucucagcaaugguggaugccccucccccaaccaaccucaaacgucccaggucgaccucagacugcugugcuggcagugagaauuucaagccaguggaucuuagcuugcuggcucugugggcaugggacccacugagccagaccacucggcucccuggcuucagcccccuuuccaggggagugaaccguucugucucgcuagcauuccgggugccacugagguauggaaaaaaaacucuugcagcuagcucagugucugcccaaauggccgcccaguuuugugcuugaaacccagggcccugauuguguacacaccaaagggaaucuccuggucugugggucaugaagaccaugggaaaagugcaguauccagacugcagugcagauauugaguuccucacggcuucccuuggguaggggaaacaauucccugaacccuugcacuucccgaguaaggcaacaccccacccuccuucuacuugcccucugugggcugcacccaguguccagccacucccaaugagaugagccggguacaucaguuggaaauacagaaaucacccaccuucugcgucgaucuugcugggagcugcagaccagagcuguuccuauucggccgucuugccuuauuagauuuuccauugccaaaugugugccuuacauuucaagggcuuuaccccauccuugacccuuacaggugugcaucaacacguguaaucauaagcuuuuauuccccuuugcacucaucucuagguccucuuagugcauuauuaguggacucauguucauccuuccuuuauccccuuccucccguagucagggccaguagcacuaaaaguacuagagaacuucugugcacucugaaaucagaucuguauguagcauuacuggagaaggacuagaaaaccccaugagguaaugccagauacuguuuuauuuuuacuuugaggaauucaaggguaaggauuaggacauaguccacaaacugaaacaguucaauuuuuuuuuuucaugacaccuggcaucauuuuuagccagugcccauacuguauccaccucugcuguaagagaggcagccaaagcuguguccauuugaaaccaugaugucucuuaacccaguaccuuuuagugucacuuugcucucagaaucuuguggcuuaaaugcucagugaggaucccaguauaaacuuugaacaaauucccaauguuuuuuaagaaauugcuaccaucaucguuuuucuaagaccaauuugaacuuaggugaaaaaucaguaugcauuuagaaguguugacuggaagaaugaguuuauaauggagaauaccuuaaaguaugauacaaugaaguuauauagggaauacaggaaaguuagaaagucuggugaccccugccaagggaaaaagagcuuuauguccacacacaggcacaacacacuuccuguauuucucucccuuugccucccuggucaguguccacuggaauauuuuauuaaaagaguaaguuuauuauccuuccaucuguuuugcuuuuucauuaguuuuaaaugauaaucuaucaaacuuaguaccuagaaauaauacuuucucauaaaaagaaauaauacuuucucauaaaaccaugcucuuuuaaaguaauauucuuuucuuuucucaauauucaggauugaauccaacgaccugccucuguugacugcuauugccaguacucauucuccuuauguggcucaaauacucuuauaagcuaaagcucaggacaguucuuccuuggaagaaaaaaaucaaauucucaacugaaggagaaaggaauaagcucucugugaugucaaaagcaugagaagagcaaacagaaacagucauuccaccuuuuuguuuuguguuuuugcugucaagcugaugcuucauugaagacuuagguuuacuugacauaauagcauuugugauugucgugaacacuuuaggccauuuguuacccaugaaucaacaaagaaacugaccuuuuugguaggaggaaacauaagcacuaaacacuaagcuguugcaacagauugccuugugcuguuugggcagaauaaagacaagugacuugagcgggguggucagcaguguacauaauauuccaguaggaaacugcuuccaaguuuaagcaugagcuccccaaacuggagaaaacauauuuugcuauucugagacaacaaucagaauacagacuuuggauuccaggucacaguuugcuuuuuagacaagguaaagcaaagaaagccacauugugccaucuucagcuccaguggcuuuagcagugacuguuugacauaaaacauguaagaauugcuuguugggaagagugcuuuagggacccacuguuuucauuucuucuuggaguuuaccuuguuucagaugcagccauggguaggucagagauggauuguuggugcaauaaacccaagaaucaauguagccucuuaaucccaucaagauguaguuuguagcagcaaaguguacagucugaaaccguauguuuuauccuuauauuuuagagcuuucagcagccuuuuuaagagaggccacuuaccaaaguuauuucuauaagcucaagaguguuucgguugguaaguucuuccagcugaagccacuuuuuccuuauaguuaauacaaaugacuauuuuuacuuuaaaaggcacagcuguccuggugggaaaugaaaccugcagcaguucaggaugacuaaugaaagcaauuagcuugaacauuuagaaaaaauucauauaugaucuaaauuuuuauauuaucauuucugugccuucuaauuccugcauccuuuucaaaacaucuuuccagacauuaacuuacacauuguauaaaaccgaccaaaaugauuuccuaaaguucaugcaaaaaaaaaaaaaaaacaaccuaauuuucuguuaauauaaaagaaacuucaguuuacugaccgugaaacagacuauguacugacauccaggguaaaguaaaagacuuuuaaauauuggucauuaaaggacaggagcuaagcuagcaaagcaaaacaucuuuagcacuuugcagaucucaagcaguuaaccaggcucugauucccuuccacuguuuuaugaauuaauuccaguucuuuucauguaucuuugaaccuaagauuaugaaguaauuucccuauuagggacuagaaugacuucaguuuuuucauuugauaaaaaucagaacugcuaccuuucccuuuuuuaaugaugcaaaauguagaugagugcauuaaguuuuguaagaucuuuaucauuuuaugucauucauugaaaauugaaauguucauucuuuuuaauguuuuccuauuuccuuuugccuagcauuugacuuugguguuuuaaguucuguaguuccaugacaucauuguuugcuguuguguuacagagagagaaggaaccucaccuguggcucagcucaccccacauccguuucucauuacguguaaauaaacugucagagcugauguuacagcuuuuacaguuuaaagcauuccccucgucucuaguuccuuuuuucuuguuuacauguuuugggcacuuucccucauucaccaccuuccaggguuucauagaaaauaacuuguuacaaaaucaguucaauucuaauguggacauaguggcauguucauaauuagacccauauaggggacacugagcuuuaaaucguugauucuaaacucuauacauuaaaaaaauucagcccaggccccucaaagccugagaaaauuuaauuugcucuuaauuuaauguuccaaaacucacucuuggaaaaaugccuguuggaaaacuacaggugggucacaugugggggcugucuccgugacacucaggauuccagucagaaccuaauccucauaucuauugccuacaaaaauagaccaagaauguugcugcucuuuuauaauccuuuaaauauuuaacauucaaguuuucuuugucuuaaauucagccucuuccuaaaagcaaaaaagaaaaaaaaaaccucacagaauuguguugagauccaccgcucacacgccguacaccacccaguggcuucauucuggcuuagccgcagaggcaagaaagggaccccacuugcucccaugcccaccucaagaaaaaacauaaaacaauuuuuuuuaaaaaagaaaagaaaucuaccucaguugacaggauuccaccuuuaggguuucuucaacuuuuaagucuuaccuguugaguguaacuuuuguagcaucuugcuuuuccaagcaagcuagugaggcaugacagagcagaagucuguaaaugucccugugauggaccucuuucuagcauguugcaguuuuauuuuuaauaaauugguaagugaaaugaauguaaagguaauuguguacguuuuagacaugacaaugaaaauuuaaaauguagcuuccauacuugugcauaauuccaaaguauuuuauuuuuuaucaaucaguguuaaauagcuuuuuguacaggcuucaauccauuuuucgaagugugcuguuuuuuaaugaaaguaacuauaaucuuuucacaucccauggaacugccguuuacacauugcaacuuuuuaaacuuaaccauauuuuucaaaauuaacguuuuuggagggagaaaaauccccgcuugcuaaaugauacuaaaccguuguuugggcucuuauaauuagguccugagauuuuauaaaaauuuagucuguagcuuuuuagguucuucacuagaguugguuguacauaaaaauaauaaagaauauaaaguaucccaaaauucuuuuaaagucuggauuuuuccgcuaauauguacuuuagagaauauuuuguucaugcauacuuccacguuaaauugaaaaugucuucagcuucucuugguaaaugugaaccauuuguuuuuuauugugcuugggggagaggguauuuuaauauaauuuuugccuaaaucaagaaguccccucugaauguuaauuuuuaaaugucaaaauaugaugaacgauauaucuugaaagugagauugcaauaugcuuaaacuuaagugguauuucaaaaacgagaaaauucuggaauuugucauuugaagcuccauaagagaaauugauaggacuucguuuuugaucagucugaauagauaccaaugucauugugugggaauuuuuuuuaacuuguuuauguauuauuuugauccauuuuucuguggcauuuggugcaauaaaacuuuugaauuuaucuugaacauuuuccuggugcugcaugcgauuuguuauauuuaauaaaauguagaggucucauuucuaauaauucgugcugaaaacaagcugauuauuuaucucagugguuuuuaaccgggguguuuuggaaaugcagggacauuuuugguuagcauaaugccagguuaggguuacuggcacagagaggcugggggcucagaugauaggcgagagguccugcaccaugugagacagccccaugggaugaggacuugucccacccaccuccugcguaacccuuaaauguccugcuggacauuuauauggcuaaaaaagccuguuuauaauuaag

SEQ ID NO: 13651 - RNA, 49710 nt, Homo sapiens
cuuuccuuaucuguguguacucuuaucucacuguucuauuuuuucuccucauuuauauuaacucuuucuuaccuuuuuuucugaacuucuaggccuucucuuuccagaacugguggaagacaaaugaaacggccaagaugguaaggugaguaguuccugggaacgcuugugcucuaaccccaaguuaugugggauggacacucgaggggugauggcauuccucauuuuacaaguuacuugcuuggcugcggcugcuccaccaagauagcaaacauucucgaucuuuugaacuucaugagacugacauuucugagucuguuugcgaacaggacacuagagggcucccagggguuaaaaauaaguggaaauuuauuugaaugaaaacugauucucuacggcauuucuuuuuuccgaauuuaaaauuaaaguuuauuuuguuaacuauuguuuuuaaaagcuuuguaucucuuaaaaccaugcagcagucaguuuccaaguuuugcuuugcaaucaguaguuuucaagggagcuuuuaaagcugaacugaaauguuugaaauguggaacacucuugaccaugaaauauguucuacuuacaugccucagccuuuaaaaguucuuugcauuagagucaaggauuacauucuuccuggagccaagcauggggccagcuguguaaguaagguugcuuacgaguuucuucuuuuucuuuuuaauagugaaaaaacagaacuagagaugcuuuuauuuucuuucagcugacuucgguggaaagaaaagaaauaaaaagcagucagaguuguguuguguuguguguguguaugugugugagagagagagaaagagagagagagagagaaacagaauaaaugcaacugcuuccaagauauauggacauuuauggcuuuguauuauacuaacaauguaagcuaauggaacauauuauuaauaugaaguacaauuuguaccuuuagacuaagagaauauguuucuaaauuuuauuguuaauacuugcugcuuguacuuaguuaauucaggacuuuaaaaaauaaaaaugguauagguauagaguauuaaaaaauuaucuauuacuugucuuaaguucuuucugaauuucaaaaaggaaaagcccagguuugucacauuuuaacgcuuuugcuucagagucaacuuaaaugacucuagguacaaguuauaaaacacucuuggauuuuuguggcuuguuuucacuacuuucaagugacuaucaaaucuauacaucuaucucguuugcaugcuuuuaaauuuuauuuuuaaaaacauuuaguggugauauuuaugaaaggaaaugauuacuuuuuuucuugacucuuguagaggaacuuaaaugguuugaaauugugacucaguuaacucuguauccauucauucccagaaacaagccgcauuucuccuuggggagacugauaauuuaaaagguuuguugugucagaaacauucccagcuucaucaccaacccuuuccuuccaccucugcccacuggagaccacuuauaucccgaagcggacgcggcagcugaagucaggaaaccaugcaucacauuagcaggagccaacugcagacuuuaaacuccguucaacauguggaugcggcagagaaaugaccuguccagacaagccggggcagcucauaaacugguucaucugcucccugugcgucccgcgggugcguaagcucuggagcagccggcguccaaggacccggagaaaccuucugcugggcacugcgugugccaucuacuugggcuuccuggugagccagguggggagggccucucuccagcauggacaggcggcugagaaggggccacaucgcagccgcgacaccgccgagccauccuucccugagauaccccuggaugguacccuggccccuccagagucccagggcaauggguccacucugcagcccaaugugguguacauuacccuacgcuccaagcgcagcaagccggccaauauccguggcaccgugaagcccaagcgcaggaaaaagcaugcaguggcaucggcugccccagggcaggaggcuuuggucggaccaucccuucagccgcaggaagcggcaagggaagcugaugcuguagcaccuggguacgcucagggagcaaaccugguuaagauuggagagcgacccuggagguuggugcgggguccgggagugcgagccgggggcccagacuuccugcagcccagcuccagggagagcaacauuaggaucuacagcgagagcgcccccuccuggcugagcaaagaugacauccgaagaaugcgacucuuggcggacagcgcaguggcagggcuccggccuguguccucuaggagcggagcccguuugcuggugcuggaggggggcgcaccuggcgcugugcuccgcuguggcccuagccccugugggcuucucaagcagcccuuggacaugagugagguguuugccuuccaccuagacaggauccuggggcucaacaggacccugccgucugugagcaggaaagcagaguucauccaagguaacagauucacaugcuucguuauuugcagcuguuggggauucugguucauuuucuuuuuucccucacucucuuuuucuaaaugauuuuucuccacccacgguucacauuuggacagcagcagcagcagcgugucuuuccaugcgcuuggcauucuuuauuuucccagccugggaggauaugagaguuccagggaaaugcuguauuggacaugcaagaguaagcccauacuguauaaucuuugcucuccauuucccucgcuucacuucccaguggcuuauuaaaucuaauuaaagccaacggcaauuugcaugaugaggagaggaagcuaggcuggaggcaaagaacuugcugacagucaggcauacuauuaaauagguuacuaugggaggaaguagaaguuuuuaaaaguaagggggaagcggguuaucguucuugagcagauggaaucuucuuaagccgcgcagagccagaccauguuagguuuaacccccccuuuuuuuuucaauggauuuaaccucuuuauuuaacaaauaaaaagaaugagcaaaaauuggugauuuguucaguauguauacuaacuagcugugugguuuuaucaagccccugacuaugaucuauugagucugucuuucaagauucucccgucuugggugacaaacauuuuggcagguucuaacacauguagccaguuacugcaguugccagcaaaaggacuggucugcggucaugcccaugccauauaaaggauauucucugaauauuaaagcuauuccagggcucgaauacaaaguacagugagucaguggcuuauguuugaaugcagaaugaugccagaaguuacaacuuugaauccagauuggcccaagaggcuaaaauguaccccaaagagauuauaagcugaaaggauacuuaacuuucuccauguuaccaugaaauuuagcauuucagugagguucccagggagccuagaauggaauggauuaaaaucccugggaguggcugagacccaacugcauuuccaauggcuuuagcauuauaauuucauuuuaaaauggauaccccuggaaguaccagugauuuacuuagaaaaauuggacauucccuacugauggugguucuugucuaagugcuccagauucacagguaugcuuugaugucucaaguuuauaaagcaguccaccacaguuaugccaauguaagaaaccuucucaaacauuuaaucuaauguugauaaaaaugaauuuuuauugggugcccacaauuugcuaaggauuauacaaauugauucauauguguuggcuccuagaauuuucauaacaaugcuaugaaguggggacuauuauuauuuccauuuaguagaugagaaaauugaggcuuauugagacaaaguaauuggccucaacucccacagcuaguagguggcuaagcuggguuuugacuauagacccagcaaacuucagaacauaacuucuuagccacuggacuuaggugaauauguaacuuauuauccaaacuggaaccguguggcgugaaaggagaugcuggugggcauugggacaacaggcccacacugacuguucugagcagaguagagcacaggaucccccuuguuaugcugaaaucccauucauuuucaugucauaaaggccccagagaggagaagaugaacuccuguguauauccugaggcagaguucucugauauguccuuugagcuucccuuagacgcucuuagacuacuguauugggagaaugcaguaguggcuaagagccugggccguggaguuggacugacuagguuugaacuuaccaaucauacgacuuggaaauguugccaugucucuuuaugccucaguuuccucagcuguaaaaugacaauacugccuaccauaugagauuguuguuaguuaauacagggaaaacacuuagaaccaguauuugccacaagauaaaccuucaauaaauauugguuauuauuauuauuauuguaccaagcacaugagguaccaaguucauugaauuccucacauaaucuccaagucucauguguuacuucguuacgugauaggacuaugacuaaaacugcucaauuaaacuuuuguaaucccaaucccucuuagauauuuaauucuuugcucugaauuuccagcaucuuugagaacaaaaauucauuugaaggcgggguuuaugaucucaauauagccuggauauuucucucuccuuucauaugguaguggugauggaaauaaacuaauaaagcuauacuaauaugacucaauuuaauaaauaaaaucccuaagauuauaucucaaacaacauucugucuuugauaccuucuucuacuuagucauuuagagucacaaagucaggccaguuucuccaggggcucaugaaaugauuucauauaguuaugaauacucuacacaauguaauucuacucaagcagacuguuacaguguugcaaaguacauaaauagaccacuucuggucaugguauagacagcauuagguucucaguaucucuacccauccaccuauuucuagucuuuuucucacugugucuuucuucccugauuuccacggaagcguguagcuuucuucuagggcacugcuauucuguuggucagaguuugacuuuauuugagccuugcagcccacccagggaggcaacagaucuuaccuaguuacccagcaucuuuuucagcuugcucuauaucauuauauuauauaauacauauuuguauuauaaucauuuauuuaaucaucuguuccuucccacuacucucuaggucagugaaggcaaagauacuuccuguuuucuuuagaauugcauuucuggaucuuagcagagagucuggcccauaguagaugcucaauaaauauuuugaaugaaugaaggaaugcguucauugcuuguuccuuggacucuaaacaguaaaacuauacuggaagccaccagcuucuaauacuuaggacguguaauaacauuuuuagucuuaaguccaggcugggcuuucuccuggaggaucucauaaggaauucauuguggagguaauaaaaaauguuuuugguagccuccuuacaaugcaaaugaaagguuuacagggcuuauucuugugagaacuaucagugugguguguuggcaucacacucuaguguaauucgauaaugaguuuucugcaggaggaacaauaggauuuaauuuagguauauauuucucugaugaccuggcuuggucugggaguagaucuuuuaauauuugagagagugagaagccagcaaagccuguaaguaaucuacccuaaauguuguuucuguucugacuuuugauuaauguuuauaaaaauaaauuuauaucuggcaccaagaaagugguuagucuguguugcaaguugaauuuagauauuuaaguugucuuaguuaauuuuucugagaauccuaugcaguagacuuuuuaaaccucauuuuagagaugaaagaaaggcaagaagacugcucaaggucaugugaugaguuaguuguccagcaaaaauuuuugucuucuaacuuccagucuuuucucuuuucauaaaucugcgucccucaacaaauccuuuagggggcccuaagguacaucgucuuucucuaucaccacagccuacuagaaaguuuaguuauaaauaacuaaauauauaaauauaaugaaacagaugacuuauacacugaugcacagauauagccaugggaaccuccuuuuuuuccucaaggagacaaaaaaaccuuaaccauggcuaagaguuauugaguuuuccuagauauauauaccagguaccauucuaaguacugugcuugcauuauuucauuaaauccucauacaaauucuaccagcugcacccagaugucauuaugccuggggacucuuacaaacauuuaacaaauauggaaguugaggcccaaaguaauuaugaaauggauaugugaugugaaaagggagguguaagaaggaaucaaaugcugugauuugaaugaucugccugccccagccuuucagauaaagcucucuguugauuuaaucaaaugacaaagaguuccaauuauaaagcucaucuuuagguuuuuucuaaauuggcaggacuggugugggugauccaaucagcuagcucaguuuaaucugggacaagaucuugauugugugacuugaugaguucuagaugauucuucuuaaauacaaaaagaugugugaaauuaguggacuuacugguauuguacuuuauaacagacuauuuucugacagguuaugcuccaagauauccuagaaaaugagaagggugcacuugaggaagggcaagauaguaauuaauuaggcagagccagcagugugccacaauauaagauccagcaguuaccacuggagcagauuuucguccuguauguuucuguguaggaagucuuaaaaugaauuaaaauauagcaucaaagggccuuaaaauguuugugugcaauaaugaaguauuuuucaauugugacaaagaaucuagugugauguaucacauaguauacacacuguauuugauguguguugucuauuauacauaccuaacaauuuuacauagcagauauuacucuuauuuuaaauaggggaauccugaggcucagugagcuuauaaaaugugcccuacgucaccuaccuagagagcaaugaaauuggaauuugugcccaauucugucucugacacugaaguuuccucacguugcuucuguuaacccacacuaccucacaaauauaacuuacuacaauuaugggauaaugucaaaaaugugcaaauuuuagcaugaugguuucugauuuuaccacuaugccaacauuucuauuuaauuucuuuuuucuauucaauaaucuaacauugacaauauuuuuacucaagugcaguauugauguaucauuaugaacacugcuacaaguuuuuuuaaugcaaaccaaggugccagugcuuaccagauuuucuuguuuaccauaaacaaucacauguguaucaaugugaugaacauauuuguuuucugccaaauuguccuugcaagagucucaaauuauuauaaaagucaccagauacugugugguccugauacauuucgauaauuuaaaaagugaaaauauccuaaaguauuuaucuagcauuagacaaagcagacuauguccauguaaaaaucaagaaaauaaaaaaagagaaaaccaagcaccguucugugaucuuugauuuagcagcuuugccagagcuuccccuguagucugcacaguagugugaaugaaucucgagggacaccauuuugguagcauuuaagcauuguacuauuuuucaugcccagcauggaagauguauuauguaugcuuuauuuuuaggaugcuguuuuauugccacaaagcugucagacugaauuaagguagccuaguuccaagaauucuguaugucaaugcugcuuaguugacaaacugcaggcaccccacacacuuccauuuaaauucauuguagaucccaaguugcucacuguuuuccaacuuguauugccucuucguauuauaaaguaggagaaauauaugguauguuuuucacucucuuuucaagccuaugugagcagcacugugaguucugggugaaagugcaguugccgaggcagggggaugucagcuuugcauuuuauauuguuucaggcuuucagguaaggacacagucguuuugcagggaguguugagaauaacacagauguccucacaacuugcgaacauacuggcuuccaaauccuagaaaucuuugacauauaggcaaacuuucugaaaauauuuauuuaggaguguguaaucauguuuuauuuuuuaaaaaguuggauugaaaguauguuguguucuuccucagaaaagcccuaaggcuauuucuuuaugaaucaaauugagcuggucagcuuaauacauucauucaucagugaacaaaaguuuacugagccucggcucuaagcagcgcugugcuccaguguccucuuauuugcucacuacauaacuucauaggcaaacggggaaccgggcaaccuucucugcugugcuucuguaauuuguccuuggucccacacucugcugggauaaaaggggugauuaaugguuaccacaguacccacagcauaaaagaugcaugugccuuaacuccaugcaaucuaucgucuucuauaggaucacauuuaucuuuucuuccuuuaacauguauuuauugagcaucuacuaugugcuagccacuauucuagucacuggggcugcaucagugaacaaaacggucaggaaucucugcucucguggcacugacacuagagggccaugugugaguucaguguucuggaggaaaucuuccagucaccgaugugaggauucacuaagaaccuucccaagcucaaggaggugggcucuucagugggagugaaucugcugcugucucugaguugauguaaggaccacacaggugcaggagugcuagauagcucuuuuuaccuaaguuaaaaaagaauuguuacaguuccaauguguuuguaaucaauucaauucaguagcauuuuuaugugugaggcacugccccggauacuagggaaaagugguacaguuuguaauuuaaauagcuuuguguuuggggguguggacgggcaauguagacuccuugcaggugaauucugauucugccacuugcuagcuaggugaccugggauaaguuacuuaauauuuuugugcuuuauauuuuauuagcauaauagggauaaugacaauaaaaacaaugaugauaacauuacuuaccuuagaguugucaugagaaugaaaugaguuaauauguauaaaauauaacauugcuuaacgcauacuaacacucuuuuuuuuuuuuuuucugagacagagucuugcucugucguccaggcuggagugcagugcugugaucucagcucacugcaaccucugccuccuggguucgagcaauucucuugccucagccuccugaguaacugggauuacaggugccugucaccacgcccggcuaaucuuugcauuuuuaguagagacaggguuucaccauguuggcuaggcuggucucaaacuccugaccucgugauccaccugccuugguuucccaaagugcugggauuacaggcgugagccacugugcccagcuaacacucuugagugcuaccuuuuucauaccauuucuaagcugauguagcucuuuaugauaugcuucuuuagauuuucuuaguugguuuauccagauugauguuuacuugaguagaauaaaugggcaccuaaaauuuucauuuaaagaaggaccuuggagcuuauaguggauaauaacgagaucucuuauuuguggagugcuaggcaguuugcauccauuaucuuauuaaaugucacaacaguccccuacaucagauaaucuuguacacauuuccugaggggaaacugaggaugaaagaauaauauauguucccugaaagccuacagguagcgugcaguagggcugggauacagacaugggucaagaggacucagccucauuccucaaagcugugccuuacugccucccgcuaucccuucacaucaugugugagcguccaaugacuguagcauggggcuuucccaguuaaucauccauccagauugcaaccacuuuucccauugccuugucgccugaucccugaauguagccaugaugccuaacuguuccccuuuucaugauagugaucuggggucagaaggagagaggcaguaguguuuccaccaccccuauuuucaucgucccaguauauaagagauacaugggaguggauaguugagcacaagcuggacagaaugagggcaucaaaaccucugcacaucccugucucuaugucucaaguguuucucuaauccuucccaauucguauugagugaagacagugaaauuacaccuuacuaggaugucaugccaggcaaauuuuuauucuggguccauggaccauuccuuagacucuaagagcuauccaugaacauugggggauucugaaaaaaugcacucagaauuuuugagugcuugcuuuguucuagacacugcaucaaaaguuggagauccagaggacuaagaaguagucucuguucuucagagcucucagcuuggaagacaggagacagugaagcaaaccuaccuuacaaaaaaugugugauaaaaaccucaauggagauauuuuuaggaggcccuguaggcacagagagggagaauuuaaccuagaauguguauguaggggguugagugggaaauuauaaauacuuuuggaagaaguaaugccagaacugguucuuaaaagucacuguggguggugugagagaugggaugggugcagaaaguauagagagaauagacuaugaaaaacgugugaaagcagaguguguucaggaaauugcaaauaguucggaaaaacaacagauuaggguuuaggggcacgaugugaguuaagcugugguaaguggagagugaguguguuuuauguccugcaaggagccuggacuuuaucuugcagaaaauagggagucgcugaaggguuugaagaaagggagugaugucaugggcuuugcacuguaagaaguaagaagaucacugaggucaggaauucguggcuccuuuaacuggauuaacaaaggcuaaaucgcccaggacugagucacccugaugugaccaagauuucaucugcaaaaugugauuguagagucuggcacagugaccacaucaucaccacccucugaagucaaauuugauuccuguuuuuuaaaguggaauauugagacaggaagagucuuggaguuuccauuuauacagcagaaguucagggcagaccuagaaagcagaaguuccugcccauuugucagaacaaagaagaaugccuuguuuucagaggagaacuggcgauuuaaguuguuuagguaguuggugaugaaugaagucacaagacauucuccuuuccugcuuccuugacuucacacuuagcuaacuccugaggaaguauggagauuauuuuaacucaguuaggccuagagaaaacaaacuaugaagugaaaaacaguuagauaaauaaauauaugaaacauauuuggaaucacgcagagaccuguuucuuuuuuauuauuuaauuuaauuuuaaguugaaaaauaauauuuguauauguuuaugggcacaaugugauuauuugauauauguuuacaauguggaauuauuaaauuaggcuaauuuaaaaauccaucaccuuacuuauuuuuuuaaauuuaaauuuuaacuaauuuauuuuuuaggcuucuucaaaucauaggaugauuuuuuuugggugaaacauuguaaauauauucuuuuaguaauuuugauauauacguuauauuauuauuauagucaccauucugugcaauagaucacuaaagcuuaucccuccugucuaaccgaaacuuuguaccuguugaucaacacuuuucccaucuaacccccucucccagccucugguagccaccauucuacucucuacuuuugagcucaacuuuuuuagauuccacauauaagagaggucaugcaguauuugucuuucugugccuguauuauuuugcuuaaaauagugucauccaguuucauccauguugucacaaaugacaggauuucucccuuuuuaaagggugaauaauaguacuccauuauguuuacguaacaaaacacauuuuucuuauccauuuucugaugauggacaccuagguugcuuccauaucuuagcuauuauaaguagugcugcagugaacaugggagugcagacaucucuucggcauacugauuucaauuccuuuggauagauacccagaauuaggauuacuggauaguaugguaauucuauuuuuaguuuccugagaaacuuucauacuguuucccaucauggcuguauuaaugcauauuccaaccagcagugcuaaggguucccuuuucuccaaacccucaccaacacuuguaaucuuuuugucuuuuugaucauagcccuucuaacaggggugaagucauaucuuauugugguuuuaauuugcuccaggacaagucccuagauucaggacuuguuuggccauauaaaaucuaugccuauguaaucuacagacuccuaccuccccaccuacuguuuuuaaaaaucaugaaaaccuuauggagguuuauuucuuuucgcauuaaaguuuuccuucaaugcguuguugacaguugugauggggcccaacagaauuuguuuccuauaacaaagaugccacucaaguuugacuggcuuuuguuuucuucaauggguauuauagaguuguuuuuaaugaaggacuggagcuggacugucacuugcuuuuuaucuuguucacaaggagucuuggaacauggcccgugcaagagaaagaacuuuugauuucagagcucaagacuuuucuucuuauuuuugcucagugacaaaugcucacagacauucauagcuccacccaacaugcuuagcauucaccuauaauuccacaaaaccgcucagccagugcucaaagugaagggcauuuaauaaaucuagacaaagaagauuguguaaagcacucauucuaagugaauuuucauguucaucuucucagaagaaugucuucuuugugcuuuugaauaaaaaacgacuugggagagcaccaaauucagcggaaauauucagauuucagaaaaaaagaagcuuuccuggcaagucucauuuuuuaggacagcuauauaaccuuuaauucacaugaacacccacauaucuuuuaaaacccgcuuucucaccacugugacagaauuuuaucucuucacuuguugagauuucucuagagaguccaguacugcaucauuuugacaaaccugaauguggagagaugaaugcuucucaucucugaaacacuucaggguaaguugcuuuaaccaguuuccuguuuucagaggcaauuuuucugucaucucuucaaauccauccagguucauuuaauucuuucaaaagccuuauauuaaaagagguggaauucuccucaacaguaguacucauugcucugagaucuggaguuaugcugacugcuauuauuaccugcaagggccacacacacguauauguagcaagaaggccuguauguggaaaggaaccacagccaucugugacucagucugucuuacugcucaccaugcuuucuucuuguucucuggaaauccccuuuccugaggugcacugauuucuagcagggcaggaaagaaugucuuuaugcgauaguuggcauucaaaauauuuugcugaggggaaauggaugaauugggagaaaaacauaggcuauuaauugaaaaccaauuauacuuaucagcugaacacuuuauuuggcaguuugaggacaccuuuuuaaugauuaguauagaaaauguaucauuccaaaaauuuggugaucuaaaauagagaaauggugacugacauacagcauacccauaaacuaaauuagggguuaauguauagccuguaggccaaaaauggcccacugcccauuuuuauuuugugaacuaaaaauagucucuauaauuuuaaaugauugacaaaaaucaaaagauuagugauauugcuauaacccuugagacucauaugaaauuuaaguuucaccauacacaauaaaauguuaauggaauaguuacaaccacuuguuuauauauuguccaugacugcuuuugggcuacacuggaguugaacgguugcauaguugaauaguugugauauuuuaggcccucaaaaccuaaaauauuuacucucugccuuuuauaaaauuugcugaucacugggcuagauuauugcauuacaauuaaagugguacuauuuaaaaauaauuaaacaaaauauuuauaguauaauauuuagugaaauaauuaugacaaacucuacauacaagaugaucccaaauagcuuuuuuucuuugcauaauuuuugccucuuucuccugguagaaauguaagcuccaugaaagcaaaaaacuugacauuuaucuguuuauauauguagcugcagguucuagaacagugcuuagugcacaguaaaugcucaagaaaugguaaaggucaguugaagccugaugaauuaugugauuaugugauguauauauguaauaaucaucagagcaaaaccuuucuggggcauguguuuauguuaggcaccaugcugugaauuuuagaggcacgaucucauuucuuccugauaaggucaguuuugaauguauguuguugcuucauuuuacaggugagaaaaacaagguuuaaaaagguuacauaacuucucuaacguuacaaaaugaagacauaaugugaccagauuuuguuggauuccagagucugagcucuaaccauaaguuauacuccuuaaaaaaaauucuagaagcaguuuaccuauucagaugagaaagaaagggauagaaaaauaacuggaaguaaauauacaaauaacaaccaauuacugggagaugagguuauaggugauuuuuauuuucuuagcuauacauuuuuauguuuuucuauauuucaugaaaugaguggauuuaccuuuaauuaguuuuacaauuagaaacaaauguuucuaaagggaagaaaaacagcccagcagguuucaauuguuuauguagaucaauuuccauauuucuccaaaggccuuauaugaauugcugaggaaacugcuguccuucugacccgcguguugauuuguguugaaguucacuguuagguuucaacucccuuugauuacuuucuagcccugagcaugcaaagugcuguuugugugcauauaacuuugguucaaagacacuaauagaaagagcuucuugguguuuguuuuuagacgccugaaguacacacguuuggaggcuguguguguguuuucuauuuguauuugguuauacuggcccagugcugucuuccacagcaugauggauugcuuuuaccuggaauuuauucuuuuaaaauaaauuggcaugguacuugggauauacacauuuaaaauuaucugauaucuaagaagauaauuaggccccaggaaccccaaaucauuuacuaagguaaaaagacauuggaaggagagagagagugcuacaaaugaagcuuuuuuguuauggcucacauuucuuucucuacucuucucuuaguuuuguaucaaugauuguggcauauuuuccauaauccaauagacuuuccacaugcccuggccuacauugcaaggcuaaagggagaaagauuuuucuuugaacagaacuagaaugcaagugauuagaaugauuuaagugaaugcuauucaaacuauuaagguuaguauaacaccaaacucaggagugguuugagagggggacuguuuccuguguuaaagaccggagauaagaauucuacaagauggcaagacaguaagguggcaaaauaaaaguuucuaauaggccauaaaguuauauauugagaacauguaaguuucuaauaggccauaaaguuauauauugagaacauguaaggcuauuuaagagagguuuuaaaaauuccugugacaagucugaacauucugguuguaauuucagaggccucuguuguucagacguguuaagaaugaguuaagugggcuuuauuggaucuuuguaauuuaguuguuuuuaucaggcacaucauucugauuuuugaguuauaagcaaaguugcuccacaccaucucuuugugacuuuauugggcagaaaugggggcuugggaaugauguuauugguuuuaagcuuaaaguguuguuuaaugugucuggaucauggucuuccuuguuuaugauuauuucacuggggcucauaauucuuuguaaaguuuagcaauuaaagaaauuacauuucuaaacuuccaagagugagacaaaacaaauugagugacagguuaaaaaagaucaucuaugaacaugcaguugaaaaacugacauuugcuuaaaugcacuuuguugagguuaugugugaauaaaugaucccuuaccaagagcacuguugugcuugcacaguuucuaucaggaaagaaaaaaaccucuugccucuuuuuuucugucuuuggagauuauagugauuggugugaaccauacaauuucacuuuuaaauuugcgacuucuaaaaauucuuuuucuuccugacaucauaauguggccucagaaaaucagacaguuguuauuacaaauaaagagcagcuccacucagacauugaauagacaauuauaaaugucuagauucuuucccuuuuugugguggcugcuuuuagauguggaauaaaaccacauuaaccauaggacguuguuauuggugcuuaguagccuauuccugccacaucuauaaaauaucucguuuaaauuuuuuuucauugucuaacaauaacuuucugcuuuaugagacuucaaacaggaagcauugagguaugaaaguauuaaaaccagaagacaaagagaucauaaaauauugucagauuaaacucucacauuugauaggugagcgugagacugugaaagagugaacgaccugcucaaagacacacccugagucaauagugugcugaaaguguguuuguuuuucugauucuauagauggccgcccaugccccaucauucuuugggaugcaucuuuaucuucagcaaguaaugacacccauucuucuguuaagcucaccuggggaacuuaucagcaguugcugaaacagaaaugcuggcagaauggccgaguacccaagccugaaucggguuguacugaaauacaucaucaugagugguccaagauggcacucuuugauuuuuuguuacagguaaguuuaucaaaucaagcaaauaguuaucuaagacuggcgcugaguuauauuagccugacacuaaggaauguucagcaccuggaguuuuuaugaagcuggugauaacuucuauuagcuuggugcaaaaguaauugugguuuuggccauaauggccaaauguagaugaggccuccagguagcaggcuucagagagaauacauuauaaauguuucuuaucagacuuaaagagguaccagacucuuaaccucuccuggagcaggaaaaagaucuggaaagggaaggggauucucuacagaauguagauuuuccgcacaagggacagcuuggcagggccauuucaaaauauaucaaagaaauacaucuugggguaaaauacuuugauuucuuucagggcccacugucugccauguugguaucuuauugcuacaaagagaaucugcuuugucgaucuuaaguucuguuuuaauguuaaugccggucaacugugccugaauuccaaagggaagaauguauaaggaggcaugcccaaccacccauugccaucauggccugaacuaguguucagguuuacuuuuauuuuuuaauuuuaauuuuuuuaaauuucaauagguuuuggggggacaggugguguuuuguuacauggguacauuauuuagcggugauuucugagguuuugguguacccaucaacugaucaguguacacuguacccaauguguagucuuuuaucccucacucuccucccauucuuuccccugagaccccaaaguccauuguaucauucuuaugccuuugcauccucauagcuuagcuuccacuuaugagugagaacauacgauguuugguuuuccauuccugaguuacuucacuuagaauaauggucuccaauuuuauccagguugcugcaaaugccauuauuucauaccucuuuaugcaucaguaguauucuaugguauauauauaccacauuuucuuuaucuacuugauugaugggcauuuggucugguugcauauuuuugcaauugcaaauugugcugcuauaaacaugcaugugcaagugucuuuuuuguauaaugacuucuuuuccucuggguagauacacaguagugggauugcuggaucaaaggguagaucuacuuuuaguucuuuaaggaaucuucacacuguuucccauaguaguuguacuaguuuacauucccaccagcagugcaaaaguguucccuuuucaccacauccacgccaacaucuguuauuuuguauuauggccauucuuccaggaguaaggugguaucacauugugguuuugacuuguauuucccugauuauuaaugauguugaacauuuuuucauauguuuguugaccauuuguauaucuuaugagaauuaucuauucauguccuuagcccacuuuuugaugggaugguuucuuuuuuuuuuuuuuuucuugcugauuuguuugaguugcuuguagauucuggauauuaguccuuugucaugcauaguuugcaaagauuuucucccacucuauggguggucaauuuacucugcugauuauuucuuuugcuaugcagaagccuuuuaauuuaauuaaguucuaucuauuuaucuuuuuuguuguuguugcugcaauuugcuuuuggguucuuggucaugaagccuuugccuaagcugauguccaggaagguuuuucagauguuaucuucuggaauuuuuaugguuucagauucuauauuuaggucuuucauccaucuugaguugauuuuuguauaagguaagagaugaggauacaguuucauucuucuacauguggcuugccaauuaucccaacaccauuuguugaauaggguguccuuuacccacuuuauguuuuuguuugcuuugucgaagaucaguuggcuguaaguauuugacuuuauuucuggguccucuauucuguuccauuggucuaugugccuguuuuuauaccaguaucauauuguuuuggugacuauagccuuauaguacaguuugaagucagguaaugugauggcuccagauuuguucuuuuugcuuaguccugcuuugacuguguggacucuguuuugguucuaugugaauuuuaggagucuuuuuuucuaguucugugaagaguuauggugguauuuugaugggaauugcauugaauuuguagauugcuuuuagcaggauggucauuuucacaauauuaagucuacccauccaaacucacauuggauguguuaccauugguuugugucaccuaugauuucuuucagcaguguuuuguaguuuuccuuguaaagaucuuuuaccuacuugguuaagcauauuccuaaguauuuuauuuuauuuuuugcagcuauuguaaaagggguuaaguucuugauuugauucucagcuugguugcuguugguguauagcagagcuacugauuuguguacauuaauuuuguaucccgaagcuuuacugaagucauuuaucaguucuagaaguuuuuuggaggagucuuuaggguuuucuagauauacaauuauauaauagugaacagugacaguuugacuuccucuuuacugauuuggauguccuuuauuucuuucuauuuucuaauugcucuggcuaggauuuccaguauuauguugaauagaaguggggaaagugggaucuuugucuuguuccaguuuucagggggaauguuuuuaacuuuuccccauucaguguaauguuggcuguggguuuaucauagauggcuuuuauuaccuuaagguacgucccuucuaugccaguuuugcuguggguuuuaaucauaaauggaugcuggauuuugucaaaugauuuuucugcaucuguugagauaaucaugugguuuuuguuuuuaauucuguuuaugugguguaucucauuuauugacuugcuugcauauguuaaaccauccuuguaucccugguaugaaaccacuugaucaugguggauuaucuuuuugguaugcuggauugguuuagcuaguauuuuguugaggauuuuugcaucuuugcucaucagggauauuggucuguaguuuccucuuuuuuuuuuguuguguccuuuccugguuuuccuauuggggugauacugacuucauagaaugauauagggaugauuccuucuuucccuaucuuauaguggaauagugucauaggauugguuacaauucuucuuugaaugucugguagaauucagcugugaauccaucugguucuggacuuuuuuguuagcaauuuuuuaauuacuguauuaguuaggguucucuagagggacagaacuaauacguuugauguauauaugaagaguuuauuaaggaguauugacucacacaaucacaaggugaagucccacaguaggccgccugcaagcugaggaacaaggaagccaguccaaguccccaaaucucaaaagcaaggaagucgacagugcagcauucagucuguggccaaaggccugagagacccuggcaaaccacugguguaaguccaagacuccaaaagcugaagaucuuggaaucugauauuugagggcaggaaccauccagcaugggagaaagaugaagacuggaagauucagcaagucagcuccuuccaccuuuuuugccugcuuuauucuagcugugcuggcagcuaauuagacggugcccacccagauugagggugggucugccucucccaguccacugacucaaauguuaaucucuuuggcaacacccucacagacacacucaggaacaauacuuugcaucuuucaauccaaucaaguugacauucaacauuaaccaucacaauuaccauuugaauacuacugcuuguuauuggucuguucagaguuuguauuucuuccuaguucaaucuaggaggguuguauauauccaggaauuuguccaucuccucuagguuuuguaguuuugcguguaaagguguucauaguagccuugaaugaucuuuucuguuacugugguauugguuguagauugccccaggcuuagaggucaauucaguugguugggggcuuagaauuuuauuuuugguucacauuauccugcaauaaucauacucaucauagcuaccauuuauugagguaugaggaauagucuuaccccauuugggaggugaguaaacugagguuugaugagguuaaguaucucacucaaguucuuacaaccacugaaggcuggagcugggauuuguugggaucuguugaugguaaagugucuucuuuccaacauuccauacuguguuucaauggucaguuggccauguaacuuauuuuccuuauuuucuuuccaguuaaauuuaucgcaaauuuuucaugaagauucugcauuagagaauaauaaauauugaucaucuacauaauugugugacuccucacauuuuauaaggcuuucuuaugacucuuuucucccuuugauaaauaucucaggacuuucuccacccccuuauucugauuacucccuuucccuucgcccauuuuagaaaaaaacuuuuccguuguugcauuguuaacuaguaucuuguggaaauuuaggauggccuuagaacauuugggaaacauuauccuuuuguuaguucauuauuuuaugagugugaguaggaggaagaaauugcagagggacaaaaauguaggaagaaaaccaguuuagcacagagucacagucuacgaaauaggaacuuugauggaggagagaaggaucucugaugucaguggugcagagacaccagcaaggacugaacuggggaguaagacauuugacuuggcaaggagguggucagcagccaccaaguucugccuccuuaaagaguguucaagaguccugcuauggggcuguaacugguuuuaagcauuauauaugcauuaucucauuauuccauuuuauuaauguacuaguucugugaaguaggcauccuuucuccauuuuauagguaggacugaagcucagagaaguuauuaucaagaacuaugaagagucugggauuuuacuuuacuuggaaguuaacaagguagucugccacagguugauagacauuagcagaagauaugagacuccugggucagagacaaaugacuuuauuacuuaugauauaguagguggcaucaguuuuaugcucccuugccucucaaguucuauuggggugauagaguggccuuggugaaugcuucagauaguguguuuaugucacugcugagagacucuaagcuuaggaaaccccccauucucuaaggggcugcuaguuaaccugcccaauauuugccucagauggauacauuaucuuuauuaucuuugucaggaaacaaaucugcccuucaucucagagggagauauucucuggugugcuaacacucuuaaaaauacaugcagaggccgagcgcgguggcuuacgccuguaaucccagcacuuugggaggccgaggcgggcagaucacgaggucaggagaucgagaccauccugguuaacacggugaaaccccgucucuacuaaaaauacaaaaaauuagccgggcauggugguggacgccuguggugccaguuacuugggaggcugaggcaggagaauggcgugaaccuggggaggcggagcuugcagugagccgagaucgcgccacugcacuccaaacugggcgacagagugagacuccgucucaaaaaaaaaaaaaaaaaaagcagcaugcagaacaaaaucuaagauguugccaugaagaauugucucucaacaguuaucuaacuuguccaauguuacauaguuaguaaguuccuaaacagagguaucaucaaaucuggcugaugguggauuccauauuuuuagccauaguuguauaacuacuaccaaguuauccuuggauuaaugaaacaagucaauaugauaaaauguaauaguaauaaaguggagaaugaaugaaaguaccuagagugaaguagguaaaaguucucacuaugaggucaaauguuuggggagugguaagcagagauacugaaguaccugagaaugauuaggacaauggaaaguaaauuuugaaccugccagugaagucuaugagaauggaccuugagguuugaagcugauaaacauaagagcuaaccuauugugaauagagagcaaacccuuauguucucuagugacauguauuuuaauucugaaccugucaacuaaaucucauucuacccuacugccuuuaucauuuucuuuucuauugagggaagcuccauuuaugcaacaucuauuguguguuauagugaagaaaacaaccacaaugguagcaaaguaguacaaugugauuauccucacugucccacucuaaguuuuuuaaaaacuauuucauuaagaaaauauagugcaugaaacgaaugauagauccaaggauugcuggaugacauaauauaaggucuaauuuuuaugaggucaaaagagaagagcacuuugccauaaaauaguggaggaagaguuugaguaggauuguaggcugucaaugauagagaggauagggaaaagcaugaguaagaauauaagauugguacuguucuuauaacauucagggcauucuaaauauaccauuugaagcagagaguucuuugaggggaguaguaaugcuugcugccucuaagagauaugauuccucaacauagaggaagagagauauuucuccaaaaugucuguuuacuuuguaacuuucuacuauucauacauguuccugacugagcaagaacaaauuccagcugauccccagucuucuucugagugcaucugcagcuuuaaucauuaucuugccuauugucuguggucuugaggacgaaucugaacaugugaaaucacuauuaggaguuuucaacaaaaauaaauauuucaaaucucuugcccccucugccuggggugggagggccuuucucuuuuuugaugcuccauaagguugaggucucugcaagacuuuacuagaauuuacucaaauuauaacaccaagauuggagcucuggauuuuagcuauggcuaaagcacaaagcuaaaaucagaaguuaaucugauuauuagaaguuaauuugguuaguauuuacaaaaguaauacuguuugucaaauuauauauucagggauagcaauugagagaguggacuuauguauuuuguucauucaauauuuauuuauuucccacagugcaaaauguaagaggcuaauuucuuguagguguuguggcauuuuacaaauucaauaguaagguaugaaauuaccucuuuccuuuucucuuaccaacugugggaaguggaaagcaaacuaauauuuuugcuaaucuuguagauguugaugggguguuauuuauauuuuucaguuuuucauuuugagugauauugaggauauuauauuuucuuucccuuuuuuaaaauagagacagggucucgcucuguuccccaggcuggagugcaguggugugaucauaacucacugcaaccucagacucuugggcucaagugauccuuccaccucagccuccugaguaacugggacaacaggcauaugccaccacacuuuuuaaaacauucaaaaaauuuuuuuagagacaggucucauuaucgugcccagucugguuucaaacuccugggcucaagcgauccacccaccucagccucccaaaaugcugggcuugagccaccacacccagccucuauuuucaaauauuuauugauuauuuauauuuuacuuucugugaauugcucauucaaaucauugugcuuuuuuauugcauucuguagcuuuuucuuauugauugguaaaauguuuuuguauaucaagaaaauuaacguuugucaauccuaugucuuaaauaauuuuucuuacuuuguuguucuucuuuugacuuggcuuacaguagaucuuacuccagaggaguuuuacuuguuuuuaauaaaaucauaucuugauucuuuuacuuccuguauucaccaucauacaaguuuuuuuuuaauuuaaauuuaauuuuuuuuuuuuuuugggacagagucacagagucuugcucuguugccuaggcugaaguguguugacaugaucauagcucacugcagccucagucucccagcucaagugaucaucuugccucagccuccugaguagcugggacuauggguaugcaccaccaugccuggcuaacuuuuugauuuucaauagagacggagucucacuauguggcccaggcuggucuuaccaaacucuggagcucaagugauguucuugccuuguccucucaaaguguugggauuacaggcaugagucaccgugccuggccauaaaaugcuuauagaacaauaucaaucaaaaaaguguauugaauaaauaaauaaauaaauggacaaacuuaggccauuuuucgugaaugccauaguaaauaguuauuauuaucuauacacucuuucucaucaauuacacugaaaauuuuauuuuaaaucagaauaaaugcuucauuuaaaugguauuuaggaauguauuggauggauauuugugagcaaucuuagaaaaguuaugccugaagcaaacuaaaaucacuugcucuaugaugccagagccagagcaagggaauacagaacccaguuguuaauuuucuguacacagcauucuuuuuguuucacccaguuaacagaucuacauucacaaaggcuaugccauuuuacugggucuguaaaaugugagagaagcacaaauaaucuuuuauucuugaaacguggggguauaaacugccuagacaaaaauucaccuccauuaggaugacaaagagaaguauucuagagaguguuugagucuccaagauuuggucaaacuucucucaaaagauuauauaaaauaacaggagcacauucaggagguagaaaacuugcuuuuugaccaaagagacacuguauugugucacuguauuguauuguguuaggaacugggacucugcagucaguuacauuucagucccauuucugcuacuacugauuuaaccugaagaaguugcuugaaccucucucugcauugguguccucaucuguaaaauaggaauaauaauggugcguauauagagagcuauugagaugauuaaauauuuuuauauacauaaagcauuuagaaugaugccuaguacaugguaggcacucaauaaguauuacuuaugaauuaagcaacugaucauccagaaaugagcauagaaauaaguaagaauuaaauaaacuauauuauuuuaucauuauuuuuauuuauuaaauuauaagccacucccaaauaauuucauuuggacuuucguacuuauauuauaggccuucgccuauuaaguuuuaauuauuuuugacuagucugucuugacaaacuauaaauuucucaagggcaagucccugucuuuuucaacuuuguaacaauucuaucagcagcagagugucuggaaaugucacacuuacacagggcaugguuuauugaaaaaaaaaaacaacuaguuauauuaaaauaguaagucuaaaguaucagauuaacaauguugaaaguaaaauauauaaagugcucucacaauacacguauauuuaguuuuguuaaaggaagagaauuagaaguuuagaaaauaaaagaaucaaacaaauaaaaaauauuuaauauuuucaguguuugauggcuucuucauauacuuacauuucuaagaauaacuguuuauuuaaugauaaauuaauggguguuaacauagaggaggaccaacaaagauaugucuugggagauaucuuuuucuacugucaaaaaaaggcugcauguauuucuuuucacuugauuguagcagacuuuucugagcucuuaucugcugcagacacugaguagguuuagugcugguaauaaaagaugaaugagaccauuuuccagcccucaggaguuauacaaucuaguacaagggacagauaaucacagcagaauauagcaggugccauaauuaaaaguaauauuuuauagaaagaaauuuugagaguguagacagaaaaugugacauguaaucuagaaauggaaaaaccugcagaaauuaggugaguacaagagacgggaagagagucuauaagaaagaggaauuuuagcaaaggguugaggguaugaaaaaguucauugagugguagaaauggugcuuacagaaauauccuguucccuaaaggugguuuucuuucagauggcugcaauaaacuuauauucauaaauucaauagacaacaagaauaugaguugguaugccuugccuccuagauuugucucuuuuaacuuaacucuguccuccuaauucuuaccugacuucuaaagaauuauuuccugaaucuaaugaauuagauuaagagguguucaucuuuguccugcuuucuccuauuuuugauucugugcauuauuuuuuucccacuuaauggugugauaaaaguaagaauaaaaauuccaaccaaucauuguugaaacaagagggaacuuauuacuguucauggaaagaucuuuguuucugcaggaacauucuaugugcauaacagagaaagauuccaacuauggcccccuugauagaugaugaggauuuuucuccuguuugauggucaagggucuugccgccagcuuucagaggcgagugaggaaacacacucacagucaggugcuaugacagcaagagacauggugcuccaggguccuggacauugggauuucaaauaguuuggguugguuuuauugcuuugcugaaucagaauacugccaaacuaaaugaccucuagccauguauuuauugguaaguucaagcaaacgaaugaaauaguuucacauuuguuuucaagcaaacagcgagagaugauguaguuggauguugccuuggcuucaaguagcaaagaaagucugggauuaguugucaguauuggguagcaugcugaacugguggaucuaggaagcaaaaacugucaagaaucagaggguuuugagaacaauguauuucugcuuuuuauuguuuuugagacaucuucucaauuucuuuuuauggagguaauuagagugguucacuuggucacaaggaaucacuuacuaagguaaaggauaugggaauguaugaugcuagggauuaaaaaugacaaauuccaaacuuuuggguauggacaugcuaagcacugaacaguauugugguuauuauagacuuuuaauaguguacaacuaaguuugucauaaaugaaauucaaaagucugacuuagacacaguuucuacuauauguauuuccauaguuugucacuagaagaaauuauuucaguauugaugauguuacuuaagauaauuaaugauacuacuuaauaaaauaaugauguuaucuuacuuaaggaagcuucagaagacuuuccaaauuaucuggcagcguuacaaucuuauucuucucaguacugcuugcaauaagugagcauauuggccagaaaacuugguauuuauugggcaccuaugauguguucauugcuuuauauguuuagauguauagagacagggaaagugauauaaaauaaguacauauacagaucuacuuaugauaucaaggaacauuuuuugcagggaaauaauguaaacaaaugguaaaacaugacaaaaaaguagaauuuuaucaaagaaggguuugggcuauuuuaauaucaguaacaaggaaauuugacuuauaguuuuauuuuauucaauuauuuuauuaugcuaaguuuaauuuaugacacuguauuuuuaaacacauaaucacauuucaggagacagcacaaaggauuuuuuuuaaugcauguguagguaaacaauaauuuacuuuaauagcaaguggucacuucauccucucaaacuugaugucuagaaguaaauuuguuaccucaucacccaacaauuugucaucuugacuggccuauauuuauucaugacauuacuauuuuuaaaauaugccagguuugagauuuuuguguccucuuuuaaucuuucucugcuuaguguuucauauucaaguagcagcgaacuuugaugcuccucaaaaucauuccugucacuuuuuccuuuucauuucuauuaauguuaccucagucagacuuuuuccaauguagaucgggaugcuguaagagacucuuaacuaaucuccuggucuuuggucuuccccaacugccaauuaaugugcaaaucauugcuuaauuuaucuuuccuauuucccuuuuaaucauauugccacuugcaaaauaaaaucucuaaagacuuccauuugauuggaaaauaaaguuuaaauuuuuagaacauuaaaaaauuauuauggaaaauuaaacauaugcaaaagaagacgggauauuauaauaaaccccuaugugccugucacucaacuucaacaauuaucagcucauaauccaucuuguuaaaucucuaucucugucuacuuuccacauccacauuaauuucaagaaaauaauuggcauuauauuauuucaucuguaaauauuucaguauguaucacuagaagauaaaacacauaagcacauugcuauuaucacgcacaaaauaaaauugagcagugauuuagucaaauacccaaucaguggccacauuuuuguuucauaagugucauuuauauauuucaguuuguuuauuugaaucaagauuuaaauaaugcccacacuuugugauugguuggugugucuucuaaucaauggacuucaucucuauaucuucucucuucccuuucaacagcuuguugaagaaaccagaucauuuguuuuguagaguucacacucucaauuuugcugguuacacuuuuguggugccuuucuuuugcgcuuccuuugucuauguucccuauagauuggugcugaauugaugaucaaauuuagauuugauuuauuuugucaagucuucuuuguagauagugguguguucuuuuaucagaagacaucauaucugguuaguccuuuuucugauaauagcagcuauugauguucacauugauccacuaguucacugggaauugaaaaauggugauauauuaauuauaucauugauucuucauuuauuaguuagacuacuucuuuaaagagaaauuucacuucauguccuguuugguuauccagggguacaguuuauauagaaaaaaaauagcauugcuuuuaauaaauccaaugaccuaauuugcugacuuuccaaucuugucugccacugguuccucauaagguguguguguguuguaguuuggucuauccacuguugauuaaauaugccucacacucuuguucauggucaccacugccuuuagugguagagauuauauaggucuuucuuugaauguucuacaguguggaacugcucauuaugguauuuggugcuguaagaaaccacaacaucggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgugguggcgggcgccuguagucccagcuacucgggaggcugaggcaggagaauggcgugaacccaggaagcggagcuugcagugagccgagauugcgccacugcaguccgcaguccggccugggcgacagagcgagacuccgucucaaaaaaaaaaaaaaaaaaaaaaaaaaaaaaaaaaagaaaccacaacaucggccgggcgcgguggcucacgcuuguaaucccagcacuuugggaggccgaggcgggcugaucacgaggucaggacaucgaaaccauccuggcuaacacagugaaaccccgucucuaguaaaaauacagaaaaauuagucuggcgugguggugggcgccugcagucccagcuacucgggaagcugaggcaggagaauggcgugaacccgggaggcggagcuugcagugagccgagaucgcgucacugcacuccagccugugcgacagagcgagauuccgucucaaaaaaaaaaaaaaaaaaaaaaaaaaagguaaauacaaaggcacugaccuaugaaucucccuuuugggcauuaacaucauuuuucuaguggagacuugacuuuuaagaccacauucucuaacuucacauaauuuaagcauuuuuucaugaaggcaacuuuaagaaaaagaauagccuagccacccuaacucauguucauuacagaggcauagcuuaugagauaccuguccucaauaaccaaaagguacuucugaauguuuucugauacauucugguuauugaggcccaguaucucauaagcuaugccucuguaaugaacaugggucauuauaacaugugcugguacacauccuuuucagacugaucuuugucucaaagcauaucucuuccguuaagaaacauauagauuccucacaugucugcuuccaacuugaaagccucuagaacuuaauacauucuuuccaccuacuaucuagcacucaugcuuagagauugcuggcguuguuuuucuaaagccucaucugcauaacauguagacuagaaaguuggugaacauaagucuuugcucuugaauccgucugaauuaaagaaggaaaugucugaucaaauauguuauauuuauaauuucaaauugcuaagugacaaccaguugagcauuacuggauucauucuaauuuuauuauuaaucaaaacugcaguauauauuuuuaaauuuuauguuucuuuugcuuauuuccacccuuguggugaauuuuuuagacuauguugaaauugaucagugcauaguuaguaugcuucaguuguaagucuaguuauagacauagcugggcuagaaagaugagagacuugaggaagccugugugauuucauaaauaaccauuugagauucaaacauuuuuuaacguauugcugggacuagcuuuugggauuggcuucuucacuaagccugugccauugaaccauagacagucugaaaccaaccuugauggguaugcucgagcaaagcaagaggucaaagcacugagccucugaguaagucugguagggagcaaauauaacaguuuuggaaaaaugaacgugauaguguuuucauaggaacaucugagagggcaggcagauacucauugggcucaauguauaugguuuuuguauguauuuuuuaaaauuuaugacucauuauuggcuaaugaagaaguauauucaaagaggguuaaggguuaagugagagcugguucaaccagugcaaaaguaggauaaguauucuauugguuucaugcucuucccaaccauauucaugauguuuauggacacauaucacuaagagauauauggagcuuccaagaauuauuacuguuguauggucaaauugaauggaacuguuuggggcaugguuuuugugugccuuucugcgaguccauaagggcaaaacuauuuucacaguaauacugagaccuuugguuuuucacuuuuuucaguguugauauaugcaguagugguuaaaucuguugaugcuuuagcaugaauaaaggcaggcaccaaacuauaccgguggucauuguacucuucacugccacugcagucacaggaagaaaaauagcacaugaaacaaaugccagauucccuuaaaauuuuucuugaagcaaugaaaaucuauuaauuuuuaaaaaucucuaccuguaagucccugucuuuuuaauauccugugugacaaaaugagaauguguaaagcacaucgacuguaucccauagugcaaugguugucuugaggaaaccacuuauguaauuguuugaauugugagcugaacuagcugcuuuuuucauuaaaugccauuuuaacuugaaagaacaauuccacuucucucauuuguuuggaaagcauagcaaguuccuuuaaaauaucuuauuuauauuaacauaugauagauuauuuuuauaugaauuuaaugcauacuuauuuuuuaaauucuuggcuuuaauuuuucauuuaauaugguaaauaaccacaaaugaauacucuuaggggguccucaguaauuuuuaagagugucaaagaauucuaaaaucaaaaguuugaagaccacugcucuagguuaucuuuucugaaauaaacucccuuuugucuauauaagaucuaguaacuucaaagguauuacauuucugugauucuaagauucugugauuuuaagauuuugagauugccacaaaaggauggguaggggaaaacagaccuuuuaguagauagcuaucugcauucuguuucaaugagugagcugaguggagcugguaugcguucuuugauuucuuucaacaaacauuuauaaaguaccugcacuguauaaaguauaaugcugguugcuauagagaauacccagugaaucauucuuagaggcauuaaguuguaaucuucaugaaagcaagaacuuugucuuuucuagcaggggaagcaucgugguaggcaggcggauguuuuugaaauccacacgagucacucguuuuaucuccuuaggcagguugcuauccucucugaacauuuuucuucaauuguaauaugggaaaaauauauacuauucuggauuauuuugaugauuaggaacuuuuaaugugaagugcuauagcagaguucugaaauauuuuagcaagguuauuuaaagggcuugauuuuguagcuguuuucuaacccaagaaguauagaaacauagaagggaaaauucuauauguauauguaaaaguaauuuuuaagaaaaguuuaacucauaaaagcaaaauuuauuuuuaguggccagaaaauaauuaggcugucaaaauuaauuuauuuuuucaaaagagaacugauuuuuguaaaaaaguguaaguuaaaauagcuauuagauuuguuugcuacauuagguucuguuaaccauaaccaaaacugaguuuuaauauagucauuuagcuuaucuuuacuuauuuuugucauuuuccuuuaaaaaucuauauuauagaaaaaaauugauagaaauucuauauuaauaauaaaaguaauacacaucaaguuaagcaaaagaagguuuucagugauacuauuccuucagauauaaaugaacauguuuuacuuguuucuaauuugauuuuauagauuuaguuccaaauaguggugcuuuacuucacugaagaaagcauuuaaaaauuuuauuacaguaagguuauuucauuuccauguuaaauuuauugccuaauagcaauucauucuauaaaucagaauuucauaaaaugcaaaaauuuuuuuuuagucugaguguucuuuuuaaaucuuuacaggaaaauggaugugucuuugacagagacuauuuucauguaucucugcuugugcaaauuauagaacauaaauuuucuuucuccaaaaauagauuguugcuugccuggugacuccagucuuucuguggcauagugauguuuggcuucugguucuuauugagaggugcaguauauggauuuuaaacauugcagcuauagaaaucgauccaaauguauaauaaccuuagaauacuuuuacuuauacguaaagaaauacugugucauuacgugucauuuauuaauguggaagaaacuagagauucuucccuggguugguauacacugacauuuauuuuuaaacauggaauucuaaaguagagguggaauagagcaaugaaugcucuuuacagaggcagaggcacaaggaagccuaugcccauuuuuagauuucuauauugcagacuauuuuuacauuucucuucauucaucaacugcucuucaagucaaauaugcaugcucacuaauuuaacaggcaccuguugucauggcagcagagaacaaaaaugaaauucauuauuuuaugcggugagaguucgcaggugauacagaugcuggcggggguggagcaggggggaauacugugggcuuuugcuuuguauagcuccccaagcaagaggcugugucuauauuaacaagugccaugggauugugggauuuguccgagguugcauucuuuacaaucuagugucccuuuauacacucauuagacuacauggggccaacucuaguucuauugauaauauggcaaccauacagugguuuucaucaagacaaauucaugaaaagggauuuuccaguguaaguuauuagcugauaaacaaauaaguccauguguuuuugcaucugucugucugaagggaugcugguaaugauaacgauucucacugucuuuuucccuuuuugaaauaauuaaaauaauuguugaaaauggaacuuuuuucuaaaugagauauccaaugagguaacuuggauugaaagaaaucuuccagaaaacugcuaauuauagaaaagcauuuccuuugguuauuucugucaaccugccuaguauguauuuauugaaugccuauuacauacauggcauuauggcggacccucugugagauaugagaauucguuauccaugguuaguuaauuuaaacccacauaaagaaacuaaccaaaagcacacagcaagcacaggccauuccauuauuuggccuguucaauuuuuuuugcacuuuauucaguguaugcugcauuuaaaaaaauccguuaucuugauaagccaccaucauuugguuuauuugacucuucccaauacaaaacagugcuuuggaggagcauuguaaauagccaaauacaaagugggugccaacuuucagcaggguucauucaauaacaaacauuuauugaguaccuacuaugugguaggcauugggugaaauacuauggugaauguuaaauuccaccaaucacaugucuuauugcauauuuauacuuucucucugauaugcauucuucuuucuaaagaugcaguuuuuaaaugcuaaaaacaaaucauuugaaaagagauggugaggaucuuaagaugcugacuuaccaaaccagaaacacacacaccuacauacacacuugugauuauacccucacuuagacccuuaaagagguggaaaaacagaaguuuaucuaauuuaacuaacagauuugaaugagaauaacauuuggaugaugggaauuuccuaccuauguuaggaagaacauccucauuuuacccuguuuuuagcugucaagcacauucugccuguguuuccuuuaguugucauucuuuuacuguuuucaccugaugcccuacccacuugccuucaaccuuucuuccagcucugcaugagaaaauaaaaaugaaacuugcagacacauaaaaaauuuuuagcuuuuuuuuuuauaggcacagugcauuuucuggggguccugcuauguugcccaggcucgauuugaacuccugggcucaagcaauucuccugucucagccucuugaguagcugggaccguaggugcacauaacugcaccuagcuaacaauacccuucuucaccuuucuaucugacuaccugcccuaauguuccccuuacucucaguaauguggucuccuauugcgccacucacaguaggauccaaggacccaugccacuuuauaccaguucaugaugagauaaugcaaaguuacaaguaagcauuuagaaacuuugauaauaauuugauagaauaauuuugccugcugaaucuaacaagauguuuaucugguauuuuccauuucaaaaacuuuauuucucugaugauuaaucauuuuuuuaaacaaaacaauagucuacauagagaagcacuggccaaauacacuuauuguaucucuaaagaugccuuuggauuucuuaccuccaugccuuugccugguuuuuagcuaacacugccuggcucuuaaaauuuaacuguaaugucaucuccuucaugagcuuuucucugaaauccuacggaaguucuuuguauuucugacgaaaccuuuauaacuaauauuuuaaauucaguaucauuuaacguucuacacaaaugcgccuccuuuuugcaguaucguuuuggagacuacccccgagagauacaaucaggauggauaagagcauggacuuuaaagcuguagauaccuggacuggaauccugaguugugucauuuaagaguugagaggccuuggggaggucaacuagcccuuuucugccucaguuuccucauuuaucaaaugagacuauugguaucaccuaugucuuaagguuacuaugaggauuaaaugaaauaauacaugugaagcauuaaguauacaguuccuggcacauacuaaacacucaauauaaaacugcuauuaauauuuuuauuauuaauauuagcagcauuuuauauauauaaauaaaauaaaaauauaguacuuuuuuuuuuuuuuuuuuuuuuugagacggagucucacccugucgcccacgcuggagugcaauggggcgaucucggcucacugcaaccuccacuucccggguucaagugauucuccugccucagccuccugaguagcugggauuacaggugugugccaccacgcccgguaucuuuaguagagaugggguuucaccauguuggccaggcuggucucaaacuccugaccuugugacccacccaccucagccuuccaaagugcugggauuacaggcaugagccagcaugcucggccaaaauauaguacuuuuuauugccuucauccaagcauugccugaaauuagugauuuaaucauacuguuuugaggaaaaagaagaugugaagaaacugacacaauuucuugauaggcccauuuuugaagacauagcugguguggguagugugcauaggguuggaacaucuuuagguuucugcagauuucuaauggguuuuggugaacuaggacagugcugcagaggcacccuuguguaggugcugcaagcauaagucgaaucacucaugagaugcuuuuuuccuacaugcaaaacuaacacuaccaaaggaaaauggaauuaaaaaaaacuuuagaagaaggaaauauaucuaaaaauaucccaccaccaccaccaaaaaauuuggcuggaacaccuggguuuuucugaguauaauuuuaguuagguaaacauugaaaaaauguauuuuccuaagaaaggaaagacucauuuuauggaaaauggugauuggcaguauuuuaagaugcagaagauuaguuuuggaaaagacauuccuguuuuaaagaauaagaugugaauuugaacaagcagcaauaaugaggacuaacacucauuauugcuuagcugacaaaauguauccccaaauagccuucuuguaggauaguuaccuacgcagacacguagauguacacuacagugcuuaaucaugcaguaguuaagugaauguuuuaagugugcacuaaacaaguauauuaaaaccauauuauggauucauagcuauguaggauaugcuuuauuaggcuuuaaaaauuagauaagcugucuuaaaaguaagcauaaauaugcucaauagaaaacuaaauuaacugccuaacaaaauggcacugaauuuaaggguguagauuauguuuuuguggucaaguuauuuuugguauauugaauaugaauucaaaaggaaaccuauaaacaaaauucugagaagagcuagagaacaugaauuaagagguacguaagcccuugcuagacaagggcaauaauacaaagacguaauuuacuauaguuggagcauaaggaaaacaaaguaaaaccuagauuauuugagaccuuacagcugauuuuacaucugcagguguacacacaguguucgugcacgcgcacacacacacacacacacacauaugcccaucaaguacauauauagaucugaaaaaaauuaguggcaacauuuucuauaagagaaguugggcugaaugcacacaccuguuuucaguaauaaugucucuuagaucugaauggcacaacagucugucagggagguggugaaaucaucacagacaguugagugauucaaaauuagaucagacgaaguacuuuaaaaguacacuguagcaaacaaucuaauguugguaaggcaauaaaaagaugaccuaaaucaaucuuuucaaccuuuaacuuuuaaugcuuuuguguaguuuaaaaauagaaaaauauaauguuuacagaaguacugaaagggccuuaucucuaaagagcuuauuauuuaacauaaauauaugauauucaugguuuuguuauagaaacaguacaaauguaguuauguaucuuaguccuuuccccacuacuaugaaguccacaaugauggaagaacuaaggguuugaagaagcauuuaagaaauguuugguagcauuuucuuuacggguuauauucaaaacacauauguccaauauaauagacuuugauauuuagucaaaauuaaauaagauuuaaguuuuuuuauuuuuaauguuaauguaacuagauaaaacaaugaugauaaaaugguacacagauucucugagaaucauuaguuaauguguauuuaaaaaaaggggugauugagugggaagcagcuuauagaaaaguuaguuuucauguucuuucugaccuuaacuuaaauaauuggcaaucagaugcagucucuuuuauaucauuugauuucucuuauacucaaagucagugaagguacugcguaaaaugacugaaauugagaagaaagggcucaauaaaguucucuaaaaguuucuaauuugugcuuuuuucauuccaugugcuauucuaaccuacagugauuugcuuggggcacucuugcucaccuuugggaaaccuucuuauucucaugucaaucaaaugcacauuaacaagcagugguaacuuacuguucccuggagucagucuaugugacuuuuuggaugaacuauggguuagacuuauggucccauggaucaguggcuuggaaccaaucuugacagaacccuccuuuucugugacuguuucuaggccagcaguguacccuuugacuggugcaaaugcuuggucgcucgcuugccacacaugugaccagcuuuacauaaacuucauagaaaauuggcuuaugcuaacuucucuuacaauccuugaucucaagcaugcuauuugauacaaaguccauuuacauacaguaaacagagaagaaaguccuuuguccaguucuugaagcuuguucugguagcaaaggaaaacuaaauaaccauuucaauuuuccauuggaagugguaaugguggagaggugcugaccauggguaacauuugccuuggugccuagcucacugauaggauguagaagauguucaauaacuguuuguuggauaaaugaauaaaugaucauuccaaaguaggcuaaauuuuggcacugcuuuucggcaucccuuucuaagcagcuggucuccuagacagcuccaugggagcugcagaaacacaggaggaugagaaaaagaugggaauuuaauaccaaaagaauaaaaguggcagugucugucuagccaucuuuugacuaguuagccuaaaaccauucaauaugacguacuggggaaaaaaaucguggaauuuuggagacaaacaaauccacgucuaaauccucacuuugcuacuuacuuacuaauauucuacccagggcagguuacuuaaugucucugaggcugaauuuuucuucauuuaaaauggauaaauuacucuuugucuuagaagcuuguuuugagauaaauaacuuuggaugguauguagguguguuucaacaagaguaacaguaguuuucauuuuuuaagugucuuauagaugcuugggacagggacagaggguguacacauauuuucaucaaucuuucuaccagguguucgagguaaagaguaucauuccuguuacucaggcguuuacauugagagucggugauggaaaggaaucuacacaagguugcagagcucagaagugugaaagcagagauuugacuuaaauuuaucugauuccuuugcccaggcuuuauuuuaccugauucauaaauauuauuucuuuccuuacccaauggaaauggaauuaaacaguucuucuuuuucuaauuaaucugguuacccucuucuauagggugguauccuuaacucccauaauaaacuucaguaggcccauuuuguucauauguuuagaaucuagcuguggccuccauuuagauagugcuuuuagguuuuaugauuuggucucacaucuuuucaauagauuucuucuaugugauuucaaguuagcuuacuguaauacugaaguccagauaggcuaggggaugcaauaaacuuuuuguggcaaugaaguaacuccaauuucccauaagccaccugagggagaaaacaagacagagccuuccagacacauagaaguacaaugguguuucuucugcugugcguggagucagagauugugcuggccaugugucuguaugugaugucagugggaacuuugaauauuuaggguggagaugccuaacuuggauaaucugacuuuggaucuauuagcagaagcuggaaaugcuuauaacuaugacugagucagaaggauaugaaccuuggacuuguucugacaguugccuuuaauuaaaugagccuggcccucuuagauucuggcaagucagcuauucagaaagcacugaucuuugaaaaucuuguaacuuucccaaguuuuguuuucacucagcaucuuggauuuuguguuuuccauuuacagauuuauaaucgcuuagauacaaauugcuguggauucagaccucgcaaggaagaugccuguguacagaauggauugaggccaaaaugugaugaccaagguucugcggcucuagcacacauuauccagcgaaagcaugacccaaggcauuugguuuuuauagacaacaaggguuucuuugacaggagugaagauaacuuaaacuucaaauuguuagaaggcaucaaagaguaaguuuuauaguaacaucugcaggacaucacauuuauguuagauaaguagcaagguucugagaaaacucacaucuuacaucugaucauuuuaacccuugaaaauaauugugaauguggaaucugggaauggagacccaagaaaggaaacaaacccaagaagaacagaaccagagugcagccauagcgccucuaucaacaaccaauaccgccuacaaagugcaugcuacauuucacauucaugauguugcuugguucucauugugaaaauccauguggguuuuguuggaagaaugcagggaccucuggcauaggauuuggcagagcagggauaagcagguggcagaggcuccauuauuaggcauaagauaggacaugggaagaacuaauagaugugcaaauauugacauggcagaaugucuaaauucauaaugaacucaagugacuuuuaugaaugcaguggaaaaugacagccaaucugguaaguaaggcauagucucagaggaaagcuggcuguagaauucagcagguggauuuuucagcauuuugaaauccuucaaggagacauagauuaaggggaaaaguaucuaacaccugaaagagagggcuuauggaggcuaguuagggaagaauuauuuauuuacuuaggguugaccaagaauucagggaagaucucaaagaucuggggacauccgacaagacucagaaagaaugcugaguggagagggaaccaaagaaggaguucugcaaugcagaaguuaaaacacagugguugcucauggcacacuugaucauacaucuauuggaaauaaaggaaauuagacauuuaguaauggcaagaacccagcuauaaagugugagcuguucaaccccagcaguggaaauuguggcuagauuucaagcuccacugccuagugggcagagccacucuccauacuucccaucuuagucagaaaucagauugacuaagagacugcgguaggguggagaccuaaaaauagaggguucuuugguaaaauagguaaccagcugugugaagcuaggugacugcuggaaaccucaugagcaagucucaaauugagguuagaacccaagucuuccaaauccaaguccaguauuuuuuuuuucuguaauaacuguggugcuaauucuguaguaacuguggugugcucuguuacuauuauucuuguuaauaauauucuggagcauauuucaaucauucuuccuaaacacuauuacuuacaugguguggauuuuauguacuuuagcauuaagagcaauacuguugcuaugagaguuuuaugagacaugauuuuauaaguuuuugccggguccugcccuguugacacuuguuucucacaucucuuuguggauugaaggcagguuauguggcagguucucucuuuuaagcuaaggaaauuuuauguaucggaaaauuuacuuuccuaagacaucacuuacuaaggugauaucgcagggucuucuugaaucccuaaauucccucuuagaauuaggagugccugaagaauacaguccauccauuucauacauucauguaaaugugaauaucuuuauuucuucuuucaaagaagauuuacauuuaaaugcauuaugaggaguaauggguuugaaguuaaaucuucuuugaaaauauaauucacacauugaaaagcaaaaaugaaggcuuuucuaacccccaauuuaugcacugaauauuccuacuauuauaucaauguagugcagagacagguaauauuuuugcuuuccuuuaugaaaaggauuagccacuaaagagaucuaaugguuuuaacgauuucaucucauacauucugccacaguuaaauuaguugaagggcuauagaauugacaauucauggauuauuaacacuucauaaagcaaaaaugcuacuuaauacuagagccccuaaaguugaggcccuaaacuauauaguaaugucuucagggaacucagagcaucuuauaaacauucuuucauuccgcacuuccucacacacauuaagcaaguccggcgccguggccuuuguucuuucugcagcaucagaacugcuggagcaccugauccuuggcuuucgggcacccucugugccaucuccauugugcuccauugaaauuuggaagaggugcuuagaaggccugaaauuucuggcaaaguguacucuuuaagcaaguauauauguucuuacuauaguuuuugagguauaacugaguuuauuagaaauguacucuuaaaacaauauuuuuacugugcuuuuaucagcauuuuagugaaaguugagaaaugucaaauuggggauuuagcaaaauauuacuuauguuuuugaucuagaaauuuugcuaaguccuucagauaauguauaugcuggacuccuggcuuucuaaacgaagaaaagcaagcacaaugcauucuuuuaagguaauucagcaaagaccccucuaaauuggucuuagguuuuccagagagacuuucauuguggaacuaaaacuuuucucugaaacuugaguuuugcugaauuuauuugaaaacaucuuaacacucuagcuaaauaaaaugauccuaaauccucagagcuccaggaguauaauaugacucagagacaauucuuucuuuaauuugauguuuuugaaugaaucuuaucucauuuuaguacacacauuuuuuauuauuucacauaaauucaguuguguaacuucuauucaggcagaauacuuuauugaaguugucauuaucaauuugucucucauauuuucuugcauaaaaucccaccuugacacaucugaggauacuguucuacuugacagauuaaagggguuuccacaggugaaaugagccuaagacuaagaaaaguauuucugccaaucuaauagaauccuuuccaauuccaugccuuuguuugaguguacggaaugaccuuaaguaagaagucugucauguucugaaugguguagaauauucaguucacuggaaacacuuucuucuaguauauuauuauuaagagaagugucaucuuggcaguaacaaaaauguuuugguucucaaagauaccauuuguuagugugauuuaugacagauuaaugaaaggcaggacaguuggguaaggaguacuauucccaagcaauuacuaagauugaaauaucauuuuaucuuuucagguuuccagcuucugcaguuucuguuuugaagagccagcacuuacggcagaaacuucuucagucucuguuucuugauaaaguguauugggaaagucaaggagguagacaaggaauugaaaagcuuaucgauguaauagaacacagagccaaaauucuuaucaccuauaucaaugcacacggggucaaaguauuaccuaugaaugaaugacaaaagaaucuucuggcuaggguguuagauauauuuaugcauuuuugguuuuguuuuuaaaucaagcacaucaaccucaagcccguuuagcaaugaggcaguguagaugaauacguaaaauaaaugacuuuaaccaaguagcuauaaugggacuuagcacuguaugcauacuuaaaaagguuuugaaaaacaaacuacuugagaaauauuuguuuauauuuuucucuaacaucaugcuaugugucagucugaacaucugacaacagaaauuucaguuauuauucuagcuaaguuuugaaaacauuugucaugcuguuuaauagaaaacugcaaaccagagacacugacuccauuaauaaaccauauuuugugccguuuugacuguucugaccaaauacuaaugggaacaauucuugacguuuuucuguugcugauuguuaacauagagcagucucuacacuacccugaggcaacucuacauuggaacacugaggcuuacagccugcaagagcaucagagcugaccauacauuuaaacagaaaugcugguuuauuugcaaaaucaccaguauauuuucuauugugucuauaaaaaaucagucauuuaaguacaagaaucauauuuuccauuccuuuuuagaaauuuauuuuguugucccuauggaaaucauucacaucugacaauuuauauguuaaagaguuuuacucucucuauuuugguccaauuuguaucuaguggcugagaaauuaaauaauucuaaaguaugaaguuaccuaucugaaaauguacuuacagaguaucauuuuaaaauggaugucucuuuaaaaauuuuguuacuuuuaccaacaauguaauauaauuuauguauauuuuauuaauaauagugaauuccuuaaaauuuguucuauguacuuauauuuaauuugauuuaaugguuacugcccagauauugagaauugguucaaauauugaguguguuucaauauauuaucuggcuuauuucaacaugaguaauaugagcaaaauaaguuaaaaccugcgucugaucaauuuuccucaugacuagaacuaaaacaguaaauuuggacaauauuaagccucaaauaaucaucuccaaacuccuucuaacacuuuuuaaaucagauuggaagacauggacaaaucagguucauguguugcaucuuuauguccuuugccaauauccaagaucaucacauaugguagauauucacauggaguuucaaauucagaauagauuaccauuaccuuccugcccuuacacauccuacuccuuauuuaaaaguucuauuugugacuuuucauuuccugaaaguuuaaaaauacaauuugagaauguuuauaauacauucucuccugucuuuucacgguuacgucuguuauugcugaaauacaccacauuuucuuuguucuggucaagguuaacucaauaucugugugaaagagaacuacuaacaacguuacaauagaggcuagauuugaaaaaaaaaaucuauagaucuaauugauacaauuguagaacaaaaugucaaaauaauguuuuaaguauaagagaagauggaccaaggagagagagaucauuugaaaaucuaauuguagcuuuucuaggcucacauucauguacuacuuuuagcacccuuaugggcugugcucgcccccuggacaguugagcuuuggauuaucuuccucuucaauuuucccucuauugacccgagugucucccucugcuucuacagauuuauaguacuccuuggcucuuuugagucuccacuuuuacucacugucucugggauuuuuaagauccuuuucuucucuuauaaaucauccucuuaaugaaaauuagccuaacaaaaguuuggagacuggaauccuacuuugagccacugacuugaaauaacucuuuuggcaaguugccugacauccugucuuaccaagguggcauauuugcauuuuuacugcuuaaaacauuuuuuuuuuuuuaccaucuuuauccaaauuuaucauauugaugguaggacuaacaggcuuuuuagaagcuggcuuuaacuuugagucucaagcuacaaugcuguugggcagccuggucuucccacgugaggguuuaacuuuguuuauuugccuccaguuauuccaaaaugcuuauuaaaugaaagucccaggaacauguuuauuuuagucaccuuugcuuuuuaacaauuuuguuuuguaaucaaugaguaauucaugaugaauuauuuuugacuaauggauagccgaaggccaggcuuuuaauucuaauagguaauguucuucuuuugucuuauugaaacaaugagaauacucugugcauuucaaaugcacuccgauuaugcugugguuuuauucacauaagcacaauauguguuuuauuuauaacuucauaacaaacuuauaauauaauaauuuaccuuagcagacaugcaaaagcuuauucuugugugacuuacuuucuuuaagcuaauaauauaaaaauaaauauguaucuuaaaaaucuauaauaaaacauuagaaauuaaagauaugugcuuuuuauuuugcagaugaguucauuugcuuuuguagauguguuuucagagcuagguacagaggaauguuugcuaccuuuagcggugaaaaaagaaagagagucaagaauuuuguuggauuguguuugugugugcauauauuugauaucaucauuauauuuguaaucuuuggacuuguaaucauagccuguuuauucuacugugccauuaaauauacuuuaccuuauacauaacgaauaaaauaccuagaaguagauuuauuuacacacugucuuaugaaauucuuauguuuaugucagcacagaacaagcacacauuuagagcauucaucugaaaauuauauggaaauugaacaugggucaaauaaagaugauaaagaccuuuuuuaaaaaauuaaguaucauaaacaauaaucaagaacuuucaugcaugaaagauaacuagaauugacuugucagauaaagaugauaaaaauugacacuugggacuacuagagggggacaaguguugaaaaacuaacucuuggguauuaugcucagcaccuaggugauaggaucauucauaucccaaaccucagcaucacgcaguaugcccaggcaagaacccagcacauuuacccccugaaucuaaaauaaauguugaaaaggaagaaaaaaagaaagaauugacuugucagaaaaauuauaugaaacguggaaauagccagaagagaguuuuguguguuuuuucagugcaaugcugggauuaauuuucuauuacauaggcuacuuaacaaugcaggaggggagagacuuguagacuuuuguuccauagagauacaaauaauuuccuucugguggaagagauaaccuuaauaauugggcauuaaccaguuuuaaaucuaguccaacaaucuuauccuaauauugccuauaaacauuuagcuuuugaaauacucuuuuaaaugguuuuuaccaucucaccgguuccaucauuaauugauuauuugaauaaaaucuuuauauucauuuaacauuuucauacgaaucaguuuuuuaucuuuugaaaauuuugcuuuaauaaacauuugaccacagagccauauaauuuuauuuccuugagagucaugauuuuacauuuuggaaaauuuuacuuuaauaaacuuucaaaauacaacuuauacaauuuuuuuuuuuuuugagacgaagucuugcucugucacccaggcuggagugcauggcaagaucucagcucauugcagccucugccuucuggguucaagggauuuuccugccucagccuccugaguagcugggauuauaggcgccugccaccauacccugcuaguuuuuguauuuuuagcagagaugggguuucaccauguuggccaggcuggucugguacuccugaccucaggugaucugccugccuuggccucccaaagugcuggaauuacaggcaugagccacagcacuuggcuaacacaauuuuauaauaaaaugggaccaugaagucagcaucuuguccaacaacuucauccucccgauggagaaacugaggcuua

SEQ ID NO: 13652 - RNA, 298 nt, Homo sapiens
ucuagucauccucgucggucuucugcuucuugguaucgacaucgucauccucaucaucuucagcugcccgcuugcccguagcugucucagcuuccucaucuucaucuccauccucuuccucaccaucaccuucuuccuccuccucuuccuccccaccuucuuccucuucuucaucuaccucauugucagccuccugcuccccauuuuccucauuagcauucccguuagcaggggcgucucuuccauuuucugccucuuccacaacuuccuucuucuccuguaaguccuugguggugau

SEQ ID NO: 13653 - RNA, 298 nt, Homo sapiens
aucaccaccaaggacuuacaggagaagaaggaaguuguggaagaggcagaaaauggaagagacgccccugcuaacgggaaugcuaaugaggaaaauggggagcaggaggcugacaaugagguagaugaagaagaggaagaagguggggaggaagaggaggaggaagaaggugauggugaggaagaggauggagaugaagaugaggaagcugagacagcuacgggcaagcgggcagcugaagaugaugaggaugacgaugucgauaccaagaagcagaagaccgacgaggaugacuaga

SEQ ID NO: 13654 - RNA, 3394 nt, Homo sapiens
acaaaauaugaguauuuuucaccauggucauacaacaaguauacaggccagacacccuccaagcaagucaauguuaucuuuuaaucucuuuccucaaguuaaaucugaagacucuuguuuucauaagugagacagggucagaaguaagguuaaaaauuaaguauaguauaugaagucaacuuauaauauuagaggauaaaacuuuguacaguaaaaguggcaagaauugcaauccaaugguaggucaaaaaccagauaccuaacaauaguguaaaugacacuaacccuucaaagcuaauucugaaccauguccacaugauccagucuaaauccauguaugcagcauuggcuacagcaaucaauuuccaauucuaccuccucuugaaauaccaaguuaauauuaaaacugagcagcccgagguaccugauugaguaaucaccauuagggacuuuagaauacucaagaaaagagaguaucaugaggagggguccuuggagacaagaaugagcugcuacagucauaauauaucaauuuggacauuucagaguuagagaagaccugucacaaaacgaugcaaugcacaaacugggccaaugggaucuucuacgugguauccucaaggaggguucguauuuacaggacuguacaacugucaaaauugagacagcaacagggcaaucaaaauucaaucauaauucaguaugugggcaaaagauuacccacauaauggaaaauuugaaagacaaaaagaagaagaaguagaaguaguaguaguaacgguaaugguaguagcucuaacaaaucugguuacauuccaggggaaucuucuucagcacccaccuguuacccucaaaucuugaaacauuuacguauaaaaaucaaccugagcaugugcaagaaaauagcucuauauugcccccuagugcuggccagugccacuucuccuugggcuaaaaacuacaaguaguuccucuacuucuaguuacuuccugcugccauccuuaacauagaccaacccccaaacauagccuaauccucuacccacagauuaggaaacaagcagcaauuuuuagcaucaugcaucuuaggaauggaaauggcccagccucagauggcaacagaauguguguggccuggcuuaaugaacucaucucuccuggaggugugaaucuacuuggguaaaguggccuaugaccacaugcugcaugacagcucugggacccuuacaaagugaugauagcauggggaucacaagagagaacuaaaaggaaaggacaaagagaagcacaggucagcaaagagauucgggcagaugccaagagaggcuugauaagacaaggcaauaggagaaaugauaugggacaggaacaauaaaaaacagaagccaggaagccaggaauauugugcauuguugucauuauggaggagcuuggcuaguaagaagcaauauuuugaacuggacauuuauuuuacaugagaaagaacaaagguuggucugauguguuuccugcacggguacagcuggugcuguggcuccuuugaucacuuucccccagaccucugcagcuacugugauuagagauacaucccuaggcugcccuuugaucagcagcucaaggagccugcaggugccauguggcaucacauuagcaaguuguaagaagcaccacacuaauauuagcugauaaaugugauacuaugucuugcugcgcaacagcaaauacaaauaacguuugcaaaagucggcagaauccuuauuuuaucuacuuuuauacccuaaaacuuucugugcuuucuuaaacaugaacacuucauagaguuuaaauucaaaguugaagucuugaaacaccccaauaugaaaaggaaaaaaaaucacucugacuuaaaacuauagcacauccuaucuuaauuuuguagguaugccacuuguguucauuuugcaugguuaaucaagugacagaauccuugcauucugaauagaugauauacaaagcaguaaaaacauguauauuccuuuucaaauuacaguaagagccaccauuuguaaacagggcguuaaauauuccaauuuuagacagccuaacaugaacauugugguuucaugugcaguauaaaauuucuauuuacaaaguauucucaaaaaugacuucauaaugguagaugaagagaaaaagaguuuagaaauugaaugauguaaaucauauggguucagaggcuaagcaaauuacacacccugaagcugcccuggcuuuaugaaaggagccuuucuccagcucugugcaaucccagcccaagggaacuugcaucugagaguuuucuaaacauuucagguacacuugaaagcugaaaguaauucucauuuccuaugcaggauuaagucguuuccagcacacacaaaauagcagucauucaccaacacauacaaaaacacaccaccagaaagguaaggacuucagaguacaaaggcaaguuuaaaaaacaaaaacuagggagcaagagaaauacacuuuuuaauuccucuaaaaacgaccacacagccucuugaccucuauauuuccuaucuacucauugauuaauugaugacuucgaccuagagugcuucaauuaaugcggcugauauauuuccugaccgaccccccucgcccuccccaaaucugaguaaagucaaacaugccaaggcucauucauuuuggauucguuuuuagaggcaguucuugaacuucuaacuuuagcaaugagcgaaccugcaaugugcauuugaaaugacguucacaaucgcucccagaauguccucacucagcaguggcacucacguugcccucuuggagcuuuguggcagcucccgaaguugcaaacuacacuuaaccuuuaacaguccaugccaaugaacgcagcgcacauuugcauguaaugagagaccaaagauaccuucacagucugguauauaucacauaccaacgcacaaugccaacguuaacacacacagcgagaaacaagcagggggagaaugggggaaagacucaccguucuguuccuuguugcuggaaaacuggaauuuacuacucagguuggauuccgccugaguccccugucucuggccggccagggcagaugucagcaggagaagcccgaagaggcucauuuggcugacuggggugagagcucacucacggcgggcacuuuggaagcagcgacucccgagucucuuucaccaccgccaggggaaggcugcacugggguggaagcgccgagccugcucuggcagcagagaaucgcaggguaguuuccacauaaucccauccaaaacuuuuuccuagagcccucuucugugucuccaguuuuugaaaaggaucaaagcaaaaccuggaccugaaccaguuucccaagguuuaa

SEQ ID NO: 13655 - RNA, 4472 nt, Homo sapiens
ugauguguaaacugugggaauuuuugugagcuauuaauuaugcuauugugucuucagaagauugaugucaaaaugcaaauauaguaucucagaagaggaagauaauaaacaccaucccacagauaugaauuaaauuaugagguuccuguccauccugugggcucugagggacugaaagccagucaugagcauuuuaguggagaaagugggagaaauggcugacaauggggagguaggaagugaagagaccuagaagggaaauuuagcaggagaaagggacuccaggaauacauaaguaccugaagcucacuguuuguggacuaagccuggcuaucucucucaacuuaagcaucaggggaaauaaugauaguuaacauuuauuaagcacuuauuuuguagcaggaaauguucuaugugcuuuauuguguacuaacuugucuucuccuuagaaaacccaugaaccugauccaauuauuauuucaauauuaugaaagaggaaacugagucucagagggaugaucauguaucaaaucacguagcuaauacagggaucacuggcgauggcagagggucgaaggagaggcugccagcugucuuaacccuggcuucuaggggccaugucaaggcugugugguacugcagagaaguugaggaaugcaauguggugguggacacaagcauuagacauggauuugggccaucuggaauuugaauucugacucugcuacauauugacugggagguugggacaugugacaucucuagauuagaauuucuucaucuacacaaggaaaaaauaguaucuuuccugccuuccccacugccuaaugaugaaauuuaaauucagauaauaugucucaaaagcguuaggaacaauuuuuuaaauauaaaguaagguaguagaaugccaacaauaacaaauguaaacaauagcagggauccagcuuuuagauauaaugauuccugaagauuccuggauugguaaagagaucuggccaagaaaaucugaccaaucaauccuuagaguggagaaguguuaacugcaguuaagaauugcagucucucagguucuucuauaggcaucugaggaguagcuaagccccauuugaaguaauugaugauuaaauaaauuauauucagaaaauuauuagauguuuuauugaaaagauugagagaagacaaguuaauuuggaguacacucagccaauggagcucucaucucuaccccacaucaacggcugagcagaucuuuuaggagccuggcugcggcagcagcugcugccugggugaaugggcuccgacaaauucacccaucucaauagcucaguacaaauuggaauguugcucuugagucaguugggguccauuuuuuaugucuguguuauauacaguuaaauggcaagaggaaagaggagaaaugauuugauuuugauuucaacuuucucugauuagggguugcugaaggacuuuuucugaaugcaccauuaggauagcugacagaugucuucuuaccauuuguacagaaauuuagagaacuuagcaaagugugcucaaugacuuucugguagauuucguagcaucugaaugugauaauuuaacauuuguuuaguuaggguauccuuguuuugaaaugguggugaaagaaggcgcugaggcucauuuugaaggagaguugcuuuggaauauggugacaagcugauaaacuaaaggucagaacugugaccaguugaucauuaauuuguucucgcuucugggaggaccagauccuacauauuuacagcagaccuuaaugcugaugauuugagcaaugaaaaaugucugugauuuuaguucugcaugcagaggcugugauguauaagggaaaaaagugcugaguugggagccuggaaccuggguucuuacuaccuuuuaaagcccaaaugagccucuauacuccucugcaucucugucuuccuagcugguagaauaaaaacugagagagagaauucugggcuucuuaaggaauuuuuuuucccaaaauuuuguuuguuuuuuuuuuuuuguuuuguuuuuaauugggcuuuuuauuuucugccugggcugaauucaucaaucaacaggucaguguaauugaaaauaauuuuaagaaauaauuaagagaacacauuauuuccucaaguaaugaaauaacuguuuuguucuaaucacaguggauccucauaucugugaauaaugagggcgcuuaauagcauuacuacuuuauauuaaucaaauauaucguuaccucaacaaacaaagaugaugaauggccccugucccuggaaccuugcauccuacacguaauuugucacucaugcuagcuuugucacuguugagaagugaauguuucuguguucuuaguccugcuucuucucuuuugagggacuccuuacuagguccuucccaagggagggauaauuacugauuagauucuacauguucuggacagagcuuagaauaugccuuggaucuuguuuuauuaguugguugggugguuacugugagucaaugguuggagcuugugugaggccuucucuucuguuuuccuaggagggccugaccagguugcuuucucucuuuuuauuucuucugaagauaaaauugagcaucuaagcuuguuaccacaaagcggccccaaucuagaucccaagagagaguuccuggaccucaugcaagaaagaauucuaggugaggcuauagaguaaagugaaagcaaguuuauuaggaaguaaaggaauaaaaaauggcuacuccauaagcauagcagcagccugaacugcucgacugaauauacuuauaguuauuucuugauuauaugcuaaacaaacgguggauuauucaugaguuuuccaagaaaggagugggggcuuucuggaacugagggucccuccccuuuuagacuauauaggguaacuucuugacauugccuuggcauuuguaaacugucauggugcuggugggugugucuuuuaguaugcuaauauauuauaaugaacagugagaacgacuagaggucacuuucauugccaucuugguuuugguagguuuuggcaggcuucuuuacugcguccuguuuuaucagcaaggucuuugugaucucuaucuugugcugaucuccuaccucauccuuugaguaagaaugccuaacguccugggaaugcagccugguagggguaggucucagccuuauuuuacccagccccuauucaagauggacuuacaucguuucaaauaccucuaacaaacagauucauacuccuuugguuucuggcuuuuuauccuucauaggccgagcccuuccaggcauacucaagauucaauuucagaauauaagaguccaacuuagacucaaguacgugacagauacuccaacuuggcuuucaccaaaaggcucuacuuugguuuggcaguaucaaauauuaucucacuuauuaauaaauacuugcuuucccauaugacuaguccuccuuuccuagaguccccuugugaguucccagggacggagaugugaguaauaucucaggacuuggauauucucgagucucuaacauccuuagaauaaaaugaaaccuuuuuuuagaacucuuaacagcaagugcugcacaccuugcuugacagacauacuuuugccuaaauuaaaauggaaaucacuuugaccuggcacucucuuuauucucuucucuuccaaaccaugccucuuacuguuuucgugaccuuggccuuuaauguccucauuuacaaaauaaagagguugaacuaaauccuuuccaggucaccuucaauccucaacauucuuugauacauacugaaaaugucccucugugaguucagagccugcuuagauacagcauucauuuuuauuuuuaaucuuuccucuaaauuccguuuugaauccaaaccucucuuccuccuucucucucugccucugucucucugucuuucucagcacauacacuuaaauaucagugaauuaaauacauuuucugugaauggaaaacuggaagaaaaaaacaggguaaaacaggccucaucauauuuaggaggccuuuuaaaaagcaacuucaagccaaaucuccugguguuagaggaagcacaucaagcagccuccaaucugccucauuuauagccuuuucacauaacccaggguaucacauuuuuuaaagaaugagccgugcugcauucugaaaagagcuuaauguuucugugaauaacauaauuaaaaagaagauucacaucaauggcuuaaucugggccauugcuuuaugaagaaguucagaaagaaguauuuauuaaggaggccuguggggaggauagcuugauaguaaaauauaaaaauacagcuugucuuuggaaccagagguuacacaauugcagagggcagcugcugaguccagcuggaggaaacagcaggccaaauggacagaagaaacauugcauggagaaaaaaagaguga

SEQ ID NO: 13656 - RNA, 14000 nt, Homo sapiens
cgcagagcuugcaucacauccgccgccugggcgcccaauuccggaaggugcugcacagcuguggcggcggguacugcguuagugauuagaguuucuucccugccggaggugggauacacgguagcaucauggucgagguaaagugacacuggggcucucaagagucguuugucucuggacuguuuuuuuuggcagugcgcgugggggauugagaguacuuggaguccagagagaaaagaggcuacgaggggagcuauuuggccaaggccgaguggucucuucuucggguuuucggggaagggguagaagccggaugagaacccgagucggagguucagccugggcgcgaagccugagauaauucguccaguccucguuugacucuugggagcuggaaaguguccucggaggcggggccucuguuggugaucgaccacugguacuugccgcccucggggcagugucagugagucugugcccuaaaagauugguagucuucucuaucuugcguucaggucgucucuuauuucaccucuacccccagaaaaacuugccguucuuuacaucuuucccuggcaugaacagccaacgcuguuagcuggucuuguccaucuuaccccacauguuuauugauuccauucacucuucuccauauccgcugcaguccaccuuaauugagaccaacaucaucuuucaccuggacuggugcauuagcuccccguugguugguuuccuugcuuccauuuuguucuauaaguuguucuguuuaaaacguaaguuguucauaccuuucuuguuuaaaacccuuuacugacccuauguugcuagaacaaaauauaggcuguuguaauagucuaaaagaccuuaccuaaucuggaccuugucuacccuugcagcuacaaagcaccaucucauccuccauacacagcuguacugcgcuccuuguauuauuucaguuaacugaacuuuuuuuuacaugacauuuccaucagccugguucguucuuaccucuguuuugugcaaggcuaacucccuuucugcuuaaauaucaccuuagugaaaucuuucacaauuauacuuaguccuucauucccugacucagcgccuugcuuguugccuucauagcacuuaucaaaauguggaauuauuuuacuuuuuauuugucuguuuccucuugagcacagggaccaugaccaccuuuuuaucauucuauugugagauucuagcacaauaccugccagacacacaguaggagcucaguaaauauuuauugaguaaguuaaacuccggcaucacucaguugcuaaaccugagguucuagccaaagaggagcuuccuccucuucucugaacuugacuccuguagcuugcaacaaguagcuauggugagugguauaaagcuuuuuacauauuuaaacacgugaaguguauaaucaaucugacuuuagguuaugauuuguguaauuuguagauagguguguaauuacauucuuuuuuuuuaggagguacagaaacauucuguacacacccuuguguucaggucguugaagaggacccaugacauguuuguagcugauaauggaaaaccugugccuuuagaugaagagagguugguguaguuuuuuuuuuucaauugcuaaaauacuuaacauucuaauacuaggggaagagagcagggagagggaguccuuuaaagauaagcuagucaugggcuaauuauucaauaaugagugguguuuuggcauaauuuaagcugauuuaacuuuuuuuuuuggccuuuuacaguaaaaguuccauuaauuaauugcauuuuacaaauacccaguaauuaagagagucccuuuuagguauuuuauuuuauaaucaaucacuuuguaugugcuuucagcuucccgcugcucucagagccuugcugagcugaaauuguaccuggcuaguaccucuacucccaucuuuucucguuaguaugaugaagauuuuugagugguggcauauuuuugguucuacauauccagcuccagucugggaaugcauuaugugcaguguuccuucuuuguccuuuaccuuuuuaaaaucuacuuaacuccucaaacaagcauuuauauuuaauuuauaaaguagacuauuuuuaaaaguaauauaaaugcauuucuuuuuaagauauugaaccaauuaaguacuuugauuaguucuaacuaaccuguuuggauacaucuaguaaagguugcuauagaguuuuuacuauauuuauauuuugaaggaaaguauauugacuuugagguuucuuaaaggguauguuaguuucuguauaucuuucagucagacccuugacaauuuaucauaaaagguuuucuauuuauuagguaacaaacuaaaauauuacguagguuuaaugaaugcuguguggucgaauguaagcaaaagaacagauaugguggggaaaugcccuuggaaauuuuugauucuuuuaaauacuacuuaaaaucauacuagaaacuuuuucuacgugaaugggcaaacuuaagcuaaguguuuguuuuaaaguauuuauggauacguucuuauguuuauaauuucuaaauagucacaaacgaaaaauggcaaucaagcuucguaaugaguaugguccuguguugcauaugccuacuucaaaagaaaaucuuaaagagaaggguccucagaaugcaacggauucauauguucauaaacaguacccugccaaucaaggugaguaugguauuaucagaaaugucagacuuauaugugaauuuuaaaaacagaaaaauaaaauauguuauuuuugccccuccuggcaggacuuauuguggucguacaguauuuaauggccguaccuguauuauaauggaaguuuugauccucaugggaauacuguugaugacuuuuuucuuauaggaaauaaaaaugguaguauaaugauggcagagauucuuagaguguggagaaggucacaguagagauuaaaggaaaaaauuggagaauauucuuaaccugugaggacaccaucuaucuugucuguaauucagaaagaugaaauuaaauacugaaaucuuaauaaguaaagagaauucaagauuccacaggaaaccauuugcuuggaagaaauaccagaguggauugucacuugauaggagggcuucuuuguauaccauugcuauauagcaaauggucaaggacaugguuuacagagaucaaagcaaaagugaucaacuucccuuauuucugaggcuugacuuuaguugagaaaauuugauagauccaguugaaaacuuaauauuacuugauacauuuaaagagaugauaacuuuuguauaagguaaauucacuacuguugauuuuuuuuguguuuuuuuaggacaagaaguugaauacuuuguggcagguacacauccauacccaccaggaccugguuagugagcuguuauauauugaaaaugucuuaaaaaugucacauauauuuucacuaacgagccaauaaugagauucuuguugccuauaaaaugcaagauaagcucaguagccaagcauccaugcauagcuuuguagguaauaaugaauacucauaugccuucauucagcaaacauucuuaaguacguauaauuuuucaggcaaugugcuaggaauucaaagacaguaaaacuguugcaggccuaguuauuuauuaucuggugguuuaggcagacauguaaauaucacuaagcuuguaaaaaugauggaaauguuagaagcaguaucugagaaacauguccucugucuguauuaaggcauugguccacagauggaguggccaguguaacaggguagaggacaaaaggcuuaguauguaaagaaaguacagggaaauuggguguuucuaguuuuaguaaguuacauccacucuuggaaacauucuguuaguauuugaggaacugcuuaauacugacuugaaacuaauacccaaauauaauggaaauuaacuuuacuauucugggcugcuuuaauaccaugugggcugugaucaaaucaaauuugaguuacguguuauuaagcaguauuuauuguagaaauuaaaaacaaagaugagcaaaacuuaaucaaauuuguauaauaucacugccuggagauaauaaacauuugguguauguuuuccuucaucauuuuauuuuaagugcauguaaaugaauaauacacagcuacuaaaagaaguugauuuuucauuuuaauagggguugcuuugacagcagauacuaagauccagagaaugccaagugaaucagcugcacaguccuuagcgguggcauuaccuuugcagaccaaguaugaaauauuauaauuacaaagaucuuaaaagcauauuucacuguucacauuuuuucuuuuuaaaauuucuuuauaacuauuauaugacauuuuccuuuaucaggacuuuauaacaauuuaaaauaaaggguuaguuuugcagaauacaugacuggaggcauuaauuacuuugaaaauauuauuucuuuugccccagggcugaugcaaaucguacugccccuaguggaagugaauaccgacauccuggggcuucugaccguccacagccuacagcgaugaauucaguaaguuuuucugcaucaaauagcagguuucuaacuuuuggaacauguugccauauuucccucuucuuuggaauuauuaagauaaauagcagccugagcuagucauucauauuucauagcccuaaaacucaaguugguaguaaauuaacguauuuuuuggaauuuaauucuguuauuugucuacuuguacauuguguguaauauauauuuugauaaagauaaugugauguugguauuuauugcccacuauuaaaaaugcaaggagaguuuuucugaaacuuguguuaguauguauugaauaugaaagucuuuuuuuuuuuauuaaauuuuaaguugguguguacaguuaucuugagugcuguuaguguuguacuauucaugggcuauacaacuagucuuauaaaugagcauuuagaaauaaguuuaucuguuuguaaguaaauggcaacugguauuaguaugguagaaauaguuguugaauuuucuauaguuauuuuauugauuuaucugcagcauaauaaaauaugcugccacuugaaauaagugcugguuuugcuucucagcucauuaugcaauugauuugacuuuaugaagugaaugaauguguaacugccacaucuccuuuccuccuuuauuccauucagagcacgucuucuguccaggcucucuacccuccuuaugaggguauaauuuaagcuucuugagggcaggaacuuuaugggcuuauuuauguuuuggaugacuagaugacugcuaacaacagaugguauaucaggcaguauaccuguuaaaauaguauuuaaauauuguauuagaagauaaauagaaggaacugucagucuuugcuauauuaaaccaauaauguuaaaauaugacaaugaaagacaguggcacuaauacacuuaaaaugacuuuaauauugggagcuuacauggagcauuuacuacuuauuaaaucuuuguaguaacccuaugaaauaggcacuauucuucccauuuuacaggugagccacauagagguuacaugauuguuaccuaaugucaaacagcuaguaauuggccaagcuggguuuugaacccguacacagugaugugugcucuuaagucuaaugcucugccugucugugauuuuauaauugcuuuuuuaaguuaacauacagaaaauuguauuucuucauuuauggaaaaauucuuuuguaaguucccucuuuccauuuccauuucugaauugauaucaugaagccuuagguaugaugucuuuaauaauaauaaugucucuucuaugucuagauugucauggagacuggcaauaccaagaacucugcacugauggcuaaaaaagccccuacaaugccaaaaccccaguggcacccaccguggaaacucuacagggugagugacucugcauuuauuuuauuaugugaaccaugauugcuuuguaguugacaagcacugaagaauagaauaaggaggaaaaagagugaauaugaaaagcugguagagcgaucugagguggauugagaagagucguagggaguaucuuaaaagaucucuugggaaggugacuuccuuaagcaaaaguuauacuuuuauauaaaauaguaugaaaugucaagauaaagcuacuaaauauggauggcagacuaaauaaauguagaaaaaguguucaaaguauuuaguuugaaggugaaggggaaaaacaccauauaaagaaauuuauuugggccuaccaguuacucuuucaacuacaauaaaugaaaaugauucagaguguaucaucuaaaagaaaauggacaugcaugcuaacuucagcagcacauacacuaaaauuggaaugguacggagaagaugagcauggcccuuccacaaggauaacacagauucgugaaguguuccauacuguuuauuuugcauugcuugccuauaccaaaauaucucauguacuccauaaauacauuucuacuguguacccacaaaaauuaaaaacagaaaauuuuaaaaaagaaaauguacauaguaggaaauguacagcuacacauaauuuaauauguaucuuaaaaauuucauuuuucaaaugauuguacaguaagagccuuuuuguuugacauacagcucuaaugaauuguaauagauguauugauuuggguaaccacuaccacaauuaggauauagauguuacaccaccucaaaaaacacccuugugcuauucguuuguaguuacacuuuccuucaccucugacaaucacugaucuguuuucuaucacuauaguugucuuauuuuuuuucaauaauuucaguucuaauuuauuuuuaauuuuuauggcuaacauaauagaugugcauauuuaugggcuacauaucaaauuugauacaagcauacaguguguaggccaggcaugguggcucaugccuauaaucccagugcuuugggaggccuaggcaagcgcaucucuugagccuaggaguucaguaccagccugggcaacacaacaaaaccccgccucuacaaaaaaauacaaaaauuggcuauguguaguggagcacaccuguagucccagcuacuccagaggcugaagugggaggaucacuugggcucaggaggcggagguugcagugagccaagaucacgccacugcacuccagccugggcgacagagugacacccuaucucaaaacaaaaaacaaagaaaaacauacaguguguaaugaucaaaucacgguaauugggauauuauuucuuuguauuaggaacauuccaauuuuacucuucuaguuauuuugaaauauacaauaaauuacucuuaacuguagucacucuauugugcuaccaagcuaacuagccaaacuagugcuaccaaacuagcuaaccaaacuagugcuaccaaacacuaaaucuuacucccuuuaucuauuuuuguacccgugauccaccucuucuuuaucuucugccuccccacuauucuucccaaccucugguagccaucauucaacucugaagaucauuuauuuuuuagcucccguauaugagagagagcacgcaauauuuguuuuucugugccuggcuuauuucacuuaacauaguaucuuccaguuccauccauguuguugcaaauaacagaauuucauucuuuuuuauggcugaauaguauuccauuguguguauguaccacauuuuauuuauccauucaccucaugauggacacuuagguugguuuagcugugucuuuuugacuaugucauauaaauggaaucauacaauauguacuuuuugagacuggcuuccuucacacagcuuaauacuuugugagucauugaaguuguugcaaguauuaauaauguauuccuuuuuauuacugaguaguuuacauuauauagaugagccacaauuuguguuaacuauuaacucacugaagauaauuucauauuauuguaaaauguaauagucauuaucuuuuaugauuugaagaugggagggcaauucaaacucgggcugcaguuaaacuuaaauacauuuuaacuucuacguuggccugcccauucuacuuuguuuuauacagguuaucagugggcaucuuggcuggguucgauguauugcuguggaaccuggaaaucagugguuuguuacuggaucugcugacagaacuauaaagguaauaaugaaggaagaaaaaauaaacaugacuuuguguuugucauguaaguuuaaucaguuauuauuuccuguggcaggaauugcuauugcaguuccucuguuauuuuagaccugaauaaggaguaaaauuuaucauuuauacuaauaaguguucuaaauaaauaucuguuugaaaagugcuauuuaaaccacuuuuucuuuaccuacugaauaccuaccacuaauuccuuuauacuuacauuguucucuccaacugguuacaaaauuaagagcaugcucauucauagaaaauguggaaaauauagagaauuaggaaaguacauagaccuguauauaauccuaccauuguuagauauuuggauaaguuucguuuuaguauuuauuucuguaaguaucaauaccuucacuucuaagcucuuuuccuguguguguaucuuuuaaaaaaucauucuuaguauguaauuuuguaucuugcuuuuuucacuuaacguuguaucaaaggcauauuccugugaaaaauuuaccaucuuuuaaagugguugcauaauauuauaucauuuagauagucuguaaucuguuuuccuauuacuggacaguagaguuuuuagucugauuuucaccauuacaaguaaugcuguuaaguuuuguauauaagacuuuuucuguauuuuaaauuauuuuguuaugguagaguuccauaaauggaauaaaugggucaaauauuuuugaagcugauacccaaaguacaaauuacuuuccaaaugggugaaucgauacuugcaguguaugagaggauccuuuucagcacauugguuguacauuccuuuacaaauaucuaauaugguaagcaaaaauggauacuuaaucuuuuuaaaaaacuuuguaugaaauuucuaaugagugugaacuuuuucauaucuguauuugcugcuuuuaggauuucuuuaaguuguugccagccucaguuaauuuaauaccauacuuuucuuacuguuauuaucaaagauaucauuuauauaacaagaagguuaaccuuuugucaucuaauugcaaauauuuuuccaguuugagcaugccaguuuuuuucuugcuuuuauuuggaggggagucauuuugcaaaauuuuuuauuuuuacguauuuguuaucuuuuuccuuuugucuuugaaagcucaguuuuaauaaucagguuucuaaaauuuuguuuugcaguaaccagugaaagaaaaaaauaaauauucuuugauugcagaucugggacuuggcuaguggcaaauuaaaacugucauugacugggcauauuaguacugugcggggcgugauaguaagcacaaggagcccauaucuguucucuuguggagaagacaaacaagugaaaugcugggaucucgaauacaauaagguaaguuuggaguuaaggauuuaaaacauugugaacuacuauuuaucuuucuaauucuagaaguuuuaacuuuccugcuuugucuuuagguuauacggcauuaucauggacauuuaagugcaguguaugguuuggauuugcacccgacaaucgauguguugguaaccuguagucgagauucaacugcacggguaaaugggauagaguuguguauuuaucuguaaauauauugcaucuuguagggugcacuuucgguuucagugucuucaauugauugauagagaauuaaagauagcugucuugagucaucaauauccuagucccuaaguuucuuaacuugcauuuuuuuccaccuuagucuucaguuguauggccucaccauguuaguguuauuagugcccugccccugaaaugugauauucucacguuccauucuguaacaacuauuguccauuaguucuuucauucaguagucuuaaaaaguagucccaucauacucauucuuagauuuucaguacccugaucuuuuagcuuuuuagaauucuugcaaguugucuccuauuuauauucguccuccaguuuguaaaucauuaucuuucacuuaagcauuuucuuuauuauauucaggcacuaguuauguaguaaauuuucagccuugaauugauccaguuaucuucuugagauaaugaauaccuauucucuuuccuaauaugucuauuguguuuuuauagauuugggaugugagaacuaaagccaguguacacacauuaucuggacauacaaaugcaguugcuacagugagaugucaggcugcagaaccacaaauuauuacagguaugaucgauacuuuucaaguuuacagaauauucaugucagaauccauguuauuauacauauacuuuuaauauucaugaugacucuugcucuguauuguguuuacaguguuucugugucauauuuuaaucauggacaauugaaauguauucaaaugaaauuucauuccacuguuuuuaccucaugcuuuuuacauaucauagaguaugccauacauaguauccuguaaugucugacuagaauacuguguuaugaacaauuauuauuuuauagugucaaaauuauuuuucuaagaaauugaaguuagaagacaaaacaucuugagacuaguaaucuuuagaacugauuugaaucuuacuuugcucuaaauaaaguuaguaacaauggaucuuuaauacuagaaaauaauuccuuugccugauguauuuuauuaacuuaaaaaaaucauugaaguuuuuuccuuuucacuaggguauacaauuauauauuuauuuguuauuugcauuuguuuuagcuguucaauugacagugaaucaauuguuguauugcauuuuuuuaaagaauuaaaaucaaccuaaaaauuuggaacuaugaagaaauuagccaagacuaauuugcgugugauaugacuuucauuuagaacauauguguuuuggaagaaugcuuuguauuuuauuuaacuuuugcauuauuuuuccuggucuauguuuugagggauauauguguuuccauuacaggaagccaugauacuacaauucgauuaugggaucugguggcuggaaaaacaagagugacauuaacaaaucacaaaaaaucaguuagggcugugguuuuacauccaagacaguaaguguauuuuccuaauuagcuucuuguuuuucuucaguucuuaagauaaugcugaaaugcuagugguguuagcacugcuuuuggcagucauuuagcugcugucauuucuaggccugugccgcauaggaacguguguuucuuuuauuuuccucaugcacuauuuugcuucaugcccuauaaaacaugaggaaagccuucuacuugauaacaaauaaauaaugucaaaugagacaguguaaaucaugauuaaaugcugcaugucaaaauaaaagauauuaguggcuaggcuuaauguuuuggacauaaaugauuuuggacacugagacauucauugaauaguuuaauucuuaaggaggaaguuaauauauguagaaacagaaauaauaagaaccgugaacauuacagucagaguauccaaaaagguggagcauaauaucacaacuauuguuugguguaucagaucacucugacacuuuucuggauucuuccucuccuuccuuuccucuucucugucuucuacucuccauacccuuuucccccucucuucuuccuuccuuugcuuaucuuucucacucccauuucgccucuccucccuccuguucucucucuuccucuugcccucuauuccuuuucucucuuucuuccuguccugucuugcucucccucccuccaaaagaguugcauaacacauugcccuucaugugaaauagggcuucugcacauuuauugcucuggcuuagugcagagcauuaaggaaaugaaaggagaacaaaacauuaaucuaggacuuaaaauauacuguuaaaaaugugaaggucugauuuaaccuugaacaaaugucuuaauauuuuuacauuuugauacgacuauuuugcugaauauauaaaucauugaguacacacugcaaaauauaacugaaauaaacuuuuuaaaacccaccacuuuauuuaacuugguuuacuuugucguuaauucuuuuuaauauuauuucaguuacacauuugcaucugguucuccagauaacauaaagcaguggaaauucccugauggaaguuucauucaaaaucuuuccggucauaaugcuauuauuaacacauugacgguaaauucugauggagugcuuguaucuggagguaaaauaagauuuuuauaauaaauauguuuagucuguuauuuuuucuuuuaaugaugaauaaacauuuguaaugcuucuaagcugucacacuuaaguauuauagcagcacuugccugguuagggcauauuugcauguuauuauguguguucaugcauauucauauuacauguaguauauuucauagcuuaguccucuuugaguucccaucuaaugaaucucagggauuuaugcugggaauugcuuaaaauuuuguuuauuauucuggaauuggaugucagauuuucaggugcuuuuuaagaucuauaaguucugaacccagcccaaaugaaaguagacaaaccaauauuaagagaagguggagugccugugucuuauguauuuuuauaaccguaguauucccaugcuugggcuaaugaugcuucauaaauguuugucaagcuguacugcugaggggauaccagguguaacuagauuuuucccuuuaagcugacaauggcaccaugcaucuuugggacuggagaacuggcuacaauuuucagagaguucacgcagcugugcaaccugggucuuuggacagugaaucaggaauauuugcuugugcuuuugaucagucugaaagucgauuacuaacagcugaagcugauaaaaccauuaaaguauacagagaggaugacacagccguaaguucuguguuucacauucguuaaguaaaacagcuauaccaauuuggcagcauauucucauuuaauuaucagaaggaaaaauaaucuuuauaguauuuaagauaucugucuucuugaauaguguccauuuauauauuucuauauuguuucacugaugccagugaauccauggauggcuuuaauuuuaucccaacuuccuuuguuauaguugcugggaaauguugcaccaagaauaacagcaaauaaauagauugcuauguaaauuaauucgagaaucauaagcuuugguguuaguagaauauccaaguagaaauguuauuuuagauggaaaacuacaaacuaaacauaaugaauccauccaucuguuauuagacuuggauaaugccagaaguuuaucaacucuuccuaaaacugucaaagaacuaaguguauaaagccaaugaauaauguuagauaccuuauuuuuguuagaaaggaagccuauuagacaugaagcaaacuaauaauacuuuauuuuaacucacuuuucuauuuuuagacagaagaaacucauccagucagcuggaaaccagaaauuaucaagagaaagagauuuuaaugaauguggaauuuuuucucucucuuuuuuuuucuuuuuaauuaaaaaaaaaaaagcuuggcguucaugaggauauccagucauuuugugcucuggcugggaauauaaaggagaaauucacuugcuucaaucauugcugcuucauauuuuacaauaaacuguccccuguccccuaccccuguguuuuuauuucuaaaacaauuugugauacuaggaagaugcagauaucaaguaaaugcagguuuauu

SEQ ID NO: 13657 - RNA, 8488 nt, Homo sapiens
aacggcucauucugcucccccgggucggagccccccggagcugcgcgcgggcuugcagcgccucgcccgcgcuguccucccggugucccgcuucuccgcgccccagccgccggcugccagcuuuucggggccccgagucgcacccagcgaagagagcgggcccgggacaagcucgaacuccggccgccucgcccuuccccggcuccgcucccucugcccccucggggucgcgcgcccacgaugcugcagggcccuggcucgcugcugcugcucuuccucgccucgcacugcugccugggcucggcgcgcgggcucuuccucuuuggccagcccgacuucuccuacaagcgcagcaauugcaagcccaucccugccaaccugcagcugugccacggcaucgaauaccagaacaugcggcugcccaaccugcugggccacgagaccaugaaggaggugcuggagcaggccggcgcuuggaucccgcuggucaugaagcagugccacccggacaccaagaaguuccugugcucgcucuucgcccccgucugccucgaugaccuagacgagaccauccagccaugccacucgcucugcgugcaggugaaggaccgcugcgccccggucauguccgccuucggcuuccccuggcccgacaugcuugagugcgaccguuucccccaggacaacgaccuuugcaucccccucgcuagcagcgaccaccuccugccagccaccgaggaagguaagccuucccucuugcuuccccacucccugcugggcugagacgcucccaggagaucccgccccugccacgcaucccagugcaucccugcuuggggugccaguagcgggaagggcagaaguucugccugaccuggucugucaucacaacaagccuguaucaaauuugaggcaccccucccacgccgcccaagucucgcgcauucuccucccgaguuguaccagcuauacuuaagggcaguuuaaaaauaaaacaaacaaacaaaaacaacaaaacuaaaaaaacgaagaacugaacggcgguuuaaaaaaaaauagauacacgauuauuguuaaagaugcuagcacuggagcugcgcagagcguuggaagugguguuugguggaggaguuuguggugagcauucuggccagaggccccucgcucagccucauucugcaccuuccuaccacugggcaggauucuagucacaggaacauuuccuguacagaaaggaaaaccaggaugcacaaguagauaaccuuuuaagggucuuuuuguccuuugucaauuuagauuuuggaaauaaaaccgggacuggcacggaguguguggaaaauugaacauugguuguaacugcucagauacuugaggaagagggcauaaagggaaucucuggaaaucacuuuucuauugcuaucaguuuuuaacuuaggagugguuuugauuagcuggagaaaaucaugcaaaagagauucccaaguuuuuagaaaacggagggagaguuccugugcaaaaaccaucaaagcaaugaaaaccucaugggcucucaauauuuuuucugaaaggaaaacauauacaaugccucugagcugauuuggguccccuggguuggaaaagggagcuuccuaaucccuuucagggcuucagcagccucucccuuucaaucucuaguaguuuuccuacagacaucauuaguuaaagcaaaugcaaaguucuuuagcaaucuuuccuggcagggaccaugaguuugcaaucaucuuauugguuagauuucuaauuuauugcaaauguuuggcauuuuucaaacauuuguccaacauguaccauagaccaaccaauacagguuaguaauauuuuauauacauccugagagcuccuaauuggaaauguuugauuuuguuugggugaggggacuuaagggcaguuuuauguauguugcuuuuauuucuucccacuaucagcagcaacauuacgcaucuuacauuucuccaaaaagccacuuuucuccuucaaaauaaaaguuuauguucuucaaaauuccagcuuugugauuuuucuaauuugauaaauaacgcuucuauuaagucacauaguuuucuaugaacauuaaauuucacauuagugaaaaucucauuucaccuaaauuuuaaagacauaauuaacacauuuauaaaugagagaagggcaauauaauuguucuuuuuuuuuuuuuuuuacuucucccaagaaaucaaacucuuagaagagcuuuuagcaggucuucugauaauugugcuaguauacaaucccuaaguuugaucagaccacuaaaccauuuuugcuucgucuuugauuagcuucagaaacagguuuauuuauuuguuuguuuugagaguuugaaacaggcacagaagggcaagaagaaccuguaccagggagcuugcagauaacaaugaaaugaaugcugccuaacucaagcacaaucuuggcagaggcacaaggugacacagaaccacuuagagcaggcuguuguaauuagugagauguguuuucaagguggaaacagcccacauguggaacgcuagccagucaccccucccaguccagacuuggccccccugagauacagagcucugccgaguagagccaacuacacugguguccuguggcugagaaagacaaucuuuugucuauauuuucuaguuaccaguuuucccaaauuccucaaguaucuuugguucuuugggugcuuucuccuucaaaaggccuugggaauaacuuuuucagacugaauuucccagagguugggaggaugagcugaaaagcugcacccugucucaguuaacuauaacuacauacacuuguauacucugcccacaacucccuuuugagagucauaauuuauuaaacacaacaacauauaggcauucucauuuugcucccaccaccccucccccccaaaaaaauugggaagcaugggaaaacuuucuuaggauugaguguuccugcuuuuauagaggaggcagaagcugagguuaaauaggacaauugcuacuuuugucuggauaagucccuuugaguuguuuacaaacgccaccuacuguucucuuuuaagcaaacuuacuaaagacuguuuuucacauuucuagcuccaaagguaugugaagccugcaaaaauaaaaaugaugaugacaacgacauaauggaaacgcuuuguaaaaaugauuuugguaaguaauacaacaacaacaacagauuucacauucagaaguuuuauuuaccaguaaaacuucaaggugcaaaucauuaugauguugcuagauaaagguuggguaaaacaccauuauagcucauguaucccaaaaucaucuaacuugaucuauccuaguuuccuccuuauguaacugucuagcauugaguuguaucuuguuaggugagacucauuguucuguuaagccaauaaucaaauaaugaaaauuauucagauuaucaauuuccaguggcacauuuuaaaucccuuuuuuuuuuuuuuuuuuuuugccgacaggcauaaucccgaguucuauuuucuuuugauuacuuaacaugugcaccagggauggaaguguaaauauuagccccagccaaacagauucaaggcuuuaaauuggccacaaauaaaaauauuuuuacuuucuuuauaacccauaaugauuuuaaaccucuguguucuaccauuagugaauauauccaaggcacugauuaauaauuugucaaggagggguuccuuaaguugaaaaagaagaguggcuuacugagaagacaccuaacauggaacaccuaacaaccuuaaaacaccaucuuaaaaucccuuuuaaaagguuuuuguaaauuuuguaugacuaagucuagacacauuugccacaguuucgaaaauaguuuuaaaaaggaaaaaaaaagcuuagaaauuuacuuuagcaagauacaugauagaucacaugguguuuggggacaauaaaaaacacaugugauauguuccauaaguugcaagucacuccccugaagacaggauuauaaggggaaagagagcuggggcuuugucuacauggaacucuaccagcaccucaucugcugacuucagggcucucaggucagaagaggagcccagcuagacacaggaucaaugcuaaauucagaguugggaaugaccaggaacuucacccagaggcauucuugcuuuuauccuuuuccaagggcagguaccuuuugguguguuggaauuauugguaccuuuuaaaaaaguauuuauucaggcacaaggcugaacuuacucauaagcagauauguucccugcucugucaaucaauaauggagucuaauagacccauauuaacacuucuacauauucaacauaguccucgagacugagggaaaucacuccagcucucacucuccuuaccuugccaucccagaaaucucaggccuggucaggucccuaaaacucuggaaccauccaaucccugcucuuugacaacuccaggucucuuccagaaaguguccuggguuuaacucugacuggucccagaacuaccauagucccgguguugggaaaggcuucacacugcugaggaaagagaaagaagggagguagcucaaaguccuuagcaacuuuuccccucaggaggagccacaaauggggcugacgggguuucauaugccuguuuucaaauguauacaacccucaaacuggcuaagagccaggcauguuagcagcagauaauuccaaaucaccagagccuuaccaaaacacaguucucagcccccaugcuacaucacuucauuaagggcaagauagaaaaauaucauuuuauaaaauuucuauuaaaaagccuauaaaauaucauguucuucuggcaguuuauauccuuugcacugcacauaaaacagauccuuccugacuuccaugaaaaguugauuguuacacuguggagcuccauaacaauuggcuuugggaaacaugcacacacaccuauuacuugcuugcuuuguggcugaccuuacagaagacccccuuucuaaggaugcccuaucaagacaugagccaaaacauggaugccugugugccuuagugugcucccuccuuacagagagaaagccuuucaaaacaacacagaaguuaucacacuuaagguaucacaugcauagauaccucacaagcuuuguuuucuauuucuucacucuuuuugacccauagagggauaaugaagcagaauuuuaagaacugcaucauaagauuauugguuuauaagcacuauuccaucuugccucuguucuuugugaauaauggaaaaguaggaggaacaagcauagaaaucugauuuauuugacuugacuacucugggaaggcaucaccucuucccuacugugcuccugaaguacaagggaaauucaguggugcaaguacuggugaauaaaaaaugguucagaacuaccuuccuauauauacaaccuauuguaggaccagaaaguaucaucaccucugccugcgaucacauccugcauccucagucacauccuccaggacaggaaagguuaugugggggauucaauucucucuguuugggccuagcugaaaauccagggagaaaaucccuaauguuuucucaugauaaacauuugcaaaauuaguuauuuuagagcuagacaaagaugacuaaaaaaucuuccuccugguuaaaagugaugguuuuuucugauguuuggagcuugagaauguuucauuuggccaggugaaaucuuauauaugcccuaccuguacuacagacaaggcucccagguaaaguguaaucaguccauuucucccaccauggugaggucuauccaacacccuacucccaaugcagaggacacaaaagcaugaaacauuuccacaaguauggcuuauuccacgacuugagucucaaaaacugagaauucaguaccacaguucagaugcauaucauaccagacaaaaccaugguuggccaagucauagcauuuuugauuuaccugcuagagauucuauaauuuccugguugacuagaaagccauacucagucaaauucccauucugauauuuaaaaaaaaaaaaaagaaaaucucaaaaacaguuguacgcaacacagaaaaaucuuccucuauuacuaauuuaaacauagauuaaacuccaucaaagucaggaagucauacuuacacaucaucuauacagaauagcugucaggggcacacagggucuuaggacacauugcagcugggcaaguuuaugcugcaaccacuacaaaaacauggacauugccucaagacaccacagugguauuacaggaggagguuuggcaacuggaguucuagcaaacaaccuaaacugggugaccucaugcaagucacuaaacuucucuggauuuaagauucuuuguguauuaacaagcaauuuuaaugggaugaucccuucuaaccuuaaaauucuauucuuuuccugcuuucauggagucuugaaauuuaauuccagcauacacguuuguagggcuuucuuucccagagcauacuguucaugacuauaaaacguguccuuuauaguaaaccacuuacuuuuggucuucgcauucuaacgagucuacauauacauuuuggaaacaguacauauaugauccguaaacgccuuggccuuggacuggcaaaugagagcauauaaggaugaggucuucagaaaaacacuuuuaugacuaaccacguugugcuguuaaaaagagacuugcauauuguuucuccugcuuuaccaaaucaaaugcagcuguaagaucaauucuccuucccuguaaucugaucuuuagaaaacaaugauugcgugacacaguuuccuuacagguuuguccaaaaaccucuugcauaauaaauugaguuuaaacuuuacggccacagagggaucauauuucaccuaaaagucaggcauuucuuuucaugcuuaaguuuccaacagaggaagucauuuguuggagagagcacacaccacaugcaacuuucuuacaaacacaagggugagugaggaaaggagaagaaaaguuaauugagucccgcaaagagagaguuuugaaaaaauggcugauuggaaaccaagugccuggcaaaugcuuugaggcuuuagcaguggagccaccugcugccccuagcucccaacccccgaucugcagccucugagggucccauuagcucuaggaagccucucuuuccucauccaggccaagucacacgaguuggcagaauggggggagguauacuguauucccucauuauaacuggcaugacucuuucugcccucccucauagcacugaaaauaaaagugaaggagauaaccuacaucaaccgagauaccaaaaucauccuggagaccaagagcaagaccauuuacaagcugaacgguguguccgaaagggaccugaagaaaucggugcuguggcucaaagacagcuugcagugcaccugugaggagaugaacgacaucaacgcgcccuaucuggucaugggacagaaacaggguggggagcuggugaucaccucggugaagcgguggcagaaggggcagagagaguucaagcgcaucucccgcagcauccgcaagcugcagugcuagucccggcauccugauggcuccgacaggccugcuccagagcacggcugaccauuucugcuccgggaucucagcucccguuccccaagcacacuccuagcugcuccagucucagccugggcagcuucccccugccuuuugcacguuugcauccccagcauuuccugaguuauaaggccacaggaguggauagcuguuuucaccuaaaggaaaagcccacccgaaucuuguagaaauauucaaacuaauaaaaucaugaauauuuuuaugaaguuuaaaaauagcucacuuuaaagcuaguuuugaauaggugcaacugugacuugggucugguugguuguuguuuguuguuuugagucagcugauuuucacuucccacugagguugucauaacaugcaaauugcuucaauuuucucuguggcccaaacuugugggucacaaacccuguugagauaaagcuggcuguuaucucaacaucuucaucagcuccagacugagacucagugucuaagucuuacaacaauucaucauuuuauaccuucaaugggaacuuaaacuguuacauguaucacauuccagcuacaauacuuccauuuauuagaagcacauuaaccauuucuauagcaugauuucuucaaguaaaaggcaaaagauauaaauuuuauaauugacuugaguacuuuaagccuuguuuaaaacauuucuuacuuaacuuuugcaaauuaaacccauuguagcuuaccuguaauauacauaguaguuuaccuuuaaaaguuguaaaaauauugcuuuaaccaacacuguaaauauuucagauaaacauuauauucuuguauauaaacuuuacauccuguuuuaccuauuc

SEQ ID NO: 13658 - RNA, 5126 nt, Homo sapiens
caaaccaucacaaauagcacuuuuuauuugccacuauuugaagucugaacuuuaaacagauucuuggacuggugguucauauccaucagcucguucaacuuuagcaccugucucguccccaguggcuuuuccagaacuacugccuucaccaugaagcuccaugagcuuucccacuaaaaggcaaaaaaaaaaaaaaaaaaaaaaaccaaaaaacuguuaguauaucuugaaauaauggucaucacuacuaugcaagcaugacaggaagaaaaagaaggccaugauauggccccacacuccuccuccacccaaaaacaauguauuuggcccuacaggaaucaugugauuucucacuuacauucaaacuugggcuucuucagcauuuuuacuuuucuaacgaagacaucauggagaggauaaauagauuggcaagccuuuucuaugucuuuuccaaugcugucuggaauccugcaaaccaguaacaguaaauuuuuuucuaaaaguccuaguucucagauauaagccauuuccuuuaaaaguagagaagccuuggaauaaaccuacacauaacaccuaccucauuuaaccugcauaaauccuccuguuaagauaagccauuauuuaccuuucacauguaaaggauagaugaucugaauuacauagcuagcuaguggcaaaguuaguagagucuucugaguccaagccuuaugcuuuuuccauuacacccucuuagcuaacuguauauugcaugggaacaucagaaaaauguuguuaucacuggccaucaucugggaccgaaacuuuuuucaucacuuauucccgugcaucauuaaucaugaaagguuuugucuauucaguguauuuuuucuuuguguguguauauauauauacguauauuuuuuauuuuuugggacagggucucccuauauugcccaggcuggccucaaacuccugggcucaaacaauccuaccaccucagccuccugaguagcugggacuccaggcacaucccaccccacucaacuuauucaguguauuuuccaaguaggggaaaaacauuuccuguccuucaacuccaucuacugugagacagcuucauucaaaauaaauaaacacgaaaaaacuguuaucauuuagaguacuggcagaucaccugaagucaggaguucaagaccagccuggccaacaugaugaaaccccaucucuacuaaaaauuuaaaaaaauuagcuggguaugguggcaguccccuguauucccagauacucaggaggcugaggcucaagaacugcuugaacccaggaagcagugguuacagugagccaaggaggaucacaauacugcacucgagccugggcaacagagcaagacucugacucaaauaauaauaguaauaauaaucauauuuacugaguacuuaacacucuuucacuuaaagagauauagcuagaaggauucacagacaggauuucaacagaccuuuaccuugucucauaugcguucucucaucucaggaauaauccaauacucaagguuguguugugugaggaagcaaagaaacacuuacaauuuauugaccacuucuuucaagucauuugucugcaccucucgggucaugauuuccaucaucuucuuccggauuuggcggaccuguuggugcugagcauaagaggucuuccguaucugauuguugcguuuuuuaguaaaaccaacacagaacagacgaagcaaguaaccaucgguagucuugacaucaacgugagcuucaaucauugucuggagaaaaaagauaccgucagauuuaacagguuuuacguuauccauuuaucccucaaguucuaauuuuaaaaagcuggauugucaaacacucauuauuaaauauaaaguauccuaacauaaguaacaucucuuuaaguuuacagaauuaacuuccuugaacuuaccaaguuacccccaaauucuuacccaauuaaauaaccagguccucucaacugcccucccuccuccuuucuacccuccauuaacacuaccacuaucuugacggcauccaaacccacauccauugcauauacauauaccccuuuaaacagcucauacccccucaaguguaaaacuacaccagaggaaaauaggucugagaggauccaugguauucuaugguaugaacacaucuacagugauuaugucauuuuucaaaaaacuguguuguaaauaggugacugcuauaacucuaaaugcacacuuugaaagacgucuuuuauguuccaaacuaaagccaugcugaugauuaaauacccaauuucagagcuaaaauauaauuaaaaaccccuaguuaguggucauauuauugccuaaauugaaaaaacaaaaaacaucuuggguagugaugaaaacugauuuaccuuguuugcauuuuguaaauuuuauaccuuaguauaaaaaaaaacuaaucaaauacaauuuacagcuaagggaccuuaaaauauuucuagaaauguaaaccauaaagccuuagaggaaugucaggauaaauauaaugguauaaucaguauguaucauuugggacugaaacauuuugucaucauucauucccacauacaaaauauucgaacugugccaggugcaguggcucacaccuguaaucccagcacuuugagaggcugaggcgggcagaucacuugaagucaggaguucgagaccagccuggccaauauggugaaacccugucucuacuaaaaauacaaaaauuagcugggcgugguggcgggugccuguaaucccagcuacuugggaggcugaggcaugagaaucccuugaacccaggaggaggagguugcagugagcagagauggcgccacugcacuccagcccggacgauaagagacucaaucucccaaaaacaaaaaacucccacaaaauauuccaacuggauaguuagccagacacaucugaaauauuuucauuucauccucacaauucaauaaaaugacacucuuaucugcacuuuacaaauaaagaaaccgaggcuuagaaaacaaguuacuuuccaacgagaacacaauaggcaaauggagcccagauuuuaaccucacuccagaggcucugccacaauuaugcucuacugccacaguuaaucaacauucacucaauucugaggucaaaaaacauccuuaagacaggcaaaaccgcccaccugcaccuaaacguuccucaaaaaaccacuaaucuaugcagcaagaaaaucugacuuugaugauacaccacuauuaaaucuuagauuuaaauaguaaguaaaauaugguguggcaaccccagaguuagcacucaacaacggcaagaaaacaaaaauuuaaaaugaacuuuguggacauuucacuggucucaauaaauaaauaaaaugaacuugcuccuuccagucaucaaaccaugcuauccuuggucaaacacccauagcacaaccacucuaaggaacuuugggucucaccugccauuuuuugaccauggaacacauuuugucacggguaagauccaugccauggaaguuagucaggcaguuuuuacccugaacaucuucaguaaucagcuugaauuuucuaaaugcaacuucaucauucugcaaaucagcaagacucacuucaaacacacgacccuugagaccaucagaugcaauuucuacaaaagaaaaaaacaaguaucuuaacauuuaggaaccauauaagcaaagucaagccuguaaacugaggguagaaauuaaguuaaugguaaauuauaaagaccuuaaccuuuguuaucaaaucuauccagacaccagugacuuaucaacaguacuuauuugaagcucagaacuacccauggcacauuuucuuaauucaaaaagcaccaucuugcuucucuccaagugcuguacuaaaaaugaucaccacaggugccaaggcugcaaccaagagcugacauuuccuuaaagucucccaccacaggaccaacaacagaccaagaugccugcuacaauauacaagcgccaacuuaaggaaaauacaaaccaagaauaagcuacuuacugguuccuuggguccuggugacgagcgucuuuccaauauuucuuauauugaacauagcaggugcuuucacaucauaccaaucuuucuuagaaaauggaucaacccuggauuuuaagaagaugcuuaaguuccauugcagaucaauucuuacuguauuuuucacuguuaaugguauuucccauuaauauuuuaaaaagcuaaccggcaauuugauaccaaaguauaucucacagugaggugaggggaacaaacauaaaucuagcucuucccacuguacguuucacugcaugcaucagacuuugaaagguuauguccacuucccacccucaucgguccauccacuacacaggcacuuagaauaacaugcaucgguccuuccacuacacaggcacgaguaacaugcaaucucauuaacuuugcuggcacguaauggcauguacugguaacuaagagacugcauggccccaaagcuuagcaggagcucgcagauuccagcgggaccaagcaaaggcgagauugacggguccugaauggauagaagggugcuuuccucaacuccugcugucgcagugccaucaaacacucgcagaauugaggcagcucgugagcccacaaaacuaacauuccagccgagucgcgccggcaagccggcucaaacgcgacgcgcgcaaggaccagaaggccugggaaaggcagccgaccugccgcuacucaacaccgacccuccaggccgcguuccugggugcaccaacccgccacggcccgcacaauccgacuggaauccucgccauccggccuacgccgcgaucuaggaccagcccgccgauuccagcagacccccaaaaagcaagacgccacgacagucgcgacuuacacuuucuucuuggcucccuuuuugccgccuuucguaaggcgcuuguucuugccaaccgccauggugcuggucagagagccaaaagggcggaagugggagucgcgcgagaacuuaggcguacgggggcggggcgcgccgucuacgugaccuuugcccuguuauucuuccggccucaagaauuccgggacaguagaga

SEQ ID NO: 13659 - RNA, 12937 nt, Homo sapiens
cuguguuuuacuccuuuccuuauuuccauaguaccucacauaucuuaagaauacaaacucaauaaauauuauuaagugaaugaaggagugaaggaaugaaugggugaacaagugggauaugugauuuucuggcccagccaggagucaucuaaacuaaguaucaauuggaagaaauaauuuuaguuguacaaaacuaggaauaggaaaauguuuaaucccgcuucauuuccuaauagaugguauugagaaaauggaaugaagaggauucacucugcuaauaacaacauauuuaaccuacaagugaaaacguuauacugcauuucaaagugaucugauuuucauaagaguaaggagaugacgccaaaacaccaagaacuucauucacuuuuuauaaaguaacuacaaguuugccagaaaauacaugucagaucuauuuguaccuggauugucaccuguuuuccuaaauggauauaggccuuaugaaauauucuucucacuggauauuuaugagcaagauacuagagaaauuccucuuuucucuucuuucagguguaauuuuaagugguucggagucuguuugauaaauauacuuaauguugcgagggcaccaaagaaacacaacuaaugaaaacguuugcuauucugccaagugguguuaaaauauuucaccuaauguuuuaaaacauaaguccauuguucaauucccaccuaugagugagaauaugcgguguuugguuuuuuguucuugcgauaguuuacugagaaugaugacuuccaauuuuauccaugucccuacaaaggacaugaacucaucauuuuuuauggcugcauaguauuccaugguguauauuugccacauuuucuuaauccagucuaucguuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaauccccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauugugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuugucuuuuguugccacugcuuuugguguuuaauugaacaaugagaucacauggacacaggaaggggaauaucacacucuggggacuguggugggguggggggaggggggagggauagcauugggagauauaccuaaugcuagaugacgaguuagugggugcagcgcaccagcauggcacauguauacauauguaacuaaccugcacaaugugcacauguacccuaaaacuuaaaguauaauaaaaaauaaauaaauaaaacauaaguccaauauaaaugcuaagugguuaguauagagaucuuguguugcuuaaaugcaaguuagguuguuauaguugucucuguaaguugguauugauaucuaguauuacguacugagagaagugccucuguaaaaccugaugugcccugguauuugcagcagaauuugggcugucuuuaaucucauuugacuuguucaucuuccuuuaaggccauccauaaagaugcacuggguauccuuuucagccuuugguuaggauuugcaucaguagucauaaacgugcucucuggacaaagacacccuuuccuuugaaguaauugcucaagcuuuucaaagcaguccuagaagucuguccucuuucucuuuuuauuuuucuuuaagaagaguuugaaauguagucccuuaaacuagcagcaagauaaauuuuucucucagcauuauugaaggccaugacaauuuuucaagcaguaagacuuuaaaagguucuuaagggaaucuguucugcuuuauggucuagccuuugggagauccuacuaucucagaaagcaaagguaaagacuuuuuguaucccuuaacuauugcaaauuuuuaucagaagaauuaacuugauauuuuucagaagauuuuuuuuucuuguucuucguuugguuuagagacuucaaugagagauuauugauaguuuuggcaucuuugaaaaguaacauauggccagaaucaucuuguuugagcugauuauuucucccuggguauuaacuaugugggcugacaaguaguugggaggggcagauuucugagaacacugcagugagaaugaguuauaugguuccaagauuuuguuucuaggcuuuccaaacagaaauguacacagauauggagggauuuugccuuuccuuucugugggauguugucacuuuggcucugcugugauccaggaugauguauacaguguaacuacagagacauaaaaagaucgauucugugagccacauguaaagccucugcucugccuccgauuauccccgcuacccucaguaauuucauugcaagugguucccaaaauguccauugaacuuaaacaguuuugaccuguuagauuuaaaucccauaucauauaucugcuauauugaaguguaacuauuucaagcucuuuauuauaaaacuuauaaaaaucaaguaguagguauuuauuuugaauguacuuuuugaugaggagaaaauguaaagaaugcucaaucuguacagcagauaauaaagggaauacaaucuuuaaagaagauuggaaacagcuuuucuuagaggaaaugacauaucucuccuuauauugauguauguggguuuauagaggccaguaauguacauuuccuauaggugaggaaaguuaaguagcgcugucuuuuuacuggaaauccagugacuguaaaacugguuaccugagaaccuaaugaucauaagucuacccuuaugcuuuuaauuucuuuuucuuuuuuucucucucucucuuuuguauuuccugaacugucuaaccugcuuccgggauuagcaaacauuuugccaaacuuugaagccaaaguccuagcauugaauaguuccuuauuuagagaucaggcccuaggaaaagaagaaauccuuuuccaguuuugaaauuacucugcauguguguguguucugaucuguggagugaaaaaugauuuaauaaaguuuggauuauuggaaacuaguauuuuguaaacaaagcauaaugauaaaaaucuuacgaguuuacaaaaaaaauaaugcuuauaucuuaacccaccuucuggaguuaaucacgaggcuuccuaaacucuuaacuuuguagucauagaaaaugcucaguauuucaacucuuuuacauuaaagaaagaaagaaaauugacagcaauccucucccuucuuccaccaugcucccaagaaaacaaaaaguuagcauugauguucuuaagugacaucauccucugggaccaccauuaucuaucuguccuuuguuuacuuugucuuauacuuagaaugccuucauuugccaucagcuuuccuucaaaccuucacuuuccacugaggaauuccaagacaauucaaguuaaaacacaaauuucaccauccaugaaaugguaacuuaagaaaaaaaaaaaaaaaaaagaacaaucacaccaaaaauauauuccuuagaucuuagugauuuuaauugcugguaaaaaaaaaaaguugccaauggaucuaauuagacaguaauuucagaaacaacauuguaugguauuuuuguggaauguacagccuucuggggaaaaggaaaaccaagaaucagggcuaaaguauugauaacuucuuauuuuauuauuuuuuugagacggagucucgcucuguugcccaggcuagagugcaguggcgugaucucggcucacugcaaccuccaccucccagguucaagcaauucuccuaccuguuagaggugcacaccaccacgccaaacuaauuuuuuguauuuuuaguagaggcaggguuucaccauguuggccaggcuggucucuaacucguaaccucaggugaucugcccaccuuggccucccaaaguacugggauuacaggcgugagccauugcgcccggccaauaacuuuuuaaaacaguauacuucuuccuaaaauuuguggauccuggcugggcgcgguggcucacgccuguaaucccagcacuuugggaggccgaggcaggcggaucacgaggucaggagaucgagaccacggugaaaccccgucucuacuaaaaauacaaaaaauuagcugggcgcaguggcgggcgccuguagucccagcuacucaggaggccaaggcaggagaauggugugaaccuggaaggcggagcuggcagugagucgagaucgcaccaccgcauuccagccugggcgacagagugagacuccgucucagaaaaaaaaaaaaaaaauuuguggauccuaacagaagcuuaaguaguucagauuggcuuacauuauuugcuuuauuucuuuaaaauuuucccaaauuucuggacuuuguaagaaacaaaauugcucuugugacaaauucuuuguggcuugggaaaugucaacuuucuaauuaagguaaguuugccucccaaagaaguguuaaaacuuggaaucaaaugaaacgaagccccuuguucugccuacccccuugccucuuuguauguuauuuuuggucucccuuuaucacuaagccuguaggcuagguccagcagcuggcugcacauagcacgccaguguggugcaaaguuccguguggcauuccuucaacuuaagucucacucaggauuaccuacagucaccaaagccuugaaggacauuguagggacauggccgugcauuauguacucugguacaugcauuggaacuguccugugaaaagcuagaccugaagugacugcuggcuccaggugaaguggggcuacaagcacagagaccagaccucccuucaggguagaagccucucaccuuuucuuguucauggaccucuguccauucaguaaaacuuauuuuccuccccugcuaccuagaaaaacaggcauguagauacauuuugcauaaaauuucaaauaacccagugaccuacuggaagaacccuugcuuuggaagccggguuaguuuucugacagcagcauuugccuuuccaaguacaguagguuuccaguggguuuccccugagcugcuggacuuccuuccucugagugggugacugcuccaaggauagucaggugucugggguuaagauacaagcgauucucuuccacagaguuccauagcuggugguagccacuuacucugugggcacauuugucucuucuggauuacacaguguuaguuaucaagcauacuauaaaaccaauccaaaucaagaaaucgggaaugcuaauagaauccugcucuccacuuggaaagacuuuuuguaucuuuaccuuuagagacuauaaaaguaaaggauccguuuagucuucaaaucauauucuucaggcuagacauggaauccaguuuauccuuguggcuuggcacgaacccauccacaaaucaagaccauuaccauuuuacuuagucaugauggguuccuuauuaaccaaccaaccaaccaaccauacguuuucuuuuuaguuugggacagacauacaggaugacuuguucuuucaaguugugaaaguauucggcaauaucugccaguuuuuggauacuccuccucuguccccccuucucuacccaccgccccucauuuucaaucacuaucuguagacuuaucuguaaggguuugguuuuuuuuuagguguuucuuauauuggguuuuuuuucgguuauuugaaugaaccacagagaaauauauccaugaaauuuauauaucagaaaaauacauaagcuuaguagagagaauacauauuuaagagaggggcugcagaauuacuguggggguagcagaagucuaguucagacugucuucauuaugauggguuucagcggcccacaaaggaugaggaaggaggaaggaggggcgaggccuuucuuugaaauguaaauugagccaaaguuccuaauuuuauaaucaucugaccauaaaacaucuaauugaggggcugauuuuuuaugaggcauuuuggaaugcagauuuuguuguauuuaacccugaguuuucaaccauuguugcuugauaaucacauaaagguuacuugacauuuuagcaggauguggcccucauaaucaaacuauaguauguaacuuggaucuaguccuaaaguaggauugcuggacaaauucccaaacuauaaauuaaauaggcaugauggaaauuaggagcaaguuguugauuauuuaauaugcaugaaauugaauugauuuguucuuuuuaucuguuuuuuccuaaaggugagacugcugcuccucgggccauuuugaccggccaugacuaugaggucacaugugcugcggugugugcggagcuaggccugguguugagugguucacaagguaaaccugugguaccuucacaaaauggaugcauuucuugcugucuucuagaaacaaauuaccaaagauuaauuugguaccuuuuuucuaaagcuucugucuguuaugauagccauuagucauauggaacuauuuaaauuauuuaaaauuaaauaaaauuaaaauguaaguuucuucguggcacuagccacauugcagguccucaguacucacauauggcuaguggccacuacauuggacagcacagauacagaucauuuccaucauuguagaaaguucuguuucacagcacugcucuaaggaguuuaagauguuuuuacaaacauauccuguuaauauucauauuccccugaagcaggaacaaggaacgucuuuguauauuuguuuauucuucugagcuauuacugggccagguuccgucuuauaucugaauggaagccccugacccugucuguuuuaaugaggcaggggccacaguggcauugagaguggaguagaaagauacuuaagcugguuugccuggagguuugugcuggaaacagcauuauauauuuaggcccaagauauuaagcgagcuuagagcacaugcaacaaaucaggaucugacuaggaauggagcuguuuccaauucguugcuuacuuaucccaucauaauagucuauccaucucucugucucugcucugagcugaagucugaacacacaacaaaguauuauaucucacaucuuuuggguuuaucugguggggaaacagaguauuuggaucagcuccucuguguccuaaaauguaauacuuauuagucuaguuaauaagguguuuuaaauauuuaaaggauuauguuuauaaauuuggucaaaacauugaaauaguaauaaugauagcaauaauucuauaaccacuggauuuuucccuuauacucaauaauuucauacguccugagccaacaggagucguaaaaugaaccuauuauauauuacaggucaucuuuucuuugcacaguaguauggaacuguaaaagugagcacgccaacugaaaccauacaaagugaucugaauaaucauugguaaauuuuacaauuguuccauggucuuuaaaaauuuuugucaggcugggcaugguggcucaugccuguaaucccaacauuuugggaggcuaaggugggaagaucauuugaggccaggaguucaagaccagucuggcaacauagugagacccccaucucuacaaaaaaauuaagaauuagcugggcauggggugcacaccuguagucccagcugcuugggaaggugagaugggaggauugcaggaggugaaggcuguaguaagccaugaucaugccacugcacuccagccugggugacacagcaaaacccugucucuaagaauaauuuugucaaaacauuaaaaacucauacucaguuauacauauaacaugaaaaaaguaguaaaacucacauguacuuaauacacuguaauuuaaaacauuugauacauugauaauuauuuuauuugugaaaaacauaucaagaguaguuugaacagugcuuacugccuucuuguuauauacauguaaggagcuagcaucuuuucuaugccuuggggagcugucauacucuuuucuaaguuggaaccagcaucuaacauuuuaucuuuugugcuuucaaugucaugaaauauucccuagaauuccuuuaaugugaggcuuuugcugguuuaaauucugggacauuuuuguuacaccuucuucccuaacuuacacugauaaguuccuucauucccuuccuggcugcauaucuacagugucucagcagggucagcaucccacaggcagcucgcucuucuauaauuccauuuauauucaauucaaauuguacuuucaguuuuaucauuuuccauuucuuuacugcaguuucaucuuuguuggccaauaccccuuuuugauuauccauuuuugugaaauguuacauggcuuuaucacugggagacaaaaaagcaacacagcugcacaguuugcugucugugugggaacugaauaacagauaaugcagugagcagucaucgacauauuuugaaaggagugaugugauuggucacugaugaugaugaugcacaucuguuauuuauauagugauuuguggacugaagagcuagccacaaaagugcauacuuuaugcaauuacuaugacaaccuaaauuugaacuauguuauuggagggcugguguuauuuaaggagugauaacugaaauucaugcaugcuggaacuguguaaagcaaacacugccuguggauauuuaaaaaauuuaucaacuaccugaguggucaagaaagagcuaaaagccuuauuuuuaaaagggcaagcuuucaauagucauuguggggaaaaggcaacgauuccauguggccaugaguaauuuagccaguagaguagcagggcgcauaccccagugacccccguuaucugacuaucucuuggaacuugcucaucacacaagcaauuuuuguuccuuauuccuucuuugccuugcaugcagcagguacucaacagaaacaaaaagcuuggcugugugugggcucccaguagcugccuguccuucucuggcaccuuggccuggugguccacccaggcguugggagugguagaugcugcuccuugcugugaaggcagcagggagguggcuucacucaguugccaaggagaaguggccgaaggguuccugugugaauuuuuuggagguugagaggaacuaccagggacccccuuucaguguaaaaaaaguagugagcaguugcgggggaagagggcuaaggcacucagaggcugauugagcuggcugucccugcauaggcccacagugccguggccguuggggcuccugcaaggugcagggagaggucuuaguguaccugcccgcagcccuuguuuguuugcaucccagccuccuugaagcugugcuagaauuugaagcuuauccuguuucucaguuccuccaguuuguauugccuguuagcauaaugaauuucauagaguaacuuccugucucuugaggaaagugaacuuggacuuacaugguuuggcuucucuccucuccugaguggaaggugagaucuggcaaacaugaagaggagauuuugcaaaauaacuuacacguaagauggaaguuuuuuaaaggcuuucuacaucuauagugugguucuauaauccuguuugaucugugcucaagauucagaucauauugucuguuuucauucaauaauuuugccuuuuauuucuccucucuucucagaaggaccaugucucauacauuccaugaauggagacuuguugaggaccuuggaggguccugaaaacugccugaaaccaaaacucauucaggcuucaagagagggucauugugucauauucuaugaaaacggccucuucuguacauucagugugaauggaaaacuccaggccacgauggaaacagaugauaacauaagagugagugcccuggggacucuucagcauucacgacuuuuaccucaacgugugucaaguggggagggagaggguucgcgaaagaaaccucuauuuuuggauugccgagggccucuuuuccauaccaacaaaaaaucuuuagguagcacucagacaaggcucacacacuucacacaccacagcagugccagcugugcugaccacgucacucagcgcagcugaggacgguccuucaauagaagagguuuucuuaggggcuucugaagccauccuggguggcuuuuaguggcacugcucauuucuuuuuuucuaagaaaaugcacugcacauuguuuucugaguaugaaagcugaaauaguacauuagaugacacuuaaaacuggauucucuuuacaucugaauagcuugguggugggagcaguagggauuaugacuauuuagguuuauuaauuucagcuaugacuucuuuauggacaacaagaccaaaaacauguuaaagaagcugggcuucaaauuaugauaugaauuaggcaggcauuuucucccacugggucuacccgaaauggcaccgccaguggaccuucugggcucuugcuucaucuccaggacaggacuccacaaguauuagacauugagaaaaagaguaagaacuauucuuuucagaggcuaguuucucaagguccuuuguuucuuaccuccaaacuccuuggugaagguuaaaguaaaauaaagcuggggugguccucauuuuccagaaucaggcuggagggcggggcaugugagcuguauacaaugaggggacccaggacauguugggggcaggaguagggucacaggggcuucuacccuggcguugggcuagcucuggauauuucacucauugcuauucugaccuaugcagcuuagaugucauaaauucucccacuuucccagaucuagucugaucacccccuucuccuaaguaaauacuggucucagggaacaaagcuccuacauauagguuacauugaggaaaugaaggacccuugcugcucugucuccugggauucauuucuugauucaguggacggcuuccuucuugucuccacuguucucugcggucucuccaucacauucugccggccuccacgaggcacgcacagagacacacucguacucgcuuuuauuuuucccuaccuucccauaaugcugcauuuaaaccaaguacacaucagaggauuuucuuuuccucuuuucuuuacaauaauaauguggauaaucugucacuuugaguugcgauuauauugucagcuacgcuaauaaaucuguaaaauaauuugagaucccuggcugacugaagcaauuucuguggcauuucaguuaguaccaggggcucugggaaguuccuugaggcagcagugggaggcuuucugcagaccauucauacacacaugcuucuccucucugcccuguagccauugcuuuuucccucuuuaauauuucccacuggauuuuaggcuuaaacaauccauugccuuuuucccagcacuccugcacuuuaucaugcuaacuugcaaguggcaacugugugauuaaagcgagcuugccuaaaaugagcaauaccugcccacagcuccagagacugauacuuucacagcucacuaccucgggaggcgaggaaggaagccacaggcugggaauccaagacaccacagggcagaaucuccagcuccuuccucaaucugagcccauauaaggaauggacaccauggaaacaaauuagucaucagcucagaccagaaauuaaguuucugugaaauaccaagaacccugcaggcaggcagccuggggaagcucugcacuucccaccuauuuuuauuuuagaugccagauugcucuguggcauuuugguuagcagcauaucacaguccaucaacuagacaguguugagaugucuuuaugaauagcugauauuuaaggaggcagccuguacagagcagcaaaguuauuuuguccuaaacaagggagaaccaccauucacccaggggaaugcauuuguuuucccuuccugaggcuguuuuagaauguggucauccccagcagauugcuguggccugcuacuaccuccuuaaaacccgugcagccacggcauuguccagagcacucaggauuucaggggaugagauuaacaugugucuggggcccucugaaaaccucuagucacaacccaaccuggaugcggaggcggccugucagaauuugagugggagaucaggugcugcuugcuaaauguuacccuggcucuugccgccagaggaauuuggccucuccugaaagaggccagcgaaaucuuuuuucaccuugggaggcaucugauucauuaaaauguuuugaaugcugaugacuguauagucccuaaagcccagguuuuacuuaauuucagauggaagcaggauuagagauucuuuacuagaacaaagaauuaaagaucagugguuuuguuuuaguauaacacuuauccaguaaaaagcuucaaguaucaaauucaaaugaacuacaaccauaagguuaauggauuuucaucagcugaauuuuauaaguguagcaaauaauuguuuguccuagucuccacugcaguucccagacaccccuagagauugccauuugugaaaugagugggggaaaaggauacuga

SEQ ID NO: 13660 - RNA, 179230 nt, Homo sapiens
uccucccgcgccggcgcucggcccccuccuccgcccccuccuccgcccccuccuccccuucuccgcgguuuggcauccccggggccgggaagccuccuccagcgcugacagccugucggcggcggagggaggccagagcgcggaugcuugccagugggccgggccugaccgcugcgugggaggcgggcugcauuauuucccgcuagggccgcgcuccagggaaggaaggggccagacacggcccucucagccccgaacggcgcgcgcugcccggcgggcgggauccgggcgcggccgaggcggcggcgcugcaccccgggccugggcccgcgcgacucccccgggggccucucccacgcuccgcgccccgccccacccuuccuuccuuccuccccucggcgcucccgggagcgcucggcagacgcccgagcuuugugggcgcccgcgggcccagcgcgagccucgggcggcccaacuuugccucucccggucggcucccgagcgggacuugugaggcguggccggguggaggaggcgcuugcgggggcguggggcuccccggcaggcgggaggcacggagcaagucgcacuggacaaugaccugggcagcucggcgcugcggacacuuuuagcugagggcgcgggcgggucggcuccuccgcggcuccucggccccaccugcgcggagagggcgggaugccagagccaggugucccggcgcguuaagggcccucgcagucagacgucccugcaccggcgcucgcacccuuagucggcccggaacgucuuuuugcggacgcccucggagcagccgcgauggccagcaccaggaguaucgagcuggagcacuuugaggaacgggacaaaaggccgcggccggggucgcggagaggggcccccagcuccuccgggggcagcagcagcucgggccccaaggggaacgggcucauccccaguccggcgcacagugcccacugcagcuucuaccgcacgcggacccugcaggcccucagcucggagaagaaggccaagaaggcgcgcuucuaccggaacggggaccgcuacuucaagggccugguguuugccaucuccagcgaccgcuuccgguccuucgaugcgcuccucauagagcucacccgcucccugucggacaacgugaaccugccccaggguguccgcacuaucuacaccaucgacggcagccggaaggucaccagccuggacgagcugcuggaagguaggaggggagggcgccgcacggcaggugcggcggagcgccggcaggugcagugggcgugagccggcgcagcggggagcccgcggggugcuuuccaagccgcacgggaauugaugcuucugucugcuucucuagagauuggcugggggugggggccgguggggugcccacauacacacugacuuuccuucccaagagguuugucucuuaaagaaggaaaaaauuuccugauggucaggccaauuuaggcacugguggcaucuccuaagauuguugaacuuauuuguauugaagugcaaacuguuugagaaaaugguucucccauggggagcuggguaauccccuacuaauaagcucuguuggacccucgguguggacccuggugcaggcuccugucauguuccaguauucgggguccuguugugacugcugucagaagcugugguugugaaaugcucuagguuggcuuuccuaguuugccuugcagcagaaguuacuugaggugaagagggaugauccuagacagcaggucucaaccuuggcuucaucuuggaucacacuggggacuucgaaaaauaugggacccugaucccccaacccccagauauccugauuaaauugguuggguuugggguguggguuaggcgucuggagucucaaaagccccccccccaggugauucuaaugugggacccugguuaacaaucaccgugcuaaaggguuuuccacauuugguuggaaaaaagguaaaucaaggucaaucucuccagccuuauccucuaauaagaguaccuaauuagaaugauagaggccauuggauucagcaguggggacuuauuaaaaauuaguaauucugcugugucaaccaugccucggucaaagagacugcuuggcuggauguugggucauccuugaauuccugcaauacguaugccucauccuuuucagguagaaaaggcauuaucagugguuaagaaccuguuuccaguucuaaauaacauccagaaagaccaggcagaacccagguaugugcugacugcguguuuacauacaguccgcucuugugcaucuuucuuaaugcaaauggcacauuccauguagucauagcaauagcuuggcagggagaggaagcugaacaucaagccagauguuuuucuuauauuaucucagcaugcuuuucuguccugaaggcauuauccccauuuuauagaugaggaaacuuaggcagcaugccuugccucacagugccugcagcauauacuuucucgucuacgauucaccucugcugagcuaauggagccacauggaggaaaacuaaaggucguugaguuugucuauuuagucagaaguuuuugcugcccugccuagaacgcgacccagccaaaauuaaauugucucuucagucuacauauguaugugcuugugacuucacccauucugucaguuguguguuuugguuuuaagggcuucuugaggagguaaggggauagcuggaggaguauaaguaaaaaaggaagauacaauguucaaagggccuuguugcuuuucuuaaucauguuaaacacuuaaaagcaauauuugccuagcuauuuuaaaacagaguaaccaguuguuugacugacccaagaucagauuugcaggaucaaggcaaugccuguuugcuuaagcacuuguuacucaacaugccauugggauacuacuguuccugguaugguuucuuaagagucaacaauguuaauauccuucucuaaagaaauuuuaacaguggauuuacuacauaaaauugacauaacguaaacaugaaucucauaggagagaugauaagauggacauuaugcauguccauuaauaggaguacuuaguauagauugcgucuuuuaccgcccaccgcaugcauguccacugggucuacuucugcaacuguaguuucaacuacaaauugacuuaacaaauuuccuucaaaucauucacugauuuuuaguggauggggauuuggaaaaaacauuaucuauggaguccaaaucauaccaaaauaugauaaauaauauaacaaauaguugcacagccaaaauuuuuuuuaugacuuugcccacuucuuugaagaaguuuuuaauacaauaaaauuacugcaaaagaagaaaacuuggacacuuuuuuugucauauggaacucucucugacaaugggucuuuguuuaauucuucaguuuucccccaaauuaguagaauacuccauagcaaugcaauuuuuuuuuuaaagaaaauauagguacaauaguucacgucuguaaucucagcacuuugggagacugagguggguggaucaccugaggucaggaguucgagaccagccugacaaacaaggugaaaccccaucucuacuuaaaaaaaaaaaaaaaaaauuagccggguguggcggcaggcgccugcagucccagcuacucaggaggcugagacaggagaauugcuugaacccaggaggcggagguugcagugagccaagaucacaccacugcacuccagccugggcgauggagcaagacucugucucaaaaaaaaaaaaaaaaagaaaagaaaaaaagaaaaagaaucacgaaugcuuacugucaaucauuccagaauguaaguaguuucaacuuuuaauuaaaauugugugcucagauuuuucauguaggagaacuaagcagcuaucugugaaguuauuugcauuaguaaaaauaagucuguaauauauucaccacauugucaaaauugacugcuuuauuucguuuugguugauuauuuuuaauaaagcucucucagguaguauuuuacaacauuauguucaacuaggcucuacuucuucgaucccaugaaacuuguaguuuaagagguauguuuuuuucugaaaugucuugagugaagaauagaaagugaugacucaaaacaguaggauaugaacauucauucagagccccaaucucauugaacucagaugacaaaagaaauuugcauggcccaaauuauuuuuucuucugcccuugaccuugagagucucuggagacuaaaagcuguucuagugugagcuggcacuccuccagcacuacacuaaaccagcaagcaccuucaauuuauugauuuauccauccuugcuggauuaaguuugaguugaugcugugcaguccuguaauccuguuuauucuuuaaaacuaguugggggaccucuuccggcaggacuguggcucuuaaucaauauuggaaaaauuaguugagcugucuuaagcugugagccugcugagcucaguaucuguaauaaccaacagagaauguccagaugacuuguucuuuagcuuucuuauuagggacugauucagaauuccuagucuuaguucuguuccgugugucuucucuccuucugagcguuuggucuucucuccuucugagcauuuugaaauauuuauaaaguuuugaugaccuaaagagauauaaccaaggacaguagaaaaagugccugaccaagucaggauuccugaguucuacugacuagauuugagaaaaauuucaccucacuucccuggccuuggcauccuuuucucuaggaugagaaguuggcagaccaccuaaguuaggucucuucugguuuaaaaauguguauguacccguuaauuaucugagggguuauuguuggagcauaugauggcuugggcugccauucccuagccagaacccaucuuccagaaaaucgaugaggcugcacauguccagauaacaaucacagaaugggguguauaucucugaugaagugcuugccaagagucaaaggcauuaagagcuaccugugucugccucucucauuccaaaauaaaaugucauuuuguuauuucuaccuuuuaucccuucauaaacaauaagcugauuguuuuuuggcauaugagagaguuuugguuauuuugauaaugauacuuucauucccucaugaaguuaacagggacauguaagaaaaauaagauuguaaagaaaucaagcccaugaaguuugagguccuccuaccaaaccuaucuaccgcaucuguuugguuaggucaguucuuugaaaguguuaaauaaaccaaaauacguuucugagaauuuuuaaguaaaaaugaauuuccauaagaaccuagauuauacuuaguuguuuuuuccugaaaaauaaauuuuauaauaauagaaacuguggaacuuauuaugguaagaaggaaauaaacucaugaguuacaagguauuugcacauaggagucgaaaaugaugcacacuaaagucaugcauggugauuggacuuggaaaguuaauauugaauuucagggcugcaaaacguucuuuaccugugaaaccccuggauucuucaaggcccacuucaaauagcaccuaugaagucucuucccacuucucugggcaguuggucucaaaugguuaguugagggcauacuauguccuagacauggucaaaugccuauggucucuuccuucaaaaaaugcacauucuccugggagagagacaguaaacauacaaacaagauggcuucagcuaaagugcuguaaaugaaguggugaugacauggggcaggauggccauauuggccggggugauguggagggcuuccuagaggaacagacauuggagccgaggccugaggucaaguuuauaacuuuccucugcuuacagcauuuuucuuuacuucuauuauaacacuuagcuuuguagucucaugauauauuggaucuguuuuugcacucaacugagagaagccugaggucagggaucuuaaauacaguaaauucauugauuaaauaacucagacaaugauuuuaccucuaagucccuuaguugucuagggaaguuuuguaugaguuaagcuuuaaugggauuccuagauauuugugaaaauauauguuuuuggaaaauuggauuacauguuagauaaacguauaauuuugggugaaauucugugcuaaccauuuuggagggaaugacucuuccauaauauccccuucuauaaaucugguugucccaucucauuuccuuaaaaacaaggaaaauaagaugugcuauaauacagcugcauaagaagcucuuucccgagguaagaggaaaauuuucauuuaaagaauaaauccuaaaagguuggggaaggaaaggggauaugugagagagcauuuaugagauuagaguaugacacagugauacucuggaaguuauaagacaagauuaauaucuaauggguuuuuaaacuauggaaaaggauauuuuuaugguccuguaauaugaaauaaaggaaaccagauucucuugggcagugaucaucuaacugcuuucuucauugcucgugaggccgagaggaguugcugcgggguguguaccgccuggcuaggucuuuuuucuguaucccuuccugcccaugcuaccacugcaucuguguuuuuaugucuucuacucguaaaguaaaccauuaccguaaggauuagagaugcuuuucuucucugcauugcuaccauuuacuagauguuuuaugagcagucauugugugagguacuuuacauauuucaucuaacccuuguaauaccuucugaaauauggcugcauugucauccccauuuuacagauggggaagcugaggcucagagaugguagagaaauugcugcauuguaccaauguaagagguagagcuggcacuugagcccuuucucccuggcuucugaaacucuguguucuuaacuacuacauucuacuacuacauucuaccaccugagaggaaauggaguccauucuguuuguggggucuuugggaggugucuugguucauuuucucuugcuauaacagaauaccacagacuagguaaguuauaaagaaaauuuauuuuauuuucuaguucuagaagcuagaaaguccaaggcacggcacuggcaucuguugagggucaucccaugguggaaggguggaaggugaaagcaaacguaggauauauagagaggaaauggggcuaaauucccuccuuuuauaacuaacccacucccacaauaacagcuuuaauccauucuugaggguggugcccucaugaucuaaucaccucuucaaggccucacuuguuaauauuguuacaauggcaauuaaauuuccaacaccugaagcuugggagauguguucaacccacagcaggaggugaauaaaucauaaaggcagagacuucauaggcuggauuagugcccaaagaggccccagagagcuuguuuugccccuucuagcaugugaggaugcagugagaagucaccaugagugaaccaagagcccucacuacacaccauaucuguuagcaccuugaucuuugauguccucaccuccagaacugugagaaauugauuucuguuuauaagucacucuguuuuuuguauuuuguuauagcgacuugaacggacuaauacagucuucuuucgccucuaaaguucagugaucuugggaaaugcuucuaggggugggaaagagaaaugauuuuggcucuaucuggcuccaugucuuucuuugaaaguuggcuggguacuugaucagauguaguuacccagauuuagauggaguucuuaaaacaccucaguaacauacaggaggaucuuuuccauagaccauccucgugaaagggaaaauuacaaacccaacagggggugggaccacaauugucuuguuuauccuuuuaucccaugaaacaaaugcuucuggcacgugguguuuuuuuaauuaauuuuacuuuugugcccuauuuaagauguuuuaauaguuggguauagguggauguagaugcuuuaaaaaaccuuuauuuauuaagauagccaguuggacaguuagccagauuuacagagguaacauaaguucauguuaaaggcaaauauuccuugccccuuuguguuucaauuuuuuaauauauuuuucuucaagaaaaaugaugcaguauauuuaugucccaagaaguuaucaauuucacuaguaucugagauugagaugucugacuugaguuuucucuuuggacagcuaucacaaccagauucuuuuuauuuuuuuuuuuuuuuuuugagacugagucucacucugucugccaggcuggagugcaguggcgcaaucucggcugacugcaagcuccgccucccggguucacgccauucuccugccucagccuaccgaguagcugggacuacaggcgcccaccaccacgcccugcuaauuuuuuguauuuuuaguagagauggguuuucaccguguuagccaggauggucucgaucuccugaccucgugaucugccugcuucagccucccaaagugcugggauuacaggcgugaaccaccgugcccggcccacaaccagauucuuucauauuuauuucucguuauguguuuaaaucccaggauuauucuaagcccgcuaauauuuucagugucuacaggaguucucugccauagcuaaggcuuaguuguguucaucuuuagcauucucauuuuaagcaauuguuuuugcuaauuuuuucaugcuuaauuuuaacacaaucuuaauuuuuuaauuuugugagucagaaauaaaaucaagagcuuaaaugaauauucuuuuauuccuuaaaacauguuauaauucaauccuaauccccgggauauuuuguccuauuugccguguuuucaacagccuaaaggagaagucauuauauuguaauuugucagaagcuuuuccuuauagacuaaaggaaugguaaaauaccgguuuggugaggucgcccuaaguacuuuucauuacacuauaacauuuacugacauuucaaacuaagugacuaaaauaaucugcaauuuugaccuacucuguuaccuuuuguuuauuuguuauaguuacuugcaaccaaaaugcaaaauguucacaauagauguuuuaaaauauuuucauugaucucuuccuucacuauauguuuuuaaaacuucagauuacuuuguuaacuuuugaaauagcaaugugaggaggccaaggagguuugcugaaaaucacugagaugagacagauuaauagaagaaaaggcacgcaaauuuauuuaacaugcauacacaggagccauccgaauuaagacccaaagauacaggggaaguuguccauuuuuaugccuaaauucaacaaaguauggacagcccuguagaaauaugauuggacaaaagggcaugauuuaauguuaauagacugaguuuggacacccagcaaggccugucugucuagauucuucuuggccucugugagcaacauuccuuucuucuggguguggggcaggacccucucuggaaugggggucuugugaccuacagucaaaccagguaggucaaaucauuucuuuauagccaguuuuuacauacaaagugaaggggaaauuagaguaauauuuuuagauuuuauggcuggcuuugggggaaaagaguuuggguuucuaugaccuuccuuggagaagagggauucuaguuuuuauggcuagcuuuggaggugaaugggacuagcagccaggagggcggcagaagaucagagaaaaacguuugccucugaggaugcuacugggccuucauuuugggguauuguuuucugagccccaacagaugcaguuauuucucaaaggcagucauugagagucucuccccugauguccuugcucaucaucuuggucucuuuacuuaauaguauuuugccuuaucugcugaagaaucaagaaaaaaggcguucuagaaacuuauuacugguuauauuguuguucauuaagccugugugggagaacuugagaaauaguacaguguaaacuugucucuuauuaguuuagugaucaaagccaguuucuggaaguuucuaccuaaauuuuacaauguauuuaaacauuuagcagaguccuagcaugcaguggcugcuugauaaaugguggugguccucagcuuuuuuuuuuucguauauauaucuuuuuuuuucugcuuauauaugacagccuucagauuuuuuucuuuuuucuuuuuaaauucuuuuuacauuuuauaacuagagacagagucuuuguugcccaggcuggccuccuggccucuagcaguccucucgccucagucuccgguuagcugggauuacaggugaaagccauuacacccuucagauguuuugagaugauggucaugcuuuccucuacuacugauugagugucccucaucugaaaauccaaaaugcuugaaaaucugaaacuuuuugaguacuaaugugauaccacaaauggaaaauuccauacuuaaccucaugugacagguugcagucaaaaugcaggugcacaaccuguaguuuauucagccuccccaaggggaaaaaaagaucauuccagccccuuucagcucugauaaauauuuucugugcaugcccaguucccccacgaaagcacacucacaaggaguaauaaaauggcacaugcguaggccggcugcaccaauggcagguucuccacaaugcucuacgugggguuaagaccuauguacauuacucacuguuuugcuuuguugcuuauucuccguucugugguguaaagauacuguugaaaacaucaauaauacuugcaugauacucauaggguaaugcagauauuccaaaaucugaaaucugaaaccuuucugguccaagcauuuuggauaaggaauacccaaccuguauuuccccuucucucucuuccucuaaacaucaucaccucuuuuuuggauaaacaucugguuucugaauucuuuaucacuugcacugaaacuuuugaguuaccaucauuaucaaucacuugcuuaaaacugagggcuaagcuuuccucuuacucacagcaagauuaacauaaaggcacaguggagaaaggaaugagagauuaaggaggagaguguucagcaaagaucuucagaagcugaggaaacuuuugaggaaaguuuugccucuauuuaaaugcaccaguugaaggacugacccuauauguacuaugcccuguuuauuuacaaauauuagguggccacguuucaaugugaagguuucucugucucaguauccuuaagguugcauuguuucucaaacuuuaacaaugguagccauuuaagauuaaaaacaauauaaaaauccagcauccaaauugcagaagccaaguauugccuuaauuacuucaauuacauuaguuacauugucacuuaaauguuuguaaauauaaaauuagguaugcuuauguauauagguuuuacauagugauacaacccaaacacacugacaguguaaauaccaacaaaagugcauuaccaguaaaaaugcaaaauagcaauauaaagcuagagauacucugcucaaacuaaauugguguucccagugugaccguggcacugagugcugaguuagguaugcuguaugucagaaugccguguaaugagucaguuuugcacagcuaaugaguauuccuguagagcaaaauuuuguccucucgccuuaacuugcugugaacaugucuuuuauacguaugaaguccacuucccuuuuuccuuguugauuccuggcauaguuagaguaguugaagccaaaagacuguuaacuuagaaguaguuguucagauguuccagaauaggauuacauaaacauuuaaaguuuuaucaucaaaauaaacgcccuaugggcugggcacgguggcucaugccuguaaucccagcacuuugggaggccgaggcaggcggaucaccugagguugggaguuugagaccagccugaccaacauggagaaaccccgucucuacuaaaaauacaaaaauuagcugagcgugguggcgcacgacuguaaucccagcuacucgggaggcugaggcaggagaaucucuugaaccugggaggcagagguuguggugauccaagaucgcgccauuacacuccacuccagccugggcaacaagaucaaaacuccaucucaaaauaaugauaaaaacaaaacaaaacaaaacaaaaaaacgcacaaugaaaauucccauagugagcuccuguagauuuugggauauucuuggccccauguaugaggagcaaaaaaaccagaucacagaucugaucugcugguuccauccuacccaggagauuagauacgauuucuuccucaguggguaagcuacaaagcuuuuugguuacuggguggguuuucguuuuuacauuuagcuaauuuauuuggccuuaaguuaaacuccucccagauuucaaugcuaaaacauggauuuguggacauaccuauuucuucauagauauucguagggucaaagcagauuuuguacccccuucucgguagaagguaucacagaccauacaacuggaugugacuuuaggagaugauuugguucagucacuugccugcagguguauugaaaaaguaauggucuuugaggugaucuuauuuuguguccccagccccgcucugcagaaauagguguuguauucauugagcaaauauguaaguaaugguucagagacaaggcaaaugaguauggagugggaacagcaucugggccagagcagugcacuuuguguuagucugccaauuccuuuaaguuuacauucugugcgguuuggccaggaaacucaauuaaguuguuugccaugacggaauaauaaaucagucuuacuuuuucuuacucuguauuuuuucuuagcuagcuggaugugggaacucaucugugauguauuuaaaauggaccuuaaaauuauaauccacccggucucacacaaacgcugcgcuugaugaaggguaucgaaucaucuuguagaggcaaauaugcucgaauaucuuuuccuugguuacauucuuuuggaagcaauguuuuucuuaauuuccgaaguuaggaaaaauucuagguuccuaagauuuuacugauguuagaccugaagugucuuuccuuuucuuuccuuuuugucuuccuuuuucuguguuaccauauuuaaguauguguguguguauccuuuucucuaaguuugaagaguccuugcacuuuagauuuguaaauaaguuuuccuuuuuaucauuaaguucagugcuugcuucuacuccuagaguuaggcguagucucaguguccaaauuuuauacaacucaauaucugccacaaaugucaagacaguuuguaauuacaaacuaguuaguuguguuaggcaguuacuggacauacuauaacagagguguaugagagacuuuauaguaacugauagaaaaguagccuaaaacugcuauuguuaaaauuuccaccuacauaagauuccauguaguucuuuguccuaaaaggaacauuuauguguguguguguguguguguguguguguguguguguguauuuguguuaggaacacuuaacaugagaucugcccuuucaaauuuaagugcaacguaugguaguauuaacuaauaggcacaguguuguacagccgaucuccagaacuuucucaucuucauaacuggaacuucguacucauugagcagcagccucccauuuucucuuccccucacccccuggcaaacacuauucuagucucuguuuuuaugaauuugacuuuuuacauaaccuauguaagugaagccaugcuacauuuguucuucuguggcuuauuucauuuaacauaaugucccccagguuuguccauguuguugcauauggcagaauuugcuucauuuuuaaagacugaauaauaucucauuguauguauauaccacauuuuccuuaucaguucauccaucacugggcauucagguuguuuucauaucuuagcuauugugaauuaugguguaaugagcaucagagugccaguaucuuuuugggaugcuuauaucaauucuucuggauauauaccccaaaguacaauugcuagaucauaugaaaguuuuauuuuuaauuuuuugaggaacuuucacacuguuuccauagcagccauaaccuuuuacauucccaccaacaguguacuagaguuccaguaucucuacaucuucucuaauaccuuuuuuaaaaaaacccauucauccuaacaggagugaggugacaucuauugugguuuugaugugcauuuccaugauaauuauugauguugagcaucuuuucauauacuuggccauuuguaugucuuuuuugaaaugucuauucagauccuuucucuuuuuaaaaaucucuguuuugggguuuuuguccuauuucuuauacuuuuugaauauuaaaggauaaagaucacacaaucuuaauagaugcagaaugcagaaaaagcguuugauaaaauucaacauguuuucaugaugaaaacacucaauaaacuaaguauagaaggaauuuaccucaaaauaauaaagaccauauaugaaaagcccacagccaaucucauaguuaacaguagaaaagcuuuucucuaagaucaagaacaaggcaaggaugcccacucuugccacuucauucaaccuaguacuggaagucuuagcaagaacaacuuggcaagaaaaagaaauaaaagguaccuaaaucagaaaggaagaagcacaauuaucuguuugcagaagacaugaucuuauauguagaaaacccugaggaccacacaaaaauuguuaaacuaauacauucaguaaaccuuuaggauacaaaaucaucauacacaaaucaguuguguuuguauacacuaauaacaaacuaauaaggaaauuaagaaaauuucauguaugauagcauuacaaaauuaaauacucaggaaaauuaaggaggugaaagcucuuacacuggaaacuauaaaacauugaaggaaguuaaagaauacacaaauacauggauagacauccuguguucaugaauuggaagauuuaauauuguuaaaauucccacauuucccaaagugauuuacagauucaaugcaauuaugaaaaucccaaugacauauuuauuuauuuauugagacggagucuugcccuguugccccagguuggagugcaguggugccaucuuggcuuacugcaaccuccaccuccuguguuuaagcuauucucgugccucagucucacgaguagcuggaauuacaggcuugugccaccauaccuggcuaauuuuuguauuuuuaguagagacagaguuuugccauguuggccaggcuagucucgaaaucuuggccacaagcaauccacccaccuugggcucccaaagugcugggauuacaggcauaaaccacgcccagccucaauggcauuuuuuacagaaauagaaaaacaaccuaagauucaugcagaaccacaaaauauccaaauagccaaaucaaucuugagaaaaaagaacaaaacuaaaggcauuacauuuccugauuccaaaauauauuacaaagacacaguaauuaaaacauuaugauacuaucauaaaaacagacacauggaacaauguaacagaaccaagagcuuagaaauaaacucaaauauguauggucagcuguaucuucaacaggguugccaagaauacacaauggggaaaggacagauucuucaacaaaugguguugggaaaacuggauauccacaugcauaagaaugaaacugaaaccuggaaccuuauacauaaaaaccaacucaaaauaauuuaaaaauuuaaauauaagaucugaaacuccuagaaggaaaacauaagggaaaaguuucaugacauuagucuuggcaaugauuucucaaguaucacaccaaaaguaccagcaacaaauguaaaaauagacaagugggacuacaucaaacuaaaaagcuucuacacagcaaaagaaacaaaucaacagagugaaaaggcaaccuacagaaugagagaaaauguuugcagauaacaugucugacaagggguuaauaucuaacaguggagauuuuaaauguagagagauuacugugcuucaacuguuuaaaaaagaguauguaaauacauauuccauugauuaaaaggcauaucacauucauuagacuacaaagugcgcuuggacucuugguguuuuaauggucugaaauggaaaagauacugguagguacuuggugucuucaucuccugcuagugcccguagaugccuucaguugacuuuugauggacugacaugaccuacgagugucucagaccaugcaugaggcccuucaggagccugacccugagccucccaaagucauucuaaguaaacuguaacacuaugugcuuauuuugccuggaugcaaugcaaaugcaaaccaugaaauguguaagucuguuuuggaaauacgcauuuucuucauuacuuugacaaacauguuuuaagugccuguuguauuccagguccuguacuagguguugguaauaugaagaagguacagucaguuuuuugagggagcuucuagucuagacaguggcuuguaaccagggacuguuuucagagucauuugugaaaucaaaacaccuuacccacauguucaguucacucucacuuuccagugauuggcuuaguugaacuggggugaggcuugggugucuguacuuaugcaacaaaaucaccugauuuuuaaagaaauucuccacuaagaaccacuagcagaaacaaauaaauuguaauuaugagaaauuaauauauuguaagcucaguacaaaaagagugaggagugacauaauuuuuauuuuucaacuauaauauaccuauagaaaguucauaaaacacacgcagccagaauuaugaagugaaccucuuugugacuacuagucaugucaagaaauagaauauugccagcaucugagaagcucucccugugucccuucccauuuacaagucuucucucucccauggcaacaacagccuggcucuugcuuuucuucaugauuuuaccgccuaugaaggcaucccuaaucgauauaguuuacuuuuuccauuucaaacucuguaugaauuaaaucauagcacacauauucuuuugucaucuuuugcucaccauuguuuauaaaacucauccaaguuguugcauauagcucucauuuguucauuuucauuaguauguaguaguucauuagugaccucaccacaaucuguguacccuuucucuuguuggacaugugggccgacucugaucuuuggcuguugagcaaugcuccuaugaacauguguguguauauagagugucuaugugaaugaguuucuccaggcuguuuuccuagaguguauuucugggucauuggauguguguuguuaacuuagcacuagauaaugccaaccuaagugauugaaccaaucaguuuuuccuaagugauuuaaccaauuuaaaagcuuuucaguguaugaagguuccuauugcuuuacuaaacucuuugccagaggugcuuaaucuugaagggucaguggaagagagacaaggagagaggaggaagguuauuuccggcguauaagaaggaaugagaauaaagaggguaugagaaguuugaaaggaaauugcaagcaugcugauaugacacuaauguaggaaccugcagggaaguggugggaaaugaggcuggaagugugugaugugcugaagaguuuggccuuuguucuaagggcaguagagagacaagaaaaucaaauauacauuuuuuaaaaacuugugacagcuguguggagggugaggcccagacauggggcucuuuacuacucuaauccgggaagaaacgagagaaggcaggguagaaggaguugguuuccagagggguuuagaccaaagucaaccguucugccaauuuuguugaaugugggggaagggcagugaagaaggaagcuugguuuuugcuuagaugacugaacagugguuauuccguucaauacuuuggggacuuuaggaagaggagagugugagaucaggguggcaguaauggagagugaaauucguuuuagauauguagcaugugagauauucauagauaucuagagagggauauucuguuaguggguugaacucgagaaagaucuaggccagaaaugucaucgauguuugauuccucagaguguagauggugguugaagccauggauaaagaugcagcugcccagagaaagucuaaggaggaugagggaugccuggguggguguggaaagaggauccugaaaagcagacugagaaggagcaaccuaagaaaugugagguaaagguaagggagaucauagaugcuagggaaaaaaggauuugcaugaagaggauuaggacugguguccagugcccucagaagacacugaagacacugagugaaauuagacagaaaaugugcuuugcauuuggcaguuagguaagaaguacuugggaacuggggcgagccacauuucagcuagcagagcccagggagcacaagugaugcuccaguggcuuaaaagcaaagagugggcgaugaaguggaaaaacagaugaggacuggcagugaauggaagccaaaagcacauuagguagaguagagugaaugggguggggcugggcgguucauguguuuaaggugggacacacuuguguauaauccuauaaagagggcuggagaggagagaaagaauggcucugaaaccucagcaugggaggagagaaggacccacguccuguuagagggauuuaacuuugaauaggaggagagcacucugucacugaaaggaaaaggacgugcgaaaaaugggcacagauggaaauaaauguguaagaaugaagguuugcagagagugagaaauuggaaauuucuagccuuuuuuuuuuuuuuuuugagacagagucccgcccacucugucacccaggcuggagugcugugguacugcaaccuccgccuucuggguucaagcgauucuaguguuucagccuccggguagcugggauuacaggcaugcaccaccacuuguggcuaauuuuuguauuuuuuaguagagacaggguuuuaccauguuggugaggcuggccuggaacuccuggccugaaaugaucugcccaccuuggccucccaaaaugcugggauuacaggcaugagcuaccgugccuggcuggaauuaccuagcuuuuaaugaccucuuucuucuugaauaagaggcaguucauuugguugaguaaggaugaaaguuaacggccuucuaaacauauacccaaccaaguuguauuacauaauuguaaacacugagucaaccugcuauauaugcaguaaugcaaagugucuuugaauggacaucaaagguaaaaagccauagcugugccucuggaaagagucuuauaggauauugaaggaaugcuuucuguuccauuaccaugccugaaaacaguuaaguuuuauaaccaccuuaugcuucuguuuuuccucuuucuauacagaaaccaaaacccucuuuguauauaguacucauaugaucgggauuugcaaaaugauuuccccuaaauuuuuuacaguuuuauggccaaagaacuugaaagagagagaaggcagggaaaggagaaugaauauggauauauguaucuaaauucccuuuagccaaagaccacugggcacacacauguaguugaacaaguuggguuuauuacuuguuccaaugaagaagaacacaccuuauaagauaccauguggugucuuaguaagaggguguuagaaccuaucauagcauuugggcucuggcugauuaauauuaggaaggaucuaaggaaacgggggcucacucugucuugggugcugucagaaggcaggacaauccuaugauuggauaccucuauaaaucuuaguuauagggagggcagacuagauugaggaaaaaacuacggugguaaagaaauggcagucacucacuuagugcaagagggggauguuugguauuguggauugcacagugaccuuguuuuugugucacuuuaucauaaagucuuagagugacuucguaugauauagucugugagauuaugucuaacagaagaacaaaauggcuugacucugagugacagaccagcuuguaauaacauugaagucuagcuaugagucagcccaguucugggacugcuuuaucuacuuaugaaaaaaauacauaugcgugguccuaguugaacucuaauuuuuauuuuguuaauuuuuuauuucaauagcuuuugggguacgagugguuuaugguuacaugggugaauugucuaguggugaagucugagauuuuagugcaccugucacuuuguuuuggugagggcaguuuuaacauacguuggcaagaguuuaacaaagucucucauacugugggguuuuuucuuuuucuuuuuuuuuuuuuuuuggcagagucucauucuugucacccaggcuggagugcaguggcacggucuuggcuaacugcaaucucugccuccuggguucaggugauuuuccugccucagccuacugaguagcugggauuacaggcgcccgccaccacacccggcuaauuuuuauauuuuuagcagagacggaguuucaccguguuggccaggcugucucaaacuccugaccucaggugagccaccucccucggcuccccaaagugcugggauuacaggcaugagccaccgugccuggccucucacacuguuauuuuuauauugguacauuaagauuuaauacuguaggaugcaggauguacuuuuucagcuauguccuugugagaauggaagaaaugggagaccuacaaguuggcaagggagucacgaaucuuaaacaagaaucccuacaguaccaagaaucuguguagggggaggcuaaucgcuucuaaucaaucuugcaggugcauaguaucuaaccaagaaugauuauugauuucuuuuuaguagagacauggucucccuguguugcccaggcugagcuugaacuccugggcacaagggauccucccucuucggccucccaaagggcugggauuacaggcaugggccguugcacucaaccugauggauuaacaucgagaguuguaacuaacugcccagggaaccaacaucuuaaguucuuuugucagcauauucucuccuuguaggcaaaucuauauaagagacaaaauuacaaucugcagauuguuugauuuggauggggacauuauaagacaagcuagcuuggguaccuugauggcuguugucgucaagguauaugacaucuauacuuuagggguuuguguggccaguacacagaaacacuaaaaccaugugcugaaccuaugugcuguaauguugaaugccaagauuacuaaaguggguuucauaccgugucagcaccuaacaugagagcuugugcauaguaggcacucaguguacauuguaaugaguugucuaggcuuaaagaaaacagggccaugggugcagagaagagggugaggcuauugaacuguuauuugugucugccauggauguagagagcccuaucuuguaggcauuuguuaaccuuguaggcauuugccagccugccucaaaacuuuaauacaaguuuaugauggaacuagucuacaaguuugguuuguuugcuuuauggggacaggaucuugcucuguugcccagacugaagugcaguggugagauuauaucucucuguagccuugaacuccugagcucaagugauccuccugucucagccuccugagaagcugggacuacagaugugugccaccauguccugcuaauuuuuguauuuuuaguagagacaggaucuugcuauguugcccagaccugucuugaacuccuggccucaagcauuccucuugccuuggccuuccaaagugcugagauuacaggcaugaggcaccaugcccagccuacaaauuuuuaauggaaacauuaugaaaggaagaagggagaaugggaaggaauuaaaauuuaucuguaauugcacaaaagcaaauuaaggagcuuccuuuaccuacuucauucuaacauucugaacuuguguaaggaaacaaaaugcagagaaauuuaggaagcaucucuccuuguggauaugucaacuguguagaaacagguugaccaaggaaaucugauauaugaaaucugcucuuguuuuguuucuuuuuucauuguuacucuuuauguugggacaggcuuucccccagcugacuuacuacuuaucccugcccuuuuuaaaaaaaauuaccuucuuuugcuaagauucuuuuuucucuuccaucuuauauuuugaaucgaaaauagaauuaaaguuuuaugauagauaaaaauaguaagagcuuuuugaugugagaguuacuuucucuauaaaguuaaagcaaaauucuguuuugcccauuaaugcauaugugugguuauaguuauauuuuauuaaauugauaacuguuuuugaaauuauaugacauuuucccagaugaucauacugugaaaaaugauuuagauaagccuacagagaugaaaaaucucuaaacgguggugguugggcuagauuucacuuuacugguguagaaaugguguuaaagccugugauugguuccccaguuaucuugggcagugcccuaauuauacccuuaaauagaagacauugcuucucuuuuuaagccauucuuggggccaggcaugguggcucaugccuuauaaucccagcacuuugggaggucaaggugggugacucgcuugaacacaggaguucaagaccagccugggcaacauaauaaaaacgcugucucuacuaaaaacacaaaaauuuagccaggcauaguggcaugugcuuguaaucccagcuacuuggaaggcugaggugggagaaucacuugaguccaggagguugaggcugcagugagccaugauugcgccacugcaguucagccugggcaacagagacccugucucaaaauaaauaaauuaauuaaauaaaaauaaaaucuucuuguaugccuuaucugucacugaauuauucaugugccuucggagacuguacaauucuccauuaaucaggauuucaagaacauuaugauaauaguuaaauauaauauggauauuaauagguuuuucucgggaauucucuuucacuauuuggguuacuucuguuuuaaguauuuauaauauuuaagguucauguuaauauuguuaacgaugaguguuauacugaauaugugaaaaaauaauggauucuuuuuagaaaaaccuuaguauaacccucuuaucuuguaugucaaaaagucaagaguauaaaaaccuugggugauucugacuuuccuaaaagaaaaauugugguaucucaacauauaauuuuuggaaauuuuggaacuuaaaauaucaguaaacauugaauuaauaagccacuuggcaaauaauauagcucuuauguuguacuuaauaaaaauuaagcagaagguuucaugaguaaugaacacaucauuuuaacuacuucagguccucuccuauuuaaguagauacagaaaagcguauauuuaaacaauaguuauuuuaaauuuacauucuguaagaagaaaaguagcugagguauauuucuuuuagcugccagaacucuuccauaauguuuguggugcuucauuaauuuaauaagugaccuuguaccugaguauaauugagucagcuaugugaagauguugugauuauucuuugauuagggcugaaaucuauaauuggaagaaauauauuuguauuucuuuauagcaauauguugugauauaauuauuucuaccagaaugagauuucuaaaacuaauuaguaaauaggagguuuggggaaucaggaaguacuuuagaauucaacugguucauccacuucaguuuauugcuaaugauacugaggaccaaaauguggagaaaugaauuauccaagguggcacauuuggucaacauauuugguccagugcuucucacccuguaauccuuguuauucucucaaaaccaaucuagacuauuuaaaagaaaggaaggugggagaaugccaaaggaaaagggugaacauccccuuuuagugaacccacuaagguuaaggguucacuuaauggguuuccagcaucuguucuuuagaccaaaugcuucuaugauagagauaaucaugcuaauaaaaucaaauuuugcuuuuuaggugagaguuacgugugugcauccaaugaaccauuucguaaagucgauuacaccaaaaauauuaauccaaacuggucugugaacaucaagggugggacaucccgagcgcuggcugcugccuccucugugaaaagugaaguaaaagaaaguaaagauuucaucaaacccaaguuagugacugugauucgaaguggagugaagccuagaaaagccgugcggauccuucugaauaaaaagacugcucauuccuuugaacaagucuuaacagauaucaccgaagccauuaaacuagacucaggagucgucaagaggcucugcacccuggauggaaagcagguaagaugcuucuagcucccagcucuccaucugacuuuuaaacucccugugccaugguggcuacauagucaacaauagaaauuuaguagugugcuagaaauccuucugggagucauacuugagauuguguguguguguguauguguguguguguguauguauguaaaauuaaccauuuuugugaaaaauguaagcgacuuaaguaccucaaaagugauuauagagaagucuaucauauacuucuuuugguuauuggaaggaaaauguaaauuucugagggaaaaguauaaguugaggagacauccuacguuaaauggcaugucaucuauuuaugaauaacuguugauuuguaaagucauuauggacuuggguaucacaggagucaaaauuaaaaguauuuaacauucuuagaaaaaccuuuucuuccccacuuacauauaauagggaaaauguauuucaaaagaaaguacuuuuauaggaaugucuguaaaaguuucauagggagcaauggagguaauuagugagcauuuuugaaaaaugaaaaauugcacaggaaaaagcaauuaaaauuauggcaacaauguaucagggaaccuaagggacaaaaaaaguuggcauauugcaaaaacacaugaauagccguuagguaaguguugaauuuugcuacaaucagauuaucauugcuaaaaagaagcuuggcuucugaaguguauuuucccccaaauuccauaaaguuaaauuguuuauauuuacauuguauuaaaauuauaguuuccaaaauuaaauuuguuucuuuguuccauuuugccucuucccuguaacauacuuaauuuauuuugaaguguucugcucuugaagugcugagaaugaauaauauaaaacauugagcagugucuuugggaaaaacacaaucaaauuagucuccaauuuucuaagaccagaucuaguuaguacagugcuugcugaaacauuagcaauuuuuuaaaaauacguucuaaagauuccaguagauuaugguaaaauuagaauaacauuucuaauuaauuaauaagguauauaguaccucauagccgccugcccccaaauaugugugaaugaugauagacacuucauauaauuuaguuaauagcacaguacaacacaaaacaccuuaagauuuacucugcaaguaaggaaaaauaaauuaggcuacaggaaaaagguauuugacaaaucaaauaguugauucuugaugggcacagggaagacacauauagagacaaaaauuuaagauaccuaaccaaagaaaaaaaucuaaacucaccaauuuaggggaaaaaggcauauaaacaguaaauacagaugugauuugaaaaauuagagcucaaguuuggaaauccccaaaugaaugacauucagggaaaauauaggugaaauaaaagaaguuguggucaggugugguggugcacuccuauaguuccagcuacuugggaggcugaagugggaggauccuuugaacccaggaguuucgggcugcagugagcuaugauugugccacugcacuccaaccugggugcuggugacaaaaaagaccacaucuccuaaaaaaaaaaaaaaaaaaaaaaaaaaaaaucgagcaucuaauucaaauaucuaauugaaauaguaaccauugaaauuuaaauaguuaucaaaaaaauuauccuuaaaaagguuccagacuauagauguaaaaauguuaacuaaagcacaugcaacuaaaaaucaacauuucaaaacaauacagugugaugaauaggacuuaugcugguauuuaaaggauggcuuacuauugagaaacuucuuuauucaugagaucuauaggauaaagcacaauagcacauauucauaaucccaaacagauguugcaaaggccuuugauaaaauacucuauauucaguuaaauauuuaguaauaaaaaugggugauuuuuuaaaauuacacuaaaaaaaaaauuucuaucugaaacaacaagccaauguauuacaaaguaaauaaacacuggaaguauuucuaugacagguccaagauaaggaugccugaugauggcgccaguauucaacauucuucuauacauucuuucugauuuuuauuuauauuuuacuagaauuucaguaagaaucuaaaugagacuuuuuaggagggguagauggggaaccuaacaaaaugauuuuugaauuuaaucuggaaaaauaggaaaauuuuggaaauaauaauuaaugggcuuucaugcuaccagauacuaaaucaucauucucauaccacaccaaaaauaaauuccagguguguuagaaauauagaugucaaaaugaaacaaaaggacuaaaaguaugucaauaguuauguugaaaugggaacagauuuucuaagcauaacguaaugggaaaaucacaaaguguaagguugaauggacaacauaaaaaugaaagauuucuggaugccaagcaaggguuuauaugcuuuaauauugaguuuaguaauuuaauaugaaaaagacaaaugcuacaaugaaaaagaugaauaaaagucuaaacaauuugaaaagacagaauuagugaacauuaaaaaauguuguuucacaaaaaggugaauuaaacaagugagauguuuuaauauuuaaaacugacaagcucuuaaagaaaauguucaguguuuuugaauaugcagugaauugguauucucaaauggugauggaaguguaaaauucauaagcuuuaugaaaagcauuuuguuaauauguauaacuauacagauguucuuacuauuugaacuaguauauuaacuuuugcaauuuauccuaaaugaccugacaugcaaacauaauuacacauaaaaauuucaucccagcauaaaagcaaaaaauugaaaguagaaaauaguuguuauauuaccauggaauucauauguacuggccauugaaaauuauguuuggaguaauauuuaaagacaugagaaaauguuaaauggaaaaagcaagaaacaaauuccauguaauauguuuucaauucuuuguacaguuaaagaaaaguagcagcagaaguauuuuuuuaaagcuaauucagaaggaaacaagauuauacuugccaucagaaauugaauauuugcuguucugauauccacuacuacuuccucauaucugcucaaaaacaaaaacucaagcacugaaaaagaaaagacugaucucagauuuuagaaauucauacacauuaugaguuaauuauuuuuucaugugccaaaaaaagaucuuuuaagacuuucaaguaaaauauuucuuuggaaaaauuagauuuaauuuuugauaaacacaacauuggauauugcauuuucagcgaaccggguauucuuaaaagcuauaguuuucuuagugcugaguccauguuguacuauauaggugaacucgcuaaucuucaaaacuucaagucuguuuuugguugauauaaguauaaagauacuaugacaucugcaaaccuuuaaaugagcagugcucauuuugaucuuuuuuuaauaaaaaaauuucuauggguaugcaugcuugaucuuggccaaaaggccaagaagcaauucuacauguauguaaaacuaucagcauucugagaauucucaaggaaaggacaccuuuccuuagaugaagagaaaggaaugagaaaggaacuaagauccguugauaaguugucuguguacaaaauuguaaacugucugccuaaauuuuauuuuuuccugguugcuuccuacccagauugguuguuuucauuuaaaauuuuccugaucgucaacacaaggauagaaauuaaauaacuuuuaggcaauucaccaugaacagucacugacugcaucaugacaccugugugagaguuuuaaggggcugguuauccuuugaguuugaacauguuucugauugaagacaugauggugugucaugugccaguagcauuuauggggcuaaaacagugucccuugaaucuuuucuuccuucaaaaugggugaacacaucuugccacuagcaaugacuccauuuacaaggucugacuucguuauuaaaacuaacuaaauuuuaugucuguuuauaaaaucacuucaaauaaaaucauauuuaggacuuugucuguauuaauucuuggguuuucuuuaguguagagcagugauucucaaccagggacaguuuugucccuagggcauguauggcacugucugaagucauuuuuugauuguugaagcugggguuggggauuccacuggcauccgguggguagaagcugggcauggugcccaucauccuacaacgugcaggacagccacgacaucauccuuucuuguccaagauauuaacagugcugagauucagaaauccugguguagaguaagugagcugauucaaaagaaagugcugcuuguuugaauaaauauuaacuguguuauuaggccauaugcuaagcuuuauuucagaauuucuagaaguccugauagucucucugucuauuucuuaucuauuuaugugauugaugcaagauuguuagaaugucaugguuuguaggguuuuuuugguuauuguuuuuuuuuuuuuuuuuggagacagaaucucacucugucacccaggcuaaagggcaauggcgaucucggcuuacugcagcuuugaccuccugggcucaagugauccucccacuucaaguuccugaguagcugggacuacaggcacaugacaccaugccuggcuaauuuuuguauuuuuguagaaauuggguuucccuguguuucccaggcuggucuugaacuccugggcucaagcgauccacuuaccuuggccucugaaaguacugggacaaaggcaugagaugcugcacacccagccaguuuguugucuuuauugucuuggauuuaaaucuauuugucuucauugugugaggcugagauaugacugaguaguacagcuuugcaggggauuagauaaagacaucccaaaugguuuuacugagaauugaaagugaaguguaagguuagcugggcauggugauguuugccuguagucccaguuacuagggaggcugaggcaggaggauuacuugagcucaggaguucgaggcugcagugagcuaugaucucacuacugcaugccagccuuggggacagagugagauccugacucaaaaaaugaaugaaugugaaguguaaggaaucauuuaaucucaugaguuuucaaguacuguacuuaaaagugauaucaugguuacugauuuucuaaaaacaaaauauauaaccuauguuuauagaugugaugaccagaaaacaugaucuguaaagaggagucaugguuauucuccacuuaaaguaauuuuauuuuaacuuguaauuaauuuugauuaaaugcuucacuuaaauguuuuuaaaaauaaaaccuucuuggccgggcgcaguggcucacgccuguaaucccagcacuuugggaugcugaggcggguggaucaugaggucaggagauugagaccauccuggcucaaucuccugaccuuuaguuuucacugaaacaggguuuuagugaaaccccgucucuacuaaaaauacaaaaaaaauuagcugggcgugguggugggcgccuguagucccagcuacacgggaggcugaggcaggagaauggcaugaacccaggaggcggagcuugcagugagccgagaucucgccacugcacuucagccugggcgacagagcaagacucugucucaaaaaaauuaaaaaaauaaauaaaauaaaaauaaauaaaaccuucuugcacuuuuaaguuaaagggauuguauaggaaaacaaauuuacuuuuuaaauuuuuugaaagagugacauucucauaauaaaauacagcaaggagaauuuuuuuuaaugccuguauucuguugagagaugaaaagguccaaauauagcuuuuguccacauguguaaaaaaaaauucuagcuuuuagcuuucccagaaacagcagaguuucaacauaaaagaaacauauuuuguggaauuuuggaacaaguugauucuugucaugggcagaggcaaaacagacccagaaauugcuugcaguugaugcuuuagggguaaaacacuuccagacuuugggaccacugccagccuuaggaugcucacaugcagcggguccucuuuggggaacauggcaacuccuuggagugccugcucuuaucagucauauuagaguuuaugaagguucccaucuucacuuuuuaaaaaguuuagcuauuucauagcuaccauaacauaaauaauauuuauuuuguacuuuaccuuucuggaaucacauuuucuagugaagguucauuuguuuugaaucaccuaaccauauuuagauaaagcaaucucuuuucaaaaauugcuacauaaaagucaaauuguugauaaguauucauaaacauuuucuacaauuuauuuaaccuuguuuuaauuuuuccuuaaaguagguaaggacagaauuugguuuuaauucucacccuguucccaaugcaugcauuucccuuuuuuuuuuuuuucucugagacggagucuggcucugucgccaggcuggagugcaguggcaugaucucggcucacugcagucucugccucccugguucaagcgauucuccugccucagccuuccgaguagcugagauuacaggcacgugcaacuacacccagcuaauuuuuuuguguguuuuuuguagagacaggguuucaccauguuggccaggauagccucgaucuccugacaucguguuccgcccgccucggccucccaaagugcugggauugcaggcgugagccaccaugccuggcugcauuuccuuuuguagaugauagaaaucuagacaacugaguuuugucuuacuaaauacauucgcacuugcaaaguguggguagcccuggucugccucaagcaauggaaaauuuaucccaaccaagaaucaacagacuaagagcaacuaguaggauauuucuguucagcaggaaaugcaaguauagaaagggagggaaaauguuauuuuguucuuugauuccugaucuaaggugacuuaccuuaaauuaaaacaaaagguggagggagguagggcuuaaaucuucacuuuugaugaaccccuuuuuaaagaguaaucugaaaagugugaagaaagaaggaaauguuuagauaucccucuucuuuuuaagcuugcauuuugauauccguuguaaagcaauuuccuuugaccuuaaauauuuucucccuuuuaaugggaaacuggaggaaaacacuaaaauccugucaguugcaaauuagaagagauauuuaggagaaacaauuuuagcuuccaacaaauuaugcaauguaaaguguaggugggauaaaaaugacaucacugcaaacucucuuguuuccucaauuauucauuugaugucuaaggggaguaaugcaugcagcauaaagauaguguuaaaauuaguuauuaagcugaaauuuuacgcacuaccaaauuuuguuauaaaauguauuuuucuuggauuauaauaaugguuaucacaauauuaauuuuguuacauauguauuugacaauguguagaguaauagcuaacagcuuaauuagguaauagauaacaacuaauagcuuacuaugccaggcauuauguuagugcuuuuuuuuuuaauaugugcauuuuugaauuucaguagcuuuuaggacacagugguuuuugguuacauggaugaauuguaugguggugaagucugagauuuuauugcgcccgucaccugaguaguguacauuguacccaauauguaguuuuuuaauccccuacccccuuccacccuccccacuucugagucucuaaaguccuuuuuaccauccuguaugccuuuguguucccauagcuuaguucccacuuaaaagugagaaaauacacuauuugguuuucuauuccugaguuacuacagguagaagaauggccucuagguccauccagguugcugcagaagauauuauuucagucuuuuuuauggcugaguaguauuccaugguguauauauaccacauuuucuuuauccacucauugguuaauggacacuuagauugguuccaugucuuugcaauugugaauugugcuaugauaaacauacacaugcagugucuuuuugauauaauggcuucuuuuccuuuguguagauacccaguagugagguuguuggaucaaaugguagaucuacuuuuaguucuuuaagaaggcuuuguacuguuuuccauagagguuguacuaagauacauucccacaagcauuguauaaguauuccccuucacuacauccacaucagcaucuauuuuuuuuugacuuuuuaauaauggccauucugguaggaguaaggugguagguaugucauugugguuuuaauuugcauuucccagaugauuaaugauguggagcauuuuuuaauauuuuuguuggccauuuguauaucucuuuuaaaaauaucuauuuaugucauuugcccacuuauugaugggauuauuuguuuuucucaaugauuugaguuccuuguagauucuggguauugguccuuuguuggaugcauaguuugcaaauauuuucuccuguuguguagguugucuguuuacucugauaauugcuuuugcugugcagaagcuucuuaguuuaauuaggucucauuuuauuuauuuuguuuuguuugcauuugcuuuuggggucuuagucacaauuucuuuaccuaggccaauguccagaagagcuuuucccuagguuuccuucuagaauuuuuauggcuucaagucuuagauuuaagucuuugauccaucuugaguugauuuuuguauaugguaagggguagggaauccaguuucauucuucuacaugugauuauccagucuucccagcaccacuuacugaaaaggguuuccuuuccccaguguaugcuuugucaaagaucuguugguucuaaguauuuuaauuuaucucuagacucccuauucuguuguguugaucuauguuugauuauaccaguaccauccugauuugcuaacuguagccuuauaguauaauuugaagucagguaaugugaugccuccagauuuguucuuuuugcuuaggauugcuuuggcuaucuuggcucuuuuuugguuccguaugaauuuuaggauucuuuuuucuaauucugugaaaaaaugauauugguauuuucauaaaaauagcguugaauuuguagauugcuuugggcauaugaucauuaugauaauauucuuccaauccaugagcaugguauguuuuuccaucuguuguguuaccuuugauuucuuucagcaguguauuguaguucuccuucuagagaucgcucaucuccuuuguuaagcauauuccuagguauuuuauuuuauuuuuugcagcuauuguauaaaggauuggagucuugauuugauucucagcuuggucauuguugauguauaacagugccacugauuugugugcuuuguaaccugagacuuaauuuauuuaccaaauuuaggagcagagaaaucuuuacaguuuucuagguauaugauaauaucaucagcaaacuuagauaguuugacuuccuguuuuccaguuuggaugcccuuggcuaggacuuccaguaacuguauugaauagaagugguaaaaguaggcauuguuguccuguuccaguucuuaggaggaauccuuucaaguuuucuccauucaguauaauguuggcuguggguuugucugauaauggcuuuuauuauuuugagguauguuccuucuaugccuaguuuguuggagguuuucuuuauuuuuuuuaucauaaaaggaugcuggcuuuuauugaaugcuuuuucugcaucgauugagaugcucauauuuuuuuuuaauucuguuuaugugauguaucucauuuauugacuuguauuuauuaaauuaucccugcaugccuggggaugaaacccacuugaccauggugaauuaucuuuuucuuuccccgccccccgccccggacagagucuuuuucuguugcccaggcuggagugcaguggugugaucuuggcucacugcaaccacugccuccuggguucaagagauucucgugccucagccucccaaguagcuggaauuacaggugcaugccaccauaccuggcuaguuuuuguauuuuuaguagagacagaguuuugucauguuggccagacuggucucuaauuccugaccucaggugauccgcucgcuucggccucccaaagugcugggaauuacagcugugagccacugugcccagccugaauuaucuuuuugauguguuguuggauucaguuaguauuuuguugaggauuuuugcaucuguguucgucagggauauuggucuguaguuuuccuuuuuguuauguccuuuucuaguuuggguaucaggcuaguacuggguuaauggaaugaguuaggguggauucccucuuucucaguguuuuagaauaguuucaauaggauuuguaccaauuccucuuugaauguuugauagaauuuggcugugaaucuaucuggcccuagguuuuuuuguuguuguuggcaguuuuuguauuauuuugauucagucucacuacuaguuacugguuuguucaggguuuucuguuucuuucugauucaagcuaguaggguuguguguuuccaggaauuugugcauuuccucuagauuuccaaguuuguaugcauagagauguucauaguagucuugaaugaucauuuuuauuuuuguuguguccguuguaauguuucuauuuucauuucaaauugaguguauuugaaucuucucucuuuuauugguuaaucuagcuaaugguuaauuuuuguuuaucuuugcaaagaaccaaccuuuuuuuuuuuucauugaucuuuuguauugucuuuuuuauaucaguuucauuuaguuuugcucugaucuuuauuuucuauuuucuucugcuagcuuuugguuuaguucuuauuucucuaguuccuugaggugugacauuagguugugaauuugugaucuuucagacuuuuugauguaggcauuuagcucuguaaacuuuccacuuagcacugcuuuugcuguaucccagagauuuugacagcuugugucacuauuacucauuucaaagaauuuuuaaauuuccauuuugauuucaguguuaacucaaaaauuauucaggagaagauuguuuaauuucuguguauuuguauaguuuugaggguucuuuuuguaguuaauuuuaguuuuauuccauuguggucugagaagauacuugaaguaauuuugauuuuuuuuuaauuuauuaagauuuguuugguggccuaucauauggucuaucuuggagaauguuccauguacuuauuagaagaauguauauucuguaguuauugaauagaauguucuguaaauaucuguuagguccauauguucuagaguguagcuuaaauccagugucuccuuguugacguucugccuugaugaccugucuaguguuguuaguggaguguugcguucucccacuguuguuguguugcugucuaucucuuuucuuaggucuaguaguaagguacuguuguuacuagauguaagguacuguuccagucgucauguugauuaucacuuagauacuuuucuucaucgugguauuuuuuuauaggcccugugaguuuuaugcugucaagagguucuauuaugggguguguugacccuuuguuucaagauuuagaacuucuuuuagcaggcuggucugguaguaacauuuccuuagcauuugcuucucugaaaaagacuuuauuuugccuucguuuaugacaguuuugcuggauucaaaauucuuggcugacaguuauucuguuuagggaggcuaaaaauaagaccccacucccuuuuggcuuauaagguuucugcugagaagucuuccauuagucugauagguuguccuuuauagguuacgugaugcuuuugucucacugcucuuagaauucauuccuuuguguugacuuuagauagcaugaugacuguaugccuuggugauguccuuuuugugaugaaucccccaggaguucuuugagcuucuuguauuuagauaucuaaaucucuagcaaggccagggaaguuuuccuuaauuauucuuucaaauaaguuuuccaaccuuuuugcuuucucuucucccucugguauaccaaugguucuuaaguuuggccauuuuauauaauccuguauuuucuggaggcuuuguucauuucuuuuaauuacuuuuuccuuguuggauucauuugaaagccuuguuuuugaauucugaaauuauucuacuuuagucuguuaaaaguuuccacugcauuuuguaauucccuaaauguguuuuucauuuccagaaguucugauuggcuuucuuuaaaauagcuaucucuuuacaaaauuugucauucauaucauaagugguuuuuaaaauuucuuuuuguugguuuuugccuuucucuuguaucuccuuguguagcuaauaaccuuuugaauucuuuaucuaguauuucaaauauuuuaucuuauuuuggauccauugcugaagagcuagugugaucuuuugaagguguuauagaacccuguuuuguugccggaauuauuuuucugguuccuuuucauuggguuagacuaauuuuucuugaauuuauuuuuguuucaguuguuuauuuuugugggguuuuuuuuucccuugagaaugugacuuuaauguuuauuguagccugacuuggcucuugguucuuucagggaugaagacacuguaugaguuauuugguuauagagagucuuuguaugauggcuuucucagaugguuguauuagcaaugugcuuggugugugaccagguugauugcuguaggauugaaauggcagaggucucuugaagcuuaucucauucccuagugguguaccguuuuuaauuaauuuauuuuccgcaguauuuuguuuacucaguugaacaguucagacuucaggccaguaggggaaguauccaugguuaaaaaccggucauggcuaaagcagguggguaaauguaauauccaguggugaacagaggucccagcuuugauggagguagccaggggagcucucagugaaacugcugaaaucuuuucaaagggaagggagggagccaacucugcuucccugccacaccagcaggaaagugauccaccucccaguuacauuccugacccaguguucagcuauucagaucagacaggcaccucuuuucaucugcaggcauguugcuguucuauguagagaggaacugugacuuuauaccucgugcaagccugaaccuggagggcacuccuccuguggggaugcagucacccugaaggguucuagaagggcugucuacagguguauguauccaugcugagcucccaugggagaagccccugcugugucuucagcaguaggugagggggagaagaagcacucccuucuccaagauccuucacaagcaccagggcuuccuggcuguugggguagaggugcagacuuucccugcugagcccggcacugcgccuaugccucugcugaaacuucccacaagcggaaaguucagggacucaaggccuguguuuggauucuuuugucccaugugauguguccuuccccuagaaguaggagucccugaggaucagaccacuaggaaugcugcugcuccucuaggucuagcuacccaguggguacuccaggcuggugcuagggaaugucuucaagggauccagugaugugacugguccucaagugucgcagcagcagguaccagcaccagcgcugauagagguggcaggggagugacauagacucuaagauuccuugguuauaaauagccuuaguguguuggcuuucucaaaugccagauuguaguaguaaugaacugguuauguggacagagucagggccucuugguuagccagggugaugaaggccauggugauaggugagguuacacauacauuuuucccuuccugggugcuguguucuucuaccuggagaugcuguaauguauuggcuauguugguugacucccagagugcaaaagagugccagcugugguggugguggugggauuuguguuugccauauguuauccaggggagauacucuggugucuuaggcgaugggcagugccauaaggcuuccaaaaguuucuguucuuuguguuaagcuaccaggguggguggagggacaaugccaggugggggcuggauaaggcaggacugcacucugguuuuucaugugcaggugcaagcaguggccccaguggggaucaggggucaguucucuggcuacugggguaaugguccagggaggagugcagcugcaucugcuguguagaagaaucugccuggggaguggggaauagcagacggcaguaauucccaccagcucccacgcacuuggcaaggcaggucucucguaggcaguguuccacuagcagcagcuagcuagguuccaggcaaucugugcucagaacucaaaaaugccucaggccauaagccuuccuugaggagaaggaaaccagggcuuucaggcuaugcccuucuuggucugcccaugaagcaggggugcccagcuccugugcucauggcugcagcacacuucccacucaccccuugguucuggccaaagggguucaucccccccuuaagauuauaucgcagaucucaguuaggagcuucucucaaccugugauugcugucugaguuagcuggccgacuucugcaagguccccugugaggugggaucagaaauggcuucccuccauccccgcuggagucugggaaugcauauaaagcccguccugaugccacugcuucucauauauuccccacugcucacuaaaccagcuccagcacuggguaggugcuuauaguuuuccaccuggcucauaguguaggcugcagcccacugcuuuuuucagagggucugugguuucuuucaguuuucauguuaaguuccucuguugcuucuuggaaaaaaguucacagcaugaaucaccacacacuauuuugucuuuucacgugguagaggcaugcaaacaauccaccaucuuggaaaaauuguauauucauauucuccacugauccuuacaacuuugagaguuagguacuguaauucccauuuuacaguggggaaauugaggccaaaaaauucaaguaccuauucagaauuacacaacuggcgauggagcuaggauucauccccaggaagugugauucuggacccuacacucuuccuggcuguccuguaagccccuaugaucaggcucugggagaggcuucaaugguaaugaugagggacaggucaaauaagcugaucaggcucugggagaugcuucaaugguaaugacgagggacaggucaaauaagcuaaucaggugauuucaaaaaaaaauuguuuuagguuuuagagugaugcaguuucacuugguguuuaccagauaaaaaaccuguguaauaaguuguguugcaaaauuauacuuugaguaggaucugaaaaaugaaaaaguagauuaaagagugauuaguacuagacaaaaggaugacccuuagaguuauuuuauagauuuaauuuuuaaaauuagggaauaugaugcuucagaaaauuuagaaaauacagaaaaaaaucuuucaauuuuaaugcuauauuuuuauaauugacuauuccuauacauauuuucauauacaguauacauguauacuguacaagaaaaaugcucaaguacauuugcauuagaaaaauguaaacaauucagaaauacgaaaacugagagucuguucacaucugccuuucuuuccugaucccacucugcuucuuaaaggggaucaauaauaacaauuuuguuggccaggcacaguggcucaugccuguaauccuagcacuuugggaggcuaaggugggccuccuggccaggcuggucaugaacuccugaucacuugaggucaggauuuagagaccagccuggccaacaugggaacaccaucuguacuaaaaauacaaaaauuagcugggcauggugguggacaccuguaauucucagcuacuugggaggcugaggcaggagaaucacuugaacccaagaagcggagguugcagugagcugagaucacgccacugcacuccagccucgacaacaguugagugaggcucugucucaaaauaacaauaauaauauaauaauaauaauaauaauaacaauuguguuaaugcaguuacauacauuugugcacauacuuuuuaaauagcaugguuuuuccauguaaucauguauccuggaguucuuucuuaccguacucuuccauguuguuguaucaucuucauaucgcauaccugaaugacugaauaauguuaaauuggcuagauauaccaugauuuauucagucuaucuguggauauuagggguguuuuuaguuuuuccuucuuuuauccucugagcgacuuauugugcauagauuucaacaugcuuuagaucauugucuuuccuuaggauagauucccagagguagguuacuugaagagacucuuaagcauuuugugauuugagagauacuaucaaagcuguagacaaaaaguuguucuaguugguaaagucauggauauaugccccaguauuucuauaccugggaaaggcuuacaaauggauuagauaugaaccagguacagugcacgcacuucauuuguuuuauggaagaauacauagucugugaaauuccuauuguguaaauugaggccugcauuccucuuaccaccuccaccucugcuacuuucugcucuagaaacuacuuuaaugaaaagagaaaaagcuaguugacuagcauguugauuuuaugcccaaugcaaauacagaccaacugacucauccugaaaauauuuagcagggagaaaaaaaaaaagaagaaaauuuuuuuuagugaguagcccacauuaugauacuuugucacuuuaaucuugaacuaaaagaccuaccauuucauuaaauguuugcuuuauaacauuugccucuaugccaaaagcccuaaaagugaauucaagugacuuuuugcuuugugacauuugacucagaauugaguuauagaugcuuugaaaaguuaauuaauguuuuuggucauggcuaacuucugaauuuguuuuauuguuuuuguaucuuauuaugaaugccugcugauagcaauuuguaccaguaugugucauauauaauauuacuuuacaaauuuuauuacauuuaaugaaagggucauuuauucaucaugccuuuugaaaacaaggacagcugcaaagucaguauaguauuuuaggauguauaaccgauacaggaaaauauuuaguccagcuuucuaauuuuguaaaugagaaguuuuuggggacucacaauagcuuuugguagccuauuauaaacugugguucuugucuuccauguaaaaccccaacucaaaauuuuauaugugaccagcuaguuugcgggucacugugcaguuuaagaagcucuccuauggcuuguuuuacucuguucuguuuaguuggaggaagugcuuacuuucaaccuuauugucauugauuucucuagagagaaaaggcuaggcuuaacuaugugugucuguauucuuaguggucagccuuaagaagaggaauuaauugaaucuaaguuaaaaauugcuuguuggagaaaaauagugcuacaguccauacaagcauacuucaaagauauggcagguuugguuccacacugcugcaauaaaguuaaugacacaauaaagugaauauaaaauaaaaugaauauuguaauaaaguacaucacacaaaauguuuggcguccuagcacagauaaguuauguuugagcuauacuguagccuguuaagugugcaguagcauuaugucaaacaauguaccuacguuaauuuaaaaagguuuacugcaggcugggcaugguggcucacaccuguaaucccagcauuuugggaggucaaggcaggcagaucaccugagguuaggaguucgagaccagccuggccaacauggugaaaccccaucucuacuaaaaauacaaaaaaauuagccaggcgugguggcaggcaccuguaaucccagcuacuugggaggcugaggcacaagaauuacuuauaccuggggggcagagguugcagugaaccgagacugcgcuauugcacuccagccugggcaacaagagugaaacuuugucuaaaaaaaaaauacugacaaucaucugagccuucaagucauaaucuuuuugcugguauagggucuugccuugauguugguggcugcugauugaucaggguggugguugcugaagguggggguggcuauggcaguuucuuaaaauaacacaagaaugugugauaugcuauuugauagcauuuuagccacaguagaacuucuuucaaaauuugucaauccuuccaaguccugcugcugcuuuaucaacuaaguuuauggaauauucuaaauccuuuguugccauuucaacaauguucauggcaucuauuccaggaguagauuccaccucaaggccacuuucuuugcucauccauuagaagcaacuccuauucuauugaaguuuuaucaagagacuacagcaauucagucauauauuuaggcuccacuucuaauucuaguucucuugcuauuuccuccacaucugcaaugacuucuuuugcugaaguguuaaacccccucagucauucaucaggguugguaucaacuucuuccagacuccuguuaauguugauauguuguugaccucuucccaugaaucauaaauguucuucaugguaucuagaauggugaauccuuuccagaagguuuuccauuuacuuagccuggauccaucagaagaaucgcuacggcaaguauagccuuacaaaauguauuucuuacaucagacuugaaaguugaaaugacuccuugauccaggagcugcagaauggauguugagcuagcaggcaugaaaacaacauggaucucucuguaccucugcaucagagcucuuagauaaccaggugcauugucaaagagcaguaauauuuugaaaugaauuuuuuuuccaguaggucucaacagugguacuuaaaauauucaguaaaccaugcuguaaauagaugcacugucauccagacuuuguuguuccauuuauagagcacagguagaguagauuuacuauaauucuuaaaggccuuaggauuuggggaaugguaaaugagcauuggcuucuuuuacucuauuugauagcauuuuagccacaguagaacuucuuucaaaauuugucauuccucccgagcccugcugcugcuuuaucaacuaaguuuauggaauauucuaaauccuuuguugucauuucaacaauagagcauauaugcuauuacuggguauauacccaaaggauuauaaaucauucuacuauaaagacacgugcacaccuauguuuauugcagcacuauucacaauagcaaagacuuggaaccaguccauaugcccgucaaugauagacuggauaaagcaaaugcacauauacaccauggaauacuaugcagccauaaaaaaguaugaguucauguccuuugcaaggacauggaugaagcuggaaaccaucauucucagcaaacuaacacaggaagagaaaacuaaacaccacauguucucccuuguaagugggaguugaacgauaagaacacauggacacagggaggggaacaucacacaccagggccugucaguggguggggggcuaggggagggagagcauuaggagaaacaccuaauguggaugacggguugauaggugcagcaaaccaccauagcacguguauaccuauguaacaaaccugcacauucugcacauguaucccagagcuuaaaguauaauuaaaaaauugguuguuuaauguauacaccuucaucaguugucuuagcugaaucuucuggauaacuugcugcagcuuuuucaucaguacucgcugcuucaccucacacuuuuaugucauagcaagggcuucuuuccuuaaaccucaugaaccaacuugugcuagcuuccagcauuucuucugugcccgcaucagguaagagcuuugucaccacucucagccuucauagaauugaacagaauuaggaccuugcuuuggauuaggcuuuggcucaagggaauguuguagcuggauugaucuucucuuccaaccaaacauucuccacaucagcaauaugccuuuuaauucaugugauaacuaaaguagcaauuuuaauuuccaagagcuuuucuuuugccuucauaacucaacuguuugggggaagaagccuagcuuuuggccugucuugguuuuugacauguuuucuuuacuaagcuuggucauuucuagcuucugauuuaaagugagagauugacucuuccuuucacuugaacacuuagaggccauuguaguguuauuaguuagccuaguuucaguauuguuguaacaucucaggaaauagggaggcccaaggagagggagagagaugagggagcagcugguugguggaaaaaucagaacacaaacauuuauagguuagguuugcugucuuacaugagcgcaguuucuggcgcaccaaaaugauuacaguaguaacaucaaaaaauaucacagaugacccuaauggcuauaauaauaauaaagcagucugaaauauugugaaaauuaucaaaauaugacagacgugaagcgagcacaggccguuggaaaaaugaugccagcgaacuugccucauacaggguugccacgaaacuuccauucguaaaaagcucagugucugugaagugcaguaaagugaagugcagagauaucccuguguuugccuuuucaguaacccucugcaguuuuucagauuuaaaaauuaacguuggacugggugugguggcucaugccuguaaucccagcacuucgggaggccagggcgggaagagugcuugagcccaggaguucaagaccagcuugggcaauuagugagaccucaucucuacaaaaaauuaaaaaguagccgggugugguagcacaugcuuguagucccagcuacucggguggcugaggugggaggaucguuugagccugggaagcagaaguugcagucagccaagaucacaccacugcacuccagccugucucaaaaaaaaaaaaauuaaccucauacuuuugguuuuaaauaaagaagagcgccacacuugaaagagcaagacaaacuuucaugaauauucucccuguguauuuuuaggacauuuaauuguagugugaugcagcugccagacucucagcacaguguuggaaagcucuguagucauuagacauuugccuccacagaaguuuaauucucugagccugaggacuguuagcgaugaagcaacgcccacccagaaggagcauuucgcuuuucuuuaugcauuucaggcucuuaagacuuucaagaagauuuuauuuaaaauuuucuuuuuuuguuuuguagugguuuauggcaggcuucucauaaugugaacauaaagacauuugauuauauuugaaaauauuguucuuuuaguuugcccacauucuaagucauuaaaaugccauuuuaagaaugaguuauggaagauauuuaaguaucugugcaucagugcauacugaagcugacguuaguuacaugguugcauuuuugaaucauuaaguuuauuaaacaccuagucuuuuacauuguauauuuuugugguaaaauauuauggcugucacaugccauuuugaaaaugcaaauuaaaaaguuuuuacaaaaaccaaaaguugcauaaauggaaacuuauaaaagcccacuuaaguaacuuaauccaaauuuuaacaucuuagaugccucucagcuuaauacaguagcccaaauuuuacauguagacagaagaugaaaguuuaaaaguuuuucuggaaguuaaaagugauuuucucuugcagagcauucccaccuaggcaguaccaaucaaugucuuaauuacuucuugagcuuuuaagacuugaaaaaugucaguaugauuugugcccccaaggagcugguugcaugcauuggaguccagaaaauacaaauuaaaauuugauuuaaauauauuuauuuccccugacacacaauuccauuaugagacaaguuucacacagguacagugacaaaugccauuagagaugagaaagacaccaauguuuuuacuagcaguauuguuucagacuaugcauguugucaugucguucucaagaucaucuugugguagguauaugguuguauucccacauaaggaaugccacagagacauucaaagaacuuuuguccuuugguuuugauuugucauguuggauauaaucaggaugcauuuaucuuaugaaucucuggacauuuuuuuauuugcucucaaggcucauuuccaagauucaaaaaucaguuuuaccacucuauaauuauuccuauuuuccagaauauguuauguaguauaauuauuuauucaauagacuuggcucugacuagcuucuuaaacuuuuuccagaacuuuuauuguauucacccucaaaugaugaagagugacaaccaucaaugauauucaaagaauaugauauagaaguaaaacauuuccaaaguuuuauauacuauuuugagccaauguuugguaagugggaaaacugaauucaaaauugucuacccuauguuuauaacuaucuaaaaaugacuaucuaaaaauaguuaugcauguguggccaggcgcgguggcucacucuuguaguccgagcacucugggaggcugaagcagguggaucacuugaagucaggaguucaagaccagccuggccaacguggugaaaccccaucucuacuaaaaauacaaaaaauuagcugggcgugguggcaugcaccuguaaucccagcuacgugggaggcugaggcagaagacucacuugaacccgggaggcggagguugcagugagcugagaucgagccacuacacuccagccugggcaacagagugaaauuuugucucaaaaaaaaaccacaaaaaacccacaauaaaaauaguuaugcauguagacaauacuauaaaauaauauaaaaagaaaauaauuugucuuagugauaggauugugaaugacuuuucuuucugaaaauuuccuuuauuguuacaguuaugcaauaaauuaaagucaguauuuuaggcagucucaacauguuuggauacuaugagaguggacucacaaaggagucaacugaucuucagaccuuugaauuuugccaguugccccucuaagaagccauucuuacaguguuugugagcagcgggcuaagauacgacagaaaauguuuuuuggcuaaugaauaauuaauucauucagcuauuauuuugugccuauucuaugguaggcacucuacgagacacaugaggaacaaagauauguaagacaaggucucuguauuuugaggaacucuuauuguaguagaaaagacaaaugcaagaacuaauaauaauuuuaagucagggugagucuauuaauagccagcagugaugcaagagacuguggucaaagaagggaagcuaacucuuuguagaggcaucaaaaaugcuucacagaggaggugacagauuuguuaaggauauuccaggccguggaguaauagguuuuaauuuggugcuuuaauuuggaagaauaucucaggagaugguaauauguauuuuaggucuuuuuuuagggcuuuacaauuuuuaaaaaauauauuuuggcuuuuauuuugaaauaacuuuagacuuacaaaaauugcacaaauuguacacagagauuauauaugcccuccauccagccucccguaaugcugauaucuucuguaaacauaguguaguuauuuaaaacaggaaaucaacagaguuggugcuauuaacugaucuacagaccuuauuugaauuuugccaguugucucauaaaugucuuuguuuuaguacagcauccaauccaggaucccacauggauuuacuugucauaucuccuuaauagccucuaauuuguaacaguuccuuugucugucuuugucucucaugaucuuuuugaagaguucuggcuaguugcuuuguaccguuugcuucaauuuuggguucucugguauuccccugugaauacauugugguuaugcauuuuuggcaacaauacuaaggaaguuauauugugccuuuucagugaaucauaacagaagguauaugaucucaauauaucucauuacuggugaaguuaguguuggucacuugguuaagcaagugccuucuagguuucuccaccuguacauuuauaauuuuuuuauagaaaugaauaucuugcagggaaauacuuugagagugugcaauaccuuguuucucaucauacuuucacccguuaauguugguauccacucaugguucuugcccacaccaguuauuacugugguguuugccaaauaguaguuuuauauuuccacauuuccuucuacauuuauuaacuugauaaggaagagcuaucccuucuccccuauuuacuuacuuauucaauuauuuaugucaguauggaugaaagaauauuuuauuguauggguuauaauuccuuacuaucauuuuacuggcucagauguggucaaugggagcuucuucaaguuggagucuguguccuuugacauauuuaaggauauauggggaguaaggauuauagggaaccuuguuagguucaugauuagaccguaugaccaacaaaaauacaguagcaauucuguaucucagugacugcucaagguuuacucuucucagguuucuucuaaugcugcaccuucucuccgugugugucuacagacuccugauuuugauucuuugcacacaucuccagguuuccaugccacucuuugucucuuucagcguguuuggcauuaagccccuagauacuaggauaugucugguggaguugguugguuauugcccaguauaagagcaucauuauagaacauuagccuccacauucuugccuauagcuggcugcuuuuagguaaacacccauacuuuauuuuaaacaguugcugugguuugagucauauggcacugcaaccuaagugcaaugaacuuggcucagaaggagcuguggguauugcaggcaucuagaaauucgaugacugcgugauuccaugauucucaacaggaggcaguuuugcccaugaggagacauuuggaaauuucuggagacauuguuggauguuaugacuggcguagggugggguaugcuacuggcauuaauggguagaggccagggaugcugccacauauucuacagugcauaggaaaggccuccaaaacaaagaauugccagcguuacugggcccaaaacaucaguagugccaagguugggaaaccaugacuuaauuugauggauauaaagaggaaagauaugggaguauuaagggaaaagcaagugguuuugaaauggccaggguaaggaguguagauauguguguguaauagaauguggguguuugaaaucaaauagguaggcaaggacaagauuauguagcgcauacaaugcauuuccaagagauuuggaccucauccauugggcuauggguuacccuugagaaauuguaagaggauuaauuugcauuuuagaaaguuuacucuggagauuaugaaaugaguuuacgaagaugaucaaauccugaaagauugaauguccccaaaugugggaagcuguuuuagacaauauuauuucaaacuuuuaacauauuuuacaguuuccuaaaugcuuaugggaaguagcuccuaaacuuuauuccagauaggaagcagacauuccuaaagaaaugccacugguuucauaggguaaagauuugguuuuggcaggaaaugaaaaagauaaagugggucaggauaguggagugucuuaaguccauggacagagaguauuauuugguuggagauuuuacaaaaucuucauaaggauuggaaaggagugggauuuuauuucuaauuuuaggguuuaaaaagagcauuaacuuucccugugcuuuuuguuaucaaacuauuugagaaguuuguggcagaacagauaucaggacuauuacucagaaguaaugcuagcauuguggguaaacacuaccuuuuaauaugugcuacugagcuugugaacauuuuucacuagcauauaccugacauaacuauucauuaucugugucugugaagugcaauuauauuugggaaaaccugcuauugcaguaugaaaaguacugcaguauuuuacccucaacaagauauuuuauuuaugaaugacuuaaaacagacacugugacaacaaaaaaugaauacaaacaugcuuuuugguaacaaaagaaaauaauacuuuuccuuaaaauuguuugagugccacagaaaauaaaugguccaguauucauaagacuggucaugacagucuuaugacagucaugucauaagugacauacaguuuauugacauaagugaaaaugcuucuacgcuuuggcuaaucauauguguuaucaaaaugauuauuuaaaauaauuuauuaaaauaauuuuaauggccaggcgccguggcuuaugccuguaaucccagcacuuugggaggcugagguggguagaucaugaggucaagagaucgagacccauccuggccaccaugguaaaacucugucucuacuaaaaauacaaaaauuagcugggugugguggcacgugccuguagucccagcuacuugggaggcugaggcaggaaaaucgcuugaacccaggagacggagguugcagugagccaagauuacgccacugcacuucaggcuggcgacagagcaagacuccgucucaaaaauaauaauaauuuuaauaauuacuauaauuuaauuuaaaauauuauauuaaaaugaucuauggaacaacuagccauacuuuauuuuuuaaaaucagaagucugucuucccaaaauaaaaaauuucuuaacuauggaaaaggaaauuuuuuugaagaggugccuaaucuccauuaaugauuuggcuuuucaugcaguuguauuugcaguuuguguacuaauauauuuaggcgaauuuggugacauuauauuguauaaugguuccugguuaauggcuuauuugagcuauaucuagagcaauuuagcacugauacuguauaggaaaaugagagaacgggauuaaauucguggauguuuugcacggaaguuuuuaauaggauaauuuauuugagcaaacauccagucuauuuaaugaaucuggaaugcuguggagcucagaaguccuuaauauguauucacugagagccccccuuaccugccuagcucauucagaugaagugaggucccuguucuucaggcaucaaacucuauuugaugaggaaaucuaaaacacauaaugagagaagugacaaaaggcucguggauacuacuagccagccagaagacagaagugugagccagaagaguugggaaguguucgugaagaaauagaaugcaaacagggcuagaacuggggagacugaaguagagagacuguucccauccaucacccagccacacccguacccacacauguacacgaacaugcaugcacguacagcaguagcagcagcagaaaagcaaguacaaagaugguugacaguacuaagggaaaugagaauaaugugaggacauaguaggaaauaagcugggagaaauuuggagauggagaguuaaguuuaaacagggggcuaugugaagacuauaucagcuuuugacaaaacugauauaaugaaaacugcuuuggggucauucugccagcugaacugaggcuaaaagagaaggaagaccaccggcauaaccagucaggagacaugcucacucuagaugugaucuagacuagcauggcagaggauacggagcagagaauccagacugaaagcaagaucucuaaccuuggaccaccgaaacuggagaucacugagagcaauauggaauuuuuaaaaagcuucuucauugcuguuuauacaggugccaagccuguguagcuggcuacagguccuagcacagaaacucuuaauaaguccugguuuccuaaggggccacuaaauguugaacaaauggaaauaucaaggaccaaaaguaugcugcuacaaugauuugaucauuuuguuuuauuuagagacagcaucuugcuugguugcccaggcuggagugcaguggugugaucauagcucacugcagcgucaaacuccuggacucaagccauccuccugccucagccucccaaguagcucggauuacaggcaugcaucacugugccuggcuucauuugaucauuuuauuaagagcacauggcagcucaccauuguguuaaggcagaaaaaaagccuaguacauuuucuucuaggagcaaauuaaacaaaugugauauuaaaaauacauacuucaccuuaacauuggccuaauagaaauguuuuuguugaauuacaugucacaaauugcuugugugggagguuuuuaaaaaaguagauauucuuuguaugaagaaaaacuauuguuuuuaccuaaguacaauguaagccuacauuauauagcaaaucuuacuuugcuguuaggcugauaugacccaagaaaaugugacgaagaacuacauugugacuggagcaaauuuucuggaguauguggaacccaugaaaauaucuuguaagaaaauaauugggguccccucuuaauguugaauuggcugucuuauuugagccugggacaauccuggguguuacuggagagacugggucccagagucacuguuccuugucaaaagcucuuuuuauuagagguugaaaugcuguaggaguccuagggagacauucccagacacuggucacuuccuuguugcaucuuggcaggucccuguguuccuucccuggguaaugugugcugcccuucccugacucauccucagcagaagugagccucccuuucuugagacuaaccccuuuuguaauacuguagggguccugugggcagaauuggcuauguaauugugggacacaguguaaaauggaaaugcagaccccuuguucaggaauuacuaagacauucaagacagcaacaguauguuaaaccaagccucgggcuguauaugacuguacaauuugcacauccauaaaggcagcccugugugugaggauaagcugugguauccuugugcucucuugaggucuugugaggcauagaagggcugccuugccuuuugcuuagauggaagaaagggcaugcaaguuggcugcugcuauccccuccucuucacauaccccugccaaccaucuaguguuaagaagaggggcagcuccuuccauucccuucugcacacaggugguuuuguuaaugggaacgucauucucagaggaguaguugacuucugcuagcauucaagugcuggauuguaugccacaaaauacaagaggaaauuuaaaauucaguggguaauguggacugugaaucaaaguaugcuggugggacugaacccuaugcagaaugcaguguagagagguuucauuuuagagagcaagcaaaagauuagagagcuuucaaugccagggaugguacaguugauucucacuauucaugguaguuguguucuguguguaaacacugaauuaacaaauacuaagcuauugcuccuagaggaaauacaggguucaguuccuaagagccuuuuguucacaacuuuuuuuuuaaagacgggguuuugcucugucaaccaggcuugggugcagugucaccaucaugggucauggcagccuucaacuccugggcucaagcaguccuccugccucagucucccaaguagcugggaagcugggacuauaggcacaugcuacuucacccagcuaauuuuuaaauuucuuauagagaccguaccuggcuaguuauuuuacuuuuuguagagacggggucucacuuuguugcccaagccagucucaaacuccugugcucaaacuguccucccaccacagccugucaaagugcugagauuacagggauaagccaccaugcccagcuaacauuuugaucaaccagucaauauacaagcuuguuuuaugugugcuucuguuuaaagccaccauaguuaauguauacugaugauugauuaacauugaauucauggccaacaucauuauuacucacgacuuaaaaaagcuucacuaacauguauuuucuccauaagguccaucagaaacuucuuucacuuaggaacaccagauagcacuucagcauuaugcccggggaccauuuuaaacagcuaaaucaccaacaaaaaggucaaagaaaugugccaugaccaugaaaagaccgugaaaaggacacguguuuaccauaugagaaaugaaacaagguagaacaucaccuuaaccucaccuugaugugcacagcgcaacucagauuuuuuaccucucugugcauguaugagaaugaccacgaaaguaccacaaauauugauuuugagauuaaagauaaauuuuagcaaguagggugaacuuguacuuacagaaucugugaauaaugagcauugaacauacuuugaguuucaacuaauagguagcagugagcaggucugaaaugcaaaaccaccuaucaacauggcaaaguaaguuuacuguuugguuuuaaagggaugauauagcaggauauaguacauucauauauaauaaaccaaggcaguguuuuuuaaaauuugggagaacugguucaaaggauggaaaaaguuccugugucaacauuuccaaauuaaacaugaaauguauauuuuucucucugauaagagaaugugaacaagguguuguggguuugauaacugauugugcuaauaaucauucagugucagcuaauuacaauguguaaacauaaaauguccaucuaauaguagguugcauuagauucaguucaugagucauguaaacaaggguuguagcaaagcagggagaugaagagaguacaguugggauaggaaaaggguucuaaggucuuugcaugcuuuucaaggaaacucauguagccccaaauauuguccaguucuaauuauuugcuaacuaaaggaguuucuucagaaaacagaauuuaguaguugugauacaauguugaaauucaggaaaugagaauuauaaauuuugaaagcauucucuccugcaugucauuuuugcguauaaacucuuuuuuuuuuuuuuuuuuuuuugagacggagucuugcucuguugcccaggcuggagugcaauggcgcaaucucgggucacugcaaccuccaccuccuagguucaagugauuuuccugccucagccucccaaguagcugggauuacaggcacccgccacuacgcccagcuaauuuuuguauuuuuuaguagagaugcgguuucaccauguuggucaggcugcucucgaacuucugaccucaggugauccaccugccucggccucccaaagugcugggauuauaggcaugagccaccaugccuggccauuuuuguguauaaacucuuaaaauguuaugguagggucuauuuugcgaaauaaauuagauacggcagugcuugauguguugacaacuucaccaaaaauaaggucuugaagaaaauuuuagucauucauaagaaacaguuuauuuuuauuuuuuaugugaaguaagggugcauauguuaaucuuuuggagauuuuacaauuuugauuuuuuucuuuggucuaaguugcuuauauuacuuugaaaacaauucucugcaguguuggaagugccuaggaagcacguauaauugcuuucuugcagcaaaaguuuuaaaaauauuuuuuaaaaauugucuuucugccuuguaaaaauccauccuguuuucugcagccuggugugcuauuuggacuaaaguuuugguuuguaguuauucuugccauaguuccccaaaucauguuuguuguuguuguuguuguuuguuuguuuuuuugagacugauguguuuuuuauuccuugcaguguuccauuucacugagacggggugaacaauuaccucccucucccuuuugauacuguuuugccuuuuagaugaguauauguuuuaaaaaauuguuugcugacuuaccuaauccaaguaagaauguuugcuaugagaaaauucugauuuaauucauuuuauaaugaaaagucugcuuaguaugcuuuugaacaauuuaugggcuaaauuuuggaagauugucuuucuaaauuauuuuuuguucucuggagcaguggaaaaaaaacaccugccucucauacacguguacacacacacacacacacacacacacacugucucucucaguuucagguuguauuugagaaaagcuugcuucuuggagauucacagugcacauuagcauaucagaaacuuuuaaaaguccugaagugaagaaaucuguuggaacauuucucauauuacucagccacagaacccuuuaaugcaagaauaccuuauuaaugucuccuuggacugguguuucauaaaaugcugcccugaagacaaacgagcacuuaaauauuuacucaaauauaaugaguaguacucaaaucuguuuaaagcucugaguucaguacaagacaugcaauuggucauuaagacccaucaccgucuucaagaagaaagcaaugaaggagaauaaaauacaacgugugauagguguugugaaagaggaagugcaggaugcugcagugaaaugauguaaaaggggcaccuaacccacacuuagcagggaaagccaccugaagaaaggauaaggauuugcucaucugucucacaaacuugaauggaguguacaaauguuaauaagacaaagugucugcucuuucaaagcuugaauuccaguguggcaaggcagauaauagguaaguaaacuuaaauuuaacauuuuucauagugaaaagugcuauaaagaaaaugaggaaauagcugauguuuaguaggaagaaagcucuauuaaccaaggaagcugcuugcuuauggaagcagcuuugaaagugagauggaaaccauggacuuauuaguggcaucgugaacauacagagcuuugugggguuucuccaguugcauucacugacccaaguaaaguacaaagaauguagagaauuguguugaucaagauuuggaguguucucaguuaugggcacucacaggaaagucaagucauggauuuuugacccccuuaaauuguggaccguggagaggggagugaaaccaaggauggaggaaucucguggaggaagggaggaauguaaguaagagacugaaauuccagagguugauguaugggugucauaagacugagagagucagaagaacaggaaguuuguaaucaugaagauauuuuauuuaaaggauuuagaaguacggucccucugaaugauaaaguccaggauguggcagugggcugcaguggcagaagaauuuuaguggugcugacuacacuggagcugaggagguugccugaccaucacugugaucugugauaucacccacaguaauugaaguaccugggauggagaagacaugaacccaguucuaaagccuuaacugaagaggggauugucagaacugaagaauacaaacuggugucauuagauggcaugagauucaaaggaaugggguuuuuguuuuuauuaaggguggagaagugauuggaaaagucacugugagcaaguagcaagugcuuacuucucauccuaacucugaggaaaugagauaugggagaaggaacagcuuccagggaaccugaaaugugguuugagcauaucauucuguggucugaagaggcugugacuuuucuaugugguuagcaacuggcagacacuaagcuucaaaccaagucuccaaacuugguucaaaccaacucuauaccuagggcacuuuacccuagcagcagaguuacagaggguacaggauuuuuuaaaaaucacaaauucaucaagaagccaaauaaauauuaauuugaugaaugcugcugguguugugaaguugugugcauaauggaucauggagaaccuagcauauaacuguaauuccaaaaauguauuuauuucucaucuuuuucuucuucuucuucuuuuuuuuuuuuuuuuuuuuuugaggugaggguuucacucugccacccaggcugugcaguggugcagucauagcucacugcagccuugagcuccugggcucaagggauccucccaccucagcuucccaacucauugagacuaugcgugggccaccaugcccagucuauuuauuauccuuuaaaugguggcugcagcagcucugcuguucucagcugagcugcaagauaguagggaguaggguggaguuagcugggacagguugucuggggcagcuucccuccacaugucucucauccugcuuccaccagcaggcuggcucaggccuucucaugguaaaggcagaagcaggagggagcaaauggaaacacauauggccucuggaagcccaggcucaaaacuggcacauuguuauuucugccucauucuguugguuaaaaugagacaaauggucaaacucuugagacaaggguugaugaaaucccuacaaaggacauguauacagggaggggugaagaacaggggacagugaauagugcaaucucucauagaagccugaacuauaagcuucuaugagugaaaguuaaaugacuacaaaggaaaauaaauguugaugaagagccuacucugucaggcucaaugguaaaaugacaagaaaaauuuaccaggaacuucccaauagaaaggauuaguaauuauaggauuauaaauaaaggauuaagaguuaaguaggccauagggguggggacaagauuuugcaagcuuauuuccauuuauaacauauucuuccccauaaggaaauuuuuauaggguuucaaaugagcuuuggaaaauuauucauaaaauguuaugaccaucuguauuuuccauauugcuuaaaaucccacuccauaacuaaguauauugucaaaugaaguuaucagauccuaaaaucacauccuuuucagcuaccaucuagucagaaaguugcauauccaggggaaccugugggaagcacuggcacauuggauuuuaaaauagagaaauuagguacuguaucucguacuuucauuagggcuauguucaugaaauuuuuaucuccaccuguucuucauuuguaauaaugucuacccuucugcagagguuaguuauuaagcaauaaaguauuuggaaguagcuucaagguuauagacuaucauaaaccagcaauaaauaggaauaguuuugcuaagaacauagaaaguaagcucuugggcuuugcaacccaacuaccuggguguguccuggcuuugucacacucuagcugugggauguugugcaagguagguaaucuaugcuucaguuccuccauuguugaaaacagaauaagaggccgggugcaguggcucaugcccguaaucccagcacuuugggaggccgaggcggggggaucaccugaggccaggaguuugagaccagccuggccaacauggugaaaccccgucucuacuauaaauacaaaauuuagcaaggcaugguggugcauggcuguaaucccagguacuuaggaggcucagugggucaaacaccaacuucacauuauuguggcaaaaaaaauauuuuuugaccuuuacucagcacuuagaacaggccaggcacugugccaaguuaagagguuuauauagaccaggccucauuuaagccucauaaccaccuuauagggcagaugggacucuuauucuuuuuuuugagauggagucucacucugucacccaggguggagugcaguggcacgaucucagcucacugcaaccucugccuccuggguucaagcaauucuucugccucagccuccugaguagcgggacuacaggcgccugccaccaugcccagcuaauuuuuguauuuuuaguagagacaggguuucaccuuguuagccaggauggucucaaucuccugaccuugugaucugcccgccuuggccucccaaagugcugggauuacaggugugagccacggcgccuggcccauuuuucaaauuuuugaguuuuuaaauuuaaaaaaaaaaaagguuuucccuguaagaaagaaaauaauacauugaaaaauuuuuuucaauggagaugagggucucacuauguuguccaggcugguaucaaacucaagugauccuccugccucagccucacaaggugcuaggauuuuacagaccugggccaccaugccuggccaggucuuaguuauuuaaaugugagaauuauuuuacaaauauaaauuaaucagucaaacauuuauuguggaccugccacauguuggugauguuaugccuagcaaagaacuuaagauaugaucuccaccuucaagaagccaacaagcaguugggaaaagcaaaaugaucacgucugaagugaugccagugcuaagugugauacagggcacacuagguguguaaaaggaguauccguccaaacuccuggacgaaugccugugaagugauaccuuuaacuugauagccuggauucagaugacuguuccuugguuagccacagcauauuguggucaggugcuaacuuacacaggagcacaguuaauuaauguguggucuuacagggugcguuugcagucaaagugagaaucuacagaaagagaagaggaguuuguaguuaauguuaaagugcuucugaagccugaaaggguccuuucuuuugggaaauugcagaaaaaagucagcacaugcugugguucuccuuccaaagcuaaugcacccuguaucauuaacaaugaagcaguugacuauugccaggaaaagcagaaacuggcuuauuuaggguagggaggcucagcagugccaaagcuaaugccauuuugagucaaguguacauuccaguauauuuggucauuauugucuugucauuccauccuuuuaaauguauaauuucaaaguuuauaugcaauuaauuuuguuugccuauuuucuauccaaaugacaugguugguuuguuuuacauuuugacaaauauaggcaaauuauccuucuagaaugucacugcuuaguuagagcuuagccucauacagucuauaaaggugaguguuggucuguguuucaaaaugacauaaaaauuuuuaaugaaccauuguauauaauagaaugaaggacacugguauaaagaggggaauguagaaucuaauuuucccuccauagaaaacauaaacauaauaaauuucauggaaacaaucuguuaaaguaacuugaaagucuaaaacugaacagaaaggugauuuguuagcuuaucuucuuuaauuauuguuauuaugauaccuuauuccuuggaauuugagcuucuacugaagaaauuaucuaccuuuugaccuuguuuucucuagcuaaguggggcugaagaggaaauaaguauguaauaggccucccccagcaagcauggaggcuccuccugcgaccccaggaucucuaggaccuaggggagcagugacaauaccagcaaagggguccacaggguugaggaccccaauggugacgcuguguguggcagaccaggagcaaguggcagaguugcucacaaaacacacugcuuggaagaaauggacuuuuucacaaaagccuuugcgguauccaugaagugugcacugccuuaugcucaugacauaucuuacugaagauaagucagugugcuagugagacaccuacuauguucuauuuauucuuccuauucuuuuccuauuuacuuuucacaggaauccauguaggugcuacuucuuuauuuuuuaaaaugaguuuuuuauagguuaguguauuauuuuagauauuaagaaauacuauaaagagguuaaaaucauuugagaauaacgaugcaaugauugguacuaguaaauauguacuagauuauaacuaacuguauuuguguacuugauuuucaaaaguuuuacagaauguauaaagaaguuggauggaaacuuauuuguuauucagguguuuuccuacaaaacagucuaccuagccaggggaaagaauaaugccacuucauucugacuaauucucuuccuucaaauauggagauucaucuaauccgcuguuuuauuuaugguuuugaaaccaaaguggcaacuguguguggcuuuggguguucuuguuuuaggguggcagaaguuggcauggcauuuccuuagccuaagaguuuuaauuucauaguguuucuuaauucuuaacacuaggcaauaugucaguaaauucucugaaauuuaaucuuauaaaaguucuaggaugauucaugcuacccuuccuucccccaaaucgugacucauuuucaaacuuguguuugaaaagcuuuguaaguuagggugaaauauuuagaguuuggcacuuggauaguucccugaaaacucaguucguuucugccagcagugauugcgaugacaggguuagauuuuauuucucagguguuucuguugguguuucauuuugcagaucugaaaaggggguuaaaagggagugcugaaacagaagaauaagcacuuaaaguuuugguucuuaugagauggaaaccauuccaaaggcaccugguggguagggcuuuguuaguuucugagcauuggacucuuaccauuuuaucaacaucucuacaagaccaggguucugggaauauucauugucacuuuucuucagagaguucccauugaauguaucuaagcaggucauggcacagagaauuuuuaagaucuuaaggauuagacaaugauaaaccugagguguacguucauuuuuuuagcagaaagaugugaagcaauaugugauuccagagcaaaugugaacuacuuuacgaagcuuugaaagaugccuuugaaauauguuuuuguuugugugguuuguuaacuuuguuuuccaagacaaggaauauuuccucaugagaguagcgugauuuaauacccuggaauaugguaauugugcuaaaccauacagcuauaauuauaagacacuaaauuggccagaacccuacuuugaaguuuaaugcuugacauauuaaaugcuucagaucucuuucaggaaaaauuucuguaacaaugaaaucauacuauauuaaauuaaacuguuuuaguguauuuauuuuagaucaugaaauaucugauuuuuuuguuaguaauaaaaacaguuuaugaaccugucauugugaaugaaauaauuauuuagugaaguuuccauuuaauuccuugcacugacaaauauucuuuuaugaaucucucauucaucacucccuucucacucccucuuuagauucgcaaucaguuuucaggagcacaucugucaucauuauguauauaauuaacacagugucuuagguagugucaucugaauuacugaacagggauaaugauuggguaauuugagaugucgugauugaccccagaucuuucuucucugaaggguaaugguacauaaugguuucuaaaccauggcacccuuccaauugaguagaauguacaauuuaaaagaaaaauauauaguguuuaccuggauauuuuuaguuucuuuugcuuccuuuauuauuuagcaugcuaaguuucuaaagcauuaauauucaucacucauauuccaaauugcugucaguuuccugugauauuuguuggcgucagaauugacuucaagcuuuuuauuuauggaaucuguucuggaguuaacaaugagcuaagguuuggaggaaauaauauauuaaauaaacuaucugauucgauacccuuggauccgagacucuguuuaacaaacacgagaaucccuaggaugugguuuguaccuuuagugaacuuauauuuaaauaugcaaacuaaagaagcagcuccaguaaggaaaacuaaaaugcugauuuuuuuuuuuuuuuaauuuuagacucaggaggaacaugcacauguuugucacauggguauguuguauaaugguggggauugggccuuuaguguacccaucagccaaauagcauuguacccucacuccccucucacccuuuuugaguccccagugucuguuauuucugucuuuaugucuguguguaccuauuaguuagcucccacuuauaagugagaauaugcauaugcagcauuuuuaucuuucuauguuagcucacuuaggauaguggccuccagcucuauccauguggcugcaaaggacaugauuucauucuuuuucauagcugcauaguauuucauaguguguguguuuguauauucaguaucuucauaguauaguguguguauauauauucaauuccauagugugcguauucaauauugaacauucaauagucauugaaaaugugauauguauauaucacauugucuuuauccggucaacuguugauggcacuuagguuggugucauaacuuugcuauugugaacagugcuucaauaaacaucuaagugcagguugggugagguggcucaugccugugaucucaacacuuugagaggccgaggcuggaggauugcgagagcccaggaguuccagacaagccugagcaacauggugagacccagucucuacuuuaauaaauaauuacaacccaaauaaacauguaaaugcaggugccuuuuuaauauaaugauuuuuuuuccuuuggauagacaucugauagugagauugcuggaucgaauaguaguauaguucuguuuuuaguuauuugagauaucuucauucuguuuuccauacagguugaacuaauuuacauucccaccaacaguguauaagccuucccuuuucucugcauccaugccaacaucuguuuuuugacuuucuaauaguagccauucugacugguguaggauaauagcucaguggggcuuuaauuugcauuucucugacuaguuauauugagcauuuuucaugugcuuguuggcugcuuguauuucuucuuuugagaagugucuguucauguccuuugcucaguuuuuaauaggauuguuuuuuuuuucuguuuugaguuccuuauagauucuggauauuagucguuugccagagacauaauuugcaaauauuuuuucccauucuguagguuggcuguuuacucuguugauucucucuuuugcugugcagaagccuuuuagauuaauuaagucacauuugucuauuuuaauuuuuguuacauuugcuuuugggguguucgucauaaauucuuuaauauuuguuggcaucagaauugacuucaagcuuagucaagccuaggccaauguccagaagaguuuuuccuagguuuuauuuaggauuuuuuauaauuucaggucucacauuuaagucuuuaauccaucuugaguuaauuuuuguauaugguaaaagauagggguccaauuuuauucuuuuguauaugguuagccaauuuccccaguaccauucauugaauaggguguccuuuucccauuuauuuuugucaacuuuguugaauaucaguugucuguagguaauguggcuuuauuucuggguucucuauucuguuccauugauccgugugcauauuuuuguaccaguaccaugcuguuuuaguuacuauagucuugugguaucauuugaaguuaggcaacaugauaccuccagauuguucuuuuugaauaggauugcuuugacugauugggggguuuuugggcuccauacgagcuuuaggauuguuuuguuuugagacagagucuaacucuguugcccaggcuggagugcaguggcaugaucacagcucacugcagccucaaacucuugggcucaagugaucuuuucaccucagcuucccaaguaccugggacugcaggcaugugccaucacaccugcauuuuuaaaaagauuauuuguagagaugagacgucaccauguugcccaggcuggucucaaaauccugggcucaagauccuccugccuuggccucccaaagugcugggauuauaggagugagccacaaugccuagcguguuuucucuaauucugcgcaauaugauguugauaauuugauagaaauuacauugaaucuguaguuugcuuugggcaguauggucauuuuaacgauguugauucuuucaauccaugagagugagauguuuuuccuuuuguauuguugacaauuucuuucauuacuguuuuguuuucucccuguagagaucuuuccucucuuugguuaaauguauuacugguuauuuuauuuuuuuguugcuauuguaaauggaauugaguucuugauuugguucucagcuugaaaguaaaacuuugauuucugaaaaucuuucaaggaauggugacucuugacuuucacucucucccugggguugccuuugauuuccucugcauuaccaggcaucacccccaggguuuacugggaggcaaguugucugucaguuguuaagggagcaaacuauggaguugcaguguugggaucuugggcugguuuuuuaaucuuucuguuuucuuacauguaaaagaugaugauaauaaaaagguuccccaacauugccuaguccccuaauagguguugaguaaauguuaaacuguuacuacuugaacacuuuaauacuuuuuuaaagcccaaguguuggcagaaaguauuuucuuauuuacuuuugccacuugagucagacugacauuguaggaaguaauuuuucucaaugcuaagggaagagggaugauaaacaauuaagaguaccuaccauguggcagucauugcauuaggugguuagaucuguuauuucacuuaguucucaugacacauuuaaggagguagguugccuuagcccaguuugauugauagcaacguaacuuaaccccuuugaacaucaguuucucugagaccacucaacuacuaugugcuuagaguuggaaugccagcuccugaucuuuuuggcugcaaagcuuguauuucuucuguaauaacucacagaaauaguuauggaaugacucucaaaaauguagaguaucaaagcuuuuuauaaaaagagaauauucuaccaaaaacacagaaacuaucaguuucaaacacugcugauucugaagagcuuaugcagcuucacaagcaaauugauuuauucaaauaauauuuggaaauaaaauuuugagcaaaacaauuuccugccuccuagccuccuguucaucuuuaagugcuggaggccaucugauuuccugccauuggugauauuaagggcccuugacucauucugagauaaaaccaguaaaauaccucacccaagaaaguaauuuacuaugacaagaucugcaggagaaaaguagcauguguuuuacuuauuuauuuuugcauguguuuuagagcuuuaccacucaaggucugguccaugggcccacgucagcauuacuuagaaguuuuuagaaaugcaaaaucucagguucaacuucagcucucuugaauucagagucuacaauuucacaaaguccucagcuauuuguaugcacaaauuucagauucagugcuuuagaaggaaacacuggagaaaacuguguguagcaauuaccugaacaauugugcuaauuauuaauguucagaagagaagaauacaaaaccauaguuuauuuucuuagagaauuuauaaacuaguugccuagcacuguaguagagcaguugagagcuugguuguuggaguccagcugccuggguucaagucccagcucacugacuugcuuagaugcaugaaucuguugcaucccuaguaaagggcuguaauaagaucagaugccaucauacauggucagugccuagcauagugccugccacauaguuagccuucaauaaguguugguuauuuacuauuaaagaauccucagauauaugaguucuguaauuugauuagaguuuaaaugcuuaaaauguggcaugauuugauguauuugagaaaagaaaauagucauagagugaagauaggguuucaagucuuggguucuagaucuggcuguaccaccaagaggcugcauaacuuugggaagguuaccuaaggguuaucuacauugucuguaagauggagauaaugauguauaccauggcuaccugauagaguuuucugagggucaauugaaauacuguauguggccaagugugguggcucaugccuauuaucgcagcacuuugggaggcagaggcaggaggauugcuuaagcccaggaguuccagaccagucugggcaacauagugaggccuguuucuaccaaaaaaaaaauaaaaaauaaaaaagauaaguuagcgaagcauggugccaugccuauagucccaccuacuugggaggcugaggcaggaggaucacuugagcccaggaguucaagguuacagugagcuaugaucaugccacugcccuccauccugggcaacagagcaagacccugucucuaaaaaauaagaaaacaagaauaaauguaaaaguauguuguacacuguaaggcagcaagugggaacugauauuuucagaccccuuuuguaugggggccuggaguuuaguuaccuucauaaagcuggcuaugugaaagaccagaccaaaaucauuuauuucuauaucauuauuuugauauaaacagguugaaauaaaaugguaagaaagugcaagcaucaaaaauaaguuguacagauauuuugucccauguaccuggugcuugcugguuuuugacccugaccuaaucgugaccacugucauuccuuauaauguaaauuguauucccuucaauauucagucccauuauguacaauuuguauuguaaaaacugggcuauaaaagaaacaccuggacuucauagaaaguugcccugccuguggaacugaugcuggaaguaugcagggucagauguacaauccacuguauacuccauggcaucuccaguuuggggagaacauugccaaugcauuuuaguccuauuuuuacuuuugguggagaauuguaauaaacagauuaauugaaauaucaaucugggcaauauuuauuggcaaaguauugagaaaauauuugucaaauaaugaauaggguagauguugaaauuaggguugcccuagaaggugaacuaugauagcguuaaaaaguugccucagaaagaauugcaggagaaauccucuuauuuuagugauaguuuauugguaaaugaaaagucuuccugaagggaucauuaaaauuacauguacuuuuuuguggcuggucacagugguucacgccuguaauccuaggacuuugggaggccaagguggguagauugagcuccguaguucgagaccagccugggcaauguggcaaaaccaugucuccacuaaaaauacaaaaauuagcuggacguuguggcaugcaccuguagucccagcuacuuggaggggcugaggcaggaggauugcuugaacccaggagguugaggcuguagugagcugagauggugucauugcacuccagccugggcaacacagcaagacccugucucaaaagaaaauucaugucuuuuuuuuuuuuuauguuuuuaaaaauggaggucuugcuguguugcccaggcuguaguagaguggcuguuaauaggugugaucauagcacauugcagacucaaaccccuggacugaagcaauccuccugccucacagccuccugaguagcuaggaguacagaugcauaucacugugccuggcuuacacuuauuuauagugaauguuaacuuacaacaguaaguacacuuugauucaccacaaauuugauguauaucuaaagcuuuuucagugugaucagugaagaagguuuuaccuuaccuaucuuguaugaccuacaucuaaauauagaguucauaauuccuaguuugaguucuuugaaauaaguggaggccaggcgugguggcucacgccaguaaucccagcaguuucggagggcaaggcgggcagaucacuugaggucaggggcucaugaccagccuggguaacauggugaaaccccguuucuacuaaaaauacaaaaauuagccaggcgugguggugcaugcuuguaggccuagcuacuggggaggcugagaugagaugggaggauaacuuuaaccauggaggcagagguugcagugagcugagauugcaccacugcacuccagccugggcgaaagagugacagacugucucaaaaaaaaaaaaaaaaaaagaaagaaauggagaccauggauaccugaaagaaaagaaaagaaagaaagaaagaaagaaauggagaccauaagauaccugugaaccaaucugaggacagaauccauuuaaauuuuaucagaccccccaccccucaaauguaagauaucuugacaacauuuaauucaguagcaguuuauuuuaguaauuauggagcuuuuccaaauaauuuuaguuaauuucuauugaaaaacuucauuuuuauauucauauuuucucaauuuauauaauuaaauaauguugucaggcacaacugguguaaacagguuugggaggaaacagaacugacucuugguauauauuaaacucagcugguggaaguggguguguuuggguaucagaaaguagucuaugaguccugggcauccaguguccuucagccaggauguuucacagagggaauagagagcauuguggagagagaaucagcaagguuuuauugcaucauuuguuuuggcaauuggcuguaaagaugccuggcaugaagggagguauuuugguuuuugguuuguggagcuuuuuugcuuaacauuuugugaagacuaacuuaaggucauuuggcagacguguuauuucacacauaaaagcuucuauucucaugaggcaaggaagcaagaacacauuuuucuuugccaaugaaugucucuugcucuguuuuggaauuguguuuaauacauaaaaucugcacugauucuggacuucauugaaagagauucuguaagguugauuggggauggaaaugagguggucuaguaauuuucaaagugcuacugaauuacauaacagucuuuguaaaaccaaaggaacccaaauuuuagagcaaauaaaacuuuacauuuuaaauuuguucauguuuuuaaaugaaugucuuuuugcuuuuuuguucaaagagcauuuugacaaagaacauaauugaaguguaugggaguguguauagaauauacugacuucuuaaaaauggagguuauuuucccccccuccuaguuuccagcauuuaaugggaaguuuaacuaaauguguaugaaauaaauuuaaaaaaauaaaaaacaauuuauauacugugagucaugcauauucuugccauuucagaaaggucaagauaaaguaucguauacuacugucacuccguuaaugaagagaguaugugcuguaccuugacagagcauuggaauugaaggcagaagcugaaguuucagacccuggccugauugaugucuggugcagcauuuaauuauucugaaccucaguuucuccugugaagugauggugauaggucucuuucauccacaaaauggggacaguaauaccuaccucagggcuauugucaggauucagugagauauauuaaaggcaauuaagaaaagagauaaucauuuuauuacuaaaaaauaauuuuuauaaaauaaggagaaaaauaaaaauaaaaccuauuaaaagcauuuagcacugugucacagaguauuugauaaauguagcauuuauuuuuuuaaaaauucagagaugaaugaaugcuccaggcuauuacccuugagccugacacuucuauuuauguugggcuuaaugcccucuugcagaguaauagcacucuuggacauguuguucaaaccuguuuucucccauguccugccuaaugccccaaaauagagugaaauuauagcucagggacuaauagccaguuacuugcaccuuggcuuuuguugccuugugaacugcuggcaauuaaugugcugugaguguccugugaagcccugugugggaacuuucuccagcugaaauaaaggagggcagcacugaaaagccuggacaggcuccuuucuucucucccuuccauucucagcagugugacuguggcuacacaguccucccaguuccaauagcuggcaccugcucuugcagggaaggcuucucuggguuggcagugccucagcaccuacugcccugcuugucgccagcucuccugccacaucccaggcgucagaccuccuaggugguuuuuauuuuuguuuuguucuguuuuuaguguggcuaacuauaucaugaagaaauguucccaaaggaauuguuugcuaguccuuucucaucccucccacaucacaucccagcuauauaggagggagggaaaccauuguuuacaacauuuaugcaacuuuuauuucuggaaaggguaaccagccaacauaaagaauuugcagaggacucagugaaugaugggucuggggaagcauccuagucaguuuaucuaagcccauggaagagugaaaucuucacaucacauauugggacagccaauuagaaccucugcaugccccagaaaagccuagagugaacucacuucuuggcuaaggcuagucuuuccuguaccccuggcauuucucugaagauaaggacuauugaauuaauuccuuuggaaguccaggaaaguagcauuuugaaugcuugcuuuuauuccacaagaagcuugaaaaggaaaaugugucucuagauauggucucaaaagcuccagugaaguuuuacuaguaauuauugauuagaauuuuguguggcucugggccgggugcgguggcucaugccuguaaucccagcacuuugggaggccaaggcagguagaucaccagaggucaggaguucgaggccagccuggccaacauagugaaaccccgucucuacuaaaaauacaaaaauuagccagaugugguggcaggcgccugugaucccagcuacucgggaggcugaggcaggagaauuacuugaaccugggaggcagagguugcagugagucaagauugcaccacugcacuccagucugggcaacaaagugaggcucugucucaaaaaaaaaaaauaauaauaauuuauguggcucugguuaaaauguaaagaccacaaaaugagguacugugcacaguauuaagguuguuauuguaauacagcuuauucaacugacauuuugcauuaguuugaaucacauaugaaaucacauguguucaccaaaguguagaaagcauuaaaaauaauauacauugauuguauaagaaccaggaggaaaaacagggaacaguaaguauagcaucugcaagauuuggaucccaugaaccuucaguauguuagccuuuguuaaauaacaaaacccagugagaaaaacacacauaauuugaaagcacuuaugacauaaaauaacugauugauugauugauuuuuuauuuuuuugaaaugggaucucacuguugcccaagcuggagugcaguggcacgaucuuggcucacugcaaccuccaccuccccgguucaagagauuuuccugccucagccuccugaguagcuggaauuacaggugcccaccaccacacccagcuaauuuuuguaucuuuaguagagacgggguuucaccauguuggccaggcuggucuugaacuccugaccucaggugaucugcccgccucagccucccacagugcugggaugacaggcuugagccacugugccgggccugauuuuuuaauuccauauucagaauagagaagugaaagcccaguaacugauucaaaacaauaaaugacccauguacugcccugagagaagcggaaugcugacuuaaauuuuauuuuuuggaagugaguuuaguuaaugguuaagauacaacccaaaauaugcauuauugcuguucaaagaauaauuuuuuuaaaauccuaccucuuuuauuuaaaaagaaaaaauacuccuuaucaugcuggugcuugaauauacaaaauggugcuuuaaguggaauaggcuuguggaacaaauucaaggccaauaucauucauuugugaguacgaacagcugaauaaugagcuuggcaaaugcuuuaagauguuaaacaaaauaccguuagaacaaaggaaugacucaaucugaccgugagagaaucuucccuccucuccagaguuggaacauuuaaagcagggcuuugacaagugagcaggacuuccauuagugaaggaguaaaugagaauuuuauuggucuaagcaaaggcauagaaguacaugaaaguccauggaguagugggccaccauugaaggaucuaccauugcagaucccaccauugcuaugcaugcuuguuugccuuugaguauggggguggggauggaauuggugacaggaugaaucuuuuaagggaggccagaaccagauugugaggggccuuccauguggugcugaaggcagugagaagccucaggagugcuugauaugaucugauagcccugucacuggauuggaguaaugcuccaggccugccagccuugaucccuauuugugcacuguccucuacuugacaaacuuuuuuuuuuggagguaggggacagggucuugcucugucaucuaggccggagugcagugguacaauaaugacucaaugcaaccuugaccuccugggcccaagcaacuuacccaccgcagcaguagcugggaacuacaugcaugugccaccacaugccuggcuaauuuuuaaauaauuuuuuaguagagacgggguuuuuuccauguugcccaggcuggucuugaccuccugggcucaagcgauccuccuugccucagccucccaaaguccaggauuauagaugugagccacuacaacaagccacaaacucuuacauguuuauuaagucuguauuaggacucuuuccuucagaaaacaagcacaaacuggugugaggagaaaauggaggugcuuauuggccuaugcuagaucuagcugugcuagaaaaccaggaagcccaagugcuuuguccucaggacucaguguguuuccuguggcuuuuuccauaugccccugguagcuuuaaggugguuccagcauagguccggguuccauuccaucccuuccaccaagcauaucugaaugaacuuucacaaaagggcguaauuucagaaucaaacuguguaauuggaaacuugaugcucuacuggcacugaucaaaggguguccuaguuugaguggagagggaugguuccccgaugaaaaaguuuguucuguuaucagaaaaguggggacauggaugcugagugacaaaagccaacuugcaacauagaccugguucauaagggcuccucauccuuaaucuuucgaguaauacguuugucacucuuucucuucacuugccagugaacauugaccagaguguccuuuaguuacuguuucccgcuccacuagacugugagcuccuugaaaucgaggauucaucccuucacgucaacagcauuaacacagauguuuuaccaggaaucuugcuauguauuagguaugcaaagauaaaccagauuggaaccuguucucuuaaggugcuuaucuugaugagggacuugggucauaaaugugauuuaaguacucuaguguacuugugggacuucauaccuggacacuucauuuuauaaagauuuaaauuuuuagauccaguaugaauuucuaugugagauauuguuguguguuuuauuuccuuguuuugauuuuuuuuagaagcaagcuuuuaauauuauuaccaugugccuuuaaacaccuaaaggaagcuaaugaacuauuuguugaagccuccacuagacaaauguacagaaauggaaguggggugaugguuuuuauuguuugauuuuugccuuugucaugguaggaagcuuauuuuuuaaaaauuuuaccuuuuaugagcuuuacuggaguauaauuuuauaugcaauaaaauguaccaauuuuuacugcacaauugaguugugacaaguguauagucaugugaccaccucugaaacucauuauuuagaacauuagcugauuuuuauaagcaauacacaacaugaauguacuuucucauuuaaguaacaguagcugguugggugugguggcucaugcuuguaaaucccagcacuuugggaggccuaggcggguggaucacuugauccuaggaguucaaggcuagcuugggcaacauguagaaaccccaacucuacaaaaaauaaaaaaaauuagcugggugugguggcaugcaccuguggucccagcuacucaggaggcugagguagaaggauggcuugagcccagaggcaaagcuugcagugagccaugauugugccauugcacuccagccugggcaacagaacaagaccuugucuccaaaaaguaaaaauacguaacaguagcacaugaaaaugacuuaaaaugaauucagaagguugaacucaccagcauuaacaaccuacagauaagaauaugcugcauaguuuucuucuggaucaaaacauguauuuuccuucuguauacaagcugagguauauaauuaguucauaugaacuauagaguuggaauauguguuucaagagguucgguuuuuguaugcagcaaagcgcuaguuuaugaaaggaagagaaugauuguacugauauuugauaagugaauaaacuacuuacuuguauccugucugaaaaugugucuggcagugaccauggaaacguggccucagggaguccccucuggagggucagaaauagcaagaggguaauagagaggcugucugguuacugccagcagguguugagaaaagcuugcaguaaucauggguaaaacucuugagacauccaugggaguagcuuauggugggcauuguacaucaauaagauugggauuucugaguuuuuacccuaggagcaaugggaagagggcagacgcaagacugcacaaauggguggauagggguacauugaggaaaacgggaagccuacaggaagguuggaaacaugggaauugaugucaugaaugaaguaaucuguacagauguaaagcaggaaggaagaaggggcuaggacugagccuugaagaauuccacuaguaauggccagagggaggaagcuaggugggagaggaguggccuggguagucaggaaagacagaugaaugugagguaaaagucaagggaaaagagucuuuuaggaaggagguaaauggagaaauucugccaagcggucguuguaaggugagaacugagacccacccguuggacuugaccuaaguggagguugcuggugauuaggaaccucugcgaaggaugauggugcaaaagccguguuagauguuuguugaggugggacaaacuucagaaauaucuaaauguuauuauaaaugaucccaucaagaaguaaaaacugacaagauccugagaaggcaggagaagguggauuucagaccucacugcagggaggacacacugacccuguguaauaagaaggaagguguaaagagcagggauguaggggcuggacguuguggcucacgccuauaaucuuagcacuuuuugaggcugagguggguggcuugcuugaucccaggaguuaaaaaccagauggggcaacauagugaggccgucucuaccaaaauaaauaaauaaauaaauaaauaaauaaauaaauaaauagccgggcaugguggcacaugccuguaguuccagcuacucugaagccugaggugggagaucaguuaagccccgagguugaggcugcagugagcuaugaucaugccauugcaccugcagccucgacaauagacugaggcucugacacacaugcacacacauacacacauguccacacaccaaaagaauauguuguauauagguuuuagggaguaacuauuuuauuuauuuauuuauuuauuuauuuauuuauuuauuuauuuauuuauuuuuugagacagagucuugcucugcuacccaggcuggagugcaguggugugaucacugcagucuugaccuccuggggucaagcaauccucccaccacagucuuccaaguagcugaggccaccgaugugcgccaccugcuuggcuaauuuauuuauuuuuuguagagacaaggucuugcuauguuacccaggcagaucucgaacuccuggacucaaguaaucugccuuccucagccucccaaagugcugggauuacaggcuugaaccacugcgcacagccaggaguuacuauuuucuaguguguauguaucaguccaaacucaaacaccgugauggaaaauacauuucugcguuagcugguuuaguguuucucaccuguuuuuuuuuuuuuuuguuacuguccuuuaaggaggaaaauuaaauuuaaaugaguuauauuuauuacuaaaaaucuuuuuaaaauuuuuuaaaauuuuacauuuuugagauuaugaauuuucuuuguuuuugagacaaggucuugcccugucacccaggccagagugcaguggcaugaucucagcucacugcagccuuaaccucccaggcucaagcaauccucacaccucagcucccaccacccucuucucugaguaucugggacuacaaacaugugccacuaugcccagcuaaauuuuguauuuuuuguagagaugguuuuuuuguuuguuuguuuguuuguuuguuuguuuguuuguuuuugagcuggagucucucucucuuguucaggcuggagugcaguggugugaucucggcucacugcagccuccacuucccggguucaggugauucucaugccucaaccuccccaguagcuaggcuuauaggcauguaccaccaugcccagcaaauuuuugaacuuuuauuagagaccggguuucaccacguuggccaggcuggucuugaacuucugaccucaagugauccgccugccauggccuugcaaaguccugggauuacaggcaugagcuaccgcuccuggcagagauggaguuuugccauguuuccggacuggucuugaacucucugagcucaagugaucugccugccucagccucccacagugcugggauuauaggcaugagcugccgugccuggcccagaaucuuuuaauuuuauucuaacgagauaaauaguaaggguugaacuuuggagggccacaaaucauuguaauaucuacgauguuuagcucccuuuauuguuaauuugcuaaggccaccauaauaaaauacuacauacuggguggcuuaaacaacauaaaucuauuuucucacaguucuggagaugagaagaaguucaagauaaaggugucagcagguuugauuucuccggaggcaccucccccuuuuggcuguguguucacaugacuuuuccucuaugcaugcacacccuggcaucuguguguguccacauuuucuucucuuauaaggacacuggucacauuggauuauggccuacucauaugaccucauuuaacccuaauuaccuuuuuaaagacugugucucuaaauacagucacauucugcuguccuagaggguagggcuucaacauaugaauuuuagggggauauaauucagucuauaacaccucccaauaaguuauuuuugccuccccuccaccacagaggcacacugccccuuugagaaugcaugagcuaauugauaaagguuacucucuauuuugcuuacuggauagaguacuggggauguaaaguugcauuccucuauugagcaccuaauauauguuggguaccauaccagucucugggaauauaaaugucucgaaggaauucuucaauauguaaacuaaaauguuguaauacaaugauaaauauaacagacugagauguucauuaacuguuucuugaaugaauaacugaaauaguagugauuaauucugcugaaaguaguuagaaaaaacugcacaggaaagguggcauuuguuggagguggaugaauuggauuuuugaauauagagcugugguugggccacugcacuccagcugaggugacagugagacaccaucucaaaaaagaaaagaaaaaagaaagaaaugcaagcagaaaaacaacccaagguuccucaggcauggaggaaugaaaaugcagggcuuacuggaagaaucaugaauagcguaguauuuagaaaccuuagggaguauguugagaagaagaaauagugagauguggagccaguuucugaaggauguugaauacgauuuugcugagggauuugaauuuuuuucuuugagcaaugaggaauuaacaaagugagcaggagugugacacuccaggaguccaugucagauucuuauauugugcccuccggaaggacagacaccacaucaaagggagugccauucacauccuagacaugagcuaacaugagaguggcugguguagagauuucaggcuucacaguugaauccuggagcugcagaagagaacucuuccuucaugaauuccaccagcccacccucuaugcacauacacacaccacuuuaugguacacauacaugugucugcugcaccauugcaucugccuccuggauguccccaaagguggcuucucuugucacuucuucucugccacucuuagguuccuaaucccugucucucacccacuuugaaaccugacacagucaccuuuccuaggcaugggccaauuaaauguacgugcuuacagcacacgugcccuggcaugugguggggguguagugaaaagcugagagugugggcuucucuuuaugaagguaaagcuguaacauuugaccucuucuuugagcagggcuuucaugaugugcaguaauaucauaauuaaaaucuucauugacgaagagaagccuuucccaauuugcacgaagguaaauugaauuggucaugacagugaaagugauaugaucagaaaaguauuuuuagaaaaauaauccuaguggcaaaauggaauuuggauuagaugggaguugggacagugagaggggagguggucgagagaacacguuuucauauguuccgcuuugcuagaacaggaaucccugggcacgugacuuaggaaugagggaaacguaaaaaauacaaugauccagcauauaaaagguaauaagcaagugugacuuccuuuuccuucuucuuuacucuuuuguuugcagacccucuuugaugacuuuuuuuuuuuuaauuuuuauuauuuuugugugugugugugagacggggucuuagucugucguccaggguggagugcaguggugugaucgcugcucacugcagccuugaccucccaggcuuaagugguuuucccaucucagccucuuuaaguagcugggacuacagacaugugcuaccacaugccuggcuaacuuguguacuuuuuguagagucaagauuucaccacguugcccaggcuggucuccaacuccugagcucaagcaauccaccugccucggccucccagagugcugagacugcaagugugagccaccaugcccgauuuugaugacuccuuguggagagugcuuuaagagcagcauuuuuguccccugagaguuacauguuuguuauuuugcagcuuuuaggauuuaauuuacuuucaguauucaagcaccauguugaucaggaggucccaaggaugccagugaaguuuaucuguauauuuugagauuguuguugucccugggcaauuaaaaacccaaaacucaaggaaguuaaauaacuuguucaagcuucuacaagguuauuguauggcugaggaaauggcaguauuaaauagcuaaaugacuuguuuuguuucacaguaaauugggauagagccaagauuuguaaucauuacuguguuccgcuaagacuccaaaguugagaaaggcacuaauuggguagacugucccauccaaccaucagguucauuccuguuggacucuguucugagagaaggaaaagaaagggccucuuugcuccggauauuuggaaacauuuguguuauugggucauggauaggaaacagccucagaaauccucugccccagugccuccauguuauuggugagauaauuaaagcuccagagaggcugugacuuaaaugacacagauguuuggugacaggaagcaggacuccugauuccaaauuuaauguuuuuucaauuaauaauauaaucugucccuguaacuuaaaaaaacaaauauacaaaaacucaaagagguaaauucauuugugucaaaaagaaaugacaaaaaggagugaaacaauuuaagguaaacaucugacuacuuuguaugaacuuuaaaguauauagauugugaacagggacugaaaguuagucaaugaagauauagaaaacuuacuuucaggguaagugaggaagcaucucuuuugugauguaaaucagaguagaauugcccagauacaggcuaucuuuuaacucacaagggucuuguaaaccaguaauaaauguguuuucuauuugcaguuucaacuaaccucuauaaauuagaaaaauaaauggauacuggugaaucagacaccugcagagcuacuugauaggccuucccucaagagccagauacaagucuguguuuguguguucagaggguaauauaucuaggaugugcauuacaaagagacaaaauacaaauuuuuugguucccagaggucuaagaugguucccacuucuuuagauuauaucagauaauuuauaagacaugagacugauaaaagacaaugugacaccccauaauucaauacaguaacucacagaagaucucuggaaucaguuugguuuucuaauauauuaacaguuugugaggaaaggaaggaagccagguuauacacauugaaaaguaugcacagaugcacccagaauccacagagauguguuuccauuuguaaguauuuuauuacauuggcaaauuacaaagggcugggaaagugggagaugagagauugcaauuugugaaacuauuauuuuagggcugaauuguccagggaacuucaaugugaaagaaaauaauaagacauuuugugugaugucugugucugacuucuuaccuuuauagagggguguugcuucaagguuguaucuuguaaccuuacugcuaggggcuuauggcuuuguaguucuucccaggauuggucagaccucagcagagucaugaacauuucugaccuuauugugacuuucuucaugucaccaccgucuguuuauugguuuugauuuauuuacuuauuuugaaacagggucuugcccuguugcccaggcuggagugcaguuguacaaacauggcucacugcagccucaaccuccugggcucagaugauccucccaccucagccucccaaauagcuggcaccauaggcaugcgccaccaugccuggcuaauuuuuugcauuuuuuguagagaugggaucuugcuauguugcccaggcuggucuugaacuccuggccucaagcaguccuccaaccucggccucucaaagugcugugauuacaggcaugagccacugcauccagccugauuuauuuuuaauacauuaaaguugaguuauuagggacagaggagaaacuuuagacccucugcucuucaaguauugggauuuagggccaacuuuauuaaguaguauuaucuuccauauauauuuguauaacuuuccucauaaaauuuccaucccauguugugaaagaucagaauguuaauuuuaguuaaccuaauaaauaucuagauauuuuaaauuaauuuauugaauguaauuucaaauuaaauguaugucuuaauuauguuucugagcuuuuucuaagucuucuauuuuuuuuaauuuuuaaauuuuuuuauuuuauagagaugcacucucacucuguggcccaggcuggucucaaacuccuagacucaacugauccuccugccucagccucccaaagugcugggauuuuaggcaugagcacugugcccagccuaagucuucuauuuuaaaggccuuccuugcuguacguacucuuugcuuccugggacauugauaaguuuaaccuagaaguagcugcaacauagaggacaauaacucagacccacauuugacagaucuucucuuuucacucacuuauucugccuccuggccuuaucauuuagcuuacuauuuaauaugacauuagaauugucuaacgaauuguugguacugagaauugacugugacugcgcaacacaucuuucuuucuuccaaaauuggcaaaacgacaguugguuaaucauucugcagggcgguaccuaagcaaauggaguccuaucuuuugaaaccagucauuuaaggcugggcucgguggcucacgccuguaauuccagcacuuugggaggcugagacaggcagaucuccugaggucaggaguuugagaccagccuggccaacauggugaaacccugucucuaccaaaaauacaaaaauucacugggcgugguggcaggcaccuauaguuccagccacuuggggggcuaaggcaggagaaucgcuuggaccugggaggcagagguuguagugagcugagccucugccacugcacuccagccugggugacagagugagacuccgucucaaaauaaauaaauaaauaaauaaauaaauaaaccaaccagccauuuaaauaucauucauucccuuuuuucuucaauaacuacuacauuauagaggaguucaaagcccaggauccuugcccaaccgccaccccauggugugugauuucauuauauaacuuaaucucucugagcccauuuccuugucuauacuaugaagaaaauuauagagcucaguugucugaauuaaauaagauacuaucuagaaaauauucucucuggcuuuagaacucaguaagaacucaguaaacauuaguuauuaagcaguuacuauauugugcaggcaugcucaagauuauauguuuuaggcacuuaauuuguaucacauuuuucaauuucuaaaagcugcugucuugcauugucauuuggaccucaagaaaaugaaugauuaugauugagaugaagagucaccaaaguucuuaccaauuuuaggaaguuaguuauuuuauuuauaauuauuuucuacuuuccaugguuaaggacaguaccaacccuuugcaacaucuguuuugcuuuuuguuuuguagagcugugaucucacuauguugaccaggcuggucucaaacuccuggcccauccuccugccuuggccucugaaagugcuggaauuauaggcauaagccacugcaccagccuaacacagcccauuuuauuucugacauuuccuuaugguuuuuaggccagcaauauaaaguugacccucaguuuuccuuggaaguuagaguauaaugucugucucuuuaagacaguugauuuuaaccccagcugcuaauuaggaugaccuuggagagacuuuggcuguuacugaugaaauacagaugccuggccccaugccccagagucugauuaaguggucuggguugggccuguggcaucagcauuuuugaacugugcagccacugcucuaaggaauauuuucaguuuacuuacuuaccccccuacccccauacccuacucccaaauuaaaagccuauagcucaucagcaaauugcaacaauuccagauagucuauagauuaacagcuguuaauuuguagauaaaugaauuagcuaaguacauauauuguuuaaaaauauuuuaagggucggaugugguggcucacaccuguaaucccagcacuuugggaggccgagguggguggaucaccugaggucaagaguucgagaccagccuggccaacaugaugaaaccccaucucuacuaaaaauauaaaaauuagcugggugugguggugcacaccuguagucccagcuacuugggaggcugaggcaggagaauugcuugaacacaggagguggagguugcagugagcugagauugugccacugcacuccagccugggcaacagagugagacacugucucaaaaaaaaaauuaaguccaguuauauuuuauuaguacagauuaaccauaacauaucuccuggaguacuaaaaauucauuuggaguugcaauaucauuguauagggugaaacaaaaauuaucuugauucuugucacacuguaagacccuuacuguucuccuuuuaaagauuuugagcacaccaauuuaugacaacacuuguuuugguuuacaugaguaaucucugauuuuguagugaauaaauggguuuaaccauccugagacaaauucauucauaaucuuuagagaagauucccugagggcaugaacauuccauaugccuguaaugauggaauauaccuucgggagaggaacuuccuuguuuaaaaacacuuuuaacaacugcugaggacuauggguguugugauuaaauuaaaguggucauugagcuguggaguguuuaauucugugguuucuucugaucuuugucugccuuugaguacaccagcacuguuucuguucuauagaucuggcagcuguuagaaaugccaugcguguuugcuaagaauugggugguaauuuuauauacaauaacugcugauuggguugcccaggguugaguuuuuuuuuugauuugucuucccacaugaaguugguuagauuggaaaauuugcuccaauugcuaaagauugcuuuuaaaugugcagcauauuagccacaguuguugccauaagcagcugcaugcugcauauuagcuugaauacacaauaaacauuuuaugguuggaauagugaauaucgcuggaggagagaaccuauuucaaagagaacauaaauuggccuauaaaaaaguaagcagaaaccuuaaaccuuagauuguuagguuugugaguccucugcuuagaacugauggaagggcuaccuuguuacauuuacaguguuaccuagguucauuuuaauuguuucaccugaugcugugguuugaaugugucccccaaaaguucauguguuggaaacuuaauccccagugcaacaguguugaaagguagagccuaauaagaucugauuggauaaugagggcagagcccucaugaauggacugucauuguuaugggaguaggugaguuaugagagugaguuguuauaaagugagucuggcgccuggugccucugucuuguguguucacuuccaccuucccccuucaacugugggaugaccaucuguagacaccagugccaagcccuuggacuucccagcuuccagaaccgugagaaauaaauuucuuuucuuuauaaacuacccagacugugguguucuauuguagucacacaaaacuaagaagacaccagguguccgaguuuggauucuaaucauuuaauggagguaauuuagauauuaauaccaacacagaaguuauuuaaaaaucuaacacggccaggaaugguagcucacaccuguaaucccagcacuuugggaggcugaggugggaggauuaccugagcgcaggaguucaagacaagccugagcaacauagcgggaccccaucucuacauaaaauuuuuaaaaaaauuagccaggugugguggcaugcaccugugguccuagcuacuuggaaggcugaguuaggaggaucacuugagccugggagaugaaggcuguggugagcuaugauugugacacugcacuccagccugagugacagagugagacccugucucaaaaaaaaguacaaaaaacaaaaaccgauauucuacuuguccccagcauucuucauuacuugugaaauugcgaguauauccuuguuguuuuaucuuugaaggggugaaguucugggagcugccuugugugaugaguacacauuuuccuguuuucuuugugugacaaaugacuaccuaagaugcaaauguuaaugcauaauuuaucugaguuuguaauuagagcaaggcacuccaagcagugauuaaguccuuuuuguucaugcaaucuuugugcacugucaugaagaggugggugcuugcugggcugauugcugguccuuuucugauuaggagacaacgcucaaaaagcagcacuucugacuuuuuucagauccuucugaauggcagggagccuugccuccuuuucagagaucuuccuugucuuaaggauaaguggugggcgggacacugccuaaugauaacuaugaucauguaaaauagccacugauuaaagaguaguucacugggcccgccugggugcauuauucucauugggaggcacuuacugggguggggucgagguaauucucuuugauauucaggagauaaauuguacucaucagaaccccaucaguuaguuaaaggcaguuuagaaugugcuuuccugauuuuaagagggaaaaaugccaaaaaaaaaauaucuguuucaauuggaaggaggagagagaaaagccaucucggaagccuggcagcaggccugcagagaagcagcucuuugggcuguugcaguaguuauguccuugucuuaugaaggacagacuguuugugacuacacaagugacugcuaaagagacuuuucauauucauggaagguuuccugugaaguugcaggaggaaauaguuuguaucugcccuuugacuuugcaccagugucagccagaucauacuacggaccucaauuuaggccuuaauagaauuuaacuuuugagacuaaaucucguacuugaguaggaaagcuagaucuuaccguuauccacaccuaccggcaaaaaagggagaggggcucauucaaugcaguccuaccauuagauuauuagcugaccaggacaggaacuguuacaguagguagcuagucaggcaugagcagggcaagagauggcucuccccaaccuccaccaggagugucaggcgaccaucaagugauggucaggcaguuuaaaauaaugauuggucgcagccagcgccagagaaggacagucucccaacagauagaaaacacccaaaacuggugaucagcagcuuccccauaagaucucggaagcugggcgagugggcucaagcaugugcacuaagaggcaaaauggcagaguuuaacugguauaugaccuuccucuaggaaugcuagauugguaagggaagaaugccucaggugagcaugcguacaacuccaguaaacacacugugcaugcaggcccucccaagugcugaaaggccauugugcaugcaggcagcccaccccaagggaagaacugggggagaaggagggcgcaagaccccagaagcaugccaacguguaaaaccccaagucaggccaggugcgguggcucacgccuguaaucccagcacuuugggaggccaaggcgggcggaucacgaggucaggagaucgagaccauccuggcuaacacagugaaaccccgucucuacuaaaaauacaaaaaauuagcugggcgugguggcaggcgccuguagucccagcuacucuggagacugaggcaggagaguggcguaaguaaacccggcaggcagagcuugcagugagccgagaucgugucacugcauuccagccugggugacagagcgagacuccaucucaaaaaaaaaaaaaaacccaagucagaggucaaacugugcacuugaucucucaagucaccuacuuagcccucuuccaaguguaaagacuuccuuucauuccugcucuaaagcuuuuuaauaaacuuucacuccugcuccaaaacuugccuuggucucuccuucugccuuaugccccuuaguugaauucuuucuucugaggagguaagaauugaguuugcugcagacgcauguggauucaccaccaggaacauacuuuggugcucugugacuuggauacguucugcugcuaacagaaccaaggucuguacuucugaauguguggccacuauugcaaucccaaaguagugauggguuuuaauacucguuggguaauaacuuugcaacaaucuggcagugacacuuagcauugcguguauuuuccuucguauagugagugcuccagacauggccaauccacaauucucacugaucaguucugcauuuuaguucauucugacuguugagcugguuaccaagccaguuagcucaguuuucccaaggugaucuugcuuuucaauaucaaguauaugauuuggcuugaucuggagaugcaguguuuaauagauguuaugagcaguccauccuagggcucaguaagaguguguuccuuaauacuacaaaguucugcccccacuaccauuggaagccaaagugcacccccuccccaccccccguaauuccuuguguuucuguugguuagauuucacacaucuuuguucuuccuuucuuagcuuaaggcacagucuuuuacccaggacucucaucugacacaaguaggaccuuuccuucuggaaaaugacaaaaauauucccaacauaaaaauuaacuucuaaaaaucccugcacaggacugaacugacugaugcuuuaggguuaucauauuuagaaggaaaaaaauggacuguuaaaaacuuuagacaaauuaaacaauuuauuugagcauagaaugauucguacaucaggcagccuuccgaacaagaaguggguucagaggccuggugcaguggcucacgccuguaaucccagcacuuugggaagcugaggcgguuggaucaccugaggucagcaguucuagaccagccuggccaacauggugaaaccccuucucuacuaaaaauaugaaaguagccagugugguggcaggcaccuguaauccuagcuacucaggaggcugaggcaggagaaucgguugaaccugggagauggagguugcagugagccaagaucgcaccauugcacuccagcugggugacaagagugaaacuccgucucaaaaaaaaaaaaaaaaagugugguucagagagcucuacucugcagugugggcacacagcauuuauggauagaaauagaaguaggguacagaaacaguuuuauugguuacagcugggcauuggcuuuauuugaucaugaucuaauccauugguggccugugauugacagacagcuaauuguuacaaaaguauacaguacaccuaaguuaggcuuucaguuaaguuagguuauaauuccugaaguagggacuuaaaauacagaacagccgcaggccaaauuuauuuaacaggauguacuuauacuaaaaaaugaucuguugcuuaucugaaauucagauuuaacuagguauccaguauuuuaucuaaccaacccuagaugcaaguaguuuuuaaauuuuuauuuauuuauuuucuugagacagagucucacucugacacccaggcuuggaguacaguggcaugaucuugacucacugcaacuucuaccaccuggguucaagcgagucuccugccucagccucccgaguggcugggauuaccaccaugucuggcugauguuuguauuuuuacuauagacaugguuucaccauguuggccaggcugguuuugaacuccugaccucagaugauccacccaccucagcuucccaaaguucugggauuauaggcaugagccaccaugcccggccaguuuuuuuuuaaaagaaagaaaaagauaaaggaaauaacccuguugauauuuagcuggggcgaggauaaggugggaggggaaaagcaguagaaguguuuuccugaguaccacaacugugaggaaaauugagcucacuccaguucacaacaagcuaaacauuuucaaaauuaugcuagaaacaguaggggaaacgaggaggauauacauuugcagugcgaguagcgagguucauagaagauauucccucugauacugggaaaugaaaaauagaacauuacagcuggggaaguucuuuauaguuuacuuggucugauaucuuccuuuccccuagggggaaauuggaacugcaauauuaagaggcugaguuaccugaccacauuuucaucaucauuuagaggcugaacaaagaccagaaucuugguauuuauuugauccuucauucuuggaaaaaaaccuguacaacaugacucugacauaccauaaguuuagaggcaauccauguaaaauuaagugcuuuugauaauggagacaucuaaauugagcuuucuuguauaaaagugauuacugcagaaauuaaaguaacagucacugaaaaaaaaaauucugcccaguuucagaaauugcacuuucgcuucugcaguggccagauucacaaugcccucagcauacauucuuaauuuauuuggucuucuauagguagcaucccuauaaacugagugaauuuggauuaaaugauuucaaugguaacuucuaagucuaugacucagaaaucuguauugucugaaucucucuuaaggaauuuccagucuuacugauuucagacauacccacauaaaauagagaugauuuaguuggcugggcgcgguggcucacgccuguaaucccagcacuuugggaggccgaggcgggugaaucaugaggucaggagauugagaccauccuggcuaacauggugaaaccccaucucuacuaaaaauacaaaaaaauuagcugggcgugguaguggaaaccuguagugccagcuacuugggaggcugaggcgggagaauggugugaaccugggaggcggagcuuccagugagcagauaucgcgccacugcacuccagccugggcgacagagcgagacuccgucucaaaaaaaaaauuaauuuuaguugacuaaguucaauuaaaaguugggcuuugcugcagcuguucauuuagaaaaaggucaaaauuaaaauucagcauauuuaaugcagaaagcaaaugucgggguugagggauuguaguguuaacuggagugggccuucuuggagaauaugaguugaacucaaccuugagguagcagaacuugaggacuuagguugaggguaggaggagaggagaguuuaagaaaaccaaacauuggcuaccgcauaaaauuugugcuuggaaauagugucaaauagcauuaccacaacuuccauuguccaugcucuuaguucuuccgugauuauacuugaaucccucacacuggcuggucuacucauuccacuucuuuucuaaggaagcuuuuucaggguccucccagccacucucucaucugacuggguaaaagauaaauugacaaaugcgugcaucuugugacauguccagaauaugacuuaauaauguuguuaaauuauugccuucucaucugcgugucucuuauguucugcuuaaagagauugucaguuuguucaagcucuuuuuaguuguugcuccuccagugccuagcuuugagcuuuguacacgguaguuauugaguugaguaacauaguuuguucugagucauuuguuccacaugcuugaagacuuggcuuaaccuaguagauaauaggaaagaaauggaaaugcucuuugaugaaagagccccucucuuauucauccuuuuuaaauuuucuuugugcccauaugcagcagcucucagcaaaccuauauuuggcaguguggccuguaugacuaaagaaauccuggccaggcacgguggcucacgccuguaaucccagcacuuugggaggccgaggcggguggauuacgaggucaggagauugagaccauccuggcuaacauggcgaaaccccaucucuacgaaaaauacaaaaaaaaaauuagccgggcaucauggcgggcgccuguagucuuagcuacucaggaggcugaggcaggagaauggcgugaacccgggaggcggagcuugcagugagccgagauugcgccacugcacuccagccuggggcaacagagcaagacuccgucucaaaaaaaaaaaaaaaaaaaaaagaaauccauagaucauggacccacaaaccccuaguuuuaugagggaagugagacccagaauaguugauaacuuucucaaggcuacuaaacaugcaguucuccucacucuagagaguguucuuuuuuuuuuugggggggggggggauaccuugcucuuucucaucuuugccuggcaguacaaaaaauuuugcuagauccaaggguguucaauuauccaucucuacccuuuccuugucguaggaauggaguagaggaacaccuagaagucaggagacuuggcugcuucuuaacccuguacuacauuugugucuuagagaauccacuuaauuucuccaaguuucuguuucuacaucuuuagaaaugggguaggccucaugugaaugcuaggucucuucuaguuuuauuuaguaauuuagcacuaguucugaauucuguugacuuucugaggauccaaggaucuucuguucuccuucccucuuacaaaucauuuccacaguuuuugcuaaaaguagagggguguaacauguaugggaguuaggggaagggcagagguggggugagggagauggaucugggcuauggugugcagcagaccuagugcccuucacucuccugcccgucacucugcagugguagcaugggaugcaaaaaaccagccgacucgacaggauagucucugacuuuuggacauugaguaucuuuuugguguuggaugccuugucuucacuuucccucuucuuguggucuggguuguuuggugucucgaugucugugaagcauaauaagacaaagagcagacagaacugcucuuucagagugucaccagagauggaauaaaggcuccuaaggaauucugaggugucgugugaugaagccauggcagcucccucuggugaaggaaagaaaugugcccucuucaccuccuuugaagugcugagccuacccacaaggauguguuuuuucuagaaggaaaagucuccacuuuuggcagcagaacugaaauagaaaaauugagcuugaccuauuuccuuagcagugagugccuugcauuguccucucaggcaguaugaaaauccuugaacugggaaacugacagcugcaaucagacacuugcauugggggaaacuucaugaauuuuaauaggagugcugcuccuggaugagguugggagagaaaagagagccaagccaauucaaacaaaaggagcagaaggggcuuuauuacaugaacagcucauggcagugaugagaguaauauucaaauuauuuauuugacaacgauuuugaugauuuaagagggaaggauugcugaacuccuaugaagucgaagggguuaugaaucuuccaugauuauuaaucccacuguacugaaggcaaagaaggaggguauaucaaaacaugaauugcuaacaguagcaguccucagacaccgcacuuuagugauacccaggaaaugaacuccgggaauggcagucaccacuacucagauaaaacugcuucccucauggacucaccacacacaggcacagacgcaugugcacacccacagagccaguuucuggacauccuuucugcccucuuugauguacguagcacuuccccuacugaguagccaugcggcauccuguuuguccaggaaggaaguguuggaaucuguucucauugucagaccucucuuaugaagcugcugcuugucagcauugauauucccaagguggucuccuaagucaggaagaguauagaggcagugcuucuuguuuuauauaauagucccauccacuucuuucacaacgugccuuccaugccacucccagacuaauguuugucagaagcggggacugcuuuugaaaauucaugcaaccgugagcuacuuuuguguuugcggccacgcuucguuuaagaaggggaccugaggccgggcacaguggcucacaccuguaaucccagcacuuuaggaggccgaggcaggcggaucacgaggucaggaguucaagacuacugaauguaguaauuucagagucccacuuuucugaauaaaucacaaaauaauguuuuaagugaagacgguacuuaaaaaaauacauuaggcugggcgcgguggcucacaccucuaaucccagcacuuugggaggcugaggcagguggaucaccugaggucaggaguucaagaccagccugaccaacauggugaaacccuguauccacugaaaauacaaaaauuagccaggugguggugaugugccccuguaaucccagcuacucaggaggcugaggcaggagaaucacuugaaccugggaggcagagguugcagugagccgagaucacaacauggcacuccagccugggugauggagugagacuccgucgcaaaaaaaaaaaaaaauauauauauauauauauauauuuauauauauuuauauauuuauauauauauuuauauauauuuauauauuuauauauauauuuauauauauuuauauauuuauauuuuuuauauauauauaauuuauguauauuuuauauauauuuauaauuuauauauauuuauauauauuuauaauuuaucuauauauauuuauauauauuuaucuauauauauuuauauauauauaaagcuuuguucagcaaauuccuguguuggugggacuauuuagcccagggagauuucaaccaaggacgguuaccugugagagugcuggcugacuuuccacaaaccauuuaggaaguacugaagaaaacaaccauacgcugaacagaaccagcaauuguggucuccagauucaggagggaacuaauuucuggguguuugagccagucuuucuccuguggcuggaggggaaugaaauggguauuuccaugggucggagaauugggacucacgacagacuaaggcagaacacgugagaaaugcaagugagggcuguccuucacccagaugaaggagccccucuuugguccccugccagggcuuguugucaaccgguggaggugguggaggaaggacuuggugagucuuugucccaggccucacaguuuugacgguuucauauuuagucuugaaaaaugaucauguaaugaauguauacaguuguaauuucugugagcuuaaauaauguguugcacuuacuguagaauaugucuugauuccuguagcucauuuuggcgugucuucaugcuuuaguaagguggaaguggcccugccucuuggcauuggagaagcccucucuccccucucuguaccgugcuccuuccuaacucuuggccuauucuucuguccauaauagagcuccugcacugaggucuacacgggcucccauuuaucuuugccugugcuguaagccagaguaucuuuaaaucguguaaguugcccgaggcaaccagcuauggcagaagaagauagguggcuggaauuuauugcggaaguaacauuuauuuacguuugggaucccacuaauguucgaauccuugcuucugugcugucaugccucccucuugucucaucacaucuguucucugccuaagccccaugguuuuccauagccaucuccaugccuauccuuguaguaaaagcuguccuuccgccaugaaucuaauacuaugagcccugagccuggagucccugccucugugcuauucauccacucacccaucacuaaauauucccugagugccuacggcacaggcgcaggcacagugcugagugcucuggguguaagagcgagaaagauacggucuccaggugcugggugucuuccuaacuuuccugagcugcugcaagcucauggugaccuaccuaagccuccacccuugauauucaaucaggccauauccaccugccuacguucccaaguuuccuugccacaccaugagaauccaagggugacuucuguucauaauaauggagaaauaauguaccaaaacaucuucccggagaggggcugagaggccuuaaugcugugguaaggcaggguauucauucaggugccaagauggauuggaaaauauccaagaaguaaggaggcucuucuucucaggcuaaauaacagccuccuuguugggaagggaauaaucagucccagcuggagaaaagagacugcauucccuuugcuuuuccauucaaaucuaaucuuaugacaugaguuucugacaugaguagcauucuugcccagacuuguggccccagggaggggaugguuauuuaagacagcuggcuccuccagcaaagcauagagcuugaugauaaaugcuuacagacaacuucccuuacuugcuggucccagucccaguuuaauugacaccccuagagauuugcaaaaaagaaauagauguuucuuugaacggauaucaugucucugaaugcaagaaaaagauaagaugcuacaugcauacaguucaucaguauuucccagcuuaaggaauucuucagggagggauuccuuuuaugcauucccugugaaacaaguguccucugccuuuaaacccugucuuguguuauaauguagaauaaaucucauaugauuuuguuuuuccuuccuuugcuuuguuuuuuuaaaggaacucuuucuaugaaucagugauuuuaagacaucuugcaggguuuuuuuuguuuucucuagaagcuuagauauagcuccaaccugaauaauuuuagguuuuaguuauuuuaaaaugcuuuuuuuuccgaguugaugcuccuuuuggucaagaagcccuguauggaguaacagcucugcauaaauauuuaggcccaaaugucaagcauuugcuucacauuucuuuuucauaauuagagauguagucuaugggcgaggaaugaauugauucaaacaucuuuuccuccaucgaagaacuuuggucacuaaaaugguuauaacacauacacuaaauugaacauucugagaaaggcauuuauuugaaagaauuuggaaguauuaaggguauaaagaauuuaucuuugcaguuuaugaaaaguaaugauauuaaugauagaauuaucuuucaaaagcaaaaguuugaggaauagaucgaugagccaaaaaggagaguguaagaaaaacuaagaacugcuuagguuucaaaaucaguacuuagugaaaaaagaaaauuguaaagacauaaucaguaugacauaacuuacauaaaaguuuugaaacauaccaaauaauauuccugguugucuguggacacauaccucuauaauaugaggucugaaaacauggguuggaaggauauaugccaaaugcuugacagaauuguccuggguugguggggaaggaagcagggcacuggggcuggggaccaggaacaaaagagaauuuaacuuuguaauguuuuguuuccauguauuaaagggaucugaaguagacaugaccaaaugauauuuguuaauucugggggcugggaauuauuugcuguaacucuucaauccugaauuaaauauaugaauuaccuuaaaaugaaaacaaaaagaguuuucuacccucauugugaagcuccacguaaaugggggcagagguucacagccaacagucauaaccuuucuauggguauuugcauauuuagaguaggcauugauaagccaauuaaucuaaauaaugaacuaucuugcuuugaauucuucuaaacuaaguauuugcucuaucaacuugcaaaucaguuguacauauguuagcauaaaaaguuuuggcuguauuucaggaacaggugccuuuuaaacaggaaaauuuaauugugguguaugccucagccaauaucaauuucacuuuuaaaauguugccauaaauaauucaaacggauggcaugcuuuucguuucugaacagccacaggcauguagcuuauucagaggauuucuucgaccguagaugugagaacuucaucuacuaagaaggcugcucuagggaaaaaaaaaaaaaaucuuauugcuuuucuuguaagauuuauguugguuugaaaaugaaaauuuagauuccuugucaugugaaaacagaugcagcuauacaaaccaaaaucuuguuugcagcacagaacugccccacugauuuuggacucuaaucuacucaccuugccggaccacaacuuaaaacuaggaaauaagcagagagaacuuugucauucggcagucugaaauuugggaacugaaguuuauuuucuuuccuccuaaucaaagccucuaacuuucaaccaguuuacucuuauuuuacacuuaaguuuccuaaacuugaaauaucucuuucuaagcucacaaauguuaaaugcaacaaaucagaaguugguguaggggcugcuaagaaagagauuaagauugucuuuugauacaagauacaucuugucuuuugauacacgaugccaagggagggaaaauaauuuuauuaagaagaaauaaaaauagucaagauuucuuuucuuuucuuuuuuugagacagagucucacucuguugcccaggcuggagugcaguggcgcgaucucggcucacugcaagcucugccucccagguucacgccauucuccugccucagccuccuaaguaacugggacuacaggcgcccgccaccaugccuggcuaauuuuuuuguauuuuuaguagagacaggguuucaccguguuagccaggauggucucgaucuccuaaccucaugauucacccaccucggccucccaaagugaugagauuacaggugugagccacugcgcccagccaagauuucuucuuuuaauagugaugauuuuccuagaaacauaaauagucccacuguaguagaauguagucauggugucuuugcuauucgugcugaauaguuguuguuuuccaaaguaaguauagaauuaacuaacuuauuuucaaaauaaguauagaauuaaccaaccauaccuccuuaauugaugguucucuuagucuugauuccaagggucuuaacuaccuggaugugcucauuguaugcuaaacagacaccaaaaggguugacuaaucuuauuuuuauguacagacaaucaauucccgaaaaaugcugcagguuuugcauugauuuaaaaauuuuaaaggucauaauauuauuaauacauauuuauacccuuagaauucccaguuugucagcaaauagagucccauucuguuaugccauugaaaguaaugauaaaaacugcaguuacuuuugcaccaaccuaauaaaaccgugauuguaacuuggguuuguaauuuguuuuuaaagagcuagacaguuuguuugaagauaucaauuuccaaacauauucaguauuccguaagguaugggagauuggccuaaacuuguaccgaccuuaugauauuacuuagaaguugauccuuaaaaaaaaauccuagauauaagcuuacauacuugccauucauuuacuccauaaaaguaagauguagaaaaaugguuugauuauuuggguuuuagacaaguauaaaaaauuaucugacuuaccucaauaagcccuguuauguuuuuucauagguuguaaauuacacuguuaauacuucuuuagggagacaguaugugguccaaguauaaagaguauguuccaaguuagaguguaaaucucagcuccucccuuacuggcuguaugacuuugcacaaguuacuuacccucuuugagccucuuuuuguguaaaaucggaaugguaguccccacuucacaagguaguuuccugggaguuacgugaaauucauugugucauugcauaguuagguauuccaugcuuguucccauuccauuucuguuggaaauagaaaauuuuggauuggaagauugccaccuuuugcuuugguucucaauugccuucucuauaacacuuaugauuucauuuuuuguuuauuauuugaagaugacugaguccuagagagcauuuauuuaaguuccagucacaucugcuugaacacguuccacucuagcuucuucagaauaaaagcucaugaucauuggacucaauagguuucuucugacuucuucaccugaguucuucuaaaacuuugcucuauuggggcgcagaacacaauaccccaaagugaaggcaucagaaacagccugagaagcagagucucucucugaccuucuccugcccucuggucucuuaccccucuuucucccccaggcaggccacggaaacuagaaucucuuccccaaggugggucguagaaaccagaaacccuuuuccccaaggccagccauaaaaccugaaaauauuccucuaacuuuccccaaaccuuucucuguaagagcuggccauaaagaaauuaucugaccuaccuugugugguaguagaucauaagacccccauuccagaaagaguccugccccaaacccaggaggagggacugcugcacacagagaucgggaacacccuggacagacaggcauugcugaguuucucuaccucagucuacuagcauuaugucacagucuuuguccaauuauauuucuacauggcuguccacucuugauuggaccuaagcauacaaguggauagcuguaucuuugggucuucauugugagggcuugucauguaaaaaaauuuuuaaaaauuuaauaaauuuguuaugcuuuucuuuuguuaaccugucuuuuguuauaggagugucuaccgugauccuuacgauggggaagaaagggaucaccuuucugccccuacaguuccagccuucuucacuugguggaaagcuccagaguggguuugaaaccuuuuccugugggaauuaagacuggggguagggagcggcucucaguagggggcaaucagaggacugacauagaaaugaccucuuuuacaggaagaaugaugauugcuucuccucccagaauauauuuagaagcucaauaucucugaauucuuuaaaaccuuuucauccuauugauagaaagaggcacuuccuaaagccaaaucuuuggucucaguauuccaugauuggucuuaacuggugaauaguuauuauuaugagaagguugcagugggaaaagguuagauccaguguuuuuuuauuuuuuaggaagcaaaccaaauguagggagcugucugcagaugccuuugagaagcccuuuacuguaagaacugucaucuuuuagcuucaguucuguuuccauggcaaccacauggucccugagugccuggcugaaugaauuuacaggaagcugaaaaacauugcuauucuaaguagcuuucuucuuccuguagaaaggguccuucccuuacuguaggccagccaacauuuacugggaacaaagagggcuauuuaugcucauuguacucugggccaaggguaaagaaauggggagaaucccagccucugcuuacugaccugugaauuuguuuaucugguuguugucacuagcauuuuggaaggaccaaaugauuuaccuuuccuuuauuucagauaugguuucccuguucauuuuuuuuuuuaauuaaaaaaauuuuuuucgagacaggaucucacucucuuguccaggcuggagugcuguggcaccaucucgguucgcugcagccuugaccucccaggcucaaguuauccucccaccucugccucucaguagcugggaccacaguugugcaucaccacgcccagcuaauuuuuugauuuucuguagaaacaaaguaucacuauguugcccaggcuggucuugagcucccggccucaagcgauccucucaccucagccuccuaaagugauggaauuacagacaugaaccacucuaccuggccucccaaaucauuugaagcaaaacuuuuauccuagggguagaacuguuuaagaaaaauggagugggaaagagucaugucuggaauaacguuaguuacaauguaguuaauuuguugauuuuauagccuucaagcaucuagaugggcaguuauuuaaaauaagugucucaugccagcaauagaaauaaugauaauggcucaggcagaucuuaggucaucguuuauugcauguuaacguugugguauguucuuuacaucuuuaaaaaguuguauuucugcuugcuuacaugauagaaaacuuauauguaguagaauauuguuugggggguuuaaaaugaaaugcagcucccuuuuggcauuuuaugacuuguaacaugaccauuucuuagggaaaaaaaugaaggcuaucaauauaguuuuauuaaaagccuauagaguauuuuuaguuucaaagauaagccauuuacuggacuuccuuucugaguuccuucaaauccuuuuuagaagcaauguagaaauauuuuguuuuuuuaacuacucuuagauagagacagccuuuuagcugaauucugauaaugaaagcauuuaauuucagcaggagguagggauuuuuguucucucucucucucuuucacaccaccaaccgcccccaccaccugccaacacaguuaaagaaaauccauaaaaaaugcugaucuauucuauacuccugauaucuaucuucccauuacgucuucuauaaaaugugguccuuguucaaaagauggacauuucaagagggcuaggauuuucccuuuacucuguuuagauaaguagaugccaguuuaaaccaguuucucacugagauccagugauguuccuuuugaauuuuuaucagaucuuagaaaaugucaauaaaauagccguggaaaauaucucaagagacccucauuuaaugcaaucugaagucucugaauagcaccaaauguggaguguaauugcaaauugcagugcuuuaaaucccuucuaccaaauuguugcaguagcagauuucacaaguaguuuuucucaaaucauccugaaauaauaauaaaagagauuuaauucuugaaagagcuuauaugauguaagaucaguuuuuagaguuauuuuaagguguccagggccaaaauuugaucaaccaaguauuugcuauaucuuuuauaaggagcuacauaggauuugacuggucuacccaaacaauuuauagguuaucuugggauagaaaacuaacaucauaaauuugggaaccaggacuacucugcauuauaaugaguugauaggaauccauagaguaugagauggacccucuagagagggcuaccuggaaaaaguaggacccaaggcauuucuuuugauuucuuuuuuucuuuuucuuuuuuuuuuuuuggagacagagucucacucuauuucccaggcuagagugcaguggcgcaaucuugguucaccacagccuccacuuccuggcucaaaugguccuuuagucucagccccccaaguagcugggaccacaggcaugagccaccacaccuggcucauuuuucuauuuuuuuguagugauggaguuucuccauguugcccaggcuggucucgaacuccugaccccaagugaucugccugccuuggccucccuaagugcugggauuacaggcgugagccaccacacccagccucaaggcauuucaaucauuaugcauucaacagaaauguauuaagcaaagccuauaugcuaggugcuauguaaugcuggaauuauaguggugaacaagacugcauguauggugcucagucuggugagagguccagacacaaaaccaggcaguuaaccucaaugauaacaucuaucuugagugaguuagaguauugaggaaacaucuggauuuggaggggcuuugaagauuucuuugaggacaugcaaagcuaaaucuugaacagaaagaaaucgauggacauuacuauguagccacuuaaaauaguguuucuuuuacucucucucagaaaaaugcauuucaacuuuucuaaaagcagucuccuaaaauauaaauaauagcucuuuuaagaaacuaaaauauuuagacuuuagaaucuuagagcaggaaggggucuuagagaaauccaacuugcuuugacaccaacuccuguguacuucuggaaagaguaagaaacacaagauuuccaaagagugucaaugggucaggaaaugggugucagucuuguguuucuucuucuucuucuucuucuuuuuuuuuuuuuuuuuugagacggagucucacucugucgcccaggcuggagugcaguagcgcgaucucggcucacugcaagcucgaccuccuggguucacgccauucuccugucuuagccucccgaguagcugggacuacagacacccgccaccaugcccggcuaauuuuuuguauuuuuaguagagacgggguuucaccauauuagccaggauggucucaaucuccugaccucaugauccgcccgccucagccucccaaagugcugggauuacaggcgugagccuccgugcccggccagucuuauguuucuuacucuuaauuccuaacacaccccacucggguucagaauguaaguguccagagaagaugaucucuguguguccucuuuuuuuuguuuugaggaaaggguuuauuaugcuacuaauauaugcauuguauuaguuccuucucacacugcuaugaagaaauaccugagacugggugauucauaaaggaaagagguuuaauugacucacgguucagcauggcuggggaggccucaggaaacuuacaaucaugccaaaggggaagaaaacauguccuucauaugguccaggaaggagaagaaugagccaagguggggaaagccccuuauaaaaccaucagaucuugagagaacucacucccuaucacaagaagagcacagggggaccacccccaugaucuaauuaccucccacgagguuucuccuccaacgcguggggauuacaguuuggauuacaauucaagaugagauuuggguggggacacagagccagaucauaucaugcauaguauuuuuuuuuuuuuaaucagaccucgccuggcaugguggcucaugccuguaaugggaggccaaugcgggcggaucaccugaggucaggaguucgagaccagccugaccaacauggcaaaaccccaccucuacuaaaaguacaagaauuagccggacgugguggugggugccuguaaucccaacuacucgggaggcugaggcagaagaaucgcuugaaccggggagguggagguugcagugagcugagauagcgucauuguacuccagccugggcgacagagugagauuucaucucaaaaaaaaaaaaaaauuaauuaauaaaucagaccucaagccucuuucacacguuuuuguaucuuuuaauagauaccaaauagggaaagaaaaagagugguuguggcaagcuguuacgagcuagcacugaaauuauggcuggcaccuauucacccuaaccugauuaaucugucuagugaaggauagaaaaauuacuuuuuaaagucgcccucauucauuuggaaaacuuagauggacuccuguagauacguuauuuuucacuuggauguuuccccauuagauccuaacugauugcuuuaauugugcaccuuagcagaaauauuacuuuccccucguuuguauagcuugcuuucacaggccacguggcauccauuauuccugaugagcuucuggaagaguuaauucuucuuugcauuguagaaagaauuuagaagcaaacaguaagaggccuucuaaacugauacacuuuuccucacccuuguuaagaaugauucugagauguuauucauacugauuuuuuuuuuuccucagacggauuuagcgaccugguccauaccucaguguucaacucguuuaaaaaauaaaugguaaaaggaacauacagauuaccagaguuaaagaacacagaauauguuguaaaacauagaaaaauuaucuuaguguccaaacagauauuuuaaagguacuaaguauuuuauggguucuguuuuuaucaaguuguguuccuuuauucccauaauagucaggguguucuucuauaacauucacccuauuguaacauuuuaaacugaaauuauuaguugucuuguccauuuucaucacuagacugugugcuucuugucuuuuauuuaugccuggcauauuauaguaggcacuugauuaauguuagaaugaaugaaugugcaguaguacauuccuuggugagaguuacuuuacuuuauaucagauccugggcauuuuaucagauguucuacauuaaaaaguaucaacugaauuugggccacuacuaggaacaguuaaauacguagucccaggcugggcacagugucucacauguguaauaccagcacuuugagaggccagagugagaggaucaccugagcccaggagguugaggcugcagugagcugugaucgugccacugcacuccagccugggcaacagagugacucuaucucaaaauguguguguguguguguguguguguguguguguguagucucauauacuugugaaauuuaagcaugggcaaauaaugauugcauuagacuaaagaggucuauuguuaaauaugcaaauguaauuuuagcauaaaaauaagaucgaugugcuuacaauucuguuuauuuacauuaucuaaaaaauguucguauuuugcaugcagcucacauauauagauauauaccaaaccauugcuuugcuuuaagucaaaucuuucuuauccauuuuaugguuauuuauuuuugauuuuugagacagagucuugcugugucacccagaguauagugcagugguaugaucauagcuacugcagccucaaacugcuuggcucaugcagucuuccugccuuggccucccaaagcacugggauuaaagacaugagccacugcacccagcccauuuuaugacuauucuagggagcugcugguagacuguguucuuuaaugaucuuuccacagggcuuuuguacauuucuuucccucugccuggaacacuuucccuuacagauauucaugugacuugcuuccaguauuuuguucaaaugucaccuuugcaaugaagccuuuccugaccacccucuuuaguacugcagcacccauccucugcauucacuacuccccuucugugcucuuuaucuucuguugugacauaaauuuaccugugcacacacuuccuuaaugaggucaauaauuuuugucucuuuuuucuuccuuuacugauguauccuguagcaccuagaauagugccuggcacauaaugagugcucaguaaaaacacuuuaaauggguggaggcugaaguuguuuaacaucuugugagauaugucccugucccgaguauaccugcgacauguuuuguuucucaguuguacuuuuuuuuuuuuuuugugacagagucuugcucugucgcuaggcuggagugcaguggugcgaucucggcucacugcaaccucugccuccccgguucaagcgauucccccugcuucagccucccgaguaacugggacuacaggugcgugccaccacacccagcuaauuuuuauacuuuuaguagagacgggguuucgccauguuggcuaggauggucuugagcucuugaccucaugauccgcaccccuuggccucccaaaguguugggauugcacgcgugagccacugcuucuggcaucaguuauaucuuuuauucacuuuauagcugucauuucuuugccaguagcagugacugaauuaaggcauaucagaaccuaguugaaaaauugugcccagguguggcggcuaacauuugucaucccaacacuuugagaggcugaggcagguagauugccugagcccaggaguucaagaccagccugggcaacauagugaaaccuggccucuaacaaaaaauacaaaaauuaaccaaguguggugccgcaugccuguagucccuggaaggcugaggugugagaaucccuugagccugggagguggaaguugcagugagccaagaucgcaacacugcacuccagccaaggcaacagaaagagaaaaagaaaauuguauaauuugguuaacugcuuaaccaaauaggcauucagugacuagaaccugaaucagagggaggcagacaucuuauguacacuauguuugggaauccaaacuuaaacugacaggugaaaucauuaaaaggucaauuaagaagauccaagggccgggcaugguggcucacgccuguaaucccaacacuaugggaggcugaggcaggcggaucacgaggucaggagaucgagaccauccuggcuaacauggugaagccccaucucuacuaaaaauacaaaaaaauaagcugggcaugguggcagugggcgccuguaaucccagcuacucgggaggcugaggcaggagaauggcgugaaccugggaggcagagcuugcagugagccuagaucaugccacugcacuccagccugggugacagagcgagacucugucucaaaaaaaaaaaaaaaaaaagccaaauaagcuucuauggaaaaaaaaagucaccuuuuugauacauuauguuccugagacuuguuaaaugcuucuauuccagauaguaccuugauuauuuacuguuauuuaugcuaaucaaaugccaacuaauuuaguaccaggugaaauauuuccuuguaauaaaaucaauuaaaaauuaacugauuuuuuucagauucauucagauauguuuuuuaaaauucaguuauuucuucaugcuaaauuaauugcaaaaaaugcaauuucccuuuuuaaaaaaaauuauauuaaacugcaguagauacauuuuuauuuggccaaaaaaaauaaaaaucaguucaauuccauuuaagaaccauuuauugaauauauggaugugaaaaauaaaauaguuagaaauauaagguagacauaacugacuauaaaacaagacauuaaugacuacaaauaagguaaaaugaacaagaacuguaaguagaaagaggaccugugggauuucagaugagaaagccgcaugcugucaacuggaaagcagagaugcaaaaguagaggacuugcaccuaaauugcuggguucucauuuguuaccugugucugggcaaguuucucucuuuauaucuguuuucuuguuuauaaaugaaggaugauaauaguauaaccucgugggauuguuguagggauugagauaauacaugccgccauauagacagaaaauucagagagguuaauugaugccuagacuuaguaaguccuaaauguaagugguggugagggcaguggauaauguagccguuguaccacucaccuggaaaaguuacucuggucugagaacucaguuccaauaggagaagcccaugcagagccacaguucauuuggcaaaccuguaucaagcacccgcuaaagccaggaacucuacuagaccugugggaaugaugaacagggaacacccaugcccaccuggaggucaggacacuaaaggguggucaggcugugggugccuguaaauccagcauuuugggaagccaagacaggaggaucacuugagcccaggaguugagacuugaacuccuggcaacucaaacuuaugggcaucauagggagacccugucucaaaaaaaaaaaaaaaaaggccaagugugguggcuguggucccagcuacucaggaaacugaggcaggaggaucacuugagcccaggagguuguggagguuguggcugcacagugagccgugaucaugcuacugcacccuagccugggcaacagaguugagacccuggauagauauagauagauagauggauagauggauaguuagauagauagauagauagauagauagauagauagauagauagauagauagauagauagauaggcagacagacagacagacggacggauagaugucagaaaggccugggaaacagugugaggaaaggcauggugguaagaaucagcucugaagcuaaaaauaacccagauguccuaaacugaugaaaaaaugaacaaaauauuauauauccauaccauggacuauucagcuauagaaggaaugaacugcugauaaauguuacaacauggaugaaccuuaaaaacgugcuaaguaaaagaagccagucaucaaaugccacauaucuuaugguuccguauacaugaaguguccagaacuggcaaaucugcagagcuagaaaguagauuaugggugccugggauguggaaagggguuuauggggagugacugcuaaugggcaugguguuucuucuggggaugaugaaaauauucaaaguaaauugcagugauagucgcacaacucuuaauauacuaaaaaaaacauugaauuguggaccuuaacugggugaauuguguggucugcgaauuacagcucaauaaacgcuuuuaaaaaaacaacaaaacaccagcaguuugggagaccaaggugggaggauugcuugagcccaggaguuagagagcagccugggcaacauagggagaccccaucucuaccuacuuaccuaccuaccuaccuaucuacauaaauaaauaaauuaagauuuagcuaggcauggugcuacacaccuauggucccagcuacucaguagguugagguaggaggaucauuuaagcccagagguuaaggcugcagugagcugagacugugucacugcacuccugccugggugacagagugagacccugucucaaaaggaacaaacaaaaaacccauuagcacugugugggcaggcaacccaaagucaucuugacuuggcuguugggugaacagaagacauggcaaagacaggguugggggucaguugaaugcacccuuugaaggagcauuaucuugccauaaaagguagccacugagggcugagugguacgugaucacccagucauaccugugagagacaguauaccgauacccuugcaaacagaaaugacagauuccagggagugguggaagauagguuagcaaaccuguuccagggccaugucaggaguccagguaagagagaaggaaccaaggaauagaaguagagacgcuugaaaaccauguaagaaguaaaaaggccuaaaugugagcgguuggugaggaaaggagaaaggaugacucccugaauucuagcaugagugaaggggugugugcuaacaccaacggagauagaagagaacaggaacaauugaaaauacaguucuuaaaggcccuggacacuguagcuagagccguuucagugagauacagaagccacaucuugcuugaagagaauuggaacaaacaggcagucuccaugccuguuucucuuacugucugugcagucaacuucuuggcauugcaaaaaggcacaucauuugggucacuuaaauaauaugaccugagccaucuacauuguaucuaguucacuuucuucucucuggagcauuguuuucuaacucuguagugagaccucuuuuuuuccccaaugaaaagcuaaauagugauucggaaaacuuaacgaauauugagauuugucagccuguucaaguacuagaguguuguuuguuuuuuccuaacuuuguuggaaauggauuacuucuuaagaagaaagcuuaccacauaucccauugaaaacuggugaaaauaaagccuaucuauguucaaaguccuagaagaugguucuucuggucaccacugggauaaauggaugaaugugcucccugggauagauccagguucuguggaacugaaacuaauacaguauggaagggaggcccuuuuugaaaaaagaaugugaaauugggcugggcauggugacucacaccuguaaucccagcacuuuaggaggccgaggcaggcagaucacgaggucaggagaucaagaccauccuggccaacauggugaaacccugucuuuacuaaaaauauaaaaaauuagcugggugugguggcaugcaccuguagucccagcuacuugggaggcugagacaggagaaucauuugaacuugggagauggagauugcagugagccgaaaucgcaccacugcacuccagccuggugacagagcaagauugcgucucaaaaaaaaaaaaaaaaacaagugaaauugagaccacauauuuagauauagggcauuagaagaucccugaagcuuaagccucauuagcuucauggcaaaucuucccuugaucuugauaaugcuggugguagggaugaugggggugacuauuaacacauugagcacucaugugcagacauuguuccaagcaguuuuuauauauuaauccucgaaacaacccaaggcacgguagcagagguacagagaagucacacccaaggucacacagugggaagcagaguuguuaggagagggaagaagggcaguauggaaaagaauacuaaacugagagcagaggccuucaugaaugucagcuucaccacccaucuguggggaaccugggggaaaaaucacguaccuuuuugcauguacguccuugacuucaccugugaaaaaggaauauugaugcaugucaugaauccuugacucuguuguucugagguugagagaauguguaaaagugcuuugugaagguaaagugcuuagaaacguaguuauauuacacagcuuucucuuccacuucaauacuuaaaauucaggcuuaaaaauucauuuaguuuugcuuuucauuucacuucuaaugugucuaauuuauuucuuggacaugauuuuuguucucagguuacuugucugcaagacuuuuuuggugaugacgauguuuuuauugcauguggaccagaaaaauuucguuaugcccaagaugacuuuguccuggaucauagugguaaggcaauucuucagcuaauucauuuuuccaucuuuguaaccccugaaaugaaggcuugggauuuagccacucaguuggugcauguuaagaagucugacauguugaggaaagauagcauuggcaguacaauuuuugaaccaaugaaaauaaagaauaacaugaaagcauuugccuacuuauaaaaaaagaaagaaagaaaaagaaaaagaauaacccaaugccuaauucaaguaguuuucacuuuuagcaauucaguucccucucuuauugcauuguuugcauuguuuugccacugagauguuccaugccuuccuucagaauggugguuggcugugccaacuuaaaugcauggauaguguugaacaugaaacaauuagucauccauuuuuugugauguguaugcauaaggaaaucuauauuaaaaagaaauagaugaaaggauaauaacuaucaauggugauuaucugaggugucuuucaaccucacuggguuuuuuuugguagcaacauuuuuuuuuuaauugagacagugucuccuuuugucucccagccuggagugcaguggcacgaucacagcucacugcagccuugacugugcugcuggauucaaguaauccuccugccucagccuccugaguagcuaggauuaaaggcauaagucaccauuccuggcuaauuuuuaaauuuuuuguagagacagggucuugcuauguugcccaggcuagucuugaauuccuggccucaagugauccucccaccucagccucccaaagugcugggacacacacacacacacacacacacacacacacacacacacacacacacacguauacuuacuuuguuuauauacagucauguaccauguaaggaugcuuuggucaaugaugggcuacauauaugacuguagucccaucaggauuuuuacaauaccuucucgauguuuagaugcacagguccuuaccguuguguuacgguugccuacaguauuugguacaguuacgugcuauacagguuuguagcccaggagcaauagacuauaccauauagucugggugaguacuaggcuacaccauguagauuuguguaaguuuacaccaugauguucacacaaugaauaaauugccuaauaaugcacuucucgaauguauccucaugguuaagugacauaugacuauauuuagaaagaaagcuauuucuuuggugagaugaaaaaauccccuuuugcuaacuuuugccaauauauggcauuuucaaguaguauuuggcaauaauaaucucaacuauuucauauguuauugguccugggaauacuguuuuacccuauugucuuaaauugcuuuaaaccuguuuacaguaauagugauuauuuuagcugguaguaaagucagcuuccucuuuaaaugaaguaaaauuauacacacaucacauuucagaggagagggaucuuagagauacgauccuccucuuuaauuuuaugaaugaggaaagcuggcuuuuaaaaagguagacaguaaaccacuucuaguuguaguguuucugacaguccaggauuagagaacuguacuaccaaacaaauacagugauaccuaggcuuuuaaaauuuugagaggauacauucugugguaccaaacuuccuugugucauuacuucuuguugcacugugucagucauucaugagcuugggggucauucaucuacucuuuuuguuuuucuguuuuguuuuucaucucugccaaauuugaugguuucuauauuauauucuguuggacuggcccuauuucagccuggugacaccacuggaaaguccuuaauuauagauaauguccuguuacguuaucugugcuagugcucucccucauuccugugugguuaagguuaaauaaaauaggcauuuauauauauauuauauauaauauuauauauuauauacaauauuauauauuauauaaacaauauuauauauuauauacaauauuauauauuauauaaacaauauuauauauuauauauuauauuauauauuauauauuauauuauauauuauauuauauauuauauauuauauuauauauuauauuauauauuauauauauuauauaauauuauauauuauauauauuauauaauauuauauaauauauauauuauauaauauuauauauuauauauauuauauaauauuauauauuauauauauaauauauauuagauauauuauauauuauauauauuauuauauaauauauauuauauuauauaucaucuguacuuuacaucuuucuuaaauuuagcuuuaguuucauaauauuucuuugaugucaggugucauuuugaaagcugagccacugaaacuaaauauguucugguuuauaaaguuaauauguauaacaauaacauuuguugagccacuuacuuuguauguacaggcauuguacucagugcuucauggguauguuguacuuugaucuaagcuacuuggaucguugguaguuuuuguugauggugaacagggccugcaauaguuagaaguuggugagagcuauugauuuauuccuucuugaucucgaguuacuuaaccugcaaaguagggauaauaauggcuauaagguuuucugaggaucaaaugcauuauaauauaauauaugucaugcaguugggagugugccugucacauaguaauaugcguccacugcuaucuuuguuguuguuaauaauaauauuacaccaacaccauuaugugguaaaauuuuacaaugauuuuacaaugagcaagucucagaccuaauucugccacagauacguuuauuaggaggcaaauuuuuuuuuaaucaguuauuuaacuuguauuguaaucuuaaugaggucccaacucucugcuuuuaggcuucuaauaacaucuuguguuaaaggcccauucagaaugcauggaauucaguuuaccugaucuuagugaaguaacuacauccucgauuaaucgauacaggauugguuccaauucauaaaccuaggauauaguucugcaguucuagguuguuggcucuugauauuuacauauccugcucauauaaaagaguagcaaugcauuuaagauguuucuaauaaucuacacacaccuuucaacagucggauacuuuuaacauccacaaugcuaauuaagcaaaaauugcucccuuuguguaagguuuugauuagaaucuuucaaaugcuaacuagccuccccuuggguguauuuuccugguuaguguacuucacuugucaguuuacugccccugggguauagacuaaaauuaauccacauuuuaaacuuccugcauaaauugaaguauuuuagaguaaacuacuacagacaguauguuaccuaauuuaacucuuauaacaagccuaugauguaaauuuuauucuuaucccaauuucacuggggcaaaaaaaaaaaacucaggcuuacagccaaggccccuaguuaacaaaugucaaaugcauaauucauucaaaaucuacacaacuccaaaaccuauguuuuucauuaugcaauuuagaagugauuacuuuagcaauacuuacuucugguacucuaaauauuauuuuauuuggugauuuauggaaagaacaguuguuuaaagcuauucagcugggcacggugguucaugccuguaaucccaucauuuugggaggccgaggccagcagaucaccugagaugagaaguucgagaccagccuggucaacauggugaaaacccgucucuacuaaaaauauagagaauuaaccaggcgugguggugggcgccuguaguccacucaggccagaggcugagacaggagaaucacuugaaccugggaggcaaagguugcaaugagcugauaucacgccacugcacuuuagccugggcgacagagcgagacuccgucucaaaaaaaaaaaaaaaagagagagagaaaaagcuauuuuccucauuuuugauguuccauacuuugagaagauggaacauaauucaggaggggguucauaaguuagagucccauacccuuuuaaaauaaggcagucaagaaguuggagagcauaauaaaauuguagucuuugccuaucaauacuacugauuuaaaaagauaguugcacauguauagauuagcuguggauguuuguguguaugaaguuaggacauuggaauuucuguacuuaauuagcuccaucuggaacacugaggugauaucccaagauguguagccuuggcugggcgugguggcucaugccuguaauccuagcacuuugggaggcugaggcggguguaccgccugaggucaggaguuugagaccagccuggccaacauagugaaaccccgucucuacuaauaauacaaaaaauuagcugggcaugguggugggcaccuguaaucccagcuacuugggaggcugaggcaagagaaucgcuugaacccaggaggcggagguugcagugagcagaaucgcuugaaccugggaggcggagguugcagugagcccagaucgcgccauugcacuccagccugggaaacgggaacaaaacuccaucucaagagagaaaaaaaaaaaaaaagauguguagccugacugaagguaaacucagguguacuuuugggacaauugcuuuguauguuaaauuguuuaacaguaauaccuaauuaucagguaauaguucuggucaguaaacaauuacauguaacucugcuuuuggucguuauuaaaaccagauuuaguuaaugcacuuuuguucuuuucuagaaugucguguccugaagucaucuuauucucgauccucagcuguuaaguauucuggauccaaaagcccugggcccucucgacgcagcaaaucaccagcuucagguaguuaauggaaaaggaauagauggucauagcaggaacagaucauuuuccuucuguuuucucuaauuuuuaugaauuaguagucuuugccagggucguaugcagccaaguuccagaaaaacagagaugaugugacuuuuaaaaccaaaagucaagucuguuuccccaguuacaauaauucuccuaagagacuugugugguuuuguucugacacguuuucuugggaacagcuugaugaucuagauucugcugguauuuacauagaagcguuucacauuuugaccccuguauacugcauuuugaauuuugugcucuaugauuguggauaauuauuuucuuaacauuaucucuuuuuuuuaaaacacaugcacaugcacacacucugcccagaaauguauuuacuugauauauuuccacuggcuucugccucaucaaaugauacauucauagcagugauuauuguugaaaaguaguauuuugcuuauuuaagagucaaacaguauaauuaaguuucuugcgagucuuaagccuauaaauuugucauaauuuugacuggacauuuuuaaacauuaaaaacauacauaaauaucuucauauauugauuuuauggguuuguuuauaguaauuaagaauaagccuguuaauaucauuuccucugaaggaaagaauugugaaaaaccaugauuuuacaguuggugaaucuagaacaugggaaaguuguaucaauaacaauggccucaagcaucagacuuuauaaaagaccaaguuuuucagacauuccacuauucgcccuuuccccuuucagcacccccccccccacuuucuguagggcaggucguuuuacccuuuugaacgcacauuuagagcugcugaauaaccacucuccuuacugucuucuacucuguguauacugcauguguacaguaaagcgggguggccacuacuccagugccuauucuacagccaaauccccaggugagccaugacuauuguggcuuuguugcucugcuggguuuuuguuuuuguuuuuugccacuuuucuguuuccuuuugcuccauuuccaugaauguaucuggcuuauuccagugcacaucugugugguaugaaaugcuuugcauugcacaagacacuuuagccuccucuauuuauuagagaacugguuaucaucagaagauuaccaagugccugucuguauagucaggaauacaaagcgacugaggaggcacaucaccgcaagggguccaucuucuaguuaauuuggagcaauguucugcuacugaaaaaggcugaaguuuguugguaaugugaaaauagccauagaagcaauuuugaucuucugugcucacccccuccccacccugggguuaacaguuuaguaaucacugaaaucuuagaauuauuaguacuucauaauagcauaugccagcauaggauuaugagguguuucuuauacauacagggaagcaacacugcaauauuucuaguugucaaauauuuauuuuccuagaguuauagacucaaccuguucucucuaaaaaugugacaauuaacaaugagcauuuuuaucugaaaauaucucuguuauuaaccuuauuucaaauuguaucaugcuuucuguaaaguaucuuaaaacugagaaagcuaauauagauaugagacuugcauaaauacacugaccuggguuaaucaaagaguagauguaguuuuggugauagcuuuacagaugcuuauuacaucaguaaaaauaauuaaauagcugggcacggagguaccaccuguggucccagcuacucagaggcugaggcaggaggaucccuugaggccaggaguuugaggcuguaaugagcuaugaugauagugccugugcauagccacugcacucuagccugggcaauguagcaaggcccugucucuuuuaaaaaaauuuuaauaaaagggagagugguucaagaaucgggugugauuaauucaauuuugucccccugaggucaaaagagaaaaauuaacauauugaacuaaaaacaugucucauagccacauuuguccugcagagcaguagcuccagaagauagccuaauaaauauauacauaacucuugaauuuauaauacuuagaaacugauuaaggaaaaucguagcauucuaguacacacaauuuuaaauuaaguccacauuuggauuugaguuaauagaguaagccucaaacucaucaaguaaaaguuguaagauuuuaaaaccacauuuuagagagaaaaugaucuuuuuuauaagagauuaauucaaaguguguucgacacuuuagcuauagaaaacccaaagccugagucaaccacugggauuugagugaaucucaagaaagcuacuauauuuaucuguauagugcuuaucuguauagugcuauauagcguguucuuuccacuuucuaccaccaggaagaagaggauuuuguauuauuaaaagccaugguacccaggagugcuuuuacagauuacuuuagcuaugguguauuuguugccauuuuaaaaauuccaugggacuaauuggaacucaaacugagcugguaacuuuaugaacauaauauuguaccuuuucaaucuuggggcagaaguccuaaaugaagucuugagacugccuugagugaagucuucugguugacuaaauccuucaacaaaacucugucagaauagcuaaauaguauguaaaaagcacauagauauuaagcuagguaacauaaauggguaaaugguuacucuugcccaggcuggagugcaguggugugaucucagcucacugaaccuccgccucaggaguucaagcgauucuccugccucagccucccgaguagcugggacuacaggcgugcgccaccacgccuggcuaauuuuuguauuuuuaguggagacgagguuucgccauguuggccaggcuggucucuaauuccugauaucaagugauccacccgccucagccucccaaagugcugggauuacagacaugagccaccaugcccggccauuauuuuaugauuuuagcuugugaaucuuucuuagucugccaagguagaaaguauucaaagaaaacaaaaaagcccccaaguuucuuucuuuccuuagaguugaggggagggggauaaaauuucaggagagaaaauccagggguguagcagaagaguggaagcaugaggcaggugcuggcuggcggaggcauaccuuccacuugcggcagcagcggaaguugcagggggagaggucaugacauggugcuguccagggcccccauuagccuccccagaacuggagaaaugugcagauaagugaaauuaagaacuacucauucaagcacauuguuuagaacuuuccaaaugcuauaaaaacuuaggggacuauaugugauuaguaucucuuuuaggaugaguuauuuuggugaaaauacagacuuguaguuauugauaccaguuaaaucccuggcagugaguuuuguuaagaaacuaggccugggcaggggauguauaaggagacugaucuacugcagagaucgccaucugccagaacugcuuuuucuccuucagucccuuuccuacaaucauuccaagguagccuuugcuaucagugugggauuggaauaccagugaacucuaacagugcuuacugauuaggagcaggugaucugugcagauugcugugugagguggagaaaauaccaaaaaaaaaaggaaaaaaaggaaaauuuagucucaccucaccacaagcuuacuaguuuauugccggucauaaucucucuuuugugugaauuccauugaaaaagauuuuuuuaaagacuuuauuuuuaagagcaguuuuagguucacagccaaagguacacauuuucuguguaccuccuugccugcagacuugcguugacuucuucuauuauccacauccccaauuagagugcugcauuuguuacaauuagccugcaccuaagguccauacuuuacauugagguucauucuugguguuguuuguuuucuggguuuggacaaguuuauaaugacauauauucaccauuacaguauuguacagucucacuucacugaaaaccuuuugugcucuaccuuuuaaagaaguuuuuuuagaagaaauaacauuaauugaaauuuaacuugauugagaaguaaucagggcuguugaauacucuuauuuuuaauuguacaguuaauugugcuacacuuguauucuaaguacccacauguauuuguuaauaaaaucuagaucacugaccauuauuuugaaugaggguuuugagucagaaaaauuaaaguuuuggaaauuuaaaaauaacuggaaaaaguuuucguuuuuacugaaauuuuaaaaugagcaauacaauaaauaugacuucauaaacgcagauauuccuguuuacaggugauucuuguaaucauuaguacucauugauccacaauuucugccucugcucaaggacugguacucauuuuuuugaguccccuauucaggaccuuuaccugugcauuugguuuuuuauacuuauuagugugauuuaaaauaauaguugucgcucucucaucuuuucuuuaaaaaagaauaaaaagcaaaugagcaucucuuuucuuuccaaaaagaugaaugacacuuuucaucuacuuugggcaaaaacuuuggaaauuuguaauaaaacagauuauaaauacucuauuuagaggagaaaaacauauaucaauacuagauguuaacuacuaguuuugugaaauuacugcagaaauagauucuaaugauacaaucaggcauaagucauacugaaauguuugaccagaauucuguaguacagaaucugcaaaccuuuccuaggggagagguuucaaaguuuucaaaaacugaaaacuuuuuucaguuauuuuuuaaauuuccaaauuuaauuuucugggggaaagguucauuugcagauucuguacuacauaauucuagcauaggaucuaaaucgagcuuucaaccaaagaagcguauggagguuuagagcagauguguagaaaacuaccaagauuugcugacaaauggagaggauaagcuguacagaaaagaaaauggaaggaauuagaaauaaguagucuagauaaaaaagguugaagaauguuuuucacagacuuugagcaaauaaguaggaauuacaaggaaaacuaccagcaaauuuucccuuuucauuaagaaaauacuuagaaaauguguuuguauuaugguguacuugauuugggagagccacacaaacuucuugguuauccaaacuucuugguuaucuugguauacaccaagauaguggauauugaagguuauggaacagccuucauaguaaaccauuacaaauauaacagccaucucuaccuuugcuggcaggcaggauacauggacaaguucucguucacaucacuaauuccauaaugucuucuauauuuguuuauauagcugucagaaaacuacuauugaaaauaguucuaguuucacucuguuuuuuuuuuuuuugucuguaaugcaguaagauacauuauuuuugcuuuuugcugauuugccgucugcuuugagcugaaaacgaguugaagcuucauuggaccuauauugugcaugcaccuaguguauuuauacagucugguuguuguggguuuuaaugggacuucugucuucuuuguugucucaugggcaguuaauggaacucccagcagccaacuuucuacuccuaaaucuacgaaauccuccaguuccucuccaacuaguccaggaaguuucagaggauuaaagguaugaaauaggauauguggcauauuugugugauuuuguuauuuagaguuucauaguuuagcaguuuaauuuguuugggggcuugaguacaguagcaaauuaaaaagauuuuaggauuuugagccugguagacuugacuucgaauccuguguacugcuguaauuuuggcaaacucacuuaacuccucugagcugaaguguuucucuucucuaaaaugggaacacgggguugugguguucuuauuuuagagaugaacauaaugugguaaaguauaauaaauaguaguuuuccaauuauuaucaaaaugauucgcagcggugaagccuuggagaacaucaugauucuuuaaaaaaucuuguuucgagucaugacuuuaauauugcuaacauaauuugaguuugucaaaagccuaaaaugaagugaaauacuagcauaauguuuauacucacaagcuauaacacaaggaaaauauggucaucuuuggugaggaacuuagaaauaaucuuagguguugauuaugauguccuaaaaauauaaacaguaaccguaugauuagcaguugauuuaauagacaguuaucuaauagagaugagcaaaaccaauuuugcaaaauuucaacaaguuuuauuugauguaguaguuccuaauaauuuaaauuuagaagagaaaauuugccugguaaaauaacaguaaauaauuagagcuaaagauggaauuuccagccagacaugauggcucacgccuguaaucccagcacuuugggaggcugaggcaaguggaucacuugaggucaggaguucaagacaagccuggccaacauagugaaacccugacucuacuaaaaauacaaaaauuagccgggccuggugguacaaaccuguaaucccagcuacucugugggcugaggugggagaaucacuugcacccaggaggcagagguugcagugagccgagaucgcgccgcugcacuccagccugggugacaaagcgagacugugccucaaaaaaaaaaaaauggaauuuccuuuguagaaacaaaggguugucuacaugguaaugaauucugagaauacugauguauacacagugucauguauguguauacauaaauuaacuuuaauucccuuuauguguuuugauugaucagauauacuauuaggaauguauuuuccaaaguugguucccuaaacacuucaaauauagcccuagaggauuucuuuaaagauguugaagaauuuuuuuuuauuaguaaacuuaaugguuagaacuccaccacccuugcaugagugaggagugggaaccugccaagcccagccucugacaccuucagagcagcaugugaggucugugcuuccccacuucucagaacguuuuguucuccaauugacuguaagguuugcuugucuugcccugagaauguuguauguccuucagaguagacuuguauaauguuuaaguaccugagaauaaaaagaggaauucuggaaaaggacagagcaucuguuuuugugccugcuugcuuauccuuggcagaauuugggcugagacuaguaggacguuuggaaguagggaguaucuagcucucaccuaccuguaauuacugcaaguuccuuauauuuaucaaaagaagcaggcauuuuucugaaguacuaacuugacuuaagucaguucauaaugugauuucaguggacuuuuaaauugucaauucccagaaaaguuacauaaauuaagaauuaguaguaagcuaauuauuuucagauuuuucuccuauuuucccuggaacagauuggaaguacauuguuauuaauagaaguaacuuucaagagaacuaaaauaaaaauaaguugauuuaccucuuuucagguuuguuguuucaaaauuuguuaacgcaaaagcgaguggcuccuagagcugguuaauuguucuagggcagaucuaggguaaccuuuccagugagccacaugccaagguccuucauauuccucccccaggccauugccccagguggggcugagauccuuaaccuaggaccgcuuugggggaucagaugggacacuugagugccugcuuacucugggucuuggucacuuccccauuuuuuguuacccauugguaaucccagcucccgucuuccuaguccaucuucaccucuaaacccaauauugucauuuucuguuuuugccacuaggccaguuggugcugcuuauuaguaauuacaacuauggcuucaggacaggacagcuaaccauuucaaagaaauacauguuaauauucugugcacacaccugccucacacaugcaugcauacuugugcagggucacucacauuuguuaagauuaauggaauuuuuaaaaccuaauaaauuguauuauugcugagacauuaaguaaaauuguuccuucuaugcuagguguaucuuaauuauuauaguaaccccagcauuuagcacacaguaaaugcucaaggauuacuuauucacaccgagaggaauaaagacaaauuuguugauuaagggaaauguugauuacuggucaagauugaacauaagauuauaaguaagacaaagaacaguugucuuuccaggaccacccccuguucuccaccacuaugccugaggccugugggcuuugcuaacagcugugauacuuccucuggguuuucuuuuucuuaucuguaaaacaagacuuuugauuuuaaaugaccucuaaaaugcuaggaauauaguucuguuaacuugccgaaaaaccuaacuaaaaggcuaggaagucuauuuuuuguccuuuuacuucaaugcuguuguaaaacacugaauuuuacauuaaacaugaguaacuaaugucucugccacacugauucagcuuuuaggccacaaucccaaagcucucuaacuacuaccuauucucauggguccugccuuaugaaaauuucaucucauuacaguucccauaaucuguaguauauauugucauugggaugaaaaccuucuuuuuaaauaaugcaauuuagucagguuacuuuacuguaccaaauacccuaauuuugaugucauugcaaggcaccagcuuauuuuuuuuuauucaguggcaugacagaugaggaauuacagauaauuaccguguguuaguacugugcguuucccuucccuucauuuaaaauagcuuauuaagaucaguuaagagggaaugucugagaauggaggauuguuuuucgugggcaggaacucuuuaccacuauuuauccuaguuagaugcucuaauggccuugggggauagauaaucuuuuuccagagaaucagagaauugauaaaagcaagcaaaccaagccacgacagcaugugcaggagcugacagucucucuagcugccaggacacagcuuuuggcauugaggguuuuguuacuaucuggauuuuauucacuagggaacuaaauaagguuaaggguaagcagaauuugauguucugucaccguuuuucccucuuuguauacaugucugggaauuauuuuaauauuuugguaggggcauugaaagaacugaaaaugaaaauaggauauguuuaaucucugaucauggauuguuagugacacuuugguuugcucauuaagagagauauaaaauauagacaauccacccuccucuccacaaaauguacucguaguuuucuugguacucuuacgagaaagaugauucugcuaagacuguguucuuugaggggcuggaaaaaagccaguagcggaaggaaagcuuucuucaacuugugaaugauuuuuuugcaggugagcauguaagaaauaggguggugaccaaguaauuaagguucuuuaaccuuaaacugagagacuuuaggacaacugagaguuagugguaucuugauuauauauuuguuuuguucaaguaguauuaaagaaaaaacacuaauuauuccagauacuuguuaaagacuauaagggagacuuuauucaaagaguggggguggucccuggcaauugguauagagaccacuguaguggagccuugcagggaggaaaagaggaaauccagcuccaacaaggaaaaguggggauuauaaccaaggagcagggugggcaucagcagauggaagaguauuagaggaaccauccagcauaagaggcuuccggcucaaccgacuugauaggcuuauugcugaaggcaggcuggggugaucugacaucagagucagauaccaaguacaggggauuuucccugaacugacuuaacaggaaucuugcucaggccucagccuggauucugcaaggacagggagggaagcccaagguugggccuagucaagcagaggauuuuguagaacaaaaaccaaaagaggggcuaagcaguuuugaaguggccuaacaaaauaaguuuuggucauaaaaguuuuggucauaaaagaguuuuugucaguaguuaccuaaaaccauaaaguguaaaaacuggaaguaguuucaaaccuuguuuagucuucaagauggagaaacggaguuuuuuuuuuuguuuuuguuuuguuuuguuuuguuuuguuuguuuuguuuugagacggagucuugcuauguugcccaggcuggagugcaguggcgugaucuuggcucacugcaaccucugccucccagguucaagugauucucuugucucagccuucugaguaacacauuugcuccacaggaaaaaggguugagagauugggaggggaauagggagggggaggugugggaaaaagagagaggaaauccugggguuagggaggaggcugggugaagagggguggaaagacagagaaaaauaccuggugacaacuuuuccugagaggcuugggggaaaaguuugcuaauagguaucuaaugggagcuccuugaaagugaaacuguccacacugugcccauuauuuccaccuaaccccauaaagcuuuaguacaauaacagaguucacaauaguuuagcguuuuugguuuucuuuggaagacaguacucaguggagcugaguauugucaagauggguauagauuggaauuagcauauccagauucagcagauacauggguuacaaggaugugggaugauguucuguggugggccugugauggaagucacccuguggguaugguggcauagcuggguguugagcccaugcucauaaacacuaccagccccaaggacacagugggaaagcaagaucagucuucuuaaacaaaugauuggaaacaacaugaucagaccaaaaauuuguaaaauuaguuauuaaaggcuaacgccauccagcaggucccuguuaggccucuuccccagaaccuagcuccuagguauuagaacuuggcuuugcuucuguuuggacuuagggaaucugacuuuccugaaggucagggcugcuccuggugauggucaccuagggaggaggcauuucugcaggccacacacagccucucucaccucaguggccccaggcugccucccacagccaggaacauggggagcccuggggcuucugaaauaaagacaauucaugccaaguuguacuaugccuuuguuacgaggcuacagaucuccucgagacucugguuuauuuuccuuuuguccucuaauucuuaaguuuuuuugugauuauuccgagcuauucuaguuaagcuaaggguaaccaggauaaaagucuuggucugcuuuggccagauuauuaaggugggaauggugcccccuggugugcagcuacacagaggaccuggaggaagaaggagaccugagcucccucccuccucugcugccuccuccauuuggaaacagacacaggauggugaucaaaagcacgugaaauguaacagcccuuuuagaauuugucuagcaggguuucuggugguaccagcagacuccacacagguaaaucuauuacaacauuuagggccaggugcgguggcucaugccugugaucccagcacuuugggaggccaagguggguggaucacgaguucagggguucaagaccagccuggccaacaauggugaaaccccaucucuacuaaaaauacaaaaauuagccaggcgugguggcaggugccuguaaucccagcuacucgggaggcugaagcaggagaaucccuugaacccuggaggcagagguugcaaugagccgagauccugccacuucauuccagccugggcuacagggcaagacucugacuuaaaauuaaaaauggaaaaaaagcacaugaaguccaagugccuggguuugaucuuggcauggccacucuuaagcuguuuuaccuuggauaagucacaucaccccuaucuguggaaaaagggauuaauaggaccuaccgcacaggauugagauugauuaaauauggagaaagcaguuaggguagccuuguuauucuuucuuaccguaaaccuuggcauuuccagguuccauuuucacgugaaggcaguuuuacuugcaaaaaacuaacaugcaguagcguacaagggggaaagagaaggugagagaagucagacuccagauuuuauuaccuccucugcuuuucuaucaccaacuuuuccucucaacucucccuucaccucugcuuuccugcccucuucacauacuccaacccuaucaauaaucuauaaaugacucuacuaggaacagauuaucccaccugggaggcugaggcaggagaauugcuugaaucugggaggcggagguugcauugagcugagaucgcaccacugcacuccagcuugggcaacagagcgagccucugucuccaggaaaaaaagaaaaaagguuauucuggcaaggcacagucgcucacgccuuuaauccuagcacuuugggaggccgagguggguggaucaccugaggucaggaguuugagaccagccuggccaaaauggugaaacccuaucucuacuaaaaauagaaaaacuugcugggugugguggcaugugcccauagucccagcuaccugggaggcugaggcaggagaaucacuugaacccaggaggcagagguugcagugagcggagauugcgccauugcacuccagccugggugacaagagcaagacucugucucaaaaaaaaaaaaaaagaaagaaagaaaaagguuaucccaaaauuuagcagcuuaaaacaaaagaaguagaaaauuuauuuucacacacaguuuuuacgggucagaaauucaggagcagcuuaacugggugguucuggcucaagaucucucaugagguugcagucaagacgcgucccagggcuguagccgccugaaggcuugacugggaauggaggaucccccucuguagucacucauucacuugcuggcaagcuggugcuggcuguuggcagaaggccucgguuacucgccauguggaccucucuguaaguuggcuugaguuuccucagaacacagcagguggcuuuccccagaaccaagugauaagagagagagagagagagagagugccauacagaagcuguccauucugugaccuagccuuggaagccagaccccaucucuuccauaauaucuugguggucacacaccagcccaacucagcauggggagagacaucacaagggcaugagaaacgggagcuggggcucaugagggcuauuguggagucuggcagucacaccagccuucucuccauuuucaucucuuuaucagccacucaaaauuucugcccugggcuggucuggcuuccucauccuguccuuuccaaccuuccuguccauccucuuuuuugagggcugccagagucucaccccaucaauuuuauugcuuuguucuccuuccaguccuuuuguucgucagacugcugacucccuacucauucuuuuuccuucucuucaaauccuagaaucccaccccuguggaccucguuugcuucuuuuaaugcucgucuuccugauucuccauuuuucugcuugaccccaaccuaugaucuucuguucccucugugcaaguuccucagagucucuucaaucuagcugauaacuuuucccauaggaauauuugcuaugcuuaaaucacagcauuuucuuugggacagauaggcaauaaagaguaguaaaugugucaucagcuaccagauggaugaagaaagcauuucccugaacuuuaauucaucauucauguuccaguuuaagacuuuuaaggcaauaguaacuucaggcuucagagucacagcacaucuguggacacugagggauaaaauguuucguguuuugaugcugaaguguaugccuggaggcucucugcugugagcauucuugccgguugaaagaaggaagaaaaaaguacauuuggaacauuauccaacaucuugagauuaugaacugucugaugugcugauauuuuaucugaugaugucuccugggucugcugguggugaaagauuuuccagauuugugaagugugaugaaagggcugguaguaucucauccugacuggcagagcuaaaauguaacucuucgaccuucugaacuugaacacuucuuuucgaagcugugaaauguaaauccacaguagcugcugaccuuagacauuuuugcuuuucccuggagcuuuggcuuuucuuuuguaauuaagacuaguugauaaccuucaauacuaagaaacugaccacuucucauuacuccagagauggauggugacuucaucuuuccauauaauugauuuuguagaacaaaaaccaaaagaggggcuaagcaguuuugaagugcccuaacaaaauaagucauaaugcaucucacacuuugaggacagugauuugcacauuguaguugcucagucaaaucuggugcacuugggaaguaaaugacucaccugggcugaagccuaucuuucugaggaugcagggaggguuuaccaaguaaaucaguguauaaauaggaucaauuguaagaauuucauuugaauacaacuggcauauguguuaaacuuaaaugccccauuauucaugaaagugggcccagaaauucuucuugguagugcauuauagguaacuggauggaguuaaagacuuagagauugucauuguggcugcuuguaguagccuccauaguuauaacagaagaggcagacaccucucucaucacccuggcauccuagaaaucagugaaaccucacagugaaagcaugcagguauuuuuagcaaguaggcauggucacaccaccugucuguuggucacaauccaguaagccaacaccuuacucgaaaggcuuacucagaggggugcgaugagauucucugcugguuuuggcaagccauguagucaccuguggugguuucuguauuuggaagaacaggaaagcagaaguugggcuccacacugccccuuugauagacuguagagauggcuguuguuuuaagccauauucauguucaggcaguggauucuauuuaacacuguuaaccaaccacaagucuuaagugccacuguuuuugccaaacgaaaccaaaucuaagcaugcagccuguguuaccacccucugggugcugauuccgauuguuuucauaucucauacugaaguauuucaaauuaucagaaauccaauaugaaaauaauaaagguuucuguucuuggauacauuccuaauucagcauuuauaauacuuuacacuggauuuuauucuaguuaguggaaacaauguuccuaauguugaaaaaacccacaaaaaugccaaugaugcaaaucuauuuacaaguacuaucuaguguauuuuuuuuuaaaaaaaaauucaguaaacuucagaaguuaccuuuuuaaagaaaaaauuuaucuuaaauucuauuugaggaaaggcugugaauuuaucaauuuguguaucauaugacugaauuacaggaauguuacucuaguuauauaaucauaaaacauguucuagauauaccauaguguauauuuugaucagcaagucuagaauuaggugacuuccuuuaguugguucaauagccuugcaggacuuuucucauaaacuuagaggauaggacagugugagaaucgccaagaagcucuugggcucuggagucagcccuggguuuggauucugauuccacauuugcuguggugaugggcaaguuauauaaccucucuaagcucugauuucuucacaggucaauggagaugaugaccauaccuaacucauucaaugcaaaauacucacuucaugacuugguacaaaguaggauucaguaaaccauguggguguccuccuuccuuuucuuacaaagacaagauuguuuggcuauagaugacuugcagugguuagagugacagagugaacuuacacagauuaugguagcugaacaguuaauuaaaauugcugccagaaacuucauccacagauguucucaaccuuggcugcauguuggaucaucugcagaccuuuuaaaaaauccugauaccugagauucuuuaaucaacuugggauucagauugacaauagaauuuuugaaaucuuccuaugugauucuaagaugugaggaaagaauggcugcuuuauagcaacaaccauauccuaaagguuguucuguuuuagaguuuaaaagugcaagaauuaucuuggaggaaaagcuuuccuaagaaaguucuugcucaccaggaguuugccugcuggccaaauucagccaaucaccuguuuuucugaauaaauguuauuggaacauauccaugcucaucuguucauauauggccguuuucauacuccagcagcagagccaaagaguugccacagagaaccugugacccaugaagccuaaaauauuacuuucuggucuuucauagaaaauguuucugaccugccgggcacgauggcucacaccuguaaacucagcacuuugggaggccaagguggguggaucacuuggggucaagaguucaagaccagccuggccaacaugaugaaaccccaucucuacuaaaaauacaaaaauuagccaggcgugguggcacacgccuguaaucccagcuacucgggaggccaaggcaggagaaucacuugcaccugggaggcagagguugcagugagcagagaucgugccacugcacuccacccugggugacagagugucucaaaaaaaaaaaaaaaaaaagaaagaaaauguuucugacuugacacuuauagaccauuuaccacuugaauugugaugccauuuuccaaaaugcauucaagaaagucaacucaguacagagaaauauuuccuagauucuguucaaguuuguccuuuuauuaaaaaaaaugaaauauuaaggaaaaucuuucucaaaccauguuuuuauucugcucugacaccaaaaaaaacaauaagcacagaagaagacuuuugugaccaaaugugggggaugaguuucguuccaccaccaagugaacaaucaguucuauagcagacacuagguggguguccucccaauucaauucugaugcuaucuaccuggagguagcaucagaucccauagguugagggcccauuccccaaaacuacccccuucuucagacaccaguggcaagucugggccucuggaacuugugaaugaccagcuucaaguuggaguucccaugaccccucuuuggguuugauuaauuugcauuucacugaacacuucacuguacucagggaaguguuuacuaauuuauuauaaaggauauuauguuacaaaggauacagaugaagauaugcauagggcgagguaugggggaaggcaugcauagcuuccauggccucccugggcaugccacccuccagaaacguccacauacucagcuauccagaagcguuccuaacccugucuuuuuggauuuuuauggaggcuucauuacauaggcaugauugacaacccuguagaaauaugacuggacaaaaagggguaugaucuaagcccagcaaagccgguuuguucuguuuuuucuuagccucuuuauagagcauuccuggcuucaggguauggggcaggaccuccucuggaaugacagucuuaugacugcagucagauuagaguccugcuuuaggcaggugaaaggagggcaggagaaggucagagagauuguuuucugaggccuaaagcaucccaacauuauaacaaggacuguggaaguuaaugagccaggaacauggaugaaaaccaguauagcacaaggguagcuagcauuauacucaagucaacaauaauaugccauaaugcaguaaguaaccacucuugcuacuuuuuuuugagacuugccuauuucagaacagagaacaguucuuaacauuucuccuuaaauuucaaauuugaagaaauuuugguaaucugcuuaucaaagaaguuuaccauaggacccucugacauaacucccuggcuaaaaacagaaaacuggaguguugcucaucaucagauguccuucaucagccaugaaugccuuuaaaugaugcuagcaguugagagcauuguaaagcaucuucugcucuguuuucaagucuuuuuuaaaaaguucucagcagcucggugcagcggcucaugccuguaaucccagcacuuugggaggccaaggcaggggaucucuugaggucaggaguucgagaccagccuggccaaaauggugaaacccugucucuaccaaaaauuuaaaaaauuagucgggcgugguggcgggugcuuguaaucucagcuacccaggaggcugaggcaggagaaucgcuugaacccgggaggcggagguugcagugagccgagauugugccgcuacacuccagccugggugacaaagugagacuccgucucaaaaaaaaaaguuauuagcagaagaggauucuugcacauuucccuuccuugcuuauucauaaaaauggagccacugcugccagagaagugacgagguggugcaggggcaccagaucccagagaagacacucagcaacaucuucacgguucucuucugucaccuucccuccuuggccaagcagaaucaggaccucauuaggaaauauaucccccgcccccuugccacuguuaaauacaaugcugucuuucugaaccaguuggcaauuaugaauggcauccugaaaaaccguaaaugcugccauccauuaugcuuuguugaggaggacccuacuagcauacagcaucuaggcacuuucuuugugcugucucagcaucauaguugcugauggaagcaggaaugcucauuagcauuuuaagagauuuuaauagaaauuguuaguuugacaauagaaaugggacggguuuaaucuugaaugccauauuugaucucucugguacuaauucaauucuugcuucaguaagagaguaauucauuuacaggagacaagggaauauacacauuuugcaaaggaaaugaugagaauuuugcaaagucacagcuuuauuuccucuguuuucauugcucuuugucugcaugucucucagggcacugggaaugcuuugccuuauauuuaacaauagaugcuucacaguugccagugaucuguccagagaucuuacugaauacucagcuuuucuucuaccucuggaaagccaagcuucauuagugggagguccaaugaacugaaucacuagcugagcgauucaaacacaagcucagauuugugcuguagcaaaauggcucccucucacggcucuucagagucauuuguaaccgucagcaccuauccugaaaugcagagguuucacugaagguauuaagcuuaggugcaccuaucccuccucauaagguuguaaacaucugagcaguaauaaugaugugucuucaucuucuuaucccuuaaaacagcacaagucauugcuguagauuuuacugaggagugaagagggagaaagaaaauugucugugucuaauuauguuucucuguucagcugcacuauaauaaaacuauccccuuuauuuuuucaugcuuuuuucuucucuuuaggaaaggcuuauuuucaaauaaacaaacauauuugguuaaguaauuggauaagucaucccuguuaacgcuacauaauuguuuguuuuaaugcuugaggcuuaacaccuuuuaaaaaauauuaauuugacagcuuugaaaaauguccuugcccuuauuguuugcuaagaagcugcauuuccugguguuuaguggaggcuuuguuagguacacuugaaaguggcccuucgcuuggccccaugccaugcucgcuguugcucgcucucacucucgcucucucucucgcucucucucuccucccccgcccccccuccccccacaacgaggcccccuguuccuucugaggcucaaggcuucagccuaggugccacucucuuuuagucacuggagaccaggcuuccaucacuuguccuguuuccuggucucuuucccugcuccaugucacccgcaaaucccaacauaugccagguuuguaauugcugagcuauauaggggaucaggguagggugggagugaagguuuaaucaaauaaacauugggaaaauuacaaugguucacaggagcucaacugauaaacacuucgauuaguuacugauccacaugaaaauguacauugaaguagaaaugccuguguuucagccccuccugaugugaugaguguccuucacucagacaacacaucagcuugcaguaaaccagugcuuacccaaauuagcucaagaaagggacuuguuguaggaccauuaccugcuuccaggacagaugaacaagcaggcuucauggagagcagggacccagguacaggucuuaggaccucagcugugaguguggggaccugcacucugcucaaaguccugaggccuaagugcugggagaggcggugguuccugcccaccaugccugacccagcugccuguggccugaccauguggggcugcguugcccugggcugugagauuuaagacaugugaguccacuggucacuguccaccaugcuuccugaccauugauuuuccaccuccccuguuacuuuauucuggggcaggcagugauuagcagagaucuuuuuaucuucugagauacaacuuuccagaaaaaucauguucauauuuuuauuccuauuaagaauuuggcuggccaggccaaaugguggugcacgccuguaaucccagcacuuugggaggcugaggcaggcagauggcuuaagcccaggaguucgagaccagccugggaaacacagugagacccugucucuacgaaaaaugcaaaaauuagcugggugugauggcguauaccuguagucccagcuacuugggagacugaggugggaggaucccuugagccugggagguggagauugcagugagccaagauugcaucacugcacuccagccugggcaacagaaugagacccugucuuuuauuuagcaaaaggucucuuauggccauuuacauucaacaguucacaaacauucuuuuuuuuuuuuuuuuuuuuuuuuuuuaagaaggaguuucgcucuuguugccuaugcuggagcacagugguacgaucucagcucacugcaaccuccaccucccaguucaagcgauucuuaugccucccagguagcugggauuacagucaugugucaccacgccugggcgauuuuguauuuucaguagagacggggucucaccauguuggucaggcuggucucaaacucuucaccucaggugauccacccgucacggccucccaaagugcugggauuauaggugugcaccaccgcaccaagcccacauucuuaaucacucauuucaagguucugugcuagaugauuuaagaaaaggcacugauaaacuaauauugaguuaguguuacgugucagagacaaagugauuuuacagggauaagcuaauuuuuauucucuagcaaaucuuugaguugggcacuguuacuaccuccauuuuuaggggagaaaaugaagacuuggaaaguuuaaguaacuuuugaaagauaaaagcaaauugaauuauuguaaguauaaaacgcaucagaacaaguggugggaaacacauuagacaaguagguagggggacagaucauggcccgaaugccaugcugaagauuuuggaguuauuauguugguaacaaagacacacugggguuuuugaauccuggaggugauaucccagcuacucuuaggaaaaauuucucuggcaauacuauguggaaugggagagacugagagugacuaaagaggccuuugaugcaaugccaagugaagccggagaaggacuuggaccagggugguggccguggguggggaauggaauagagaaugguaugauuuucuuuuaggcuuuccuuuuaugucccuucucuggaccuuguuuuuaaacacuguagcuuuuuaaacauucugccauagagugcugucgauuuggaguugccuucaacuuuagcagcugaaaauuaaacagaacaacaaaaaaauuaaauuuugaaaaauugcaguuguccaucaguugucauuuaucaugaggaaauaaaaugauuaaacuccuaggagucacaugguuagccuggaaccauuagaauuaucuauaguucuaagccuuauugugccacuaauaacuaucuuauccagcuaucaugccauagagucuuuugauuccuuuuauggaaguaaaaaauaacauaauuucaaaaaaagguaacugaugauuuuucuuaugucuaaucugaaugaaauaucuaaggaagaaaugcacugaugugaugugcauaaggagagaggugagaugagaagaaagggaacgccuccucgguuucugugacacauuuuuacauucuguaagcauuuugugugucaacggauuaguuagcuagggauuuguaaauuauccugauaaauaauggucauucuccucuuucagcagauuucugcucauggcagaucuucuuccaauguaaacgguggaccugagcuugaccguugcauaaguccugaagguaguucucagucugaucauuacuuugauaaaggaaaucaugcauggggacuuggugcucaccuaaaacucacuugugcuaaauuacgaucuuccuaaagagggaugugaucacaucaccugucagccccuuuggccuuaguaagaggcggggauggggguuacuucaagauaaagaaaaaucucauugucauuaacuagguuauugaagcuucagauuuuagacuugggcuucuuuuauuuuuguggugaucugaucacaacuucuaaauauauuuccuuucucucaauuagauaacaaaacuguguuuucuugauuuggugucuucugugugcuggacacugggacauguagugagaagugggcagaucuuaacccuucccccacauaccuuuuugagaaagcuuugagccaggaauuagccuuaacaaggcaucuaucuuaucuggguagaauuuucucuacuagaaaauguugaagagaaaucuuggacauuuugaagauuaaauucccaccaccauccucuucuccuuucuuuguuuuuuuuuuuuuucuuuuucuaucaucuuauauccccugccccuuucuugaacaucgacaaaaaaguuuggauaaguuuuagugaaauauccuuuuuaccuaaggcuaaucacuuauuucaccugauaucucagggauuuguuagguuuauugauuauagguuucugauuucaaccaacgaaguuaaaaggaaauuggugauucagguguucuauucaggaaaugugugcagauauuuuauuuaguuucaccauagauuuagaaauaaaugcaucgcaguuuacuauuuuacaaauauguaggaaucuguauaaaaugcugauguuuucuuuagaauuugcauuuauccuuuuugcaggugugaauggaaacagaugcucugaaucaucaacucuucuugagaaauacaaaauuggaaaggucauuggugauggcaauuuugcaguagucaaagaguguauagacaggugaguggacagugaggauaauuaaugaauaaugaaaaugauaaauaaugaaaacuguaucaucuacagauacaguuuuccuuggaguuuauucuuaauuuuaaaaaggcccuucuggaaagucucuuucauuuucccugagucugcccuugggaccagccauuucuuuccuuuuguuguuuguuuguuuguuuauuuauuuauuuauuuauuuauuuaaaaaaaaggcagggucucacucuguuacccaggcuagagugcaguggcaccaucauaguucacugcagccucaaucugcagggugccagugauucucccaccucagccucccagcuaauuuuuaaauuuuuaauagagacagggucuugcuuuguugccaggcugguccuaggcuccuugcuucaaacaguccuccugucuuggccuacugaagugcuggaauuacaggcaugagugacuguauccagcagggaucagccauuuugcaugcccacaggaaaaaaauauuauguauauacauagaguauaaaacuguuuuaugugcauuugggaugagauauauauaaggucucaucaugagccagagaggaaugagaagaauaagucauuuuuaagaacaucuccuauauuuaccggugucaggcauuguucucagucuguacuuguauuaaaucgcuuaaucccuacagcaauccucccucucaguuaauacuuaauggaauauuccaguaguucaggacauaugagcucugacucuguuuaagaucacaaucaggccaggccugguggcuagcucacaccuguaaucccagcacuuugggaggcugagguguguggauuacaugaggccaggaguucaagaccagcccagccaccauggugaaaccccaucucuacaaaaaacaagacaaacaaaaaaaaaaacaaaaaaaauuccagguuggguggcacacgccugaagucccagcuacucgggaagcugaggcacgagaaucacuugaagcuggaaggcagagguugcggugagccgagaucgugccauugcacuucagccugggcaacagaccaagacugugucucaaaaaaaaaaaaaaaaucacaaucagccuacuuuugccuauuccagauuuuuuauaaacaauauucaaaccagaaaagacucagagucuugguucagauuagagucuugguguuuauaggcugcuauccuucccauucuaagugauaauuuuuaucauuucuggagauuuuuccagaaaguuuugguaacuacaguuuuucuguuuuguuacaucuccagugaagcuuuaguacuccuuauauugguacacaagauaaugccuuguucucugaguccuuuuacccaguucuuauacacagacugccaccuaaguaacaaaguaagcaucuaaaguaugacuuuuaaagacuagucagaaaucugaggcaggauuuaguuuuuguuauagggagaacaauuuaaggacaagugauucuuccaagccaggccucaugaguguguacuacaaccaccuggcaaauccagcugcacuugagauaacaaguguauucuaugaguacugugguguucuuuauugaaugcuuuuucuauacucaaagacauuuuuggcauguuaaaauuaaauuauuuuaaaggugauuaaaaauuaaauaauggcuggacacaguggcucacgccuguaaucccagcacuuugggaggccgaggcgggagaaucaccugaggucaggaguucaagaccagccuggccaacauggugaaacccaucucuacuaaaaauacaaaaauuagcccagugguguuggcaggugccuguaaucccagcuccuugggaggcugaggcgacagaauugcuugaaccugggaggcggaggaugcagugagccaagauugcgccauugcacuccagccuggcugacagagcaagacucucucucaauaaauaaauaaauaaauaaauaaauaaauaacaucaagauucuuauauccaugcgaaugaucucucuagugccaggaaagaacauuuaaagaugugacuaacuugguaccagaucagauccuagcugaaguuuuggcugagaaauaaugaaagucaggggacuuuucacuuuugaauuaugggcuaauguuguuaauggacuaauguaaaaauauauugauaauaaaauuuucuguuaauuugguuuuuuaaaacuuuauucugucuccuaagagaacuauuuugagauuuacauauagaaaaacuauuuccugccucucccugauguaacagaauugaaauacuuuaaauaugaguuucuuaauauuauaguuaauauuuaugaaagaauauuuaauuaacauacaguauggcuuuguuuuuguuuuuaauuuuuuggguaccuuuguccccugacuccacuagauauuuucuuuaaugcacagagaaagagccaaguuuuuccuuccugggucugugcuguagaauacaacaggaaugggccaggugugguggcucacgccuguaaucccaacacuuugggaggcugagacaggaggaucaguugagcccaggaguucaagaccaaccugggcaacauaaugagaucucaucucuacaaaaaaaaaaaaaauuaaaguauaaaaaagaaagaaaacaggaaugaugguauuuaauuuaugucuuuaaauggucuuccucugauuauuccauagguccacuggaaaggaguuugcccuaaagauuauagacaaagccaaauguuguggaaagguauaguaugcauaaccccuaguucugaaagaaacuagaguaacuuggugagguguuuacugugaugaaggaauuuaaguggggacuugacacaacuaucacagcaggaguagagaccaguaauagugggaaaaacaguuaagcgguuuuauuccugcuauuuuucagaaacuuuaauccuaaaacaguaaauugauuugaucuugguccuaacuagaaaacguagauucuuuucucugggagauaccuauuuuaacacccaacaauacucaaaaggugcgucaagaacucugagggaccugggacuuuacuugcaagcuaacaaagccuuccagcuucauacaggccagcagaacacaagauuucugagucagagacaaaaggauuuguuauuccugacacagcagguagcaugagcuucaugcuugcauugguuccccuuaacucccaagucccauaguggugaggcugaggagcccagcuggaugauuuacacacaguggguuuaugucauagcuggggaacucugagcuuaggaaacccucagucuuaggaggaggugcuagcaaugcugcccagucuuugccucagaggagaauauuauuuucauuauccuggucaggaaacacaucugccguuugcccguaagggagacucaucuuuguguuccaaggguguuuccuggacaaacauccuuggaaagauaguuuggaacagaagcugaugcaucaugagcagaaaugcugugaagaaucaucuccucaauaagauaaacuuuuuuccuucugucccacucucuaacugggguugggaaaagaucaaccaauaaaaugcugcugcaguuacugauacuuuaacuauguuugaaaaaauaaauauuccguugcagcaaugacaaagaccuuuuuagauuccauugugguaacacaucaauuaagagaacaagcuguagagcuacaucguucaacaccagagcuaccagucacguacagcuacaaagcacuugaauguagcgagucuggauugaaauaggcugcuaaguauaaaauacacaccagauuuugaagacuuaguacuaaaaaaagaaugugaaauaccucauuaauaucuuuguauaugaucacauguugaaaugaaaauauuuggauauauuaaguuauaauuuuaaaaaccuugcuuuuuaaugugguucuugguuagaauuacguauauggaucaugguguauauuuaugcuggacacugcugcucuagagccagauucuauaaaguguauuccuggcccugccucuucuuggaaaauuuauuuaaccccucuauuucuuccuuuaaaaugugguuauuaucgacaccuagaacauaagauuauugugaaaauugguugaauuaagccauggaaaacagagaagugcuaguauauaauaagaauucaacacauguuaacugcuaacauuauuaauaugccagaggaguuuagaauuuauaauuagcaggauuugaucugauaguugucauuuuauaguuauggaaccccuaaacuggucuucauuggacuucuacaaaauaguguauuuuuaacaggaaauguaaaauauucugcucgaaugguuuagaaaaaucuucucagaacuccagaauggaaaauccaggaggcaaauuugucauuuacuuuuuuuuuuuuuuuuaaccacacugugauaauuacugaagcauagacugcauagacugugcaaaaugccccuuuuccuuugaauaagguuuucuuuugcuuaauuuucuuuaaauaauuugauaugcuuuuacuuauuguucuagcgauauuacuaauguuuuucacuguaauagccuuuucuccauacauguaaggguucugcuuucgaugugguggugugugauuuaagcagaacguaucauaauuuggugagccagguucuguagaacuacauuaaaaauuuuuucaaaacaguaaaaaaaaaauaaaaaggugcuaugguaaggauaugguuuacgugauuaaaauuuaaacagcuguuuccaugguuggaaaaaaaaggucuuuguaugcaaaaaauuuacacuaagggcugaggcaaauggauaagucaguucuaacauuugaaucuuauuuuuucuagucugugaaugucauucuauuuuuauaaugcaugaucaaauauuuuuccacuuuuacauuuugcuuaucuaaacaacuauuuccacauuaagacuauacaaaauuauaauuuuaaaacuugauuaguuacaaauaaguugauuuuucccauuacauuuuauuuuuagaaaaaaauuauauagagaauuuuuguuaauuugagggggugguauucagucacuguuuuggaguguuggccaccucugcuauauacagaaaauuaauaaugcugaaaauaauaucugcuauuuguuaaaauguauuauuuauccaggcuuggauauauaggaacuuugcacauuaccuuuaaugacuugcaaaacagaugcgccaguuuuacagauaaggaaacagacucagauuaaauagcuuccaaaaaagucacacagagacugaccugugacuggaauuuugggcuguuugguuacacagccuguacauuggcugaucuacuguguucccucucuaaguucaauuuauucauuucuucagguaauacaaacuugggaaacauucuuacucucccucaccuucuguuuguucauccuuaauauacacaggcauuguuagauucauguauucaccuaaauuuuggugcauauucugucugcaagacacugugcuaagaauagggugauguauaaauuaauaccaguucugcaaagaauguuggaguucaggggaagcacgugggagagaaguaggugaccagugaagaugcuauagaggaagaagcauuugggcuggagcaggaacaguggguagggaggguuucaguaggcagcaaucaaagagcggucuaccagguggugagaacagucugagcaaaggcccagaggacagaaagcacguugggcccuucuaaguaggagauuauuacaagagcugcguuggggccagauuuauagaggcuuuugagaaugcuaugguauuuauaaauuuaagaauucuuccaguucuaauauucucuuucaugcuaaauaaauaucuauugaauucccacaguguacaaagcucugagcuuucuguucuggugcuuagaagugguccuucuuugucuuccuacuguauacaguuuugcauucaucaucuacaugggcccaggcaggacauaaauccagaaguguauuuggaaguauucguuuccccaggcugugggaauaaauuaccacaaacuugguggcuuaaaacaccuaaaaauuacucucuucacaguucaggaggcugagaguccgaaauccaugcuuccuuuggggguuuuggggagaaucuguuccuugccugcaagcauccagugaccagcaguauucuuggguugugaucauaucccaccagucucugccuccgucuucacgcugccuucuucucugucugugugaaacuucccugugcuucucuaggaacauuuguaguggcauuuaacccucuccccgccacaauccaggguuaucucuccacugcagaacccuucaucacaucugcagaacucuuuucccaaguaagguaauauuugcaaguugcagggauuaggacuugaugucuuuguguauccauuauucagucuguugcguauauuuaucacagaaaucacguggugauuuguacauuuucucucucucaccacuuucuccucagcagugugcuccgagcaacacagacaccagcugugaagccauugugggcagcacagugcgugaugugucuacuccuucacgugaacacuuugguaccuacuguuuguuaguaacugugcuaguugcuggagagugagguaaccaaaaccuccacaagcucucaguuccagaggguuagagaccagcacacaaacaguugaaagauggugggaugagagcugugauucggggcuaugagagcaggugagaggacuaccugacccagcugugagugagcaggggaggugacuuagaagaggagagaucuaaucuggucccgagaaguauauaggaguuugccaagaaguagauaaagaaaguuccagauaaaacuauggcuggggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccaggcgcgguggcgggcgccuguagucccagcuacucgggaggcugaggcaggagaauggcgugaacccgggaagcggagcuugcagugagccgagauugcgccacugcaguccgcaguccggccugggcaacagagcgagacuccgucucaaaaaaaaaacaaaaaaaaaaacuauggcuggaaugguggcucaugccuguaaucccagcacuuugggaggcugaggugggaggauuccuugagcccaggaguucgagaccagcccuggcaauauagugagaccccauuucugcaaaaaaauaauuaacugggugcacaccuguggucccagcuacucaggaggcugaggcgggaagauugcuugagccugggagguugagguugcagugagcugggaucacaccacugcauuccagcuugggugacagagugagccucuucucaaaaaaagaaaacuaccugugcaaaugccuagaagucuagguaagggauuggcaagaggaacagagagaacugaauggaugaauggauggauucagaggccaccaaggagguaaaugggcagacauuggugauuguggguauauuauccacccgaaaggaggaaucggugcaauuccuguuucugcuugggacagccagguuuguugaauaagauggagaacacagaggaaaggacugcuuuaugggcugggauggguugagacaagaugauuagucugguuugagagaguuguuuugucuccuauuauacccccccauuccucucucuuuguacguuaaaaaucaccauguccaaagauaaggcaguguccuuugccaaguuagcaguuuugucauuuacucucacucagaacuguggaacacugccaugaaaugauucauauguaaauuauuuggaguuagaaucaugaaucacuuaacauauauaaugguagauaauugaauaauguaaguucaguauggcucaagacaaaagagauauucauauuauauuuagaaauauucucuuggaaaauuuagucuagagagcauuuuuuacauauuagaaacaaagacuacauacagguugcacaagaaauagauaacguuuguaacgauuuuuaugcaguacuuuauuuugcuucugaugaugauuaguuucaaaaguggauuguuccuucauagacaauuuuacagggacagcaagagguugagaaaggcuaacagcucccauguuuuaacaaaaacauucacucugugcuuagaauauuagccauugucaaguagaauucaguaggcuaauaagugguggaggaaauguugcugcaguauuugaaagguaacacugcugauggcccuuaggagaaguuccacaauguaucccagaagaccuucuguugugccuuuuauugaaaaagauaauaacuuuugggaguuguagucuccuuaugugguagauaucuuauuuacuucaauuugagagagauucuugggguacuggugaggggauuaucuuacagauaucacuaaauuagcaacacaaacacagcccccagggagaggcgaauauauagacucuucuaacuuuggguaaaaugaggagcaggaaggagaauugaagugauagauucauuuagcuuuaaaauaaaaaaccuauuuaaugacaguagcaacuguugucuuugcuucacacggagggaaauaaauugaugugcuugcuuauacauguucacaaaaguguaucuaacccugcuuuuuagugugauugaggauaugcuuggugcagaugauccaaaagcuucaaaauaugugaaucaauggagaggguuugccaagucuuuugucuuugcaaccaugaggggcuggcuguacagcugcuucccaagggaggaaacggggcucugucugcugcucuguaacuuagacagaugggcuuggagacagauaggagacccuguucuugacuucccagcugugguuuacuggggucuaagaaacaccauucuucagauuuugaagcguuuguugaguccugagccagucaaagacuuccuagcccuguucauuaaaagaagcauagauucuccuccuugcacaaacccuggugugauucuuaacccccaaaucaguguggugcuacugcaugcucuuaucuuuuuaaggaauuaaauauuuucagcuuacagcuauaauuuuuauuuugaagaauuccaacuuggcauuuacugaauucuuccccuuuggaaggugauaauguguguauaagaaagaugggcuuggaugucagaaaccuaguuuacauucaaccuccagugacuguuuccaaggauaaaguguucaaacauuacacaaguaccuuacacagcuacuaacaaacagugacuagauuccuaguaaauguugguuucuuucuuucccauacuucuguuuagcaaauuugcacugucacucgcuaagauuuauugagugacugcuuggacaagcacagugcauucagugcucaagaaacacaaccuaccaugugcaggagcuugaaacagauuuuucuccacauguuauuuauucauuuguuauaauuucuauuuccagcuauuguccaaaagggugagguggcucuuagcuucaugcauccauguguaaaaauacauguacacauguugagaggucuuaaugucucauuuaaaacacagcaaucauuguucaugauucauggguugacguauuaagaauaauucguuaauucuguaaguaaacauuuugcuacagugcugaucccaacuguguuacucaccaggauugauaaucaggugguguuuucagaggagagugauuagagcuaaaaugagaauagugguccccgugguucuguauguuuucagauuucugaaauacaagauguuaaagaacauccaucuggugaaugauuucauauccagucauagaggaagaaaguucuuuuuuucauaaauuucagcaugaaauucaaauucauguuaguaacaguuuaaaaacuaaaaaugcuuaaugccagaaguuagauuucauaagcaugccaaguuuucuuauaugccuagucuuuauuugugaguguauaccgaaaucaaaaaguggcucuggcugaauuacaaagcacagagcugugugcugaagcuuucauagcaucacaaccucuuaagguguuagaaauaaugacaagcgagaagacaguaugcuuaauacaccacagaagcaccauggagccuuuugggggauguuuaggagucuguaucuuuuugguaaugucaauaauauguucacacugacccugucccuacagggacaauuaggucagguuuaguugucuuugugccaagagcaaugcuuucuuuggcaucagauccacaggcuguguuuguuuugcuguccuccaggccuucgagagcagaggguucugugauuucugaucuccucucuauaccguucauuugacaggaacaccugauugagaaugaagugucaauacugcgccgagugaaacaucccaauaucauuaugcuggucgaggagauggaaacagcaacugagcucuuucuggugauggaauuggucaaaguaagaggauagagagauuuucuuggugccuagucccacaauuuacaacauccuugaaggaccuaaucagaaaaguguauugcuaccucauaacuuucauuauuuauaaucgccgauuuuaguggcacuugugucauucucugcuuuaugccaaugagccaucuuucuuaccuucauaggauugcacuguugaugcuuugauauguucuuuuauguaucguuuaggguggagaucucuuugaugcaauuacuucgucgaccaaguacacugagagagauggcagugccaugguguacaacuuagccaaugcccucagguaucuccauggccucagcaucgugcacagagacaucaaaccagagaaucucuugguaugucaucccugcuuuuucuguuccaaugaaugccucucuuccuuuaaaaggagcacaugcaaauaauggcauuuuauagucuauaccaauccuacauuaugagacuuuaaauuuagaaaauuagcaagacuuaugucaaugaccaucaaauacuaauggaguucuugaauuuuucugcauuuguuauuuaccacucugcuauauuucucacucugcuauaaagaacuaccugagacuggguaauuuaugaagaaaagagguuugauugacucacaguuccacaggcuuaacaggaaggccucaggagacuuacaaucauggcggaaggcgaaggggaagcaagcaccuucuucacaugguggcaggagagaaagagagcgaggagggaagugccacacauuuuuaaaccaucguauguuaugagaacucacuaccacaggaacagcaugggggaaaucugcuuccauaaucaagucaccucccauaaggugccucccccaacauugggaauuacaguucaacaugagauuuggguggggacacagagccaaagcaugucaccagauacaagaaaauacauuuucauuuauauuuuaauugaugguacugacuuaaaggugagcaggaaaauuauuuuauagggcagaaaauugugaagaauaaauuugagacagaauuagaggcucauaggagacaggaguagaauguggggguucauuuauuugcagggaauaauuuuggaaauagucuaguccauucaucucagcuuuacuaaaggcauggaaacagagaccaagagaugccauuuuuuuuucuuagaagucucuuuuauccuauuauucuacagaauaaaaagucuuauuccacuaugguacccagaguucuucauagucugaucucaauuugucuuuucagcuuccuguccuguuaauaacucuuauccauccaacccaacauggucuaagcuucaagccauauugaacucaccuucauggugacucuugauaacuagacacagcuugcuaauugggaaccaauccucgugaccacguuauagaagaauuuuagagaaacugguugggggauuugacauuuacacuccucccagccccccacaaacacacaugacauaguuggcuucuuuauuuccaccuuucagggcucucauccucauuccugcuugggaggcaagcuuaucugagucuucuacaucauguuaauccaaacacagauuccuccauccucaguuuuuaguuaagacuugacuuaccagcagccuuacaccuccauugcuucuguccauacuggucuucauuugcagcguccucucuuccagcauugugguaaaccauucaucuuguaauacauugagcaaaaguuaagucuucuuuaacaucacucuagacuuucuagacaaaguucagucacagccaccucggguuucugcugcacuugcuacgguguugugaucuuuaucauacacuugucugccucuuugggauuguaaguaccauggaggcaagguuugugucuaauuaucuuuauaucuccaaugguuuggauggugacacguaaacacauaacggacagcagaguauugcucacugaccacugacacucacucagcuagcagcuggugcuagagcaugagccucuacagccugcugugagcaccacacaaauaacuguugaaaggaauaugcauugaugcacagcaucugaagccauccuggggacuuuuuauuuuuuggcuaaucuaauccagaguacccgucuuuucuuuuugguaauaucauuugaugauuucugaguauccauuuaaaaguauuugaaauuuuaucucacugucuucugccuugagggaauuauauuucauuucuauauguucuuauuaggaaaagaaauaucccugcucuguguuaaaaaaaaaaaaaaagggggauuguggacgugguuuuaugaacucuaacaaggaauggagacagaguuguaaaccgagccucaggaggaaaguuaggauauggcguucucuccucaaaacaggcuucucgcccauugggaccuugcagcaugccaggcuccuccaccgucgaacugaguuuggcccgggcuucgcaaacaaaggcacagggcuuucuccaggugugaccagacacaaacacuggggcauucauaaggauacccccuugacugcuuccugcucuccacaaccugccuugccccacuggcucuaguuacugcauucucugaaaauaugggagccacagguucccaaggaaccccugcagccagucuguccaacagcccugauuuaaggcccagcaaagaaggugacugaggugcuugugagcuucccuauaaaccagggaguccauuucccagcucacagaucucacucucaccuccuguuucuucucuuuuccacucagaguuucuuaauguauguaaagaaucugacaccgccuccuuuuuucuugucacacaucaaggguggauaauguuuuucacuucuucaggagaauuggcuaaaauuuaaaaaauuuaagaguaaguaauguaauggggauugaugucuccaacaucaugagucucagaaugcaaucaggaaaucagagucacacuccucauugagucucaccuguccuagaugagcguccaccccuucccaaaccuacgggagcccccuuguguuagcccagaaagggaggagaaggaagaagaggauaaaacugaccucuggaagaggcgaauaugugauguagaaaggcucuuccgagccuucagaaauaaccauagccucauauaucucaguaaaauguguuugcgauugaaaaccuaacuagaucacuuggcaguuucuagauuuagucagcagguugguauuggccugggaggagagggugccauugagauacuaaaaguaaauacccagagugacugucggccucuucuugcucugagaacuaauucaguuuuuaaacaccagagcauucagacaucugauuugcaucccgcucuccgguaagcagcaucauaauuuaaaacccugccaguggagauguauggguagcugugucagggagcacagggguggccguuaaugcugugaguuacagccuggugguaccgugucagaguuaaguaugagagaccagugauaaauucagguuguccaggaguucuggggauaggagagagaagagaagaggguugguuucucauauuugaaguccuucuaaaucauuaaguugacauuuuauuuagagaacacacaguguucauuuuguaugugggaucugcauuccucgcauuuuuuauuuuugcauucugagagcaacuuuugacagaagcaucucacagcuugugguggggcguuugaacacugcagggcuagaguucucacaguugugauuguuuaaauucacucaaaaucuguaaguaagugcaggcuguagucaggguucuggcaggccuuuccaguuauuuuucagguacagaaucuugcagaauggugcuguggaaugaauaaugauccuggcuggagccccugccuggccauaugacuaguaaccugagugcugugcgccucagucuccucguuuguaaaauggagguaacaguucucuuccuaguugcccagugggguggcucuagaaguccagugagauaaucuucgaaagaauuuugaaaucuccaaaguccuugagaaugucaguuucuggggagaccugaacucugccagaaagccuuuggagucccuguucaucuagucaccucuuuauuaaaggcaacuguuuuuaaagcaaugaugugugugucucuguaucuaucuagagagagauauauguauaauuucuuccugcuuugaagacagucucucacuaagauuugaaauguauucauauuagacauguuugcuucuguguccagcauuggggagagaugaaucagauaaaauaugacuucaggcuugucuaccccuaaugacacuuccuuugugauguuuagccaaggaauaucacuugcacagacauaauucagcaguuacagacuguucagucccuuucuauauaugcuccugcaucugacucugaauucuuuauagaggaugugaaaaacaggacuucagggacuucugaguaucugacagcaaccucugaauaccccuaggcaucacuaaauggagucuuuaaaauaaauacuauuuuucaaaaauuguaccuaaugaguauauuuuuaaguuguaaaaacaaaauaacagugacauuaauaaaacuuuuuuuuuuaacucucaugaugcagacaguuaggaauuugugcuuauaacauucuuaucacuguaauuacuuaggaaauuucuuuccaaagucuggguuuugguaaaagcauuauaaauucuaacuauaauuauaucagauuguucuuguuaauguuuacauuaaacauaauggguggaaaguuuuccuaagacugugacgugacuaagaaucuggaauccguuacuuuaggcugaaucauucauaucuuugaaaauguuucugcugacuugugggcugacucagaguuguaaauaucuaugagggacucaaaauccucaucauuacuccuguggaacuuuaaagucauaaagauauguguuagagauguguauucaguauauaagacuggaaaacguuauucagauacuaaaggugaaacauauucuuauuaaauggauaaggacaucacagguaagggagguauuucagugccguccucuuuaaaaugccuguaaaacuuggggaauuacuggccugggagagcccugcgguucuccauucuuuuuuacugaugacuauuuaaaucacucccccucauuaaguagcagacuaauggaugauguugcuaacaugcuuaucuugaaaaaacaucauuuucuaaauuuuucuccuucuacaguuaauagugguugcgauaaauaucugguucagcaaaauaugagacaaagcaaacuaugcuuaaaauagaaaaauagaaacaggcauuacaaugaguauagacuaggucucugcagcaguuuauucucugaaauuccauguuuucaaaauggacauccaagagacaaauagacuauacacucagguucaggacugcauggugaaacuugaauuaugcugucauacgcacuuguuugcuuccaaaacuauucacuuagaaccuaacuuucuaaaguuauauuuaucccguaguuuugcuuauauaugaaauuauuaugaaaccaacacauguucauuguaaacauuuuagaaaccacugagaacuauaaagaaaauuaaauuaauccuucaugcuaccacuuagagauaaacuuguuaacauuuuugaguauuuuauauguaauuuugcauuuuuuaacucugcauaauagugacuauuucccauaugauuaauauauuugaaaaaugcuuauuagaaaguauguaauauuuuauuaugguaauguaucauagucauugcccuauuacccauuuauguugcccuuaguuuuuaaaagucauagauaaauucugagauuagcguccuuauauauaacguuuggguccaucucuauuccccuagaguagguuuugagaaguagacuuauugggucaaagguuauaauugauauaaagaaauuugcuauauauugcugaaugcuuucuagaaagguucuuuaagcauaaauagucacgucuccaccagcauuuuuaaaccuuuuccaaugugauaauuaucuaaucagccaguccuuccaggaaauggaaggaacauuuuuuauuuuuuuacuuuuuauuuuuucucaucugauuacccacaaggaaggagcauuuauugagcccuguucugagcuuugucucauuucaccuucacaccaacuucacaagggagguacuggcauuaucucacuucauagaugaagaaaugugcucagagagguuaugugacuucagaggucacacaaccagauguguggacuuguuauggaaguucaggcugccugaucccaaaggucauuuucuuucuaaacuuccaagguuuuccccuauaucauauuuguauuucaucauugacugucuagacaacaaggaccccauugcugcccccaauuuuauuuucugaacuaaacaugcuagugccguggagaucaccaagugcuuugguggacacuuaauacaccauuucuugggcucucaaguacaucacacauaguaaaugcuaaauaaaggucaguuucuaccuccaggauuagaggccucucucacgccuaucagguacacagccgccuacacucuaacuacuguguaagcaagcacguguguucaucguacuccuagggaaggaacuuucugcaaaaguggaaaauauuuuuuccaaauuucacacaauugugcaaaaucucugaagagaaaaaaauuagcacuuuaaagcaacaaagaugaaucaugguguuagaaucacaaggaggugucgggcacgguagcucaugccuguauucccagcacuuugggaggcugaggugggcagaucucacgaucccaggaguucaagaccagcuugggcaguauaaggagaccccgucucuacaaaaaauaaagaaauuagccuagugugguggcauguaccuguaguuccagcuacuuguuggggguuccgugggggaaggauuacuucagcccagagguugaggcugcagugagcuguggucacaccaccgcacuccagccugggcaacaaagcgagaccgugucuucaaaaaaaaaaaucacaaggagagauuucauucgaguuuaauaguaaauguauuuguguccuuucugccuaauuccaagagcccucucacaauuguugaggaaaaaaaaaucuucugauuguuggcugauuucuguuucaggugugugaauauccugauggaaccaagucuuugaaacugggagacuuugggcuugcgacugugguagaaggcccuuuauacacagucuguggcacacccacuuauguggcuccagaaaucauugcugaaacuggguaagacuucugguggcccugguuaguacuuuaacuuugaugagaaaggucuguuuuguugcuauugcugcuuguguauacaguugguaagaaaggucuguuuuguugcuauugcugcuuguguauacaguugguaagaaaggucuguuuuguugcuauugcugcuuguguauacagugccuccugugaagguggagaauggaaagaagugagagucuguugccugcaccaugauuuugaccucaggaagcagauuuuaugcuuaccuggccagagcccuggccuggacuuguguucuaaggccacucuugagaguauggcaguagucaccaagacugugguuagguuggcagaaacagaugccuuuuucuaaagugugauucauucaucucuaugugaaaugaaaugaauaauuuaacacuaaaauaauccuuuuccuaacaaauaaaggcaauacuccaguaccauggaagggucuugggagccaucaguucucucccccucacccacuuuguuuuccuagcuauggccugaagguggacauuugggcagcuggugugaucacauacauacuucucuguggauucccaccauuccgaagguaggcggccuuuugggcgacguauuugaauugcaaauguucucccuuggguccagaagcagguacuuugcuccuggaagucgggacuguuuggucauuaaaaaugccaguuaaaaauuacauaaaacggggggaggggggagggauagcauuggaagauauaccuaaugcuagaugacgaguuagugggugcagcgcaccagcauggcacauguauacauauguaacuaaccugcacaaugugcacauguacccuaaaacuuaaaauauaauaaaaaaaaaaaaagaaaaagaaaaaaaaaaaucagaaaaaaaaaauuacauaaaacaccuuucgcuuuuuaauuuacagccuauuaauguauauucucauuagcauacuuugggugugaggugaaggccuuugcuuuguguuugguugguccucugaguuuccaguguucauucuuucauaaaaauaaacccauaauacagugucuaccauguccaauuucuccaucuuuucaaaugacagcaagauuuaaagagccuugugaagcaguccgaauccuuccagguaugucaucuuccauuucuucauaguggucucucucacucaauuaggcagcaguuuuuauauccucuuuccaagcauucaaguuuguucucauagaaacaggaucucuuucuucuuaaaauucauuuuauugguucaugugacauuuaauuaagaauagaauuacaaacacuugugguauaaauaggccugggaauacacagacugagugagucuugguaaccauuugcuucacauggugggagcagagauggccacugacaauggucagaguauuugagcagggcacgggagcacacucauuggccuggcaaucuuugugcagggaaugagugaggggcuucagccacagcucuuuugaugaguuucaucucccccucuggagcaaaugaauuacucugaagcagaaguucaucuaaccaugcauguucuguuuucuucugaguuuucuugaccucuuuucacuuuaaucucuucccuuuguucauuuuguaacugucuaaugaguagcuacugugugccaggcaugauuuuaagugcuaggaauaaaguggugaacaaaaccugagguugugguuucccuuaguuuauuugacuagccauaacaaaauaucauauacaguguggcuuauaaacaccagaaaauucauccuuccaguucuggagguugagaauuccaagaucaagguacugcagauuuggugacuguugagggcucacuucuugguucauagacagccaucuccucacucuaaccacauacaguggaaagggcaagggaaucucuggggucuuuuguaagggcccuaaucuuauucaugagagcuccacccuuaacaauagcauggcugcccaaaggucccaucuccuacuaccaucacauugggcauuagguugcagcaugugaauuuuggggagacaugaacauuuagccuauggcaugguguuuauaguguuguacugggucacuaugugaaaaaugguuuuaucuucuuuuccauccaacauuuuauugugaaaacuuucaaacauacagaaaaguugaaaggauuaucuuuuuaaaauucucgguuuucccauugcguugaacaauuuucuaauuggcauugcaguaaacauaagacugacagauguuagucucuacuuuugaaagccuuaugcuauagauaaagacacaccucacaagacuauugaucaaagagaauaagcagagcaugagggagugcuuaguucagggcuggaaaucacaaggauguagcauucaugaaagauguagcauuugagugagaccuuugugguauuaguggaguuuuuguagguggaaagauauuuccaucuggccgucaacaucguggucuuccaccaaagucauuaacuagguggguuacacagacuguagaauuacuguacauuucaguuagcuuuugcugaguaacacacuaccccugaaguuaggagugugaaacaauugcauggaucaguugagugaaucuucugagcuggcuggcucagcaggggcuugauggucuaggaugaccccacuugcacaccugguagguggcucaguguccacugggacaagagagaugacuuggcccugugcuuucaucaugcaggggcuguccugggcuuccaugagaguggaugcaagauuccccaaagcagccagagacagggcaaguucugcuccccgagcacuuccucagccucugcucaccucacacuugaugugccguuaagcaaaucaagucaaacagcuaacccaagaguaaaugugggagaaaaugagcuaaguauauagugggaagggaauaauuuguggccauuuuuaaagucacaccgggccuuggcuggucucagugaugucauguuuugggagaaggggucaaguggagaaggggaaugcaucuugaugacaggugauccugggccaguuacaguggaguucccuucccuggcuaacccaagcugggaucagcugggaaagggucuugggugaugaguuugagcggacugugugcucacaacucccucuaguguuugcaguugcuggugcagccugagaguuuuuucuuucacugcuuuuuacuuuuuaaaaaaagugagacucaaauugaagaggaugcauuuaucauggauugauacugaacggggagcagcuuuuuuguggggucuagagauaaguuuagcuaaucaaaagcaauaaagcuacauucugaaagcugcugcccuuauaugcugccuucagaagcaggucauagaccuccagguagcuuuuaaaaauuaagacagcgcuuucccucuuuuauaucauauugugaugaaagagaaucuguaauguuaaacguguguuaccaaagugucuucauggcauacagcgacauucuggguagauuuuauaaccuacuauaauacagaaaugcaugucauuaauuacggacaugguacuuuaaauuacgguaaauaaguuugguauaaaguagauugucuacauuuguacuuaaaaguccuucacauauuucaaauagucucuuuguuuuauacaaaagacaacuuuaacccaaagcauuuaaacuacaaucguuacuuggaauuuacaguuuuagcuucucugacgauagcaucuuucauucuuucuuccuucaggcuuuucagguuuuaguuguaguuugacauguguucucuuucuagucuuuuuuuuuucuuuuuuauaggcaggaucuugcucugucacccaggcuggugugaucacagcccacuccaggcucaaggaauccucccaccucagccucccaaguagcugggacuacaagcacacaccaccaugcccagcuuuuuuuuuuuuuuuuuugguagagauagggucucacuuuguugcccagucuguaaauuuuauuuuuuaauuuuuuuaauuuauuuuuuaagagacagggucucuguugaccaggcuggaguguaguggugcaaucauagcucacugcagucuccaacuccuggcucaagcaauccuccucccucagccuccugaguagcugagaccacaugugugcaccacuauauugcacuaguuguugaaguuuuucguugagauggggucuugcaguguugcccaggcuggucuugaacuccuagccucaggcaguccucccacuccagccucucaaaguguugagauuauaggugugagccacugugccugagccauuucccucuagucuuuuucaacaucagauucaucauuaccgagaaguagauugguuuuucagaggcacccaaaauuuuaguuguugucuaagcaagucugcucuuagggucacugacaaaaaguauuauuugugugacuauacugaaauuuuuguuucucuuaaaacacacacaaaaugcuccaaguggaauguuugaacaucauuugggaaauagcuuacaacauuuucagguuuaccuuuucugaauuauaaugcuuugucauugaaaagagagcgugugcacaaacucuuuuguuguuuuucaaguuuuucuuaauggacauuuuuagacuuacggcaccuugguccaaaggcuauauuguuuuagaauuuaaaaaugccaugaaggaucucagccagauuguggaguaucaaugcgauaccggauccaguguggauuuaaucagaacagcuuuucuuacaugacugcuaagaaagauaaauuagcuuucuauuuuucuagugcggggcaggccccaacugucaaagcucuugcaacuuacaguggauacuucagggucccauucucauugcugagacacccugugguuuuguuuguugacucaggguauuuugccaagaaccagcugcuauaaaugacugcugugcacacacuuccagcuuuuuagcuauuuauuaacaaaauaaaagcuguauacauuaacaaaauauaagauauuugagauuccagaaaaaauaagggggaguugaguggaauaauagguaaggaugacuaaaaagaaugauuguggaaauagcucauuuuaaauaucuuuuucuaacaucauauguuggagcccucugguucucugaaguuuuccacuaaaucuaauaaucuuagauguauucuguacucacuuugaaggagcaguaagcugaguucacucagcagggaaauaacagugaaaaggaaagaaaacauuuugacacuaagaaacgcgugugcauucacaggaaaucacucuuugggacaguagugguaaucucuuucucuugccuggcccaguuaucuguccugacuuucacuccucagugugccucuucaccaaacucuguggaccaguggguguccauucagcugggcuugcuuuuuuuuguuguuuuuauuuuauuuaaguucuaggguacaugugcccaacgugcagguuuguuacauauguauacaugcgucaugcuggugugcugcacucauuaacucaucauuuacauuagguauaucuccuaaugcuaucccucccccuuccccuaccccaugacaggccccggugugugauguuccccuuccuguguccaaguguucucauuguucaauucccaccuaugagugagaacaugugguguuugguuuuuuguccuugcgauaguuugcugagaaugaugguuuccagcuucauccaugucccuacaaaggacaugaacucauccuuuuuuaugacugcauaguauuccaugguguauaugugccacauuuucuuaauccagucuaucauugauggacauuugaaauaggaacacuuuuacacuguuggugggacuguaaacuaguucaaccauuguggaagacaggguggcaauuccucaaggauccagaacuagaaauaccauuugacccagccaucccauuacuggguauauacccaaaggauuauaaaucaugcuucuauaaagacacaugcacacguauguuuauugcggcacuauucacaauagcaaagaccugggcuugcucuuaaaugucaugaauauuuacaaagcucacaaacucuacucuuuuuuuuuuuuuuugagacagagucuugcucuguugcccaggcuggaaugcaguggugcgaucucagcucacugcaaccuccgccucccagguucaagggauucuccugccccagccuccugaguagcugggauuacaggugcgcaccaccaugccuggcugauuuuuuuguauuuucaguagagacaggguuucaccaaguuggucaggcuggucuugaacuccugaccucagguaauccacccaccuuggccucccagaguguugggauuacaggcaugagccaucacacccagccaacucugcucuuuuuaauaggagaggaaugagggagccaugucaucacaacagcccuagaauuuauugcuagacacuguccugaaugaucuguuucucaggacaccacgcuugcccuuguuccccuuugagaggguugguagcaaaacccugaaggcugggugaagaaauuccaagaaaaguuugcacacucgccggguaauacuuaacuugcacuccuggauuuugaaguugacuccaacagcccauucugagcuuucucauggggccuuguaauggccuggaaaacuagugaugcuguuccucacucuagccaucgaugcacccaccaagugagggggcuguggaggugagguuauaugggagguuggggacgucuuccccagugguguuuccacauuuccaugacaucauucaugagaagucaggucagccuguauucaucaggcacuaacuguguaagugcaccuccgagggugggucagucaggcgcagguuggagggaugccccugugagcugcugacauggguuugccucagccugugccauucugcuuggcaucuuggguuggcccuuccucucagacugagcuuaaaugaaagucaguuuccaagagugaacuaauuauuucaugaauguuuauccagauccugaacuccuuaugacuuuuucauauguuggcuguuccacugaucuuuggcuguuaaagugcaaagaagaagggaaaggagaucggacuuagauuuucugccuuuccuuucuuguugccaugacagcuugagggcagauacugauuuuuuuccccccaaaaugaggauuuccauuauuuguggauucaaauauuuucuugagugugugugugugguaaauauacauaagaaaauugaucauucucaccauuuuuaagcguacaguucaguaccacuaaaugcauucacauugugugcaagaaucaccaccgucccuuuccagaacuuuuccaucuucccaaaccgaaacucugcauucauuaagcaaauguuugagucauugucucugucucuuuaauuccucggccuauggaaauguucuuuggcucauuaucuaaaaggagaaguucugucauuacaaauggaauugagauacauaauugagauacggaaugcccaagucaaagccagagacuggacuccuuuccccgcucuuccuguggacauuuuguugaaaaauucuacggugacuuugacuuuucuuccauuucuuugucacuggcuuagugagaacaaucuccaggaagaucucuucgaccagaucuuggcugggaagcuggaguuuccggcccccuacugggauaacaucacggacucugccaagguacccuccaggccuguuucuguggguuguauuacguugugggguccucacccauugcacagggcuguagcugcgcuagguauugcauuccagaaagcuccuuggcuuuuaaugugugguucuucuuuuaaguuuaucccaugguauggucucugaaguucuuggccaaauucuuaaagcuggacuggccaucuuuccaguuucccuccauccucuugugcuccucuaaguucucaacauccauuauuucauuuacucaagaaauauguauugggcacccaucaggauacagggaugaacuugugaaacacacugaauugccaaaaggaaaaauacugcaguuuuagacuguggaauaauaacaaugaccagaacucuuaggugaaaacaucuuaguuucacauggacucaggagagacugucuuuucuuuugcacugcuuauaaggcauuaggagaguagguauaaucacguuuagguuugaaucaguuagcagcugugcuggcucuucucugaagugcuugccacaaacucagauuucuguauuuaugcuggaauuaccuccuuucuccuccucuguggucugacuuguuuguuuauuuguaggaauuaaucagucaaaugcuucagguaaauguugaagcucgguguaccgcgggacaaauccugagucaccccugggugucaguaaguacccacauucccagggaaugggccucacugugcucuguggccaacagcacgguuccucacugugauguuugcacaugcaaaaguuaugcauccaagcuccaugguagaugucugucugucccauugagcaaguagcauaaagauggcuccccaagaaagcaguuggcacuagggucccagucuuagacccugccccgcgagucaccugggcaagucacugucccuuucuuggccccaguuuccuuaucugcaaaauggaauuggccacagugcuccuucaggaggcuuuuagcucucgucuucugcgguuugggguuugagaguuuccaggguuugcccuggagaugagccuguuucagacccugaccuuugugccuucagggaacgugcucucaggagaccucuugcuguugauggggaggcugagacaggaucgcuucagagcugaguggagacacaugauauugacuagaguucccucccagaggcucagguggucucugggagggaaacaugauccaauaaauggggacugugggaauuacauuucucccauuuccgucauuucugggaggcuccaggagagugaaguuaguuuaauuagcccagggcuuuguugacuccgguugggaagcucccuguguaccuccaaugccccacccacccaccauccaggugcaguuucucuggacccugcuugcugcucucuugggcuaaaugacgugguucuuggaccaaguagcuaagauaccacauuuuuuuuuauuauaagcaauaaagacuaacaacuaaaugaauucuugauuaaagugaaaaacaaugaucuuugaugcuuccaugggagggaucauacuaaaucgugugccuugggugagggucucaguagccuaaaguguguccugcuuugugucccgggagaccugugcccucuccugggccuacucuaguccugaggggcagagggaaugguguggggucuuucugagggcaugggccuacugaauaacaauaguuauuuuugaaagaucauuguuucccuaauucuguggcuaagaggggcccauuuaggaagaggucaggagggugguugaggcggggagggggacucuuaaggaaaagacaacucaaacgggaggauggaaaaagcauuguauuugauuguuuucuuuccuguaggaugaugccucccaggagaauaacaugcaagcugaggugacagguaaacuaaaacagcacuuuaauaaugcgcuccccaaacagaacagcacuaccaccggggucuccgucaucauggugaguggaaggcggcaggucuggccugacugcggagccggccuugaaguuuuugaauuagguagccgggagcugcccucacauggaaguuggugccuuccguaguccuauuucauaugaagauuggcuuggcauguggagggcacucauucggcaacucccaggcuuugggcacuguguggaggggcuuguguagggaccagcaggccuggugugagggguccaggcgucaaggagcuccuggcugggcccucugggcagcugcuuccacucuugucucugccuucucaucuagagagacucccaagcccuggagggguguguuguguuaggaauuaacucccugccuaccccaaggccucagaaauagauuauuagagaugugaauuauucuuugagacuugggauaagaaacagccaaagcuaaacauauuucaguuuuaaaaaaucaguguuuuauaaaacacaguuuggggcuuuuaaagguacauaaucaaggaaaaaaauauauauucauuuuucaggguugguaacauuuuaugagaugucagugacaacgauggccuuauuuuuuucagccuuuucuucuuccaaaauguuucuuaaggcaacucuccuaaauacauaaacacaacaaauuaaaaugaaaagugacaugagaguaaaugaaucaaaaggaaaaaacauugaaccagaggugagggcagcacacccgcagcagcuguccaggccugagccaaugcaacccugggcgggaaggccagcucaccgugagcagguagaagccagccagccacccaggcagggaccuugguucuccccacacacucccaggagcagggaacagggguggaguggccuuucccagagcuggaguuggcugcagcagcuuucgaaucagaccugccaaggugaugggcgucugaguuucacaucugggccccccgugaccccacugaguccugacagcuaaggaugggccaccuccacagcuccgucacucguacuugggacaggccucucauccucugggaagguccuccuuguuuccuacccaacuagaagggaaacaguggcauauucucaugguacaugguugucugagagccuuaccuaggaagacgcagggucuagauagaagcuauaaggaagccacacacauaacccacauccccacacccccaacaucccccacacuccccacaccccccacaccccccacauccccacacaccacaaauccuccacacccccacaccacacaucccucacaccccccacaccacacaucccccacaccacacaucccucacaccccccacaccacacaucccccacaccacacaucccucacaccccccacaccacacaucccccacaccacacaucccucacaccccccaacacccccacacaccccccacaccacacaucccccacaccacacauaucccccacaccccccacacaucccccacaccccccacaucccccacaccccccaaaucccccacaccacccacaucccccacaccccacacaucccccacacccccacacaucccccacaccccacacaucccccacaccccccacaccacacauucccucacaccccccacaccacacacccccacauacccccacacacucccaucccccacaccacacaucccgcacacccuccacaccacacauccccacacaccucacaccccccacacccccacacaacccacaucccccgcaccacacauccccuacaccccccacucuacacaccccacaccccaacacaccccacauaacccccacauaccccacacccacaccccccacaccccccacacccccaccccccacauacacacccacacaccccacacccccacauagcccacacagccuacacaccccacacccgaacacaccccacauaccuccacacaccccacaccccccgcccccacgagcgugcagcacucuguuauaugcauugagcauacaccagguacccccacacacccccaacacccccacacaccccacacccgaacacaccccacauuccccacacaccccacacaccccacgagcaugcagcacucuguuauauggauugagcguccaccagguucucagcacccacugggccgucauucucuucugucccccggcugcguuuauguggccacccucuguguguccuugcaacuccccagcugcuccccugccagaaagugugcucucccucucucccucucucccucuccagacagagccuggguuugcaagcugagucuuuugauggcuugcaggacuuugggggcgcucugugccaaagcagugagaaggccuuuugaguugugguuucccuugaauuuuagcaguguuuugcugaaagccugagaaagucagaguugucaaagaauuacagcuuagacacuuugaaaagaaccaucuugauugagccaacagcaugagaauguuuccagcgauucccuugcgagagcuagcauugauggaugggcucagugguacacagucuugcugugcacugcguuguaaggcagcuucuuggaaaauuuagaaaaauaaaacauuaaaaauuggcauacucaacgugucaugaaaaaaccuuaagaagagagauugguuaggaucaaaauuuaauaaccauguuaagucuucugagaggaagaaccuuuaaccgcccugugcccagggcuuaggagaguuugcucggagacugugaagggagucauugcuggggucacuuuuugacucaggggcccagauaggaaucaguggccauaggccugugcccggccucuuuauggcuggcucucagcugacauucuggaaugauuagcuguucuacaggcucuguccuagauaaugacgcuuagacccccucagacagaaccuaugucgugugguuuacaaauaccauuuuccauuugcugaugaggaguucaggacucaaaagacaaaccccugggcucugacaggguguuugugugaacaaacaacccguuauuguuugcagcucugauggugauuguaaauguuguauguuuauguguguucaguugucauuuugcgcauguuggcaggguguccccucuaaccccauguuaccuacacaacucugcaggcuguuagcucagaggaacugcugaugucaugaucccauucaguaccuacagggaaauucaaucagucuugccucugguggcacccauucucgauggccaaaacaccagccugugacuuuugggcugucccaaaaagugggaggggaaggccugcugcugauccuccccuggcgcaggaccuggucuggggcaugguugugugggggaacuugcgaugcugcuguauuguccuccucguccuccucauccuccucguccuccucauccuccucauccuccucauccuccucacgucacuguguguccugucuucggaacaguuuuaaguguuuuuacauuaaaaauaaccucaaaaugacucucccugguacucauagguccucauaacugagacuguggggccaaccugguuuucugcagauacaaaugauaguggaaauagugucaaccgucuggagguugaaucaucagauaacuuacagacaggaccuucccaucugcugucacccuaguguucucauccccagagcuggggccugagacuucagugagaaaaugaugggcuagaaauugguccauaaaggugaaaaaaaaguaaaguugaugguguuaucugcauuuuguuugacaguuugauuugacaguuugagaggcaccucagaguuuccuucuuuaccccgcugagacagugggagagccugaagcagaauccugguauucaccacgcugcguccgaccagcgcgccccauccucagccccucucacgccugcaugcuugucucaguuucugaugccgccguccggcucucagcugcuuacuggugugggucuuuuguaccuacucacauccuuuccagccagccaagcaggccccuggaaaacuuuauuuucaaacuucucagcuuaccacacugccugccuuuccagaccaacagcuggugagagcacgggaggagucccauaguucuccuaccgaugcuguuucccacuuaggugaaaaguggcuuuucggaaagagcagcuuaagauggugccuucgugaaggcuuuuguucuuucuccagcugcauuuccaaagaugaguuuguaucaguaaguguaaucucagccagccuuugggauaagagaagauaauuuaaugggugaggccuugguuucaggcagggcugaggugugggauuacaguucccauuuucuuggacuuguccuuagcaugcguaagaaaggacagagcagggugcaugcaggacggccucccauguaccccggggggcucgccccaguugcagagaccaggagagaccaucuuguggugggaagggaaugccgagaagccgccgucacucggcgccugcggugcagacuugagaagggacggauucaagggcauugccuucuucgcugggggauuaugccuuguuucagggggaaguuggggaaggauuuggguuuauugccuuaauuuaagauagacaaaacuguuucacucguguugcuucuguugaaaguaagucuaguuucugucccugcuucucuccugccuucugccucucccgccgccugcauugcuucccucuggcuagguccaaggccaugguauguacuaaccgcacugccagccugccuucugccacacacgccccugugcuucugacaggaagagaaaaggagaaauaacggggggauuguuuucuuguacccaggagacauuuugugguaggaaaaaccuguaugcuggcucucugcuucccauguaggugggagcaucuuuuaguggaguuuuccacaguuacccuuucuccagguaguugaaauuguccuuggaaauuguagggauuuggggaguuuuguuuauugagacaggaucuugcucuguugcccagacuggagugcgguggugugauccuagcucacuguauccucaaacuccugagcucaagccauccuccugccucagccuccaaguagcuaggacuacaggugcacgccaccuugcccggcuaauuuuuaaauucuuuguggagauggagucucuguguugcccaggcuggucucaaacuccugaccucaagugauccucccuccuuggccuccggaagugcugggauuacaggugugagccacugcacccggccagaaauggaugacuguucagcuugaacuugugagggccuguggagaagcagccauuccauagguggccccaggugcccugaaggccgccacccaaguucaucuuagaaagcccuguuguugauucuuauuuucuccagacuuuuuuuguuguuguuaaaguacugaaagaaucuuuagugcauuuuccccucucccuccccaggguaguuagauuacaaaaggccuccuggcaauugucccuuucagcuaaaggugccugggaacugccaucuccuucacuuuugggaagcccauugagauggcagcuugaugggcuucccuggacaagcaggaaauagagaaggagaaagcaggaccggggucccuuccccagccaggcuuagaacgcaaggugacugccucacaucuuuguggcuguuucucuguuccuugaagagcugagcagauuuaaaaacuuucaggauguuucaggauaaggaagcuuugcuucaugugaagagaagacaggugaggauaucauggaggaucugaaaaaagaguaauguggcuccauccaauuccugggccuuuuauaggcuucacagcaucucagguuguuaggaggauuaauuauucacaggacaugcggguaacuuuucaaucugugacagagagcuuuauuuggaagaguaaacucuccaagacugagcacccuuguaagguuugcuuauugucucagaauucuuuugagcuuaaggucugggcuugggcugaaggggugagaacccaggcacagcccaaagcgagagaagacgacagacauccaguguguccugggcugccagccugggucaggguaggagcagaggccaaggacagccccuucccccgguggguucccgaaaccauuacucuccugugaggcuucuguuagaagcuuggcguuauuucuccucuucuguuucugaggcccgugcaugcucuguugugcucucugcucguggcagcugggacccgagccugggcccggguaauguguugucucugcuguuuccuccucagaacacggcucuagauaaggaggggcagauuuucugcagcaagcacugucaagacagcggcaggccugggauggagcccaucucuccaguuccucccucaguggaggagaucccugugccuggggaagcagucccggcccccaccccuccggaaucucccaccccccacccuccucccgcugccccggguggugagcgggcaggaaccuggcgccgccaccgagacugagccuccugcagacgggcgaagccgccugcugcagcccaggaagccagcccucugcucggccucgccggccucccugcugcaggccucccucucuucaccgccugcgccugaguucgcggguccuccgcaggccgccugggaaccggagccuggcgugccggagccuggccuggugcucugggcucugccuucugguuccuggaggcaucaaaggcugcauccguucugccaacagcuguucggagagacucguuccagaucaucccgucauuuucaguuuguuggacauuuuacagcuucaccaggagaaugugcaacuuuauuccagcauucgaugcauuuuuauagaaacacuuuggaaacacuuuggaugaaccaaggccuuuuccuuauuuaaguagacucagaacacucccuuucuuuucuuuucucucucucucucucuuuuuuuuuuacgaaagacuuagaauugcauuuguccuuuuguggguguccugugagaggugauaugggggcuaagaggacuggcuuucuaauagaagaagugagcgccugagaggacaauuuggucauuggacacggauugcaggcuuugagaagcgcucagaggcccagggcggcgggcucagccauucggcuuggggcaccaggcuccccagagacaaugcucaguauucauucauacacagacgauggaagaagccacuucuucccugggcgguguggguuucccccagcucuucccacacguguguuaggaaaugcccgugaacuugcccucugggcuuuuuaaugagaggcuuggcgcaugcggcacccagcggcugcuucccugcaagccagcgacuugccgagcagaaugagcucugcuccugagccccgguagcugcuuccucaucugcauuucaucuggagcagggcagguaaccacaggaggaggcaugcccgaggcagccaggacugggcgggaaggugcucccuggauauacucugugaaccuucuggaaggcugcuggcaguuuuuccuuuuuguccaccacccugcucuuuuuaauaauuguacauaauccguguauuuguuuuaccugcucaucuucuaaacuggcgagcccuauaguucguucucauuguuagauuuugccuuuuacaaguguccccaaccugcaauaaacuuuucccucuugaaaaaaagua

SEQ ID NO: 13661 - RNA, 17251 nt, Homo sapiens
ccucccccgcccucucugcugaggauggaagugacgaaagcagccgaggaggucacuuccugcugggguggaugaggaggagccggagacgccgcggaggagaccggaccgaagacggaccgugccgggaagaggugagucccggccucgccucggccgccggggugucuggguuggauccgggacccuggcggggacggcgucccuggaaucggggccggccgccaggccgcguacccacccagcugggccucacccagugcggggggcgggggagggugggaucccgugucugucugaggggcgacagggacccagggcagcguucaugcgguggccccgcgcagcccugaggccacgguuaagggaagcccggcccgggaggugaauggcaaggagguucugggggcuguggaagccaggacccggagcugcugcgggaaacccgcagcgccagacugugcaugccucacucuucggggaguggucgcgaucagaggaagggcagggguccugugguuugcagaguugagacgaguggcccuacuuggauggaaguguccuugcagugaauaugcgaaaggcgugcagaggcgccccagggcuccugggaaagggacuuuuauggggaaaauuggagagcuggagugucaagagaggguuuccuugucagguuaucguugcaacgggauuuggaccccagggucgugaugguuggagggaguucuguggcaggguaaaaggccucgcgaucugacagcgcauccuaggaguuaagaguccagggcagcuuccuggagcaguggggaaauucguguuuuuccucccucauugucacuaagguggaagaggaagcuccugccucagccccggugccucguuauuauguaucucgugugugugugagaguguguguguguguguguguguguguguguguuuuuccuugucugcuccuuccuuugggguguuuaucuuguccucggccgcuaguaguuuuguagacugacacuugcuggucuccuuaauguguuuggugagaaaaaauauucaaaagaucuagagaaauccuagguuaggugaaauuuccaagauaaggaauuugucccuacgcgggggccacuuaggcauucucuccagaugccugcuaauguggaugcugagggccugucauccacccuggggaacagcgaggguagaucugcccucccuccaugucccucuggcaguuucaccccucccuccuuuuugcuaagugauuaacacaaagcuccuugcugggaggaacaggaaauuuauugaggaacuguaaaucuggauggaaugaauucaaaucgcagcaagacuccuuccacucacuggccagaagggcuucagaaaugccugcuuuucaccccuuccuguuaaauggagaaaauguauaauuuuucucaaaaaauuuuugagaguuuguguguguuuuuugaauagaguaaauguacauaugguguguuuacuuccuguaucccaggguauuuuucaagggggagggagcaguuuguggcugggaagaaucuuccuucuaucucacauaauucaguaaaauaaaucaaaaucagauguucauucuugagugggaaucagauggauuugggauuuuuucauccuuuaaacugguacaucuuggugaacucaggcuuguguaucuuggcaugugggcuugucuaguaauagaagacaaacuguuugacuuguuuuggcugcguuuuuggacccauuucacuguaccuuccuuuuuuauuuuuauuuuuuuacauuugaaggguuggucaggaggaggaaaacaaauauuaaagacaguguuuacacuuugugguuuaaagucaggugagagauaauuauggcuuuugaagcugaugaccugaggcccaucauuugauaacuuggggaguagcaguuuggaggugacauguuugaaagaaagagaguugcauacggaaagaagaacaggggaaaggaaguuuggggagagacugccagaaaacuuuugagaggauacuaaauaaauagcaucuuaaaguaauuguguggcuugugucucucagcaggcgggugaaaaugaaagccggcuguagcaucguggaaaagccagaaggagguggaggugagcagaaguuaaucaucucugauguaccuggaagcuucccucagugguuccuguccucuccacuugagcucuguucacaaaugucagaccaugacugacacucucuuggcuagguggauacuggcaggacaguuguaggcuuguuuccuauggauguauauuuaacaugucuggucaccacacccauauccuaagcuuuagagucucuuugcugucagagacacaguuccaaccuuagggaaaaggaguuuucagcuguauuuuccugaaacauuaguuuaucuuuccuguuuguucccuuuagcacuuuuauguccucacagaaaguagguguauuuaguaauguaugaaaaggucagcuuaggacaucugguugcugcugcccaacucuuaucagauuuaaugauugccacaaggauaggugacuucucugugcuuuccucuccccauugugguuaggcccagcugacugagaguacuuacagcauguuugcaaagcacucuagauucugagcaguggaaugugcaguugggguugcugguauguauguaccuaccucuuaacuagcuuaaucuugaccuucucacaugaaaggguaucaguuuccugacugggccuacaaaacagagucauccccaggcucccggcagauccagcuguggcacuucauccuggagcugcugcagaaggaagaguuccgccaugucaucgccuggcagcagggagaguacggggaauuugucaucaaggauccagaugagguggcccgccucuggggccgcaggaaaugcaaaccacagaugaauuaugacaagcugagccgggcccucagguaaggaaaaggauucccaaaucuguguuaacagauuggaaggagacuaagcuguuuggugaaugcuagauaaaaaggguaucagguaauaaaagacuacacuaucuuagugaauaaugugucacuuuaaagugggaguagaagagcuguugaaugugaguagcauaggcacaggaggagaaaaggcauaucuuugguuauacguaggaggggauuccaauguggcuggcacuggauccugacagacagcugauucugcucuguagugggcgagaguauauggugaaacauggauuggaguucauuuauaauccaaaggauuaguuuagacuucucuauuagaaucuguuagaauuucuuucuuugggcuucccugaaagaaacuuagaaaaggaugaagcaagucacgggaggaagauucagugauacugaccuaucuauuccggaacugugucugugagcucagguuguccauagccugcugcaauaugucuaaagauugaucacuauaaguuuucucagguucuuuuuuccccuugucggucuuacauuucauaguccuuuagcccucaaggggcuagaaggcaguuuaugaccucugcuacugcauagauguaagacuaaagguuccagauaauugaaguucuccugaccugaaauguaaacucuguacaguggcuuugcuguauucuuucacaucccuuugagucuuugaaggugaggcgggccacacuagcugcuguuuuccagaucagggcaugccauuguuugaccugccaccauaaaacaguuguacauuccuuugucugucuuuugagcuuaggccuccagacuaaccacaucaggucucccuagugauuugucugcccccaccugggcaagaccaaaaagaaaaacuaagcaguuagugacaugcagugcaaccggacggaaauggacuguagaaucgaaauuguagagagauggagaagaaaauguuuggggcuaggauaaguguucagaaucuuaaagugaaguugucuuuguaaaccucuaggcaaaaacgagcugaguugaaaauugaguaagaaaauuaagcuguuaggucuccuagaucuaccuggagggccaggcugcgaaagauugguagugauuuuuguaaguaauacucagagcaagaauuguuggucucaguggcuaccuaaguguauugaaagcugucaguagcuacaagacgaauggacauguauuccuguuuuuacagauacuauuacaacaagaggauccuucauaaaacaaaagggaaaagauuuaccuauaaauuuaacuucaacaagcuggugaugcccaacuacccauucaucaacauucggucaagugguaagauacaaacucuuuugguagggaauuaauuuugaauugaaaagaauuuuuaaaaauccaaaucuaagacauggcauguuuaggaagauuuuagaaacacuaaaauaaugugauccuuuggauugccucaauguucuuacucaagucaucucacuuauaaggagaguuauaggcuauucaguaucaagauagauuucuuugguuuauuugguugguucccuuuucugcauauuguuuguaaucuccuagauacuauuacgcuaucuuguuugggaaugauguuucauagguuugugaugaucuuuacguucaggacucaguuuuaacacccagcccagugguucuuucauagaugggaaccuguuucuacaaacacuuccgauuuucugugaaacuaccaagcucucccuuaucaagugaauaucaucaaaaccacagcauccuugaucagagaagggggagguucacauguuugcagugaaaagcagugucuuugaucugcaacagcaaauccucagagaaaaagauucugggguuacuugaccuucucuccuguuaagugcaguagggcuuccccucuugacuuuccugguuauagcuuuccaucacagcuccccacauucucucuugauguugaaagcagucucucaaaagacuuuguuguugugugguuuuuuguuugugauuuuuuuccuuaugcaaaucauacuccugcccaagaaaauacaguaguuccccuuaucugagcaguauauguucuaagaccccuaguagauucgcaaaccacagauaguaccaaacuccauucauauauaugauguuuuuucuucccuuaaccccacucauauguaucugugauaacguuuaauuuauaaauuaggcacaguaagagauuaaugacaauaauaaaauagaaaaauuauaacaauaugcuguaauaaacuuaauguggucuuucucaaaauaucuuuguguacuguacagaccuauuuucagaccuuuguggguaacuaaaacaguggaaagcaaaaccucagauaagaaaggacuacuguagauuguauuuaacuguuuucugaccaguccaucaguaaguacucugucauuguggccuuguaugcuaaggcaaagaaugcugaucaugcaguaauacaacuucucagaaaagcuggaagaaaccugaaaaauuagugggggugugguugagagaacauaauguugagauccauugcagauauguaauuacuacacaacaaguuagggcaguuuuagcuugacucugcuaucauuacaguuucaucucaacuucuguaaccacucccuccugucccuggggcaugcauuuaaaaaaaaaaaaaaaagugguauuggaaugcaucucucuaauuacaaccuguuuucuuuccuugugccugagggagaggcguuaggaaaucagaccuguacucgccacucaaaucuugcuuccucuguuucucacucuugccccuuccuuguaugccuagaggaauugggaaucuagauguauauaccaacaauuuuaaagaauuuguugguuuucauaccccuucaccccacucccaaaaaaauguuucauucgucuuguucuucugucuuugacccauuuuuaucuauugaaaauccagaacuucagccacuuggacaaccuagaauggggcauucauaagcccugggaaguaaugugguuuuccagggcaaggaaaccuggauccucacucugugaagaaucugaucuagaaaccuaacaauaguggcccagcacaccuguucugcccgaaggcgauugaaccaacauugaucuuuaacccaagcucaagauccuaaucaaaaagccacaaggggccgggccagguggcucaugccuauaaucccaacacuuugggaggccaaggccggcagaucacuugaggucaggaguucaagaccagccuggccaacauggggaaacccccaugucuacuaaaaguacagguggcagucaccuguaguccuagcuacucaggaggccaaggcaggagaaucacuugaaccugggaggcagaggucgcagugagcugagaucaugccacuacacuccagccugggcgacagcgagacucagucucaauaaagcacaaggaaagcaaaacuguguacauuucuuuuaguacaucuaucucuacuaccugguugcucacauccuagguauagacaacugcaaagaacuggugucauuaguuuuuaaagaacuuuugaccagagaggccaaauguuguuuaagguaacuuuaugauaacaaaggaauguaacauuuauugaacaucugcuuuauggagguacuuuugcuuaguaguuuugugaauuacguuauucaacuuuucagcccagugaagugaaugucuugauauccacauuuuacaaaugauaaaauuaggaaaacgacagcaaaguuaaagacugaucaggguagguugaauaguuaucuauugaacaguuucuagggaaacaauuccugagagaucgagcuguugaagucuagcccuuauuuaauagaucauacauuccuccucuagguugugauucauuuguucaacagauaaugggaguucuuuaccucacggaacuuacaguuuagcaggagagauaagauaugccggguuuaauacaaugugaaaugugauaaguacucuaaauagagcuguguggauuuagauccuggaggccauugagaucauguccacaagguggguugagacaguugggguauucuggucuguguauuuuaucaugaaaagcauccuguauaacacauuauuaaaauauuuucuuauauuugcauaagaaacauuggaaagauacagaagauacugucaggauggggcaggacagaccaguucagggauggacuugauaccgcucagucuaugccucucuacucccaccaaccccaguuuuuuaauuuuuauuugggaaaacucgaaaccuacaggaauacuggaagaaggacaguaaacacccauauauccuuuaucuagauucacuaaugguuaauauuguagccacauuugcuuuaucucuuucuauuuauauauacuuuuuaaaucuuuugagauuaaguugcagacaucaugacauuucgucccuguguacuucagcuuguauuucccaggaacaaggacauucuccuccauaaccacaauaacauuaccacacccaggauguuuaacauugauauaauucuguuaucuaauacauaguccguauucgaaugacaguugucuuuuuaggguuuaaauuuuguaccaugauuaauaaaaaaauuauuuaacaaugacaugcaauuugcuaugcuugguacuauucuaagggcuuuacaaauauuaacuguuaaucgucauaacaauaggcccugugcugaccuauuuuacagguaaggaaacugaggcacagagaggcaagcuguccagaggcacauaacuaguaagugguaggaccaagauuggaaccuaggcaaggaccuuaugaauuccauuuugccagagggggucaaagauuccagugugcuacuuguacuaggcuacaagguggaagcugccagaacugagauucagacccaguuuuuucaaccccaguacuugaauuucauggugacuucauggagguggacuucuaaagcaaugguauucaaacuuucuuuuuuagcagcaaacuuuuuuucuaagcaaaaucuuagguuugauaucucaacauauaaaaguagggcuacuucaguuaaucagagauaaggguuccagaaugcuagaagcaaugcuucccaguauugcuucuagucucaccucccauuacuccaccuaaauacaucaggaaaauacugcuuauuaugucuccuuuacaguauaccuuaacguauguaaagacugagauauccuccaguuuauuuuucuuuuuuaauaaaaaacuagauuuugggccggcacaguggcucacgccuguaaucccagcacuuugggaggcggaggugggcggaucacgaggucagguguucaagaccagccugaccaauauggugaaacccugucucuacuaaaaauacaaaaaucagccagucaugguggugcgcaccuguagucccagcuacuugagaggcugaggcagaagaauugcuugaaccugggaggcggagguugcagugagcugagauggugccacugcacuccagccugggcgacagcaagauucugucuccaaaaaaaaaacaaaacaaaacuagauuuaaccaagcauuucuaaguugcuuaggagacaagaccuuucccugcacauuauacuuccuucuucugaauacauagaaguggcuuuuugcuuuugaguagauguacucuuaauugaaagucaagauccaaaagaaucaaaaaggguagaauuguagccacuguaauaagcuaguagaagaauacauuuggccugggacccucuuggcucuacucaaaucauuugcaaggucauccaucuguucuuccuaauuuuaaaauuaaaucaguggcuuuauuuuuuuuccagucugugauuuuguuuuuaauuaucuuaagucuuauaaucaugcauaauuuuuaaauuuguuuauauuuccucuacuuaauuccuuuuaaauuggcaaaagcaccauuuccaaucacaaauacacagcaguucuacaguguuauguuucugaauggcuguuuagaggcaaucccaaauuauaacuuagucugaauuagaugguaaagaauucaagagugaaguuuaacuugcuacuauuuuuaaagcaucugauccuauagaucaccuauaaaaugugagaaguguuaaaucuuuauuugauauuacacauaaacccacuaaaaugccuuucaauaaguaaaagaaaucacuuuagauacagauuucuaauuaaauuggcuauuauuguuaaaaccaaaaauauaaaguagacauugcugccuuaucuucagcccuugccuuuaagaggcaaaugaacauaaaacacuggugaaucuugcuugguucuaagacagugaaggacuuuccccaguauuuaaauauauucacauaacuaguuauguaaaucuaaauauaaaaccauucuccauuaaguuuuaagauggcauucaucaucuuugugaaaaguugaacauuacuaaugaaguccagucauauauuuagaagggguaaacagugauagauagcauuuacuaaaucggaauuaccguuaaaauuccaaaagccaaacauauucaucuaaucucaagucagucuuaauuaaaucaggacugcccaacaaaaaucugucagucauucaugaucuggauucugguuuaugagaucuguuaaauuaugguacacauaaaaaagucaugaggcauuucuguuuugcaauaaauaaggcaguguccaauuauuauccauuaguagcuuuuuugagauaaucuaucaagucugcccuuuucugccuuaaugucggcaaagaucauuuuuguuccaaggauguacuucuugggauucuccaaauacuccaucgguauccucuccccagguaaugccuuuguucuuauuggcaucuguguaagagaauccaguggccugaccugucuuccacccaaagagacauggagauuaggcccagucucgugcuugccucccuuuuccacaguguggcacugggcacacuucugaacacaaaucuucuugccuuucucaauaucacccguauuuaauucucucuuucaucacuggcaauaugaagguuccugcucggaagccagacguccugcucucuaaaucaguggcuuaaaaaaaaaaaaguccugcagaacaguuuucuguggaacauuaguuugggaaaugaggcucuggcauaguguuacucagucccaugcacccagaaagcuacagucuuacgaauaccagcagacuccagagucugcuagaccaagaggagaaggcaccagcugauugggagcaauucauaaccaucccauaucuguguaccuuuuuuguuuccacuccuagaucacuauacuuaaaauuuuguuuuuuucuauuuuuuucuucuccuuuguucuuucuucaccuuugccugagaacccugcugacauuauuauagaaacugcugacaccuccgaggaacccacaggucccugagacuucagauggcauaccuuuuucaugucuuaucaggaggaucacuggggaaguugagaacugugagccacuaaaguugaugggcugggcgcaguggcucacaccuguaaucccagcacuuugggaggcugaagcaaguuuaucguuugaggccaggaguucgagaucagccuggccaacauggugaaacccagucucuacuaaaaauaacaaaaauuagccgggcaugguagcacacaccuguaaucccagcuacuccagaagcugaggcacaagaaucacuugaacccaggagguggagguugcauugagccaagauggugccacugcacuccagccugggcaacagagugaaacccugucucaaaaaaaaaaaaaaaaaaaaaguugacauaaguagcacaguguauguuaucacuuagagcuuuacauuuuaguaagcaaacuuggaagaaggaauaguagguccuggauuuucucccagccuccuuaauguuugaaagcagguuggagauggagaucauucaguagaauuuguuagaggaauauagauuuggagagauugaaaaauauuugaaucucugugaagcagugauuguauaucaggaaugauaaaacacuugguaauaagaacuuaacaaauguguagccuuuuuaaaaauuaaacuguuuuuacuaaaacauggucaguguaugugagguauagggucuuugaguuuuaucuuugaguuuuuaaugcauuacuuuccaugcaugucauuuccaguuuuguugauuuguuuuuugguuugguuuguuugcuuuuuauaugcggcgaagcggugcauccaggaauggggccuuggcccaagcagagcuucucuggaggugcagucagccagggcagcuaugccccuccccacagucagccagggcagcucugccccuccccacagucagccagggcagcucugucccuccccacagucagccagggcagcucugucccuccccacagucagccagggcagcucugccccuccccacagucagccagggcagcucugucccuccccacagucagccagggcagcucuuccccucccuacagucagccagggcagcucugucccucccuacagucagccagggcagcucugucccuccgcacagucagccagggcagcucugccccuccgcacagucagccagggcagcucugccccuccgcacagucagccagagcagcucugccccucccuacagucagccagggcagcucugucccuccccauaucccaucucgaaauauaucuguauuccaacaaggaaaaaugggauagcauguggguagucuaggcagugaguaaacaucagauguccucuuguagcaacuaucuauauguuguuauuauuuucuaucuuaaauguucucgaauguuuauauuucaguaaaccucuaccucgucacacacacacacgaauauauauauauggccaaaauuauggaaauaagacuauuugcagagcuaaaaauugaaacagguaauauauacacaauauuuagaguugcagaggagaaggcucuuguacccauucauucauuccacuuaauauuuauuguguacaggaaguacacaaccguuaagcccugaacugugagguguacaguugugaacaauaggaagucccugccauguggaauuuagguuguagaauauggauaagcaauuacaauguuuuugacaguaaggaguacugugaagacagugaagagccuagagaaggaugacaaguugaguagaagcagcugagcaguaguuacuaggaaguuggagaacugugggauucaguccaguuggaaugauuguuuccuguuacuacuaaauauuuugcacuuaguuagcauaagugaugauaaugaaugagcaguccucugaugcaggcuuuuguauuuuccaccaucacaggugugguuccucagagugcaccaccagugccaacagccucuucccgguuccauuucccaccucuggacacccauucuccaaccaaugaugugcagccgggacgguucucugcuagcucccuaacugcuucuggccaggaguccaguaaugguacugauagaaagacugagcuuucagagcuggaggauggcucagcugcugacuggcgccgggguguggaucccguguccuccaggaaugccauugguggaggagggauuggccaucagaaacgcaagccugacauaaugcuuccucuguuugcuaggccagggauguacccugacccccacagucccuucgcugucucuccaaucccuggccgcggagguguccuuaauguccccauuucaccagcccucucccugacucccaccaucuucuccuauagcccaucaccaggccugagcccuuucaccagcagcagcugcuucuccuucaacccugaggaaaugaaacacuaccuucauucucaagcuuguucuguguucaacuaccaucugaguccucggacuuuuccccguuacccagggcucaugguuccaccacugcagugccaaaugcauccugaggagucaacucaguucuccaucaagcugcagcccccaccaguugggcggaagaaccgggagaggguugagagcagcgaggagucagcaccagucaccacgcccaccauggcuucuauucccccaagaaucaagguggaaccugccucugaaaaggauccugagagccucaggcagucggcacgagagaaggaggagcacacucaagaagagggcacugugccaagcaggaccauugaagaggaaaaaggcaccaucuuugcccguccugcugcaccacccaucuggcccucugugcccauuagcaccccaaguggagaaccucuggaggugacugaagacagugaggauaggccuggcaaagagcccagugcaccugagaagaaagaagaugcacugaugccccccaagcuucgguugaagcggcgcuggaaugaugacccugaagcccgagagcugagcaagaguggcaaguuucucuggaaugggucaggaccccagggcuuggcaacagcagcugcugaugcuuagaacuggaaguggauuaggagcuguuuauacuauaaucaaauacauacauguauuuauguagcaagauuucagggugggggggagggaguuaaacugguuugaucauucuaggggcauagacuuguauuuuuauguuuuggggaugggaugggguuaucuucuguuguaaauuaggugggauaugaacacacuuauuuuccuggugaguaggacacagggaggguauugaacucaaaggagaaggagccucuauuuccuguugaggcuuauacuuucugacaaggaaacucccaaagggccaagauacuuuuuggucccaugauagucagguuccagacuucuuucuuuucuauuguauuuguauguggaaagccauuaaugaauuuauuuuacuccaagagauacacauaaaagggaaaagggcaugguugggagguugagcaguaagagaccauuaauacuaaguauuuugccugaaaugcuucuuuauaauuauuucagggaaggaauaagauaaucucagacuuacugggguggggcuuggggaauguuuggauguugcucuuuuucuucuuccuucuuuuuuuuuuuuuuuuuuuuuugguugguguuguuuggcauuuuuuucuuuuccuuuuuaaagaaaauguuuucaggaaacaugaacaaacauacugccaauuauaguggggcugggaaggcacaggagcuggcgaccucucagcugcauaguugggacggcaaacccugcugugagcuucucagacuuuucaccuacuucaccuauuaagaagccaugaggaguuguaaacucuuguucagggaagaaaagagggcaggaggaaguaacccaaugccuuuaaauacaaaacagaugaaaaacaaaauacucauuuuuccuuuucuauuguggguuuggggagccaaaccaagugugacugugagcacguucacugagaggcaugacaacauuauugaagaggucuuuccauuaugucugguucucuuauuuucuuaagucaagccuuaacuaugaacauacuuuaagaugauacgggucugucaccauaaaccuguaaaagggcaucgacagcuuuucagauaauccaggaauguugagacauggcuaaguuucuagcugauacuuagucauucccucuugauauuguugggauggguagccaaaaggcaggcuugugggaguuaagagccaaugauaccuggaaacaugggagguagcuggggguacaaguggauguugagacugaaggaagagguggaaagaagacacagaaggcacccagaugccaaaaggccuggcaugaaugagaguuggcaucuguccuguugugguguucccauucuugccauacccauuugcccagauuguucugauucucauguucaauugacuaucccacaugagacuacaguuuauaggcagugaggaauuguuucuuccugggaaauguccuuccagcaacuucagaggaaugggaaaguguuaaucuuacgugaagcaaaggagccuggacuaggggcagagagaaagaagcagcagcccaccuucuuuguguuugcacaugugccuaugucguguacauugguaccugacuguggcucagaucugcgucgcagcagcgagagaagaaaucacuccauauccgaugagaggaaggguggcacagagauggugucuacaauuagagacauuucugacuccaccuuagccuaagcaaacuuuauauacugaguaacauuugaagguugucuuuuaauggugggggguguuuuuuccuuuuuaaacuacagugcuugcacaagagagggagggacucagaaaagguuagggcaggugagggagacaguagauggccugggaugacuugaguccaucauacuauugcuuggcagguguccucccccauguuugauucaaauuccaugagugaccuaccuuuccccaggaaugggacugagaggguagucuccagcaacucagucugcacagggcuccccguucaggcugccuuuggugguugugcuuuuguaaguuucuuucucugcacuucgacuuaccucugaaucagaaagcaagcccagcaggugaaugagggaugucugcuuggcauugcccaaucuaaccagggaggcuggcuggccacccacuguccgcuagaggggagagcuagcagguguugguaugaacucaggaauagaaacacgaggccuuuuuaaauacgagggagaagaauccaugaugcauaccuguaacccccuagaacccaagugccagaauuccuagaugcugcuucuguuugaacaaaaugucacugcuuuuacacuugaaaaaaacacacucgaaaaauguucaacuccaugaaaaauauuuuuuggcuuuaagaaauuguuugguguuuaacuguuuccuuugauugccauuccaccaguaaauuguugguugauuugcacugcacucugggguugggguugggaggggaggguccuuauacagagccgaaccugggguugcucaggaagugggccagggaauguggaagucguugacauugccugggccaaaagagugggagauaguuuuucuccccucagcccacuccugguagcaccugucgccagccugguacaaagccaggccuuuuucuucugugagcaucucaucacuguccagcagcagguggaaaaagggggacaacaaccagaccuauuuuuucucccccauuuuuuccaaauuuugcugugccaaauguuuaaaauuuuauaaauaugaaucuauugaaauuuccuuaaucaagagcuucuucguguaaaguuugcuuuuuuagcuauagaaaaagaaaacaguaaauaucucuuaauggcauccagccuugcugagcucaccuuuuuuccugaagaauggguaggagugaaauauuuaauguaaacauuucaccaagucccuuuacccuaauuuugaagcugcauuaaacccaacucacuaacacagggaaugauugcacccuaguccucugugggccaagaaacuuucagaagcauuaaaaaaauaguugaaguauaucacuucucaccaaguggguagagucaguuggcuguuugucccuuguuuuuuauuuauuccauaauuauguuugugcuuuuuguuuuguaaacaguaauggaacguacauuuuuauuuuguuuagaagacaacuuugauucaaucuuucaagaacuguuccauucuugguuucuucuuagggggauaaaaaguuaccaguuaauuuguuuugagauauuuaagcauucuuugaguuauagaauugugaugcagggauuugugaaugagacauuuacaugugaaaggugacuucacuaguuaccugcuugagcagaguaaaguguguauauguacauaaaauguaaguaaucuuaacuccauugugcagugccuuuuagauguuccgcuuucuauaaagucuucaaauuuuugcauauauauuauauauauaugauguaauguuauagaaauauauguauaauauacauauuuuuuccagggguaucugauagcucuguauuuuguuauggaaguugaaagaaaaaaguauuuuaccucagaaauuaaauaaaaaaauacuu

SEQ ID NO: 13662 - RNA, 6059 nt, Homo sapiens
cgggaggcggggccacuucaauccugggcaggggcgguuccguacaggguauaaaagcuguccgcgcgggagcccaggccagcuuugggguugucccuggacuugucuugguuccagaaccugacgacccggcgacggcgacgucucuuuugacuaaaagacaguguccagugcuccagccuaggagucuacggggaccgccucccgcgccgccaccaugcccaacuucucuggcaacuggaaaaucauccgaucggaaaacuucgaggaauugcucaaagugcuggguaaggaaauguucgagggcccagguggggcaagggggggcucuggaguccucgaaguuggggaugagaaagacagcgggaccacaaucagggcgugagacacugggugccugcauccccgaaaaacgugccaggcguccgggucccggggcucugggcacgacgccuaaaucccgcuuucuccugcgggggcccaccggugccaacacugcggugacucacggccugugaaucacguagaaaccagaagcgcgagguuggccucugggggaaggggaggcuggccucagcggccggacucggcgggccgaggcaccuggcucucugcaguucagaagcugcgggcugguggagccacgaacccugcauccagacugggagcccgguucccuacccugcccagccgcucggagacauuccaaucuccuucccggugccccccucgguaacccaauccccagggcaggcucauuaccccucggcgcccagcucugccugcgaggugaucugcugccccagcgcccccugagccccacuuuccucccccucugcacuuuccacucugcucuccccaccccccaucugugagacaaguauuuucauacagcgagcagcuccagaguucuaaaaucgcuagggauaauuaucacuuucuuggauuucaacaaaugguuucgugugaaaccccaaucccacauuuccaaaaaucuagguucccaccuaccucccccgaccauagaucggcugcagcccaauuggguguguuggucaaagguggggaaaacuaagucaauccagacugccuuucccacuuuuccagcccaccuucugugugcccucugggccaacugggcuagacaucuggggcaggggagagugccaggaccuggugacugggagaggacucugggggagagauggacguuaguuaaggaccccagccacugggagcguaagggcaggccugcugccuucaauuccugcacucaacagagagacgguaguucggcuggguugggcgagaggggagggagggaaggcaccccucucccuggacuauaggagugagucuggaucuaagacaggucuggaaugcugcagagagagcagggaucuccaucaguccuugccguuaguucuuccugcgaucuaaccacaauacuucuuggagucauaucagucuuucuugcucuguccuugcuaaacuuaaagacaaaaagaaauuuucucuuuggaaagccuagaugccacucccuccucaucuucucuggauucuggccccuguccucaguggaugaggugguggucugguacacccccaggccccagcugaagaguaagauucaaggccccaauccugcugucugucuucagucuguuuguccucccugcagggucucucugagccacgugcccuccucaggcccugcagggggcagauuaaaaacagauccauuagacaaacacaguccugagccagcuaaggccggcuaagcugggcccucagcuccacaggcaccaggggcucgcugaaaggaugucuccucugaacccagccuugccucugcaggaacuucgguccuggcacaccccucuuagcucuagucaaggguccaucucaauaagacuuggggaccugucauuucuuccuagacacaagaguucagcagccaacaauggggguccugggcuccccaggggcaaggcuuccucucucccucucucuucuguuugcaguaggguagguaugcuuuggcacugaggggaaagaggauuuguuucucuaggaacccaggucuggaggagguccagggaguuggccagaucaggggcagggaaauccugcuaccuggcagagggcccuuucacccccgccuagugcaucccuggcucuacuccaggacagggcggcagaucaggccaggugagguggguguguggagcuuagaccuggagcccauccagagaggcccccugcucugcacgucuuccuuucagaggggugcugucuccuaucucccccacuucgguuaauaacuggggagcagagagaagggguccaaucugggcugggauauggaggugcacagagagucugaauccacgaggcugaaugagauagccggacccugugaggggagugggggguccugaagaaggggauacaucacacagagcggggagggcagucuccuuuucuauuccuucuucucacagcagaggggguucccuugaggggacagggguaugggagucuuccagaagggcagaugaguacggugccuaaugcagagagcuuugagccccagcuuuuugcuuuccuuuuuuuuuuuuuuuuuuuuuuuagugguagggucucacuguguugcccaaucuagucucaaacuucugggcuuaagcaguccugcugccucggccucccaaagugcugggauuacaggcaugagccauggcaccugacccuuugccuuccuuuuaucaguaaaaauaauaccaacaaucauagcuauuguuuccugaaaacuuaagcauaugccuggcacugugugugcuaaguccuaaacacauaccaucccaauuggcuuuuuuuuuuuuuuuuuuuuugagacagaguuuugcucuuguugcccaggcuggagugcaauggcacaaucuuggcucaccacaaccuccgucuccuggauucaagugauucucccgccucagccucccgagcagcugggaguagaggcaugugccaccaugccuggcuaauuuuuuauuuuaaguggagaugagguuucuccacguuggucaggcuggucucaaacucccaaccucagaugauccacccaccucggccuccuaaagugcugggauuacaggcaugggccacugcgccaggucguuuuuguuuguuuguuuguuuuuuguuuuuuuugagauggagucucgccuugucgcccaggcuggaaugcaguggugugaucuuggcucacugcaaccuccgccucccggauucaagugauucuccuaccccagccucagcgucccaaguagcugggauuacaggugcgcgccacuaugcccagcuaauuuuuguauuuuuaguagagaugggguuucacuaugcuggucaggcuggucuugaacucuugaccucgugauccgcccgccucggccucccaaagugcugggauuacaggcgugagccacugcgcccagacuuuuguuuuguuuuguuuuugagacagggucucucucugucacccaggcuggagugcagugguaugaucucgguucauuacaaccuccgccucccggguucaagcaauucagcaauucuccugccucagccuccugaguagcugggauuacaggugugagcaacugcguccagcccuggcuuuuuuuuuuuuuugguagagucgggguuucagcauguugcccaggcugguaucgaacuccugagcucaaacaauccaccugccuuggccuuguaaagugcugggauuauaggugugagccacuauacccaaccuugauuggcuuuugaagaagcuguuauuuccauuuuacaauugaggaaucuaaggcucagggugguuaagccauuugcucagggucacccagccuguaagggggcugagccaggaggaaaucacagccuccuggaccuuacuccagagccucugucuucccaggcugcugaccauucuguagagggaagcagcugccccugcucucuuucauugcuguggggcagaaauugggcaaaugaagaccuaucuagcacuagauacgguggguagauagggcaaaaagggaaauggcuccuacuucccaggacaugagugauggggucuggccugugcuuggccagggguacagucccagugacucugaugagcugucaacaggguagacaaaaggccaaaagugaaguaaacagagacaaccggagccaguagcaggauguuuguuggguagggggcuggggagaagcugccccugggcauucugggacugaagagcugagacguggggagccugauccagaccugcugacucaacaagguggggccacagcuaggaacaggacucccaggggcaggccacugccucucucccucuccucccuaaacccccucaucuuucagggcugcaccgccuaccgucuccuucaaggcacuuucuuagacacccaggcaccaggcagaugcaccccccaacacacccaccccaagcaagucacaaaucagccugcuccaacugucuuauggggagggugugagagaggugcccaaaggccccuaaaaggugagccucuccucucuccccacaggggugaaugugaugcugaggaagauugcuguggcugcagcguccaagccagcaguggagaucaaacaggagggagacacuuucuacaucaaaaccuccaccaccgugcgcaccacagagauuaacuucaagguuggggaggaguuugaggagcagacuguggaugggaggcccuguaaggugagugccagaaggggcuccagggucauggcgucauugcccugccucucaaccugccauuuuccaggcuagcaguuaacuccuagcuucucucugucccaguagggaaaaucccuaggugguggugggggcuagaaaggggcucucucccuuaucccucucacugcauugccccugcuaugggcccagcucacuuggccaccugucucuugcagagccuggugaaaugggagagugagaauaaaauggucugugagcagaagcuccugaagggagagggccccaagaccucguggaccagagaacugaccaacgauggggaacugauccugguaaguccugccuccuccccacuaauagcaaacccagugcuaccuuccaagauucucugggagaccccagggugcaggagacucaagaacaaccauggcuggacuccgcacccugcugaugggacugcuugaacagaacuaaggugucccuaucccauacagugcccugugugaauuagaaaugguguuccuuuuaugcaagcaaagggcauguacugagggaucccagcaguucuucagggagaucuuccuggcuugaggaggaggacgggccccaggggcucuauugcuauccucccuccauugaugccugggcauucugggaccagcuccugccuguuggucuugagccaagaagcagguuuggaccuggaggccaagcagaguaccuccauucaacccuccucuccaaagccacaggaccccaggggccucucaggcuaacaacuacuucuguccuuccagaccaugacggcggaugacguugugugcaccagggucuacguccgagagugaguggccacagguagaaccgcggccgaagcccaccacuggccaugcucaccgcccugcuucacugcccccuccgucccacccccuccuucuaggauagcgcuccccuuaccccagucacuucugggggucacugggaugccucuugcagggucuugcuuucuuugaccucuucucuccuccccuacaccaacaaagaggaauggcugcaagagcccagaucacccauuccggguucacuccccgccuccccaagucagcaguccuagccccaaaccagcccagagcagggucucucuaaaggggacuugagggccugagcaggaaagacuggcccucuagcuucuacccuuugucccuguagccuauacaguuuagaauauuuauuuguuaauuuuauuaaaaugcuuuaaaaaaauaaaac

SEQ ID NO: 13663 - RNA, 17597 nt, Homo sapiens
ccuacuucgcucguccuugcucucgccgcugcugccggagccgaagcagagaaggcagcgggucccgugaccgucccgagagccccgcgcucccgaccagggggcgggggcggccccggggagggcggggcaggggcggggggaagaaaggggguuuugugcugcgccgggagggccggcgcccucuuccgaauguccugcggccccagccucuccucacgcucgcgcagucuccgccgcagucucagcugcagcugcaggacugagccgugcacccggaggagacccccggaggaggcgacaaacuucgcagugccgcgacccaaccccagcccuggguaggugagugccuccgcagccccgccgcccgccguggggucggggacagggagaagggagugccugccuggucugcgccccccgccugucagcccuugccucgaggcucuggggcacccaacucgucgacuccugacaccgcagcgggguaggcugcuggacagccccgagcgccugcagcugcugcugccaucucugaucuacaugcuuccagcucugccaguggcagccccccugcugcucgcagucugaucagcaaccccucggguccucgcaucuucccugcugcgcgcuccugucccagcgcggccgccgagauuuccgaccuugucccaggcagggcgguagcguuccggaucaguccuugccuccgugcccccacgcacaggcagcuccaggagcagcggccagcaacccuucuggggacaccuuacuguaguccggcaggacagccgaucagagccgcucuaggggguggucggagugcccauuucggcuggaaucccaacucggcuccuugcucugugaccuugggguaguuaguugacuucucugaaccucggguuccucaucgguguaaugagcaaaacauaaacaaucuuuuucucacaguugagguuauccacaggaagcauuuaggagaacuggcucagguagacaucaguaacuauuagcuggaauucgguuaccacuauugcauuccuuccuagcacugccaggggccugggaauucccucucccagguauuuccauauccugucagguauucccccaccuauuggaauagcucugccuacaugguucuaauaggaccaagagauuggcgucaaguccaaggggcaccauuauuaucugcauuacuuagauugcagaugaugacaguaagaucagggaacaguguuacccuuagacccacccacaguauuaccagugccuauguugcuauggcuaacuuugcuauuuauaacagcaucauccacauuucagauucuauacgagagggaucugcaacugcucggcuggugucauugcuaauaguauuauuaguuuugcuuccaauaaaaaggacuauuuauaugaugauugcaauuacuucuacaggcccuaaggcccugcuuauauuguguaggcucauguugcuccucaugaagccguuaaggggguagcagagagcuucccuccugcuauagccaaagcucuggcuucuugugccucccugcugacccugcugagugcuggagcucaguuccuaugggacagaccuuggcugccggcugaugggcauucagcauggaggugguggguguuguuagauguguguacacacgugcaugccuacacacacacacacacacacacacacagagagagagagagagagagagagagagagagaccuggucuuaacucucuggguugggucuaugaagacugugagggagauggacaucccgggucagacagaaaugaugugacaagaggaaaguuuccugaacagcucaagaaauucaaaacaagggcagagauacagacgcuggagcugaaacagagagggggauguuguggcgucaagggaacggaccgcaugacugcugagcucucaggguuagaguuggagagguguggccugcucuggaggaagagaagaggaaguggagaugaguggugugugggauagagaaggccacagaacccuggaccccuggguucugaggcugguaccggauguggggaagucugaguuuccucagggcuccuagcugcaauugggaggcugaggcccgagacuggagagacagagcucucucagaacugcacggggcuacccucuuggccucacuggucagugacucccauuuuuggggucaaggguagguugcccuccauguuccagagcaguuagguccucauuggccuuaggcccucuucccucacucucccacugucagacagaggugaaagggugguccaggguguuggccccaaaaugacuccaacuauaugggucucugggcugcccgucagagagaugggagccaggucugugagcagcuccagcuccagcccagagagaagggagggagggcaccagaagggggccaggcccaggcccuggcacagcucagaugcauggcaaacagucuucccagcacccggugggcacuggcugcuccugcccaaugguccccacuccagccccagaacaguccucccaagcaccccaaugccuggagcuggucuccgcaccucuaaucuggccccaucaagaaccuccucccucugaaaggucagagagaggcccuaagcaucugguugugccacuccucucccaacucugacccuagggaaugauauccagacacagugggggagauggggguuaugauggcagggaggugggaggaucugggaaaaguaggaaauuucccaucaucucaggcuuaggaaagugcagggacagguaugaaggcagaugcugagagggcagggaagaugggggauaaacagugggccuggaaugggagugcacagccaguggaauaaaccugaucucuaggaaguccugccuguagucuaaccuucaauucucuugcugcaucauuggccuauuccauggcauaccuggaucuccaugcucuucuaaguuuagcccaacccuuaaagaugauguagcucugagucuucucuccugggagcacauugcccucgugccugacuuggcuuuacuagggauccagggucagcccuauccuucucugagccucagucuccauuucucaaugucacaacacauccuuuuuaugagaguguaagugcuucgagaucuuuggaggaauauucuggguucuagagcuucugauagccagggguaggaagggguagccccucccauuuauucuccccccccuuaguccacccuccagcccaaggcuuucacaaaagguagggugggggaagggaggggcuggauagaggccagacuggcagagacaggggcuuugucccaacugauuucugagccaagaguuccggugggaaagcccgugccaggcagaaaggagaggcugggaagaagaagggaggaggcagccaaggaagggggauggagaauguuggggaguaaagagaggaguuuccuuacaaauaaugguggggaggaaguagaggagagggugggcucaggagaagcugugcuuacuugcguucggucuaggaggcccuccuggaaaaggccaggugaguauggugucccuggaggcagggacagucuagaaggcagaagaggcuaaagagauacuaugggagaaggcucuggguucgaggaaggagucuggcacugggaggagcagauggaauucugaguauaagagcacccaccauucaugcuguaaacugagcuccuacugucugccuggugcuaugcauuuguacaggaguuuuaagauacuaaacacucucaaagcacaugguccuaucucaacucaugagauaguaaugaugaugcuuuuuuauaaguaagaaaauaaaggcucagagaagguaaggagcuuggcuuaggucacacagugaguugacuaggacucggguuuugguucugagaagaaaucacuugcugggaagauggggaucagaaacagagaguccauggugaugugaagguaggggacuucuggagccaggauaugugugaacccacaugggugugguagggagcaggggggaaguccauccugaagucuaaccccaucuuuccuucucaugucccucugucagccugcagcauggcccagcuguuccugccccugcuggcagcccugguccuggcccaggcuccugcagcuuuagcagauguucuggaaggagacagcucagguaagcaaccccacuuggggucaccgucucugucuuguucagcccuaaccaacugcuuccaggcuuaggggccccaggaagagagagaauuggagggcuguggggaagcguccaggcuggaacacuuggaaauaagggcugagcugugagcaucugguggguuggagaaaucauggggcaggacuagggaagggcacugggugcaaggcuuugggccccuaagguggaggauaggggauccugaagcuaggaggugggaaagggguggaacugggagaaacccugaaggaggcccuaaagggagcagacugggaaacugggcuggaggacucagggggcgagguuggaggacccugggguguggucuaggaauuuuggagaggaaguggaagacucugagagcagggcaaggaauccugggggcugaauugacugggagacuuugggggaugggucuggagaccgucggggugguccuggaggaccuagagguagggcugcaggacccuggccccuggccccuggccccugguccuaggggggccggggaauccuggggccggaaggagggauccuggagcggggcuuggaggccaccgggugggacucugagggucgacagcguuaaguuccagccggcuccacccguucacagaggaccgcgcuuuucgcgugcgcaucgcgggcgacgcgccacugcagggcgugcucggcggcgcccucaccaucccuugccacguccacuaccugcggccaccgccgagccgccgggcugugcugggcucuccgcgggucaaguggacuuuccugucccggggccgggaggcagaggugcugguggcgcggggagugcgcgucaaggugaacgaggccuaccgguuccgcguggcacugccugcguacccagcgucgcucaccgacgucucccuggcgcugagcgagcugcgccccaacgacucagguaucuaucgcugugagguccagcacggcaucgaugacagcagcgacgcuguggaggucaaggucaaaggugagagggcagggagguuccagagggagggagggagggagggaagggaggacucuugccuucggggaucccacagugugagagggaagcaaagguagcuggaaggcgcagccuggguuggaaaaagagugaggagacacgggccuuuguugucuccuuucucucuucagguggaggacauucuacccacaaucuaacuuaagucccucaugcuguagagugagcacaauugaacuuuauuuacccuuguguacagaggagugacaaggagggugaggggaggccagcgugcugggugcucaccuggcucagggguccucucugccccacaggggucgucuuucucuaccgagagggcucugcccgcuaugcuuucuccuuuucuggggcccaggaggccugugcccgcauuggagcccacaucgccaccccggagcagcucuaugccgccuaccuugggggcuaugagcaaugugaugcuggcuggcugucggaucagaccgugaggugggcaggggcuguggauuggggcuucuauuggccccugagguggccauggccccccuucugcugggugcugccugcugugucaggcuggacaugcagggcuuuuugccucugggggaugaggcuggucugaggaggggaggugaggacccugagcaugugcaucccugcagugcuagaaggacagccagcugucagcaagugucugcacugugguggcagugggguucaauagaaucaauaugggcuggcucccuggugaaagcaucuguacuaagugauucuguccuuccucccuagguaucccauccagaccccacgagaggccuguuacggagacauggauggcuuccccgggguccggaacuauggugugguggacccggaugaccucuaugauguguacuguuaugcugaagaccuaaauggugauuaggagugagagguucccaggggacaauuuccuacucccaugcugcccauagguccucccggggccucugcaggaccuuacuaucccuccugaguuuaagggggcaagcaggaguaaggagacaauuggugucccucucuccaaacacugucacagaggcaagcucaugaccaaagucucagccaggcagcaggauaccgaguuuaacucaucuaccaccugccagguggacucugugcaugacucugcagaacaagaaguuugggccccaucucuuugagcucuaauauccaucuugagguucuauucagacuaugauccuaugaaguagaguaguugacucccugccacagaugagggaacuggagaagcuugcccaggguucccaugggagaccagaguggaaggagcuaccagcugccugauaacccagccuucucuucuccacccaggagaacuguuccugggugacccuccagagaagcugacauuggaggaagcacgggcguacugccaggagcggggugcagagauugccaccacgggccaacuguaugcagccugggaugguggccuggaccacugcagcccaggguggcuagcugauggcagugugcgcuaccccaucgucacacccagccagcgcuguggugggggcuugccuggugucaagacucucuuccucuuccccaaccagacuggcuuccccaauaagcacagccgcuucaacgucuacugcuuccgaggugagcccaccucccugcagaagcugagaccaaucucagaaaggcagaguugaguccuaaaaguccuaccccagucugaucaguuuagcucagggcuuugccauuugccugaaguggucgugggugaaguccagcuugucaucuaggguucuaauucugggcaugcccucugguguggugucugucagcuguuuggcccaaggaguagucaccuuuuggccucuccuuaucugccuucccaccaguaguccaugccuuguuugcuccagcugggcugcugaauaagcucccaucuccugucagcuuauuggcagagcaaagacgaccaacauucugugaauucaaugaguaaucugcccaaguucuuccagucaacaaccaaaugcccucaggagcccucuggaggauuuccagaaacuacagcuuaagaaggugucagaucuuuaacuaccaaauacugguggauggauacaauucccccaaaagggagcaagaccuuaaguacaguugggaauagagauagcuuucugcccacaucuuauggcuuguuucuuuuuuugagacagggucucacuccgucccccaggcuggagugcaguggugugaucaugguucauuguagccucaaccucccugggcucaggggauccuuccacuucaaccuccggaguaggugggaccacaggcuuaugccaccaugucuagcaaauuuuuguaauuuuuguagagaugggguuucaccacaugcccaggcuggucuugaacuccugagcucaagcaaucuaccuaucuuggacucccgaagugcugggauuuauaggugugagccacugcacccaaaccugcccauaucuuauguugggagcuggagcgggaggcaguuucugggacucucagaugcaaaaggcccaggccaagggugaccgacaauaagagaggcauugccaugcggugucucgguccuuccccaguuuuaagccugaaauacuguuacaagagcuggaagcagaaauggaaggagcagacacagccuugaaccucagggagcacuuggucugaaggaugaagacacagcuuuugccaugggaacccccagcaaagggaagacaagaugccucacucccaggaugaggagagacugagagaaaagcauuacuuccauuuggacagaucuguggacauauuuggcugggguuggggagggguggggaaguaaaaguccauaggaagacagguccaucugaaaagaccuccuggaacagggguaguaguaguaguaguaguaguaguaauaauaauaauaguaauagcuaaaacuucugugugcuggcuaugauugugugccaagccaagcacuguuuuggaaagaaauggccuggaucaugaggaggggcaggggagggggaauaugacuacaguugggacuacgauugguggaggacacaggcagcaaggacacaaggucuggugaggaguaaggcucacuggagcaggugaugagggcagggacucacuguccugucuugccuggcugagcacagacagcccucaggacuuuucuuagcccaauuccaccuucacuucauugguuuucugcucuuggcucccuuccccagaggacaaguaaaccauucuaaacuucugguuauuugaaaggaguaggucccagaaggagguggccuuuucccuugccuacuugccccaccacugagauccucaggugaugccugaaguuauuccugcacucugcccuccagcuauccugaggggaugacagccucuccccuucuauuucaagaauuuuggaggcucggugcaguggcucaugccuguaaucccagcacuuugggaggccaagaccacuugaggccaggaguucgagaucagccuggcaaacacggggaaacccugucucuacuaaaaauacaaaaauuagccaguuacgguggcacaugccuguagucccagcuacuugggaggcugagacgggagaaccgcuugaauccaggaggcgaagguugcaaugagcugggaucgugccacugcacuccagccugggugacagaaggagacucugucuaaaaaauaaaagaauuuggggauaccugggacaccucacaccuugccccaagcccaagaucacaaggugguaaagcuauuucauccauccugcuggcuccagccccucccccuagggaauaucucucaccugagccuuuccugaccacuccaaaguaguauuuuccaucacuccaucuucuaacucugcucaaguguucuuuaucuuguaagauuauaauauauguuuguuugucaucuguucuagaauauaauuucccuugaggguaggagguuugcuauuuuguucugcacuguauccucagugcccaggggaaugcuuggcaugacacacuguaggcacuugaugaaugcuugagaaaugagugacgaaguucugggaugcucccugggccccaguaggugcuccacagggaagaugugagagaauugagagaauuccauggugcaagcugugaccugggagggcagagcuaccuauucaggcucgcaucaauacuuuccuccugccacagacucggcccagccuucugccaucccugaggccuccaacccagccuccaacccagccucugauggacuagaggcuaucgucacagugacagagacccuggaggaacugcagcugccucaggaagccacagagagugaaucccguggggccaucuacuccauccccaucauggaggacggaggagguggaagcuccacuccagaagacccagcagaggccccuaggacgcuccuagguaagucggaucccuuauccuaaggaugucuugauugaaagaaguugggggcagaagaggcaagcccagguugaugcuagggugauggaugacaugacucugcccuguccuuucucaguagcucaggggugcagggcaccuuuccugucccucucccaaccuuugcuuuuccaguaaauuccacccccaacucuauggagcuagagaugcuugcacuaaggagcugcgcccuggaaagguggaaccugccuucuuuggucccucuuccgccucacacacccaaaacagacuagaguuuugacagaguaggagggagacaaaugaccauguucuccggggcuaaugauggcucacagagccuucucaaguguugccucaacaauauggcuggggucaaguucuuccaguguggcgcaaggaccaccuguccucagggcggucucuucccuauuccccagggcucacccuccugagcccuacuuuucuccccuucccuuuuuccuuucgguccuuggacagacgcugucccuggugcugaaccguuugugcuuugccuagaauuugaaacacaauccaugguaccgcccacgggguucucagaagaggaagguaaggcauuggaggaagaagagaaauaugaagaugaagaagagaaagaggaggaagaagaagaggaggagguggaggaugaggcucugugggcauggcccagcgagcucagcagcccgggcccugaggccucucuccccacugagccagcagcccaggaggagucacucucccaggcgccagcaagggcaguccugcagccuggugcaucaccacuuccugauggagagucagaagcuuccaggccuccaaggguccauggaccaccuacugagacucugcccacucccagggagaggaaccuagcauccccaucaccuuccacucugguugaggcaagagaggugggggaggcaacuggugguccugagcuaucuggggucccucgaggagagagcgaggagacaggaagcuccgagggugccccuucccugcuuccagccacacgggccccugaggguaccagggagcuggaggcccccucugaagauaauucuggaagaacugccccagcagggaccucagugcaggcccagccagugcugcccacugacagcgccagccgagguggaguggccgugguccccgcaucagguaauucugcccaaggcucaacugcccucucuauccuacuccuuuucuucccccugcagcucugggucaccugaccuguaguccuuuaacccaccaucaucccaaacucuccuguccuuugccuucauucucuuacccaccucuaccuaugggucuccaaucucggauauccaccuuguggguaucucagcucuccgcgucuuuacccugugaucccagccccgccacugaccaucugugacccuucccugccauugggcccuccaccuguggcucacaucucgccagccccacagagcauccucaggccucuccaaggguccucaucaccuauugcagccuucagggcucggccuauuuuccacuacucccuucauccgccugugugccguccccuuuagcugccuccuauugaucucagggaagccugggagucccuucucaccccucaaccuccggaguccaggagaacccguacccccacagagccuuaagcaacuacuucugugaaguauuuuuugacuguuucauggaaaacaagccuuggaaauaaaucucuauuaaaccgcuuuguaaccaagcucugguacccucugucuccaucuccugcuguccaccucucucauuccaugggucugugucauggggagcacuuggaugcuucuucucuggcuccaugucucucccugucucugugugugucuuggccucucuuccuuuuucauuuucggcuucuccccuugucuguccuggcagucuaacagccccucauuguucccccagccucuccuucucaggccugucuacacuuuccuuccuggcugcuaagaucccaaaauuugacuguacacauuaccccuggagaagucaucauccauagucugaggcagugcugggaguuguagucccucacuccugaugaggagaaaccccugcagcccggagugcauguguugugcauuuauauucacuuccaauccaucuugguggugccaagggucauaguaacugagggaacugagggucucucagcauagaggcaguucccuggcauucaguugcccucacccccauccccuagcccugcaucucagcagggggugguaucuaacucucaucccacuaccuacaacuuccgucuucuccacuaacuccugcacuaaugaucauucccuacucuccagaaggaauggcuucacccuccccagacccaaagggucucaaaguaccuaaugcuggagaagacacugaucaaaagcaagugauggagagugugaaggaaggaaucagguucuggggucugagagaagcccucucuacucaggaaggcuaagauucccaguggagguuccuggagaaggcugggauucccuuagcccuaggacccccauguuagauggaucacauccugagucccacccaggcuuacccaugucaacuguuaggucccugcacaacuggccuuggaguucagcccugugggggauagggaggggguuuggugggaagaggagcacaauuggagguaucuacagugucuuaguuuccccaccgggaggguaagugagaggucuccuuggcugcuguuucaauggaaagaaagggaaaacuuucugguuguguagaauaguuguccccaaaaagggagagggaaaaugacaagaagaagaguucuucacccgacucugccugcgcuggguucagguucuguagcccacagccagggggaggggccuauggcuuggguaggggaccaaagaccaaguuugagagccucugucccccaggguuggaggguugaaugggaaggagcagaaaggacaacaggagggacaggaaagugugaggagugggaggggaguucagaauucuacccucuguggggccuggugcuuaauggguuaaaugaaauaccucuuccucugggguugggaggugggcagcaccacaagcugggaagaaacuauuggcaggagggaagaugacagaaggagugcugcuggaaaagcugauucauuucacccaaaacagcuaggucaucccagcaaaauucuuugaauccacuccagcuucuccucucuccaccccuacugauucccaccaggcagugggaccuguggccaggccagcgggaagcacuguggaccuuggccauggcuucuagagguggaugguaaagucugaaggguucugcccuggagugguuuugccucucauggcugagggccuugaccuuaccauggcugagggccaugaccuacacaguuggucuguggagccaucuuccuuugggucaucugaaccagaaaggauuggaaacugacagcuccuguagcacccaagcacauccuaaggacagccaccuccuaccccaggauacagagagaaaaaguccaguaaagcagauggccuagccagauggagcuagauccaggcaacagauugcagaccuucagggcaguguguuagucuaagaggacugccuggaggagagggagccagaaggagggauugagauggauucuagguuggagaaccugcagaaggcccaaaguggaguugggagagggagccugguaaguggaagagucuguggauauaagaaggggaagugagagguugggugauauugagagaaagcugcaugugugaggccagucagcacugcaggacaaugggagcugcugcgacuuaguuccuaagcugggggagaaggggcagggccuagagugaggaaagugggcuggaucuccacuaaccacuucugggacuggcugacugcccaguggacagcaggaggaaugguuaguauucaccuggaccacaccaauaucaggucucaggagcagucaagggauaccacccuccacuguugcugcgguaauccuucuguccccuccuucacuuccauucauuccaccuggacuauacagaacugugcugggaccuggcacaaagacaaggggguguggcacuaaacuccaagccuagagaaggaaaaugaccugcccaauaucacacagaagccagauaagaguuuagagcuauaacuuucugugcccaguaucuuucuccauuguggggcuggguucucagggcucuccuagccucuucuccccagccccuuuugggcugggcucacacugguggccauaacaauggaaggcugagccaaugcugaagucgggagcgggaagaggaaagaaacccagaacucagggcuggguugugaccagagacaggcucuagggagaacuuuuagggugcuguuauagcuuccaggacagagagaccagggcugggggacccucugcacccucuccuggagggcucaggcugcagagugcggcugccucgcuccccccgccucacuucuuucccccucucaggugacuguguccccagccccugccacaauggugggacaugcuuggaggaggaggaagggguccgcugccuaugucugccuggcuaugggggggaccugugcgauguuggugaguguugagggacggggggcagguuugaagccuggacccugccacaacgugcuacuucuggaggggggagggagaacauugguuuuggccuugucauuaaugagucccuguuuuaggcaaguugcauaacuucuuugaguccuacccucaauuuucuuaucuaagugaaaccacaaugccucucauaggggguccauuugagaccagugcaaagcauacuccuggcauuuaaucgguggucaauacaugacaggcuccauucuccuggagaggagagccacugcucguuaggauggagacccaggccggaacuccaucccucacccugguuccugucucuuagaaaaggcaccagcgccccugcccaagagccccuccaggcuccugcuacccccucauucucuacuagcucuuuugcaccgcccuccugucccccuuagucccgccccucucggccugcgguaguggaaggagaccagccccuuccaggggaccuggcccucuggguuuuggggcccuaagaugcccgcccuuaugugccgcaggccuccgcuucugcaaccccggcugggacgccuuccagggcgccugcuacaagcacuuuuccacacgaaggagcugggaggaggcagagacccagugccggauguacggcgcgcaucuggccagcaucagcacacccgaggaacaggacuucaucaacagugggcugggagacagggcgggaggggccccugccauaugcucucacucucucucacucgccuaaccgccuuccucauuaacccaugcacuuauuccuugguuuucucaagcgugcauucccucacucauucguucacuccccuucucauucucucucccuucccacccuacgcuuaggcaguggccuucgggaacggagaguggagguucgcgcaguagagugcgccugugugggccgggccgccgugcagggggccgccuccaaucccuccaaccucccugcucuccgaccuccgucggccuccuccaacuccaacuccaaucuuguugaaaguuuugacucuuuuuccaaaacuccccuuuucuagccuggguugauaucuuccuuauucucccacccccauuccccugcuuuccaucuggcccuugagcagaggcugggguagaagaacccgacaagggcgggugcuggaucgcggggaaggguuuccaaggcagucaccgcagaccgcccgggagcggggaacggccgccaucugcuggcggcugcgcucacugcacgccuucgucucccuagaccgguaccgggaguaccaguggaucggacucaacgacaggaccaucgaaggcgacuucuuguggucggauggcgucccccuggugagaggccccagucgaaccccgccgucuagcucacuuccucuaagcacuucuguucccuaccacccccaccccucccgacccuguccccuucuuuuuccggccuccuucccuuucucgugcccugugccucuucucccugggcucuccucccuucguuguguccucuuucuucccuucuggcucccauucucccuccccuaaagucccugcccucuccuuuccccuuccccgggagauccccuacccccuagcccuaaccuucccucuccuggggccccgcucaccagcccuccuccccagauccucuaggcccucucccggugcuccugguguaggagcuccucaccaccuccuccguucccccagcucuaugagaacuggaacccugggcagccugacagcuacuuccugucuggagagaacugcguggucaugguguggcaugaucagggacaauggagugacgugcccugcaacuaccaccuguccuacaccugcaagauggggcugggugagggcaggcaaaggagggucccagcaaggaaguggaggggugggcuaggggaccagagggacugauguuuguagacagagagugcaaagcaacauagaggagucagaacguguuccagaccaugggagagcuaacaaguuacguggguccacucggaaucccugaucuuuuuuugucauguuguggcccauuuuucucuuccccauggagauucugggaacugucacccacagagccaggcucaguuccuaacugucuuccuuugcaguguccugugggccgccaccggagcugccccuggcucaaguguucggccgcccacggcugcgcuaugagguggacacugugcuucgcuaccggugccgggaaggacuggcccagcgcaaucugccgcugauccgaugccaagagaacggucguugggaggccccccagaucuccugugugcccagaagaccugugagugccaggaagaggcaggugggagugggagacaguagccaacaguagccuuggacuccacuuaaaguccugccugucacuggccaugugaccuuggagccaucacugccccucucugaggcaaaggggaagaggugggcuggaggcucugggguuccuucagugcugaugucugauaacaugcagccccauucugggcucuuacgggcugagcaagaacaucagagggcaggcucugaggagaggagaaggaagagccaggguggagggugagugugugucuuccccaggcccgagcucugcacccagaggaggacccagaaggacgucaggggaggcuacugggacgcuggaaggcgcuguugauccccccuuccagccccaugccaggucccuagggggcaaggccuugaacacugccggccacagcacugcccugucacccaaauuuucccucacacccugcgcucccgccaccacaggaagugacaacaugacgaggggugguacuggaguccaggugacaguuccugaaggggcuucugggaaauaccuaggaggcuccagcccagcccaggcccucucccccuacccugggcaccagaucuuccaucagggccggaguaaaucccuaagugccucaacugcccucucccuggcagccaucuuguccccucuauuccucuagggagcacugugcccacucuuucuggguuuuccaagggaaugggcuugcaggauggagugucuguaaaaucaacaggaaauaaaacuguguaugagcccaggcaagu

SEQ ID NO: 13664 - RNA, 2385 nt, Homo sapiens
caugcgccggggccgggccgggccgggggcgcgcgcucugcgagcuggauguccaggcugcgggcgcugcugggccucgggcugcugguugcgggcucgcgcgugccgcggaucaaaagccagaccaucgccugucgcucgggacccaccugguggggaccgcagcggcugaacucggguggccgcugggacucagaggucauggcgagcacgguggugaaguaccugagguaggcacgggucucggguggccugcucugccccggggcggggccugggacggccgggccaccugcgcgacagagaacacgaggggcgggacucaggccgcggguuuuccucagccaggaggaggcccaggccguggaccaggagcuauuuaacgaauaccaguucagcguggaccaacuuauggaacuggccgggcugagcugugcuacagccaucgccaaggucaguggcacaacucucgaccuuugggagcagccagggaggagucacugucccagcccccuggccuaggcacaaaggggugggagagacagcugggccaauauggucuauuaccgccugaaaccccgccgaaccacccuugacucugccuucaggcauauccccccacguccauguccaggagccccccuacuguccuggucaucuguggcccggggaauaauggaggagauggucuggucugugcucgacaccucaaacucuuugugaguauguggggaggggcugugggggaggagggcgugagggcucugggaucugggguugaauuaccacuuucuuccuagggcuacgagccaaccaucuauuaccccaaaaggccuaacaagccccucuucacugcauuggugacccagugucagaaaauggacaucccuuuccuuggggaaaugcccgcagagguagguggcuccaguugaauaccuccauccuacaguaaccacugccugugcucugcucuuccuucguguuuccaggcugagcucauuuuagugccugguacggaaggugccuaacggaugguauucgaauaagugugcaagagccuucuccuccuucauaaagugugcuccaugagucccacacaccaccuucucuaaagcuuccuugcccuuucaucucccuggucccuccuuccacucuguagucagauccucuugcccuagcaugcaguaaacacaugaucuaccccucaggggccggaguggcugcccuaucugaaacccuuccugcagaugcauggauuaagggaugggaaauuggguaauuuuuuuccuuaacccauuuuacagaugaagauacugaggugcagagaagugguuugcuuaaagucacuaaauuguaucauggcagagcugaaaccagaaucuggcucuccugacucgucucaggcuaucucagccuguagccuccccaguggugggcaggcaggcaggcaccgagaacaaaaacugucuggucucaauuuggccugaaucagugaccaacucacacuuucucuaggccucaggcugcccucugaaugagacacaauacuugugccucugagaauggucugcaggugcagaggacagcccucuccaguuaaggcuguuugugcagcugcuggcucugacauccuuuuccugcuccaccacagcccaugacgauugaugaacuguaugagcuggugguggaugccaucuuuggcuucagcuucaagggcgauguucgggaaccguuccacagcauccugaguguccugaagggacucacugugcccauugccagcaucgacauucccucaggugcugggauccagaagguggggugggggagauuggggcccuacccuccugacucuugcccacaccaggucuaaaauaauuuuagucuagaggggcagaacacagcuuucuggacccccaucagggcuggggaacaguguucagaaguccccuuuacauguuggccccaugaagagaccacggcccaaggguacguggagcucguuggacgagaguuccucaggugggaacugaggggacuucccacuccucugggacuaggguaaacuaagguguagaaggggacgagacaucuggccucuuccugaacaccacccucuuuucaggaugggacguggagaagggaaaugcuggagggauccagccagacuugcucauaucccucacagcccccaaaaaaucugcaacccaguuuaccggucgcuaccauuaccuggggggucguuuugugccaccugcucuggagaagaaguaccagcugaaccugccacccuacccugacaccgagugugucuaucgucugcagugagggaagguggguggguauucuucccaauaaagacuuagagccccucucuuccagaac

SEQ ID NO: 13665 - RNA, 4832 nt, Homo sapiens
gcugaacgcgagucaugugacccucuggcaccucuuccgucggcugaauugcggccguaugcgcggcucuguggagugcaccugggguugggggcacugugcccccagcccccugcuccuuuggacucuacuucuguuugcagccccauuuggccugcugggggagaagacccgccaggugagggcccuggggcuacagcgauagaaguuucaggaaacgcuacccuugcaggguggcuggaaccgggcauccaggggcuagggguggaggguggcugccaagaggaggguucuucaaccuggagggugugggagauggucaugggucaugggacgggauuguggaguagggcaaaugugagggugaugucuggaccccgacucagcccugggugacccagguccaggcaaguguugaauguuuucuucuucgcagcccugugcccugacccgcccaccagggucaggggaguccuggcuguacccucuacccuaccccuuuucauccuguccccacugccccuuaccccaggguucccucagcucccgcacacauuccucuugucuaguccccaaaaucccauccuuuguccagcacuuuccaagccccccuccccucaagcuucucuuuugccugugucucuccuugguccuguucccucaacccuccacuacuccauguuccaggugucucuggaggucaucccuaacuggcugggcccccugcagaaccugcuucauauacgggcagugggcaccaauuccacacugcacuauguguggagcagccuggggccucuggcagugguaaugguggccaccaacaccccccacagcacccugagcgucaacuggagccuccugcuauccccugagcccgaugggggccugauggugcucccuaaggacagcauucaguuuucuucugcccuuguuuuuaccagggugaggagguugggagagaaccaaggagaagagugcagaggagagaguucaucccaauuagaggguggaacuaaagacugggggugggugaaauagacucagauaugaaagccuugguagggggugagugggagguguggucucgggagaaaaacugaggcaagcccaguuccacccuacccccacccuccagcugcuugaguuugacagcaccaacguguccgauacggcagcaaagccuuugggaagaccauauccuccauacuccuuggccgauuucucuuggaacaacaucacugauucauuggauccugccacccugagugccacauuucaaggccaccccaugaacgacccuaccaggacuuuugccaauggcagccuggccuucaggguaaggcgugagaaaucggaaagagcucaaaaaggcugauuugugagggugggauuuaaugauggagguggcccuuaagcacaggcauccagcuauuucccacaccucccaugcuucuuccuuccuagguccaggccuuuuccagguccagccgaccagcccaacccccucgccuccugcacacagcagacaccugucagcuagagguggcccugauuggagccucuccccggggaaaccguucccuguuugggcuggagguagccacauugggccagggcccugacugccccucaaugcaggagcagcacuccaucgacgaugaauaugcaccggccgucuuccaggucaggcuuccuggagagaggcagaugggugaggaauguaggugggacaccauugggaccuaaaacucauucaaccauuugccauuuagcaacacuuucuuugggucguuuaagagcuaggcacugugcuaaugaaucugacccagucucugcccucaguggagacagacagaaagugcaauaugacuuacacucuggcagauggagaucugcaagggggcuaggggccaagaggagggcugaguccagacuuggagguuuggaaaacaacucaguccucacccagucgaacuccccauuuuuacagaggagggauugaggcccugccuaggacucaggacuccugcugcuagucacagaauaaggcugggaguggcaaggaaaagagggucgggcacagguugguccucuuuacccucccuuguuugccuuucuucccaguuggaccagcuacuguggggcucccucccaucaggcuuugcacaguggcgaccaguggcuuacucccagaagccggggggccgagaaucagcccugcccugccaagcuuccccucuucauccugccuuagcauacucucuuccccagucacccauuguccgagccuucuuugggucccagaauaacuucugugccuucaaucugacguucggggcuuccacaggcccuggcuauugggaccaacacuaccucagcuggugagagccaggguuugggccggggacuuggggaguugaaguggacaaaggcugagccucccagccuuuccuccuaagcccgcuuaccucucucucucugcuugcucuaggucgaugcuccugggugugggcuucccuccaguggacggcuuguccccacuaguccugggcaucauggcaguggcccugggugccccagggcucaugcugcuagggggcggcuugguucugcugcugcaccacaagaaguacucagaguaccaguccauaaauuaaggcccgcucucuggagggaaggacauuacugaaccugucuugcugugccucgaaacucuggagguuggagcaucaaguuccagccggccccuucacucccccaucuugcuuuucuguggaaccucagaggccagccucgacuuccuggagacccccagguggggcuuccuucauacuuuguugggggacuuuggaggcgggcaggggacagggcuauugauaagguccccuugguguugccuucuugcaucuccacacauuucccuuggaugggacuugcaggccuaaaugagaggcauucugacugguuggcugcccuggaaggcaagaaaauagauuuauuuuuuuucacagggcuccagucucuugaugugugaguguuguugggcuggucuugggcugguuccagggaauggaagggcuaagagaugggcuuggaaggcaaguuucuguuugaggcuccauuuccuugcuguggaaccaaggaaccugccagcccugcuccaccagguagagcugggagguuucuaucgucaucugaauuaaacagggaagggacacucgagacugggggacaaacaggaaaaaagagccagcaaagacugguaguaauuuauuguuacacacacacacacacacacacacacacacacacacacacacacacuagguuaacaucaaccaccgcaccauccaggcacuccccagccaccacgugugggcacaaagacacacacaccccucuugguaggcagauuucccugucugcuccccucuuccugugggagaggcaugccuucugggcaguuuaaaggugggaaguuacaggggccuaaaaagguaaaagagcagcagcucugcacuggccagcuguaaacaguaaauaggccagucauggaggguccugaauccagauccucaggaagguuuucaccaaacaccacagucccauuugaugugaugcccagccucuauccuuaaggcauuuccagcgucccugaggcgcucugcuuagacaacuggcacagaaguggucagggccuuggcuguggcucugccuccugccucacgggaagccggggaguggagcagagaccagcauuagggagccuuguggcaguggugagaggcugcucaggaaggagcugugccucuccccugguccuggccccaugcccucagcauccuuaagaaacacggcuguccaccuuuuucccugcaagaaaacuaaguccaucccuuaugacugucucgggccccaaaggugaagggcagcuccggcaaggggagaacuccgauugauuggagucccuguuggggcaguagcaggguuccacccaccgcgguccuaggccugggggcgaaguccaggccuggccacaagguucaaagaugugucagacccaagccgcuacccccuacuccgagggcgagggcggagaggcucagccccaggggcggggccuguagucggaggccgagcgggcgugguccggguaguccaggcggcucucgguggcagugagcaugcgcuccggcuccaccacgaacauguaguagagguuccacaucagcaucgacagcaguggcagaaacgucaggccguagccgaagccucggaaggagcggcccacggcaaaggucagccaguagaucagccuaugggggcaagaaaagggucaggcuacucucgagggaagcgcgucagcugauuggcaauaggcugacgguggggggaguagauaggggaggcagaugcaguugguggguauggcugguacuuccaaauacagccaaaguuuaugcacuuaacauguauuaggcacagcgcuaauuacuauaagugauugauuugacuuccccacaucuuuaugaaguugaguauguuauuccuuucccucuuuuauuuacuuuucgauuuauuuuuauuuuuuuagagacauggucuugcuauguugccagucugggcucaaacuucuggccuugagugauucucucaccucagacuccugaguagcugggauuacagaugcgggccaccacaccuggcuguacaaacuuuaaaauguuugagcaaauucaaugaguauaguaaaauaucuuccucccuuuaccgauucccacccuauucucccccacccccaccccaggcaucaauauuaugguuucuug

SEQ ID NO: 13666 - RNA, 4832 nt, Homo sapiens
caagaaaccauaauauugaugccuggggugggggugggggagaauagggugggaaucgguaaagggaggaagauauuuuacuauacucauugaauuugcucaaacauuuuaaaguuuguacagccaggugugguggcccgcaucuguaaucccagcuacucaggagucugaggugagagaaucacucaaggccagaaguuugagcccagacuggcaacauagcaagaccaugucucuaaaaaaauaaaaauaaaucgaaaaguaaauaaaagagggaaaggaauaacauacucaacuucauaaagauguggggaagucaaaucaaucacuuauaguaauuagcgcugugccuaauacauguuaagugcauaaacuuuggcuguauuuggaaguaccagccauacccaccaacugcaucugccuccccuaucuacuccccccaccgucagccuauugccaaucagcugacgcgcuucccucgagaguagccugacccuuuucuugcccccauaggcugaucuacuggcugaccuuugccgugggccgcuccuuccgaggcuucggcuacggccugacguuucugccacugcugucgaugcugauguggaaccucuacuacauguucgugguggagccggagcgcaugcucacugccaccgagagccgccuggacuacccggaccacgcccgcucggccuccgacuacaggccccgccccuggggcugagccucuccgcccucgcccucggaguaggggguagcggcuugggucugacacaucuuugaaccuuguggccaggccuggacuucgcccccaggccuaggaccgcgguggguggaacccugcuacugccccaacagggacuccaaucaaucggaguucuccccuugccggagcugcccuucaccuuuggggcccgagacagucauaagggauggacuuaguuuucuugcagggaaaaagguggacagccguguuucuuaaggaugcugagggcauggggccaggaccaggggagaggcacagcuccuuccugagcagccucucaccacugccacaaggcucccuaaugcuggucucugcuccacuccccggcuucccgugaggcaggaggcagagccacagccaaggcccugaccacuucugugccaguugucuaagcagagcgccucagggacgcuggaaaugccuuaaggauagaggcugggcaucacaucaaaugggacugugguguuuggugaaaaccuuccugaggaucuggauucaggacccuccaugacuggccuauuuacuguuuacagcuggccagugcagagcugcugcucuuuuaccuuuuuaggccccuguaacuucccaccuuuaaacugcccagaaggcaugccucucccacaggaagaggggagcagacagggaaaucugccuaccaagaggggugugugugucuuugugcccacacgugguggcuggggagugccuggauggugcggugguugauguuaaccuaguguguguguguguguguguguguguguguguguguguguguguguaacaauaaauuacuaccagucuuugcuggcucuuuuuuccuguuugucccccagucucgagugucccuucccuguuuaauucagaugacgauagaaaccucccagcucuaccugguggagcagggcuggcagguuccuugguuccacagcaaggaaauggagccucaaacagaaacuugccuuccaagcccaucucuuagcccuuccauucccuggaaccagcccaagaccagcccaacaacacucacacaucaagagacuggagcccugugaaaaaaaauaaaucuauuuucuugccuuccagggcagccaaccagucagaaugccucucauuuaggccugcaagucccauccaagggaaauguguggagaugcaagaaggcaacaccaaggggaccuuaucaauagcccuguccccugcccgccuccaaagucccccaacaaaguaugaaggaagccccaccugggggucuccaggaagucgaggcuggccucugagguuccacagaaaagcaagaugggggagugaaggggccggcuggaacuugaugcuccaaccuccagaguuucgaggcacagcaagacagguucaguaauguccuucccuccagagagcgggccuuaauuuauggacugguacucugaguacuucuuguggugcagcagcagaaccaagccgcccccuagcagcaugagcccuggggcacccagggccacugccaugaugcccaggacuaguggggacaagccguccacuggagggaagcccacacccaggagcaucgaccuagagcaagcagagagagagagguaagcgggcuuaggaggaaaggcugggaggcucagccuuuguccacuucaacuccccaaguccccggcccaaacccuggcucucaccagcugagguaguguuggucccaauagccagggccuguggaagccccgaacgucagauugaaggcacagaaguuauucugggacccaaagaaggcucggacaaugggugacuggggaagagaguaugcuaaggcaggaugaagaggggaagcuuggcagggcagggcugauucucggccccccggcuucugggaguaagccacuggucgccacugugcaaagccugaugggagggagccccacaguagcugguccaacugggaagaaaggcaaacaagggaggguaaagaggaccaaccugugcccgacccucuuuuccuugccacucccagccuuauucugugacuagcagcaggaguccugaguccuaggcagggccucaaucccuccucuguaaaaauggggaguucgacugggugaggacugaguuguuuuccaaaccuccaagucuggacucagcccuccucuuggccccuagcccccuugcagaucuccaucugccagaguguaagucauauugcacuuucugucugucuccacugagggcagagacugggucagauucauuagcacagugccuagcucuuaaacgacccaaagaaaguguugcuaaauggcaaaugguugaaugaguuuuaggucccaauggugucccaccuacauuccucacccaucugccucucuccaggaagccugaccuggaagacggccggugcauauucaucgucgauggagugcugcuccugcauugaggggcagucagggcccuggcccaauguggcuaccuccagcccaaacagggaacgguuuccccggggagaggcuccaaucagggccaccucuagcugacaggugucugcugugugcaggaggcgaggggguugggcuggucggcuggaccuggaaaaggccuggaccuaggaaggaagaagcaugggaggugugggaaauagcuggaugccugugcuuaagggccaccuccaucauuaaaucccacccucacaaaucagccuuuuugagcucuuuccgauuucucacgccuuacccugaaggccaggcugccauuggcaaaaguccugguagggucguucaugggguggccuugaaauguggcacucaggguggcaggauccaaugaaucagugauguuguuccaagagaaaucggccaaggaguauggaggauauggucuucccaaaggcuuugcugccguaucggacacguuggugcugucaaacucaagcagcuggaggguggggguaggguggaacugggcuugccucaguuuuucucccgagaccacaccucccacucacccccuaccaaggcuuucauaucugagucuauuucacccacccccagucuuuaguuccacccucuaauugggaugaacucucuccucugcacucuucuccuugguucucucccaaccuccucacccugguaaaaacaagggcagaagaaaacugaaugcuguccuuagggagcaccaucaggcccccaucgggcucaggggauagcaggaggcuccaguugacgcucagggugcugugggggguguugguggccaccauuaccacugccagaggccccaggcugcuccacacauagugcaguguggaauuggugcccacugcccguauaugaagcagguucugcagggggcccagccaguuagggaugaccuccagagacaccuggaacauggaguaguggaggguugagggaacaggaccaaggagagacacaggcaaaagagaagcuugaggggaggggggcuuggaaagugcuggacaaaggaugggauuuuggggacuagacaagaggaaugugugcgggagcugagggaacccugggguaaggggcaguggggacaggaugaaaagggguaggguagaggguacagccaggacuccccugacccuggugggcgggucagggcacagggcugcgaagaagaaaacauucaacacuugccuggaccugggucacccagggcugagucgggguccagacaucacccucacauuugcccuacuccacaaucccgucccaugacccaugaccaucucccacacccuccagguugaagaacccuccucuuggcagccacccuccaccccuagccccuggaugcccgguuccagccacccugcaaggguagcguuuccugaaacuucuaucgcuguagccccagggcccucaccuggcgggucuucucccccagcaggccaaauggggcugcaaacagaaguagaguccaaaggagcagggggcugggggcacagugcccccaaccccaggugcacuccacagagccgcgcauacggccgcaauucagccgacggaagaggugccagagggucacaugacucgcguucagc

SEQ ID NO: 13667 - RNA, 33471 nt, Homo sapiens
ccagguggugaggggccaaagcucggggauggacaagagaaaggaaggagaugucacugcugaauuucugcugaauuuccuucugccugcugcccgauuucuauuugacuggcaauagucugguguguauugugacaguucagggagccugagacucacaagugagguggcgauuugggccugguugggugggggaggugguuuggaaugccgggaauggagcuccuggggagacuguaggauuuugcuguuggauuggguuccuugggaucugggucgaagagggaaagaguauauuuaaccuggaggcagaaaccugggguuugggccugcuucugucacuugucagcuguguggccuggagacaaucaguuagccugccuaagccucugucuccucagcuguaauaugcagauaauggugcuugccugugcaccucaaagaaauuugagaaggcuaagguaguaaccuugauugugaaaagcuugucaccggggggacuggggcaggugggagggcuugguuacuacuuauccagucgccccuccagccccgcuggcucagugagcccagcagccacuucccgacuuuguaggaacccaugccagucccuaaguggaccugcucuuugacaucuguccaguguggcugcccugucucccauggcagcguggcacugagcugcagugcugucuuggagguuuugacccugccuggcugugugacuuugggcaaaucuuuccuccucuggccucagaauuccacuuauaaagaaaggggcuuauuccucagagcccaggggccuccuggaagugggcuggggggaucaaccaggcaggggccucaagcucccuaaguagagaagcucugccucugucauuuaguagauugugcuuuuugggugagauuucauuugagugagggggaucucugacuuuacaaauagcugucauucacuugcuccaucuaagggcccgcuucucacccggcaccaccuaugagccugccucauucccccuugcugagccugagaagaaaucuacucagcugugcuaccucaggucaauuacaaccucguggaguuuggguuguuguuuuuuuuuucuuuuuuuucuuuuuuuuugagauggagucucacucugucacccaggcuggagugcagugacaugaucuccugccucagcucccugaguagcugggauuacaggugcaugccaccacgcccagcugauuuuuuguauuuuugguagagauggaguuuuaccauguuggccaggcuggucuugaacuccugaccucaaguaauccacccaccucagccucccaaaaugcugagauuacaggugugagccacugcucccagccggaauuuggguucuugacacauaaaaugcagauaauaauaccuaccucauaagauugaggugaagauuaaaugggaucaccuccauauagccccuagccugguugcuggcacauggcagccccuuaaagaguaggcacggucuuccacugucaagguuauaacuaucaccugcacaugagugacucagcacuucaaucauuguuuaauacccuguagucaaaggaugaauaagacccucccucaagaacucacuauaaagagauucccaaaccaugucccagaaucuguacaucaccuccaccuccucagacccuccuccaaagagucgccugucucugacuccuaccuguccaggguucuagccaccugaugguaagaucuuggcuuuccaauucaggcaaacucguauuaaaauuucaguucuggcugggcgugguggcucaugccuguaaucccagcacuuucggaggcugaggugaccagaucaccugaggucaggaguuacauggugaaaucccgucucuacuaaaaauacaaaaaaauuagcugggcuaauuuuuuaguggcgcaugguuguagucccagcuacucgggaggcugaggcaggagaaucgcuugaauucaggaggugcagguugcagugagcugagaucgugccauugcacuccagcccaggcaacgggcgaaacuccaucucaaaaaaaaaaaaauccaguucuguuacuaaccauaugaccuuagacaagugauucucaauaagggguaauuuuaucccccaggggauguuaggcaaugccugaagauauuuuugauugucauaacugggaauggaagugcuacuggccuaaagucgggagaggcuagggauguuacaaaccaucucagaguacaaagaaccuucucugacaacagagaauuaucuggcccaaaauucaguagugccaagguugagaaaccugaccuuaaaugaauaauuuaaccuuucugggcuucaguuuccucaucuguaaaauagggcuauuaauaguaucuaccuuguagagcuauuguauugguccaacaaaauaaugcaaguaccuagugccuaauaauaaagguaguccauaaauauucccuacacgaaugguucuuagcaugccucuggaaucccuccuggcuucaucacugggcugaacccaccggacccuaguuuggcuuauuucuugccaaggccagugcuccugacucuuucuucacuggucuugaugcuuuccuucucuccuugaccucaaggccuaucaagcagcuggaagccucucccucaggccccaucccagcaccaggccccugccuccaccucccacuucucccuucccgucucucuucccccucuuuccagccuuaccucuaguggcuccccaugccccuuggcaggucagagcacacucagcuuuuucccacuucagcaccucugcacagacuuccuccagccagaguggcagaagacagagaagcauguccaggauuuggaccagacugccuggucccaguucugcacugggccuguuacuuacggccuaguuuuaggaaagucagccucaucugcaaagcagggaaauaauuuccaacccaugagguuguuguauggacccaguugagaauguaugaaaacaugcaacaacuauaaagauuguuaaaauguaaguuauucacugugugagcauuauucugcuaaauguaugcauguauguaugugugugugugugugugugcauauauauauauauauacacacacacauauauauguaauuuuuuuuuugagacaggguuucucucuugcucaggcuggagugcaguagugcaaucacagcucacugcagccuugaccucccaagcucaggugauccucccaucuuagccuccuggguagcugggacuagaggcaugugccaccacccccagcuaauuuuuuuuuuaagagaugggguuucacuauguuggccagguuggucuugaacuccugggcucaagcaaucugcaaucugccugucucggacuccccaaguauugggauuaugggugugagccaccaugcucagccucugcuuuauauuuuuauuuccauagcuccuaccguguucuaacaaacuauaacuuugucuuugguuuauugacugucucccuccacuagaaugucagcuccauaaggguagggauuuuugucuguuuuauucacuucugcaucccuggugucuagaauaguuccugguauauaguagauguucaauaaauauuuguugaaugaaugaauucucuguguauaaggcaguucuguaaagccccuaaaucuuccuucuccaagaagcccuccuucaaauguauguaaccuuauuuaguuauugcacauccccauuuuacagaugaugaaacuaacgcuggaaaaacuuguccagagucacugaccugaaaaguggcagggccagaugcauuuguuuauccaagaaacccugagagggcugggcaugguggcuggcacccgugaucccagcacuuugggaggcugaggugggaggaucacuugacuccaggaguucaagaccaacuuggcaacauagugagacccccaucucuuaaaaaaauaaagaggcugggugcgguggcucaugccuguaaucccagcacuuugagaggccaaggcaggcagaucaucugaggucaggaguucgagaccagccuggccaacauggggaaacccugugucuacuaaaaauauaaaaauuagccgggugugguggugggugccuauaaucccagcaacccuugaggcugaggcaggcaaaucgcuugaacauggaaggcagagguugcagugagccgagauugugccacugcacuccagccugggcaacagagcgagacuccaacucaaaaaaaauuagaaacaccgagugccugcugugugccagguguuagggagacagaugaccaagacuugguccuuucugucccucacagcacuuucaggaaugggggucacagaggaaacacuaggaugcuauaagaacacagaggagcccccccacccaaucaaggucauuggucuucaagauaaagugccuaggccuggugcaguggcucaugccuguaaucucacacuuugggaggcuaaggugagggggcacuugaggucaggaguucgagaccagccuggccaacauggugaaaccucaucucuacucaaaauacaaaaauuagccgggcgugguggcacacgccuguaaucccagcuacucaggaggcuaaggcaggagaagcgcuugaaccugggaggcagagguugcagugagcugagauuguacuguugcacuucagccugggugacaagagcaaaacucugucucaaaaaaaaaaaaaaaaaauucucaaaccguccguuggacccaaccacugcaugcugauuucacucaugcaugcuccagcucccagacuucugggaucccuuuggaauucauccaauucagaguccucuacugcucuuuaaucauuugugcuuguugguuuugcuucucccucugucuuucccacuggugggaggcucccuugggagcaagcauaguauugcuaucacccuguggcauagugugcagaacucuugcacacccaggagcucaguccccgucuuugauagccacucuacccauacuacagguaagaaaacugagguccagagaauucaguagcagaucuagcaucacucagcaguuaagagguaggauuagaauguggucacccucuagccaccacucccaucaccucucaccuccagcaggcucagcuccucuggaccuggcugcugcuucuggguuggugauuuuugcccuggcaaagggagagcagacuuaugacaucuggaguccagaguuaggauugaauauucaggauaaaguuucacuuugaaguucagauuuaggauugaggccauuuugaugguggucgcagggaaccuuuagaaagagcuuggagugaaauuuggggugaaagcccuccuucuuucuccugcaccuuuuccacaagauggggaggucuggccagacacaguggcucacaccuauaaucccagcgcuuuggaaggcugaagugaggaucauuuggggccaggaguuuuagaccaaauugggcaacauagcaaggcuccgucucuaucaugauagccuauagucucagcuacucaggaggcugagauaaaagaaucacuugaacccaggaauucaagguugcagugagcuaugauccugccaccgcacuccagccugggcgacagaccaagauucucaaaaaaagagcggggaggucuaggacaggaaggguuaagugugguuuagcuuucccagccuggaaaggaagccaggccaagcagcuggguaggggaaaagggggcacugagugccagggaggggcugaggcagugggaacagcaugaacccuucccucacguuucacuggcuuaccccuccugccucugcuucugguguggagaagaacaagacuuuuuauugucugggaagcugagggugggugccacgcccugggggagagaagccauauucugggcccccucauccgggugcaucccuagugcucaccaugcugcccaggcacccucacugagaugagaacuuuccuuguuccccuccccuaauaaccaaaguuccugccuuaaucccacuccagucccucauccaccccgaggccaggcuucagaacccagaacugagggccuguccagcccugcuuuccuuguguuugagggaagcccugauaucuuggagcuguacaagguagcaacauaauuugauuucccugguugcucaucggaggauaagcugugggaggcaguugggcagggcaugcaggcagaugggacccaggccucaaugcugucaccucuuagagaggauaaggugggacgggcaugguggcucacaucuguaaucccagaacuuugggaagcugaggcaggcagauuaccugaggucgggaguuugagaccaguuuggccaacauggugaaaccccaucucuacuaaaaauaaaaauaaaaaaaaaauuagcugggcuugguggcaggugccuauaaucccagcuacucaggaggcugaggcaggagaaucucuugaacccgggagguggagauugcaaugagcugagaucaugccacugcacuccagccugggugagagagcaagacuuaaucucaaaaaaacaaacaaacaaacaaaaaaaacaaacaaacagaggaugagguggauggugggaccaggauaggggccaggaugaggggaggggaguggaaggcuuaucaaaaggguccuuggugaggccugaggauggaggcuccagagccugagguagcgaacccuggggaccugagugaucucguuuugugagagagccuggccccuccccagagccagcugcagaauggaccuggccagagaggaaaguagagaugaguauggugcuggccuuugcagccagcaaggcuguggggucuuugcuguuccugucccccacuaccuucuugccccccacuaccuucuuucuggcugaaaccaggauagagacccaauauuggcuguccagcccccagcccugcuuccccuuucaggccccucugggaaccacagaaaucugggaccuagugucuuggcaacguaaugaaugcaugcacagcucugguaucuguuuuaaauuauccauuaaaauaaguacaguucugggggaaaaaaauaaguugacugggugcgguaagcaguagaaagggacugaagggggaaggaacccaggcagugcuuggguccaaaggaaggggacaggagauggaaggggcagugccuggcuccuauucuuggcuuucuuuaggggacuucuuuaggggacuguggcuuguugcuugggucuaaaaacgaaugcuuggcuuugaagagagauagauuggggcaaaagaaagaaaaaaagggaccccccaaacuccuugaucccuggccccaaacugggggcauaaaggaacucagguuccagaacuuugcuccccccagggaacccaggcauuccuucuccaccccacuccuggcacacugagaugcagcucugaaugggcugcccacguguggagggggguuggggugacucacuauuacuacugggaggacagggggagccagugguggaagaagggugagucacacugaugggcaccagccucagcccuccccccacuuuccuggcucccagcccugccuaccugacccucucccuugcuuugcgcccacuucccucucuuucuccccgacccuuuugcccacccacucucccuccuuggcucugcccucuagcccagaaggucugaggcaaugggggcaagcuuggagccgacagugcugagcaggcaggagccaagagaggggaagcuugagccucacgcaguuaggggugcgcuggagaggguggggcccgacuccgccacaccccaacgguccuucccccuccucaccacucccgcccccacccccaauggaucugggacugccccuuuaagaguaguggccccuccucccuucagaggaggaccuauuagagccuuugccccggcgucggugacucaguguucgcgggagcgccgcaccuacaccagccaacccagaucccgagguccgacagcgcccggcccagauccccacgccugccaggagcaagccgagagccagccggccggcgcacuccgacuccgagcagucucuguccuucgacccgagccccgcgcccuuuccgggaccccugccccgcgggcagcgcugccaaccugccggccauggagaccccgucccagcggcgcgccacccgcagcggggcgcaggccagcuccacuccgcugucgcccacccgcaucacccggcugcaggagaaggaggaccugcaggagcucaaugaucgcuuggcggucuacaucgaccgugugcgcucgcuggaaacggagaacgcagggcugcgccuucgcaucaccgagucugaagagguggucagccgcgagguguccggcaucaaggccgccuacgaggccgagcucggggaugcccgcaagacccuugacucaguagccaaggagcgcgcccgccugcagcuggagcugagcaaagugcgugaggaguuuaaggagcugaaagcgcggugaguucgcccagguggcugcgugccuggcggggaguggagagggcggcgggccggcgccccuggccggccgcaggaagggagugagagggccuggaggccgauaacuuugccauagucuccucccuccccggaacugcccccagcgggugacuggcagugucaaggggaauugucaagacaggacagagagggaagugguggucucugggagagggucggggaggauauaaggaaugguggggguaucagggacaaguuggggcuggggccggccugaauucggucagauugggauuugccaacuauuuggagccggggggaggggcuugagcaaaacagaacuagcccugccagcucgaagaacucugggcacccaggacacaucggaguggcagaaaggguccuguuagaacuuuguuagcgggcuuggcacugugcuagcuuugcccaagcuggcucugaacacaugaugcccacuaagacauaacucucaaguuggcaucuguccagcguguuggagcgaggucaggaaggcagggcaaucccccuuuucccucccaagggcuuggcgguggcccccccucagcaugaccuuguccuggguucuaaggguugggaaguucucccucacucugccacucugcgugucugggaccuuccuugggcucugacaggcccaccaaaagagcuccgggagaugagagaucggcucccccgcagcucccacagcccuuggccugcuuggcccaggaaugcaagggagggagggaggcagagggcagaggcucccagcucaggaaguuguguuaugcccaggucuggccgcacuccucccuuggcccucugccuagugucuucgaggguugggggcacuguccuucccuccuuggggugagccacuuucauuuucccagcggggccaggcagucuuugcucgggcccauccucuuagcugcugacguuuugaucuuugucuuauugaagugcuggaauacagugacauuuuugaaauccagccguuggaagauucaggccacucccacuuuacccaccccugccccacccuaccccacccuacucaacugcaccuucuucuuuucuaaaaaagccuuugggagcuuggaaguauaggcccucucuuccagccccaucaaaauuuguuucccuucuuccugccuucccuuucucuaugcagacccaggccaagagcacuaagggugcuuggagauccguaaagggcuguuggcuuugacuucuucucucucuuuuaucaucuacuccaaacuucugcucuuccuagaacccuuugcuaggugugguuuuguugcccaggcuggagugcaauggcacaaucucggcucacugcaaccuccgccucccagguucaagugauucuccugccucagccucccgaauagcugagauuacaggcaugugccaccaugccgggcuaauuuuguauuucuaguagagaugggguuucuccauguucgucaggcuagucuugaacucccaaccucaggugauccacccgccucagccucccaaagugcuaggauuacaggcaugagccaccacgcugggcccaucacccuucuuucugaagagucaauggaaguuguguguaggaagacaggcuuaacgguuuuuuuuugagacagggucuuacucugucacccagacuggagugaaguggugcgaucuuggcucaccacaaccucugccucccaggcucaaaagauucuccugccucagccuccugaguagcugggauuauaagugugugccaccacacauggcuauuuuuuuuuuuuuuuuuuuuuuuaauuuuuaguagagaugggguuucaccauguuggcuaggcuggucucaaacuccugacuucaaaugauccaccugccucggccucccaaagugcugggauuacaggugugagcuaccaugcccggccaucaaccuuuauuuuguuuuuuugagacggagucuugcuuuguugcccaggcuggaguacaguagugugaccucaggucacugcaaccucugccucccagguucaagccaugcuccugccucagccucccaaguagcugggacuauaggugccugccaccacgcccggcuacuuuuuauauuuuuaguagagacgggguuucaccauguuggccagggugaucucgaacuccugaccucaagugaucugccugccucagccucccaaaguguugggauuagagacgggagccacugcgccuggcuucuuuuuuucuugagauaggguuucacucuguuacccaggcuggagugcaguggcaaggucauggcucacugcagccucuaccucucuggcucaagccauccucccgccucagccuccugaguagcugggaccacaggcaggcaccaccacccacagcuaauguuuuuguauuauuuuguagagaugggguuuugccauguugcccacagucuugaacuccuggguucauucugcugaaagagaccacaccuguccuuuucuuuauuuuuauuauauuuuucagagacagggccuugcccuguugcucaggcuagagugcaaugguacaaucauaacuugcugcagccuggaacuccuccugggcucaagcgauccuaccgucucaccuuccggaauagcugagacuaagggcaggcaccaccacgcuuggcuaauuuuuuuuuuuuuuuuuuuuuuuuugcuuuuuguuuguaaagauggaaacuugcuauguugcucagcugguuccgaaguuuuggccucaagcaauccuccugccucggccuccggaagcacugggauuacaggcauaagccaccaggccugacgccaggccugucuuuuuucuacuagugauaugaacaauuuaguuagcaagacagauaggaagcaaggaaggggagacccagagaauucguugcauucuaaacuaguccacucaucuaccaaagcccugugaaggacauuuuuagcaguuuuagcaguuuucuggucaaaacuuugaucgagaaacagauugaguggauucgauauucucuugcucacccagccacgccaguuugucuccucugccuccuagugcagcuguccaggccugggacaccaggcggguaugugcgcauguggggcagggcggaggugguguguguacuuguuauauuuagccaccucccucuguucucccccacugauccuggcuggaaaggcugggcuuccggaaaagagagguggauuugcacaccuggaucccaagcugauagaaaguggggugaagacaaaggggacucagacuggggugucuguccucuucuaugcccacaguaggaggagccaggauugguuacucccugcugggucugcugugcucagagugagguagagaaguggguagaguaaagaauuugggagaggaaaaaaggcauuuucccaaccccucccaccaaagccuagagagaagguguugucugguuuaauguuuaauuagagcucagaguucagggccagauuuggaguugggauggaaaguuguuuuuaagacccuguagcaauuuuugacccagccuggguaccucaaccacacucaggaguuugggggaccuucuguugggcuggauuauaggcuccaagaagaaaccccuuucgccaauacucucucucucuucuuuuuuugagacagggucuuguucuguugcccaggcuggggugcaguggcaugaucacagcucacugcaacgucagccucacaggcucuggugauucucccaccucagccuccugaguagcugggauuacaagugugugccaccaugcccagcuaauuuuuuuuuucuuuuuuuuuuuuugagacggagucuuguucuguugccaggcuggagugcaguggugcgaucucggcucauugcaaccuccaccucccagguucaagcgauucuccugccucagccucccgaguagcugggacuacaggcacaugccaucacgcccaguuaauuuuuguauuuuuaguagaguugggguuucaccauguuggccaggauggucuugaucucuugaccucgugauccguccaccuuggccucccaaagugcugggauuacaggugugagccaccguacccggccacuaauuuuuauauauuuuguagagaugggguuucaccguguugcccaagcuggucucgaacuccuaggcucaaguaauccaccugccuuggccuuggccucccaaagugcugggauguauaggcaugagcuaccgcaccugguacccccugccccuucucugucucuuucuagucuguagcccaagggauuuggauacccaagugcaggcagaaugggaagguuguaagcaccagggaagccugucuggaguccaggcuugcagcugggccccaccccaggcaaggcagcuggguggaugacucagaugcugccccccucccucccacccugguggcuuuacagaagacagcaggagacaggguggagacagcaguugucuuaaagggaggagugguggucugaaugucuaccucuucugccccccuccccauugcauccuggagucccuugccuggcuccuuccugagacccucugguggugucuggacacauagcucucucuggacagguaacaugcacaaguaauuagaauccagaguugaguucagaguuauggauugggcugcaggauagugccagggucugugccuucccaugugaaacugauggaggaaggcugagucagaaguggggagauccgaggcccacaaagcagaagcgcuacuuccacuccaaaaaggcccuggugcuugacaacuuccuggauugcccacuguugcagccccaguguggacaggcagggagaugcaggcuccaguucauguaggcucugaucaagacaagaacagcaaaggccacagaggcacagaugcuugucccaugucacacaauaaaggggucagcacuugaucacaggccuuaugacuuccagcugggugugcucuuaccauuaagccucacuucucuagcuugggggacagguuggagggaggaucuagagggugagguaaggugaagucagguagcugaggcucacuucugcagccuggaaacucugcucuggggccagugacaccuuagugcucuauggccauacuucguggcucaugccuguaaucccagugcuuugggaggcuaaggcaggaggaucacuugaggccaggaguuugagaccagucugggcaacauagcaagacccccuucuguacaaaaaaauuagccggucaacaccuguaguccagcugcuugggaagcugaggcgggaggaucaccugaagccaggaguuugaggcuauugugagcuaugacugcacuacugcacucuagccugggagagagaaagacccugucucugaaaaagaaaaaaacaaaacaaaacucugcuguccugcagggccuguuagcauaugaucgauagccuuugcuccagccuauaccuggacccaggaccccugccagccccucaaucgugagacggucagagcucugggaggcuggugauucuugucuugagacuaucuugagacuugucaugggaauuguccacccggauugaaaggaagcugugccuuuuggcagacccauuagguuaaugggguuggagaccuuugaggaugcaugggcccugggcuuuaucugaggguaucuccugguguuaccucuccaacccuccaccaccaaauccauucuuuuuuuuuuuuuuuuuuuuuuuuugacagucucgcucccuggcccaggcuggagugcaguggcaugaucuuggcuuacugcaaucuccaccucccaggcucaagugauccucccaccucagccucccaagaagcugggacuauaggcacgugccacaugcucggcuaauuuuucuauuuuuaguagagaccagguuucaccauguuacucaggcuggucuugaacucuggggcuuaagcaguccacccaccuugaccucccaaagugcugagagccacugagccuagcccaaauccacguucugauucaaagggaaagaagaagggugcagcuaaaccuggggggugagaaguacuuaaaaagcccaagagaaacaaaagagagaauaauuccucacuaggacccccuauugccuucccacuauuggugcccuugcuuggcacuuccccuggccuccaggagucugagacuuacucuuccauggaugugcccauugcccccacuuccagguccaccccccagugauucgguagcuuagugucugcgcugaagcccaggacagcuggauggacaacugguagaucccuucaccuaccaacugugcuuucugcuccccucccccuugcuucccuccuccccagccccucgccaccccuagcagcugcagcagccaagaccaagucuucagagacccagacacaagggcaggguucauuccauucucaccuccuuggggucccaguguacugauaggccgaacucuaauauuauaggagaucucuggaagauugcagggucucuuaucccucaauaaggggcaaggcaagccgggcgcaguggcucacgccuguaaucccagcacuuugagaagccgaggggaacagaucacuucaggucaggaguuaagagaccagccuggccaacauggugaaacccugucucuacuaaaaauacaaaaauuaaccagaaaucgcuugaacccaggaggcagauguugcagugagccgagaucacgccacugcacuccagccagggcgacagagcaagauuccgucucaaaaaaauaauacuaauaauaaauaaauaaauaaggggcaagguaguccaccaacaaaaugacaggcagugugauauaguggacacccuagcccucggugcccuuaguucuguguguggcccuuucacuaaauugcugugugaccuugagcaaaucgccuccccuuucuggcuuuccuuagcuguaaaagaaagggauuggagcggaaagucuccagagaccuuuuagguuccaaaguaguacagugacccacaaagugagaaaacagucuucuaaaauaccaaguuauuaauaguaaaaucaaauauaaauaaugugaauauaguuaauagcuaauguuguucucaauagaaauguuucccacaagcuguggaauuaaacauacuaccacauuucucuauuuccccgugaaaguuuguuagaaaugguuaaauugugacauuacccucuuggcaaauguuuuguuuucauugcuacuaggaaagggcaacucguuuucgaugccucucccuucuggacgguggaaagggcugugucauagaguaggaacgggagaugcggcacaggaauggcucccauugacccggguugggggcuagggcgaaggccuaggagaggcagaacuguuaccuuagagcuggccaggauuagagaacagugccuggaaccggggggaggggcacggugaccuugggcugcccaccuucuacccuuccagcacccauacuggcucccccaaccugcggcugggcugggaggaggucuuggccccuaccaaucccuuaaggaaggggaaagaguuugggaaggggaguccucccuucaccccugccucccccaaguugugagagaggaagccggaauccugccugcugaagccaggaauaauucuggcugagaucccaggcccggcaggggcgcugagucaugguagagggcagaguggagaguggacaggagacccuaagcuuguccagucagaaaagcagaggcugagggguggccuuuucuugagaacuacauucaaguugcagcaagaaggacaguggucugaauuugacggggacaaauggaagggagauaggacacaugaguuccuuuaggucuggcucaggggagcuagacuucauuucaaggggucuagguucugggcaguugagaaggaggcuauuuggggucaccaaggcuccccuuucuucccaaagcucuaacacugccaccuucugcuggcuaggagagagcugugucuucugaggcuagagcuggaaugcagugagaccagacugccuagguccucccucacuucuucuccugaccuugggguguggcucccacucucucccaguguccucaggguuaauaacuaugugccaccagauagagaguuaaggggcugcugaauuggcuucuugugaagggaauccccuaaaugucccucguuuuggucacuggccucccucccgcccccuucaggacauucuacuaucuucuuaggccaucccucccuccuccaggcacuacuucuuuugcucuauccccaagccccaccccugcauuuuugugacaacaccggaaugauuucuagagagagaggccaggaagaaggaaaguggcacuuggcaggagaccuugcagggggcggcuggugaggaagccagccgcccauuguccaggaccccagugcccuggccuccggccucaggcuucuccugccucuguacaaugccacguugauacgcccagcagcugugacucaggccuggcccccugccaggcccagcacuucuacuggaguugcgucugaacaugucaacaggcuuccuaucccucucucagcaccaguucuccccacuucagccccucccucugccuggaauuaaaaccuggcuuugucuuagggaaggacagcugggagccuaguggcucugguaggggaucugagaggccucagacccuaggcauauuuggcuguuuggcaggugucacgcccaagggaagcguguggaagcagagccaugccugcugugggugcacaugcccgcgugagggagucgggguguuucauccuggggcaccugugggcuuuugagguguaugauauucagaacuucacagguugggguuuggggaaggcucaaggggcuucuaagucccuggaacagcugccccccucaguuccucucucucucucucuuuuuuuuugagauggagucucgcucuguugcccaggcuagaaugcaguggcgcgaucuuggcucacugcaaacuccgccuccuggguucaagugauucuccugccucagccucccaaguagcugggacuauaggugcccgccaccaugccuggcuaauuuuuguauuuuuaguagaaaugggguuucaccaugcuggccaggauggucucaaacuccugaccucgugauccacccaccuuggccucccaaagugcugggauuacaggcgugagccacugcgcccagccucaguuccucucuuuaaggucuccuuuccagagagggauagcaccucaaaugccagggaggggaauucuccacauccugcccuuacccgaguuguggcagacccacagacuagccaagaaaccaagcagugguuacuuugccggguugggggggagguaggggcuaucaaaccucaugauuggccgcacacaaaggugugaguauguguauauuugagggugggugggaguggcacuuucacuaggccuccguaucacucucugacugggguaucucccagcaagcgagacagaggcagacacgcuucccagacugucuuacugggucucucuguguuauucucugcagugucuguguguaucgugccauuuucuauguuuugcaccaaucugcugugaguguccucaggugaccugggggcagguuuuuagugccugagccuacccgucuccaggcuuuaguuucccccuguaaaaguauaggaguugguucaagagaagguuccucuagaagccuugagccugugaaccgucuagucuccggguauuugugggacacacagaaaaagccccacgacccaacagguagaacacuggcugaaaucagcagggcagagcugagacaggcucaaguaggcugagggguagggagguuuugggugaaugggagggagggacagagagaaggaggauauauugcaguaggaggaguugcuggaacaaaaggaggggugguaggaguggcuugggguggcagcagaagacgcccugucacauggcgggaagucagccugggcagaggucuagguguccaggaggggcugggugugguggcucacgccuguaaucccaggacuuugggaggcugaugcaggaggaucacgugaggucaggaguucaagaccagccuggccaacauggcgaaacccuaucucuacuaaaaaugccaaaaauuagcugggugugguggcaggcgccuguaaucccagcuacucuggaggcugaggcacaagaauugcuugaaccugggagguggagguugcagggagccgagaucgcgccacucuacucuagccugggcaacacagugagacucugucucaaaaauaauaauaauaggggcugggcgcgguggcucaugacuguaaucccagcauuuugggagguggaggcggguggaucaccugaggucaggaguccgagaccagccuggccaacauggcaaaacuccgucucuacuaaaaauagaaaaauuagcuaggcaugguggugcaggccuguaauccagcuacucgggaggcugagaagcaggagaaucacuugaaccugggaggugaagguugcagugagaucaccugggcgacagaaugagacuccaccucaaaauaauaauaauaguaauaauaauaaaugaaaaauuuuaaaauuaaacaauuaaaaauuuuaaauuaaaauuaaacaaauuagaugcccaggaggauacaggagagcauuugccaccaggcggacucccuguacccacccggccacagggggcgauguuccugggagacaggaaaugcccaggggcugggagacccucugcucuucugcucccuuccugugugcugccuggcaauggggaacucugagggcuggugagcagggcugcugaggagugggucuaaggagucccugcagggcugggccagcuccuccaccuccccuuugucuuccccucccacuuguuauuuuuagcuacagugucugucccucuugcuucucccccagauugggagaggaaacggaggccucucccuccgggccuagccuguugcccccagcaaccgggcccaaacaggccuguggccggcccuggcuuccauaucuggcaucagaguugggcugagcagggugacucagagggugggucagcgccuggcccggugcccaccuagccccuuugcugugcuggugccuuucuuccccaaacagccccaagggcccgggccugcugcagcuggggagccggacuuccuugucccaccaggcacagcucuucagaccccugccuugggucacauuugcaagugccaacucucauuucuaccuuauucuuuuccucucuguuccccuccccacccccucucuucccucuuucugagaucagauuugccagugaugggaagaguuagaaacaggaugcccagcccuucucgccucaagaggccacugggaugcagccacuccugugcuuggggaaccuggaggaugcaagggaaaggacuggcacucugcuggcacagcacccggccuggggcaggacacgggcgaagccagggucuccccugugagcacuagaggauuucccgaccccugcccggguauugugugccugagcaugagucaccugaggggcccagguucccacccuucccagcuccucuggccugccccacccuguccucccugccaacccagcacggggacggcacucagcgugugcucagcuuuccugaugccaacccccaguggagugggcugcaccaccacccugggaccgaaugccuggcuagggucuacuuuggucccugcuaggucugaggaccccuccuaggaaggaaauggcacuugggggcgggggcagggaggagggaggagagacacugggcucuacuguaccccuagucaucucuuggggugugcguguggcucccuggccacagagcucccaaggucugagucaugagcccaugggugauaguggcuucuuccccgcagaugggagcuccccgugccuaagaaaaccacaaagguucuuccucacuucccucucugcucgugguuuuucucaucugcagggugugucuuaguccuuuaaucuccucucuuugcagugcuagucaaaaccuccaccagggaaagacaaauaacccccuuacuguuuuuuuuuuuuuuuuuuuuuuuuuuugagauggagucucgcucugucacccaugcuguagugcaguggcacaaucucggcucacugcaaccuccgccucccaaguucaagugauccuccuaccucagccuccucaguagcugggacuacaggugcacaccaccguacccagcuaaauuuuuuuuuuuuuuuuuugagauagagucucacucugucacccaggcuggaguacagugguacaaucucaacucacuacaaucuccgccucccaggcucaagcaauucucgugucucagccucccaaguugcugggacuauggacgugcaccaccuugcccgacuaauuuuuguauuuuugauagagucagaguuucaccauguuggcaggcuggucucgaacuccuggccucaagugauccaccugccuuggccucccaaagugcugggauuacaggugugagccaccacacucagccagcccccuuacuuuccuuggagaccauauacuguggcuugugccaaagugguacagcauggauuuccagcuccccuaucuacuugcugcgggacccuagauauagcuuucugugccuauuuccucaauugcauaggaauagcaccuaucgcauaggguagcugugaagaugacgugaguuaacauaauauuuagagcagugcuugguaccuaauaagcucuauauaaguguuugcuauuauauuauuauuaucacugccaccaccgcuuuugcaagcagcagaaggugaagagguuagacugaagaaaaaacuucugugcucaucagcccauaagcucgcagagcacagggaucaugcaucuauguuuuccucagucagugucugccaggcacuggcaaggaaaggcuguuaccagggggaacuccaggaauuccuccuggcaccuaaggaggcuggggagacaggacuagggaaaaggugcccuugagacaccuucugaaaucaucccauugccuuccagcuucuuucagcucaggcuggcuggucagggaaacgcuuugugccauagugucugcccucuuccuccuccuggcuucuccauucucucuggaacuuguggcuuaggaaagcagugagguggaggaggaggaacccuagaucagcagcuagaauugacuggaaugcugcugcuggcuuucgguaauugacacugggccauucaccuuccuccuuugcaccucaguuuccucaucuauaaaagggagaggguugagcugaaucaacucuaagcuccuucuaguucucuaaauucugagagccuccuaguacagccagcagcagccauuagccuucaggguagagaggccucuucugggaagccccagccagccugggggucagcccaaggagcucggaaucuaaguugccccaguugcuucacuuuaccagcgguuuuucuucauuuucccuccucccccugcagcugcuucagcuucggaaaaguucugaagucauggaaaguuggggcugugcucccagccaggggcuaggccggauggcagccaaaaccugagcuggguuuugacuuuauuuuuagcuuuucugacugagacagaggagggaauacauucuccgguucuggaaggggcucuuuuuugcaggagacagacacuuacauuaaacaacuuguucugagguguggccagaggccuggacugagcaagugugcaggcugggggagcuuccucuggcuucucauguccuuccccugccccucugagugucacucuauccuccucccugccugguggggggaggugggggugacuccuuuuuuggacucuccuaagcagaacacugccugggucucguccuccagagcuucugcaaaucuagccuucccuaucccucuucacagugaauugcugggccucuuggaguuuaggacuuuugugguagaagaaaaauguuggcagggcugcuuuucuccuuuccaggauagauuuuuccuucugcccacgcuugguuuuccuuuuuuccaucugcuguggugggcucaugcuuaagcacugaugaguuacagauggcagcuggaaccagguccucuggaucuuucccuccgcucccugggucugcugcuuucucucacccuauauuugugaagcaauuguaacaucuagaaaguucuuggguucucuggagguuuuuaagaaaauaggaccuuucuauuucuccaguccacuagcaaaaauaaucaggggcccagaaaaggugagggagguggcagaggcagcgcuguucgacugguuauagcuaaagcuuuacccacuuugaggagcagggaggcuuaaagcuggggcccagauggaccuggaggccugggauccacaucuggaaccagaugcugaggcuaugguagauggguagggcucagccuucucccagggcacggaugaggcaggagggagggaggcagggaccccucuguucagugcagaucagggcacccagacuggguccugagaaaggaaagggucaauauugugccuggucauccuugucugaggucccucugagcucuaaccagacuuuccuuccccacagucccacauguguaaaagggacuaggagaggugaccaguaccuuuggggcucagaucgagaagugcuagggacaugugggccaugagcuuaguugucaggcuccucagagggagggaagcuuggccaaagggaagugaguagaguccagggagaaggcuaaguaaggcccugugugggaaggggcaggagacaaagguaccccugucucuuugggaaagaaugggaggagagagagggaaaagcauucauaucacgggguagagcucugcccuuggccccaggcacguuccugagcccugagucaugggaaggguggagaagcaggaaggggguuuucaaggaccuuggggaggugggagcccagccccagaggcaagcagaugcaaaccaaccuaaugcaaggaugcccucuccugguaauugcaggcauagcagcgccagcccccauggcugaccuccugggagccuggcacugucuaggcacacagacuccuucucuuaaaucuacucuccccucucuucuuuagcaauaccaagaaggagggugaccugauagcugcucaggcucggcugaaggaccuggaggcucugcugaacuccaaggaggccgcacugagcacugcucucagugagaagcgcacgcuggagggcgagcugcaugaucugcggggccagguggccaaggugaggccacccugcagggcccacccauggccccaccuaacacauguacacucacucuucuaccuaggcccucccccauguggugccuggucugaccugucaccugauuucagagccauucaccuguccuagagucauuuuacccacugaggucacaucuuauccuaauuuggcugccaaugggaucuaccacagugaauuuaaaauaauccaggaggccgggcauggugguucacgccuguaaucccagcacuuuaggaggccgaggugggccgaucacgaggucaggagaucgagaucauccugacuaacauggugaaaccccgucucuacuaaaaauacaaaaaauuagccuggcaugguggcgggcgccuguagucccaacuacucgggaggcugaggcaggagaauggcgugagccugcgaggcagagcuugcagugagcugagaucaugccacugcacuccagccugggcaacagagugagacuccgucucaaaaaaauaauaauaauaauaauaaaaauaauccaggccaugugugguggcucaugccuguaaucccagcauuuugggaggccaaggaggcaggauugcuugaguccaggaguuugagaccagccugggcaacacagaccccaucucuagaaaauaaaaauuuaaagaaauuagcugggcaugguggugugcaccuauagucccagcuacuugggaggcugaggcaggaggauggcuugaaccugagaggucgaggauacagugagcugugauugcaccacugcacuucagccugggugacagagggaaacccugucucuacauaaauaaauacauaaaauaaaauaauccacaagccauuucuacuuaacuuugcaaugaacuguaccugacccuagaucccucccaguuuggcccuccgguauacaagggccuccuauaggcccuugugauuucucuggggaaaaggaggacuggaguugaucauuuauugaggccaucagaagcggauggcuaauuacauaugggacauguguuaauaaugcuuuguguauauagaguggccuuuacuuucaaaacacucuucuccaauuuaucauguuaaaagcuaggaauugggcugggugcaguggcucacgccuauaaucccagcacuuugggaggccaaggcggguggaucauuugaggucaggaguuugagaccagucugaccaacaugguuaaacuccgucucuacuaaaaauacaaaauuagccaggcgugguggcacacaccuguagucccaacaacuacuugugaggcugaggcaggaaaaucauuugaacccaggaucagagguuguggugaacugagauugcaccauugcacuccagccugggcaacaagagcaaaacucuaucucaaaaaaaauaaaaaauagccaggcacgguggcucaugccuguaauccuagcacuuugggaggcagaggugggcagaucaccugagguuaggaguucgagacuagccuggccaacauggugaaaccccaucucuacuacaaauacaaaaauuagcuaggcaugguggcagccaccuguaaucccagcuacuugggaggcugaggcaggagaaucgcuugaacccgggagguggagguugcagugagccaagaucgggucacagcacuccagccuaggcaacagagcgagacuccaucucaaaaaaacauaaauaaauaaaaauaaaaauaaauaauaaauaaaagcuaagaaucaaagaagcaguuuauuccuaauuucacagucucaucuguucauaguggggccaggauuagagucaguggccaagcuuccauccuggguucuuucccuucccaggcccuaccaucauaguauaccagggaaagaccuggagaagccagcagguugaccaccgaaccaaggcugggccaccuuccuccugggucuggucuccagccucccaguuguacccuucccccagcccuuccuggaugcacugaucagccugugcuuccuugcccuguuuuucuuuauaaauagagccauguucuccucucucucucucucuuuuuuuuuuuuuuuuuuuugagauggagucuuacucugucacccaggcuggagugcaauggcacgaucucagcucacugcaaccucugucucccagguucaagcaauucuccugccucagccucccgaguagcugggauuacaggugcccaccaccaugcccagcuacuuuuuggauuuuuaguagagacaggguuucaccauguuggucaggcuggucuugaacuccugaccuuagguguucugcccgccucagccucccaaagugcugggauuacaggcgugagccaccacgccuggcaagacguguucucucuauguuguugaggcuggucuugaacuccuggcugcaagagaucuuccugccucagccucccaaugugcugggauuauaggcaugagccaccacacuuagcccagccugugcuuucuuaaaugaaaaucuaagcauacggcugggugugguggcucacgccuguaaucccagcauuuugggaggccaaggugggcagaucacgaggucaggagaucgagacuauccuggccaacauggugaaacccugucucuacuaaagauacaaaaauuagcugggugugguggcccaugucuguagucccagcuacucgggagacugaggcaggagaauggcaugaaccugggaggcagagcuugcagugagcugagaucgcgccacugcucuccagccuaggugacagagcgagacuccaucucaaaaaaaaaauaaaaauaaaaaaaagaaaaucuaagcguggugcuccccugcucaaacauccucagguucuuuucauggcagauaagggcaucucuucaugagccagccccugccuacugacccagccaccucucccaucccuucccaccccguacuucaggcuucagcaguacugaucuuuccaaagaccccagaacacacaugccuucauaccucugugccuguacaugcuuguuucugcccuugaaaucaugacaguagcucucuguaggccccgcuagccugucccuugggucuuagccucuuggaggccuucccagagccccccaaaaguaccccaggcauacuuugguuccuucucucauguccccucaguacuuugcacauaccuccuuuauagcaguugcuauguugugccagagaagggaguccuguggcuggggggcauauaucuuuucuuuuugagacagagucuagcugugucacccaggcuggagugcaguagugcgaucucggcucacugcaaccuccaccuccuggauucaagcgauucuugugccucagccuccugaguagcugggacuacaggcgugugccaccaucaugccuggcuacuuuuuuguauuagauauauauuuucucucuuagcacaguaccuaccaagagugagugaguagauguccugaccccugcaggcauccaaggcccuccuucccuggaccuguuuccacaugugugaaggggugcacaggcagcagcccaccucucagcuuccuuccaguucuuguguucugugaccccuuuuccucaucucugccugcuuccucacagcuugaggcagcccuaggugaggccaagaagcaacuucaggaugagaugcugcggcggguggaugcugagaacaggcugcagaccaugaaggaggaacuggacuuccagaagaacaucuacagugagguggggacugugcuuugcaagccagagggcuggggcugggugaugacagacuugggcugggcuaggggggaccagcugugugcagagcucgccuuccugagucccuugcccuaguggacagggaguuggggguggccagcacucagcucccagguuaaaguggggcugguaguggcucauggaguagggcugggcagggagccccgccccugggucuuggccucccaggaacuaauucugauuuugguuucuguguccuuccuccaacccuuccaggagcugcgugagaccaagcgccgucaugagacccgacugguggagauugacaaugggaagcagcgugaguuugagagccggcuggcggaugcgcugcaggaacugcgggcccagcaugaggaccagguggagcaguauaagaaggagcuggagaagacuuauucugccaaggugcuugcucucgauugguucccucacugccucugcccuuggcagcccuacccuuacccacgcugggcuaugccuucuggggaucaggcagaugguggcagggagcucaggguggcccaggaccuggggcuguagcagugaugcccaacucaggccugugccuccaccccucccagucaccacaguccuaacccuuuguccuccccuccagcuggacaaugccaggcagucugcugagaggaacagcaaccuggugggggcugcccacgaggagcugcagcagucgcgcauccgcaucgacagccucucugcccagcucagccagcuccagaagcaggugauaccccaccucaccccucucuccaggggccuagagucugggccggaugcaggcuggaagcccaggguugggggugggggugggggugggagguuccugaggaggagagggaugaaaaguguccccacaaccacagagaagggucgcaggauguggagucagauggccugugugcuguuucuguacacucuuaccucaccuucacuucucagggcuuugguuuucccauucgaaaauggaggcuguucuuaaucucccuaacucagaguugccacaggacucugcaaugugagguguuaaaagcaucaguauuuuucuaguuggcugugcuauuugugacaggagaaaaagucuagccucagaacgagagguuucaguuagacaaggggaaggacuucccaguugccagccaagacuauguuuagagcuugugauguucagagcuggcucugaugagggcucuggggaagcucugauugcagauccuggagagaguagccaggugucuccuacaccgacccacgucccuccuuccccauacuuagggcccuugggagcucaccaaacccucccaccccccuucagcuggcagccaaggaggcgaagcuucgagaccuggaggacucacuggcccgugagcgggacaccagccggcggcugcuggcggaaaaggagcgggagauggccgagaugcgggcaaggaugcagcagcagcuggacgaguaccaggagcuucuggacaucaagcuggcccuggacauggagauccacgccuaccgcaagcucuuggagggcgaggaggagaggugggcuggggagacgucggggaggugcuggcaguguccucuggccggcaacuggccuugacuagacccccacuuggucucccucuccccaggcuacgccugucccccagcccuaccucgcagcgcagccguggccgugcuuccucucacucaucccagacacagggugggggcagcgucaccaaaaagcgcaaacuggaguccacugagagccgcagcagcuucucacagcacgcacgcacuagcgggcgcguggccguggaggagguggaugaggagggcaaguuuguccggcugcgcaacaaguccaaugagguaggcuccugcucagggucuaaggggauacagcugcaucagggagagaguggcaagacagaaggauggcauguggagagaggaacauccuugcccucagaggguggaccagggugagccuguauaucuccuccacacucugguuccaggccuggcuccuggacucuuuggcugugagaccuugagcagguuauuuaaccucucagagcaucaguuuccucaucuguaaaauggggaugaauacugaucccuaagucuuugaguugucaggaagaugaaagauaagguauccgugugccuggugcugcguauguguccacagaucauggcuauuauccccgggggaagggcagugacagggguguguguagauggaaggagaggccucaauugcaggcaggcagagggcugggccuuugagcaagauacacccaagagccugggugagccuccccgaccuuccucuucccuaucuucccggcaggaccaguccaugggcaauuggcagaucaagcgccagaauggagaugaucccuugcugacuuaccgguucccaccaaaguucacccugaaggcugggcagguggugacggugaguggcagggcgcuugggacucuggggaggccuuggguggcgaugggagcgcugggguaaguguccuuuucuccucuccagaucugggcugcaggagcuggggccacccacagccccccuaccgaccugguguggaaggcacagaacaccuggggcugcgggaacagccugcguacggcucucaucaacuccacuggggaaguaaguaggccugggccuggcugcuugcuggacgaggcucccccugauggccaacaucggagccagcugcccccaacccaaguuugccaauucagggccccuuucuagagcucucuguugcaggcuccagacuucuccacccaguaggcaaaccaaaagaugcuuccucaacagcacaagggguggaaguuagacagugaggauuguuaaaggcagagccauacuccuacccggagagcuugacagugucccucugggguggaaaugaguuccuuagcuccaucaccacagaggacagaguaagcagcaggccggacaaagggcaggccacaagaaaaguugcagguggucacugggguagacaugcuguacaacccuucccuggcccugacccuuggaccugguuccauguccccaccaggaaguggccaugcgcaagcuggugcgcucagugacugugguugaggacgacgaggaugaggauggagaugaccugcuccaucaccaccacgugagugguagccgccgcugaggccgagccugcacuggggccacccagccaggccugggggcagccucuccccagccuccccgugccaaaaaucuuuucauuaaagaauguuuuggaacuuuacucgcuggccuggccuuucuucucucuccucccuauaccuugaacagggaacccaggugucugggugcccuacucugguaaggaagggagugggaacuuucugaugccauggaauauuccugugggagcaguggacaagggucuggauuugucuucugggaaagggaggggaggacagacguggggcaugcccgcccugccucucucccccauucuuguugcaugcauauccucucauuucccucauuuuuccugcaagaauguucucucucauuccugaccgccccuccacuccaauuaauagugcaugccugcugcccuacaagcuugcucccguucucucuucuuuuccucuuaagcucagaguagcuagaacagagucagagucacugcucugguucucuguccccaagucuuccugagccuucuccccuuuuaugucuucccucuccuccuccgggccccuagccucccaaacccccauugcccgcuggcuccuugggcacagaaccacaccuuccugccuggcggcugggagccugcaggagccuggagccugguugggccugaguggucagucccagacucgccgucccgccugagccuugucucccuucccagggcucccacugcagcagcucgggggaccccgcugaguacaaccugcgcucgcgcaccgugcugugcgggaccugcgggcagccugccgacaaggcaucugccagcggcucaggagcccaggugggcggacccaucuccucuggcucuucugccuccagugucacggucacucgcagcuaccgcaguguggggggcaguggggguggcagcuucggggacaaucuggucacccgcuccuaccuccugggcaacuccagcccccgaacccaggugaguugucucugcuuugucuccaaauccugcaggcgggucccuggucaucgagggguaggacgagguggccuugcaggggggagagccugccuucucuuccgcagcccgggggagugggagccuccuccccacagccugaguccuagacagcccaccucugcauccugccccucuugucugagccccagacuggagggcaggggcagggcuggagugugagggaugggggagaugcuaccucccuucuaggggccaggggagggagggucuggguccaggcccugcugcucacaccucucuccucuguuuucucucuuagagcccccagaacugcagcaucauguaaucugggaccugccaggcagggguggggguggaggcuuccugcguccuccucaccucaugcccacccccugcccugcacgucaugggagggggcuugaagccaaagaaaaauaacccuuugguuuuuuucuucuguauuuuuuuuucuaagagaaguuauuuucuacagugguuuuauacugaaggaaaaacacaagcaaaaaaaaaaaaaagcaucuaucucaucuaucucaauccuaauuucuccucccuuccuuuucccugcuuccaggaaacuccacaucugccuuaaaaccaaagagggcuuccucuagaagccaagggaaaggggugcuuuuauagaggcuagcuucugcuuuucugcccuggcugcugcccccaccccggggacccugugacauggugccugagaggcaggcauagaggcuucuccgccagccuccucuggacggcaggcucacugccaggccagccuccgagagggagagagagagagagaggacagcuugagccgggccccugggcuuggccugcugugauuccacuacaccuggcugagguuccucugccugccccgcccccaguccccaccccugcccccagccccggggugaguccauucucccagguaccagcugcgcuugcuuuucuguauuuuauuuagacaagagaugggaaugaggugggagguggaagaagggagaagaaaggugaguuugagcugccuucccuagcuuuagacccugggugggcucugugcagucacuggagguugaagccaaguggggugcugggaggagggagagggaggucacuggaaaggggagagccugcuggcacccaccguggaggaggaaggcaagaggggguggagggguguggcagugguuuuggcaaacgcuaaagagcccuugccuccccauuucccaucugcaccccuucucuccuccccaaaucaauacacuaguuguuucuaccccuggcugcuguggugucuuuguugguggacgucgcuguguguacugaggugcagacucgugggcaugcgcgcgcguacacacacacac

SEQ ID NO: 13668 - RNA, 1278 nt, Homo sapiens
gaagggacuugacguuuccugagugcauguuuggugccaggcucuguucuggucuuuucagacuugauguaauugucuucacaauucugugaagauggacuuggugucucugcuucacaugaagggaccugagguucagagaggcuaaguaacuuuccuaggucacagagcugguaaguagagacuuuaguguucaaaaccagagcagucugaccccagagccugggaccccagagguagacagugauacucagugagugcuuggagcccacagaggguggagggagugguuccuggaugaaguagaucugaagggugggugagguucauuugaaaggcgagaauuggaggcaugucuggaaguuggugcuggaggugcccagggagacuugcugguugagcagguggccggcuugcauggaucuuggggagcaggggacagguucaaagaaacacaucuuuaaacauuggccaccagguggcgccgcaggccaauuccuagaagcggcuccagccucagcgcccucacuagggcccagguaugacuucgcugcucagccagggcuccaugcucggcuugcuuccucaggugucaucuccagcuuccgcuugccccuggcuucuggcauccaacacaugggggauaaugaugcuaccagucguuuccugacucgggacgaacacccagguagcugagaccugggaauccccgugggucugagcagcucccccggucacccggagaccccuccagucgccuaaaccuggcuucauguccagcgcccuucugaguuucugggagacacuguucagaggacaggcugaggaaacaggcauuugaguccaacugaccugggucugaagggaaauaauaauaucuaccuuguaaggauuuaaaacauuucaucuauggccaggugcgguggcucaccccuguaaucccagcacuuugggaggccgaggcgggcagaucaccugagguggggaguucgagaccagccugaccaacauggagaaacccggucucuacuaaaaauacaaaauuagccgggcaugguggcgcauaccuguaaucccagcuacucaggaggcugaggcaggagaaucucuugaaccugggagacagagguugcgguaagccaagaucgcgccacugcacuccagccugggcaauaacagcaaaacuccgucucaaaaacaaacaaacaaacaaacaaaccuuucauccaauaaauaucuaucaaauacaugcugugucaggaacuauucuaggcccug

SEQ ID NO: 13669 - RNA, 9649 nt, Homo sapiens
cuuaaguaauaguacuuuuaauaaaauuaaguucuuaauagcacauuuaauacauuaacccucccccuucuugguuucucugcauuuugugcaacaucacuuugacuugauuauucuugggucuguuuuauuucccgcuuuuauuuugcuuuugaaaucuuuuuccuugguggauuuguacgugucuucacuagaugccucaaauuaagucugaccacaauccuacucuacuuucuacaguggagagaccauccucccugccccagggcugucuccacccacccccccuuccccacccgcacccucgaguggggaaggggaagcccuccccaccccagacgcuaccaucccaaacuagcgggguuucuaggacaaaaagagcagggggaaucugucccuagguggggcgagaagaguaaauuggguagagggagauguguuuggggucuagggccagggagggggauggcagagucauugguguaaugaagcaggcuccuccugccaaaaggagagccaaggggccccuccaaccccuuggauaggaggggaaggcccagugauugcaagcugggguugguagaaggcaagugcuuuaaaaauguugauuucucacacgcagaagccaagcccuccaguuuuguguggggagggcaauguguucccaggccaggguacaguagaugaccccuaccugaacacauauagauggaggugaacuggagcagagggucaggguuagggucacccaaagucccugugccuuuccccagccucugugcccauggggaugccuuucucccaggccuucaaggacaguguuuccacuccacuccgugggaaguccuucuuggaaucuaacuuuuaugagacaagaaagcacuuugcaaguaggugaagaacgagucagcuuuaaagaacaauuacugagauuguuacugcuacugcugccauggaggucaaagcuaaguggaaagcuggaugggaacagggguaggggacugaucgccucagugcucuugaagcucugaaggugagaagcgugugugcaugugugucuguuuguggaaugacuucccaggcucuuaaaucaaucuguagagaaguggaccgaggucacacuucaagaaggacuuccucaguuaggccugggggaagcaggcaugggaggguuugagcugggagccccaggaggggacauaccacauuggaguaugggcugcccagguacuaggggugcaggugaaugugcuuggccuccucugcugcccccaacccagccccugucuuauugagaugaucagugugcauccuuuccaagacccugggaaaugaaccccucauuucuuuguccuacaauuuaaaaauccaaggauucucagaaucaaccccagcagacuggaagcucccaaucuuaaacuagcaaccugauccaacccugguaucugaagauugggcaacucaggguggacucagccacuucccuccucuauuuaucuuuuccuuacaacuuuuauacauucuacuggacccaggggcccucaaugcuacuaaacuuuaagcuaucuuaauauugucuacuaaguaacuaguaauuguuucuuucucucucuaggauuauaugaaauaaauuugaauuauuauuauuaauaauuauuauuuuguaguauucuuuucuuuuaaaccccucgguuucucuuuuucuucucuuucucucuuguuuuugguuaaaaaaaaaucuagaucucuuaaaucucacacaucucugaggguuccuauaggccugcuaggccuuaauucuggauucccccuccucacuugccccugcgacagggcaggggaaaguggugggggacaccccaggauccucaguccuuaguccuacagcuucuuccuuucuuguuaaucccuuucuuuguuuggcucugccggcuccccugagggggagggggagaggggaggaggaguccauggagugaaauccaaucuacuggaagggucccaggagggaccggguucccccagcuccucucuccaccauucacccccgggaugcucccccaagaaaagcaaaugacauuccuccccaaaaaaaaagugggggaaaaaagcaacguaaacccaaacauauauuaaaaacacuuuuuuuuuuuaagauuuaacucugaauacaaauguauuuuuuucuucuucucucccuacauauauucuaaaccuucuaaaguuuuuuuauuuuuuuaaggaucacuuuaucauaaaauaaaauauccuuuucauauaauaaauuaccuaauaaaaagucuuuuuuuuucauauuagcccagguucuuugcuacauuuauaugguaauaaacgccuuuauuaaaauagaauauuaaauuauaaagaacugcuuuuuuuuuuuuuuuuugcuauuuuuguuuucucuccucuguguuggucgccugucucgcucccucucaugcucucuuucucuccucuauuuugucucucacuauucguguuuuguguuuguuucuagguuuggcucaauugguaagggugggauugaauuugcugagcccccuaguguaacagucuucugccuuuguggguaaagaguggagagggggagggggacgacagacagacaucccuucuucccaccccccuccccaccugccccccggcaaccgagggugcccauuugguuugguuucuauuguacagacaucucaggauggcucacauaggcgggaaggagggaagucgucacagggcaguuuucuuggcugugaccuccuuccccaccccucccuggcugguguucuggaggggaaggcuguggagagguguuaauucucgacaggaggaaggagaggaggaaauccccucugcaccuccaccugcuccauccaggaagaaugggacucuggagcuuuaagugcucgggugaucacucagaacagucccaccccacuauuuacaaggaucuccugggacucccaucccuccauccucucuuggcccggccagcggaaccaggaggguggagagcugguggcagccccaaaugagcaggagggaagcagcaaagggggugcaaggccuguaacaauaugugauucucagaauaggcccugcugcccaccuccccccaguccugcuuugccccaggcugaccccucuuugaagaccuggcuucuccucaaccacaucaggugggacacagacuccaugauuugcauggaggauucaagcuaauaaggauucaagcuaauaaggauucaauaaagguucaggucagguugagaggggugcagggagucgggcacugcaugggaggagcagcucuucccuccaccagucucuccuccugccucacgcccuuuccugcuccuuuaaauagcagacacacuacucuggcgcccccacuuccacaaccagaaaauccagcccaagaacuacucccuaaauauaaugcccauagugaugaagguggggguuugacccuuuaccccaguauuaguccccuccucacauuuucacugagaauggggauacauuccaucaauaauuugagauguuucuuuggaggagugggggagagggccuccagaugccugaagaggaauggagggaccauccaaauauuccucccccuacuucuccccagaaggaugguguccccaaagcugggcugguaggggcaggggcagggggaagggaagaaagacaaagacaaggaacaagacagagcugggagugacagccaccaaaagaaagcaaagcaaagagcuggagggaaaggaaagaguugaggaaagggaagaucccaaaggaagggaagauaggcggagagagugaagggaaacacugcaggggacaggggcagagaggaggacuccucuccagauuccucuagcccagcuuuguggggacagauggcuucugagccuuucagccacagaaacgauugacaugcuucucuccccaaccccuagaagaucuaugcaacuucugauaggacuccaacucccuuacacugcuggaaacuggugacaguuucccaaacaggauauggggguggggugggagguaaagggucauguuaggaggucggaggucaggaccagagggcuuagggauugcaaagagcaccucuagauacaggugguaauucucccucucccuuuuacccacccccuccucggaagaagggguggagugacacacagcgggggaggugggcagagggcgucagaaugccuuaguggccaccucuggcaaaacaaaaguuucucuuagcugcuuccagauuuaaggguguguugagguaucagaguuguaacucuaguaaaauuuucagucuggcccccucccaaucuuuccaggacagggugaccagaggcucugaaaguggcgcacccuccagccaccacugccucccuccccccuuccccagcgagcgaguaucucuaagcaccuugccccucaaaucaccgcuuuccaaaaggcuuuaguggaaaacagguccagggugggcccaguggagugggccccggaggcauggggcacggggcuuaggagaauauucggauggcuugcguggcugugauguggcagacgggacacucuggguccguccucucgcagaugcguacugcacacuccaugcagaacagguuguguccgcagggcacaagggcggcagucacuucgcucucaaagcagaccaugcaaucccgcccgccgccggggcuccgcaggccgcccccaccaaguuuagagaagcccuggagcggcucucccggggggcgccucgggaguccggccagcucgggucccgcggaaguggcaggggagcggugugcgcccgggggcccagcgcgggccuuggcggaagaggaggaggaggaggaggcagaggagaagagcacggaggugggcguggcguucuccuggcccgcccacagcggggggcuagucucggccacgccguaguacacauccugcuugcccacgccauagcccggaaagagguacccgccguagccaaaguccccgcccugcucacccaggcguggggccucaaagccagaguccacuccgcacucgccgaugcagcccaggcuguucugccggaagguggagaggggcuugcagccgggcuggugcacccgccaggcgucggaguagcggcuaucgauugcugcgucggggcuccccgccaggaagucguuuucauuguuguacucgaggaucuugccagugcgcaccgcgaugugcgucucgaucuccucgcgcgcacgcuccacguugccuggggcacccgugaucucgaacacggggucgcggucacggcuuggugugauaauguauguguugguuugcugcuggaugcgcuugaugguugccccuuuggggcccaccaccagccccaccacgcgguagggcacccgcacacggauggucaccuggccgggcagagcaggagccacaccaaaggcggcgccugacuuguugcgggaggcacggaucauggagaagugcuccgcugcugagaugauuucccgccgggcuguggccacguccucccgucgcccugucaccaugaacacugguuccucgccccucaccggugucuugauguagguguuggucuuggcccucaaggccuuaaucuugcagccugggauagggcggggaaggagagagacaaagaaacgcacacagcaagguuugugcugggaccaauaaauuccugauccuuacccaaauaccuagccucccaggaacacuucagucuacccuuugaaaugcccacugcugcacacacaguccacccugacuugaagaaaccauuuaucagaucucagaugugccuaaugucucucucagccacagauuucaaaauguacuaacuuucccugaguuccauucagggcccuccaaauucauucacuccucaaaacccccaaauaaucacugacccucccauacaagcugguaacucaaauccauucacaaacuacacuccuuucucccaacauuugcucuuccuucaauuucucuacugauuccuggcuacucacaaacuuccaaaucacuuaaucaccccccacaucugucacugacccugaucuuuccacagaaccccaaugugcucaguaaccucauaaucuacucaucugacccuugaucauuaaaaguguccuccaaacuacccagggaccacugaagucuaucugcucuaugaccgccccacaugccuuccacucaguaguuucucucagugggccucaaauucauagcgaguuugcagcaacgaguagaguguaggggacugggaaaggucugacaaucauaaguucaaggaggaaaggaggaguauggaguuaaacuucugugugagggaacagugcccaaccccgugucacucuugucccccuguccccugggggcaagacagcugagcugggcuggggcugaguacggugagggagagguauuuuggacccacacuccugcuuugaaguagaagugaguuaaagcugggagguuagggaaaggcaggaagagaaagaagaaaaaugagacaaagagagacaaagagggagaaggcuagagagaaaaguaagggcuauucuguuucuaaaagcugccgaccugggggucuggacaagucccucuccuccuuacccaccuuccucuucccugcuccuagcuucacacagagcuuccaagacucauacccuuuugggaagcacacgucacgugugugaguucacacacauguaccuaagaggugugccuuuaucuaaauaauacuuauggggccaaucuaauguacacuuuuauacaccucuuucacacacacaucaagucccuguguuucggccuuucauacaucccacuguccauccccauccuccccagcacacaaacagcacauuccuauacacacccgcacccaugacuuucacccccaaucacauauagacccacucacacccuucucugagcacaacucacuauuccccuucucucuccaaccgaaaccaagugguccuacuuuucugccucugccccaacccuccaaccugagaccugaggugagcucauuuuuuccuccuuccuccacuccagauggcugcuucuucaacgcuggcagauuggggggugaggggaagagaguagguugggggacccucccucacuuuuuuuguuuguuuuuuuuugagauggagucuugcucugucacccaggcuggagugcaguggcauaaucucggcucacugcaaccucugccuccuggguucaagcgauucuccugccucagccucccgaguagcugggaucacaggcaccugccaccacgcccagcuaauuuuuuguauuuuuuaguagagaugggguuucaccacguuggccaggcuggucuugaacuccugaccucaggugauccacccgccucggccucccaaaaugcugggauuacagguguaagccaccacacccuacacccuccccucacuuuuaaaagaccuuaagaaggaaaauuugcuuguuuccucuugucuucagaccucuuagcaguuaugaaguccuaccuguuguccagcccacauccuugcugcuuuaaugucaguaaaugauuguucuauuuucgagguauggagggucacaaaacagugaacuccccucuccuaccauuucuacucacauaucguuugaugggcaccuggguucuggccguaaguuuuggguccaaaaacuuaaaugagagcuagguaucuuuagcgguugggguuggggugaggaggacaggccaaggcaucgaguaagaagaaacgcuagaggccuggaggugcaaagcugguggugggucucuuccuggguucugcaaccccaaagaagcaucucuugaagggaagacccacugggcuucaccuuccuagaggucaaacagaggagcacuaacacugcagcaggaggagggagguuagacaagagggaggacuuccauauacuugacugaggggcaggcuuaucuuuugugaauaaaaauccccuuacuuuuaugagggacaagcccaucugaugcggaggcagaagaggaaagaaugacuccauuaaauuccggggccucccaagaccacccccacacccaagaaaagauagcaauguccguccccacccaauuccagggcuuuggauccccaguuucugacaagaggaaauccaacuuucuaaaucagaaaucucaagagauggagugccccagggggaugagggcugugcaggggaguggcaucuuccccuccuccauucuggaucucuccgugaaaucccccuaacccccagcacucccaguggauaaggugggauguggaguaggggccccccuggcccgccuccccuuuuccucugccagaagcuggccuccucccgcacucccagccggaaugcagcuccucuauuguuccccacugugggacagcuccucccccaccccacaccuccccagcccagccucuuugcaauuuccaaauccugccccccacacucuccuuugagaagccaggagagggaaggguccccaagaucccgucugcucaauuuggaccuucaccaacacccccacucacccacccagggaugcuggagcagcagagggugugguaccagacauacuacgcuggauuaauucugcacccccucccaacacacccagacacacgcccuccaccaaauuuccaggugaagguuucuuaccccccagcauucccccuccuacccuguccuacucuuucacuaccagagaccccucucuaggccucuggcccaaggccguggccagcccagaacaaaagccagagagggaagaggagagguccaagccaggacguagcacuuccuuggagacaccccuuccaaaaccccagagacaauccaacuuuggggugugggugaccacaggacccccuccucucagcagccccccucaccgccucuuccccaggcugggacccuccccugggccacacccccuuccauuccuacacucagcccaacaaagagacagauacucagucuggcuucgagggccaggucucccccaaagucuguaacuccaggcggcugggggccccagggaugcccccuccccagccuaggagcagauaccagaguacaggcuucugaguaacucuuugcacauuccgucaguuuuucugguuaggaguggacacccccucaggacagccucccuggauugggagaccgauccccuccccuuucccucuuccagugcgaggauauuucuuugucuaaaggcagaguccugggggaggaaggaucuggagaaccgucccgacuagggguaacggggaacuuuguggcacuuugaaaucaggguagggggcgggucccccuuuguggggaagggacagagccggaggcgggcaagaagggaagaaaugaacuuuccgcgcuagggacgagggugcccccacuacagucccucucaguggucccggcgccccgcuuaccuugccugcccacgaucucggccacgugcucggaggugggcacgggaacacacuccgugguguugcugcugcccuucaggcgcagcucggccucuuuguagagagcgcagagcuug

SEQ ID NO: 13670 - RNA, 5155 nt, Homo sapiens
ugugugucuguuuguggaaugacuucccaggcucuuaaaucaaucuguagagaaguggaccgaggucacacuucaagaaggacuuccucaguuaggccugggggaagcaggcaugggaggguuugagcugggagccccaggaggggacauaccacauuggaguaugggcugcccagguacuaggggugcaggugaaugugcuuggccuccucugcugcccccaacccagccccugucuuauugagaugaucagugugcauccuuuccaagacccugggaaaugaaccccucauuucuuuguccuacaauuuaaaaauccaaggauucucagaaucaaccccagcagacuggaagcucccaaucuuaaacuagcaaccugauccaacccugguaucugaagauugggcaacucaggguggacucagccacuucccuccucuauuuaucuuuuccuuacaacuuuuauacauucuacuggacccaggggcccucaaugcuacuaaacuuuaagcuaucuuaauauugucuacuaaguaacuaguaauuguuucuuucucucucuaggauuauaugaaauaaauuugaauuauuauuauuaauaauuauuauuuuguaguauucuuuucuuuuaaaccccucgguuucucuuuuucuucucuuucucucuuguuuuugguuaaaaaaaaaucuagaucucuuaaaucucacacaucucugaggguuccuauaggccugcuaggccuuaauucuggauucccccuccucacuugccccugcgacagggcaggggaaaguggugggggacaccccaggauccucaguccuuaguccuacagcuucuuccuuucuuguuaaucccuuucuuuguuuggcucugccggcuccccugagggggagggggagaggggaggaggaguccauggagugaaauccaaucuacuggaagggucccaggagggaccggguucccccagcuccucucuccaccauucacccccgggaugcucccccaagaaaagcaaaugacauuccuccccaaaaaaaaagugggggaaaaaagcaacguaaacccaaacauauauuaaaaacacuuuuuuuuuuuaagauuuaacucugaauacaaauguauuuuuuucuucuucucucccuacauauauucuaaaccuucuaaaguuuuuuuauuuuuuuaaggaucacuuuaucauaaaauaaaauauccuuuucauauaauaaauuaccuaauaaaaagucuuuuuuuuucauauuagcccagguucuuugcuacauuuauaugguaauaaacgccuuuauuaaaauagaauauuaaauuauaaagaacugcuuuuuuuuuuuuuuuuugcuauuuuuguuuucucuccucuguguuggucgccugucucgcucccucucaugcucucuuucucuccucuauuuugucucucacuauucguguuuuguguuuguuucuagguuuggcucaauugguaagggugggauugaauuugcugagcccccuaguguaacagucuucugccuuuguggguaaagaguggagagggggagggggacgacagacagacaucccuucuucccaccccccuccccaccugccccccggcaaccgagggugcccauuugguuugguuucuauuguacagacaucucaggauggcucacauaggcgggaaggagggaagucgucacagggcaguuuucuuggcugugaccuccuuccccaccccucccuggcugguguucuggaggggaaggcuguggagagguguuaauucucgacaggaggaaggagaggaggaaauccccucugcaccuccaccugcuccauccaggaagaaugggacucuggagcuuuaagugcucgggugaucacucagaacagucccaccccacuauuuacaaggaucuccugggacucccaucccuccauccucucuuggcccggccagcggaaccaggaggguggagagcugguggcagccccaaaugagcaggagggaagcagcaaagggggugcaaggccuguaacaauaugugauucucagaauaggcccugcugcccaccuccccccaguccugcuuugccccaggcugaccccucuuugaagaccuggcuucuccucaaccacaucaggugggacacagacuccaugauuugcauggaggauucaagcuaauaaggauucaagcuaauaaggauucaauaaagguucaggucagguugagaggggugcagggagucgggcacugcaugggaggagcagcucuucccuccaccagucucuccuccugccucacgcccuuuccugcuccuuuaaauagcagacacacuacucuggcgcccccacuuccacaaccagaaaauccagcccaagaacuacucccuaaauauaaugcccauagugaugaagguggggguuugacccuuuaccccaguauuaguccccuccucacauuuucacugagaauggggauacauuccaucaauaauuugagauguuucuuuggaggagugggggagagggccuccagaugccugaagaggaauggagggaccauccaaauauuccucccccuacuucuccccagaaggaugguguccccaaagcugggcugguaggggcaggggcagggggaagggaagaaagacaaagacaaggaacaagacagagcugggagugacagccaccaaaagaaagcaaagcaaagagcuggagggaaaggaaagaguugaggaaagggaagaucccaaaggaagggaagauaggcggagagagugaagggaaacacugcaggggacaggggcagagaggaggacuccucuccagauuccucuagcccagcuuuguggggacagauggcuucugagccuuucagccacagaaacgauugacaugcuucucuccccaaccccuagaagaucuaugcaacuucugauaggacuccaacucccuuacacugcuggaaacuggugacaguuucccaaacaggauauggggguggggugggagguaaagggucauguuaggaggucggaggucaggaccagagggcuuagggauugcaaagagcaccucuagauacaggugguaauucucccucucccuuuuacccacccccuccucggaagaagggguggagugacacacagcgggggaggugggcagagggcgucagaaugccuuaguggccaccucuggcaaaacaaaaguuucucuuagcugcuuccagauuuaaggguguguugagguaucagaguuguaacucuaguaaaauuuucagucuggcccccucccaaucuuuccaggacagggugaccagaggcucugaaaguggcgcacccuccagccaccacugccucccuccccccuuccccagcgagcgaguaucucuaagcaccuugccccucaaaucaccgcuuuccaaaaggcuuuaguggaaaacagguccagggugggcccaguggagugggccccggaggcauggggcacggggcuuaggagaauauucggauggcuugcguggcugugauguggcagacgggacacucuggguccguccucucgcagaugcguacugcacacuccaugcagaacagguuguguccgcagggcacaagggcggcagucacuucgcucucaaagcagaccaugcaaucccgcccgccgccggggcuccgcaggccgcccccaccaaguuuagagaagcccuggagcggcucucccggggggcgccucgggaguccggccagcucgggucccgcggaaguggcaggggagcggugugcgcccgggggcccagcgcgggccuuggcggaagaggaggaggaggaggaggcagaggagaagagcacggaggugggcguggcguucuccuggcccgcccacagcggggggcuagucucggccacgccguaguacacauccugcuugcccacgccauagcccggaaagagguacccgccguagccaaaguccccgcccugcucacccaggcguggggccucaaagccagaguccacuccgcacucgccgaugcagcccaggcuguucugccggaagguggagaggggcuugcagccgggcuggugcacccgccaggcgucggaguagcggcuaucgauugcugcgucggggcuccccgccaggaagucguuuucauuguuguacucgaggaucuugccagugcgcaccgcgaugugcgucucgaucuccucgcgcgcacgcuccacguugccuggggcacccgugaucucgaacacggggucgcggucacggcuuggugugauaauguauguguugguuugcugcuggaugcgcuugaugguugccccuuuggggcccaccaccagccccaccacgcgguagggcacccgcacacggauggucaccuggccgggcagagcaggagccacaccaaaggcggcgccugacuuguugcgggaggcacggaucauggagaagugcuccgcugcugagaugauuucccgccgggcuguggccacguccucccgucgcccugucaccaugaacacugguuccucgccccucaccggugucuugauguagguguuggucuuggcccucaaggccuuaaucuugcagccugggauagggcggggaaggagagagacaaagaaacgcacacagcaagguuugugcugggaccaauaaauuccugauccuuacccaaauaccuagccucccaggaacacuucagucuacccuuugaaaugcccacugcugcacacacaguccacccugacuugaagaaaccauuuaucagaucucagaugugccuaaugucucucucagccacagauuucaaaauguacuaacuuucccugaguuccauucagggcccuccaaauucauucacuccucaaaacccccaaauaaucacugacccucccauacaagcugguaacucaaauccauucacaaacuacacuccuuucucccaacauuugcucuuccuucaauuucucuacugauuccuggcuacucacaaacuuccaaaucacuuaaucaccccccacaucugucacugacccugaucuuuccacagaaccccaaugugcucaguaaccucauaaucuacucaucugacccuugaucauuaaaaguguccuccaaacuac

SEQ ID NO: 13671 - RNA, 955 nt, Homo sapiens
agagugagaagcggggagcauguuccaaugaaagcugacggcucuugacuaccacaaccccgccgguuucaacugcaaagaugaaacagaauuuagaaacuucacuguuuggcuugaagaccagaaaaucagauacuacaagacugaagacagagguaauuuaagaaacauccacagcagugacuggcccgaguucuuucaaaaguaucucagagauguuaacugucguuuaaagauucaagaucgacaagaagcuauugacuggcuucuugguuuagcuguuagauuugaauauggagauaaugcugaaaaauacaaggacuuaguaccugauaaugcaaaaacugcugacaaugcaacuaaaaaugcagaaccauugauaaauuuggacguaaauaauccugauuuuaagccugguguaauggcuuuggcuaaccugcuucagguucaaugucaugaugauugccugguaaugcuuaaggcaauucaaauuuugguucaggagcaccugacacaggaugcaguugcuaaagcaaaucaaacaaaagagggcuugccuguugcuuuagacaaacauauucuugguuuugacacaggagaugcaguucuuaaugaagcuacucaaauucugugacugcuguauacagaagagcucagacagcuacagacaaaaauuaaugaagccauagcagcuguucaggcaauuauugcugaugcaaggacagaccacaggcugggaaaaguuggaagaugaacacuuuaggacuucagcuuuucaccuauuuagucuauuuaguacaauugggaaccauguauacuuccggcauguuuggaaaucaauauaucacauucucgggggaggaaucccagaaaauugaguaaguucuagagguuuaccaccauuacuuuuuucuuuaauaaaguuuaggaaaguagaaaaaaaaaagaguagaag

SEQ ID NO: 13672 - RNA, 4729 nt, Homo sapiens
ggucaggaugggggcuuaucuuucucucccaauccuuccucuuucuuccuucccauucuggcucugcuggucauggcaccuucauccaccaucucucaggaaguuaucuuuuucuucauuuccagcauuaccuccaucuccucaugucuucuuuuucucuaugcagcugcagccagcuggaaggacauucagguacccggguaggcuccucccugcgacagaccuucagcuuccucucgggcaugaccggaaaggccaagguaggagucagcuggggaagcaggaggcuugggacccacugcccucuccaguucccuuucucccaucccaccaucgccaccucccaccacucccccuauuagaaacucagagcaaugguuccauuuuuuauuuuuuuauuuuuuuaagagaggggguuucugucucccaggcuggaguacaauggcacaaucauagcucacugcagccucuaacucuugggcccaggaaauccucuugccuuuaccucccaaagugcagggauuacaggugugagccacugugcccagccaaaugcuucaaauuuuaaggaaacacaugcuaucucuuccagccugugucucugugucccaguaaaucaccuuuucucugcuuuccccuacgcauccagcuuagcagucagcuguggacagauggaaggggaaaagggccaggaaccucagaagcugaggaauggccuagcccucccucucuuuaggccucacauagcugacaggugggcagcggaaaccucaaccauuggacauaauaaugauaauaauuacagcacuacuuuuuacuucuucauagaguaucaggguuugcaaagugcuuuuacacucauaauuuuauggguggguacagcagcugaaggaguugaaauuagaccacaggcagaguagaagcugggaaaguauaugauuauggaagcacaugcauacccguacaugugcggccaugugcuguucugaucccaggaagugaaggcacauuguucucauccuuauuaccaaccguugggcucuggugaaaccgggagcucugccugcuccuugaauuuguuuccacuuucuucauuuacugucagagugagccgccccccuuuuccuccccuggccuccccaaguaugcaugugcuuuccaacucggggcggcuucugaguauugaaagaaaccccagggaaaucaucaucauauucaccuugaagagccaugagauucucaccaguaagguugccugggcuccucccagccccacccgcagugccaggguucuccccucuuccagccuuuuuuuagccaagauucccuuuucucugggugggcugggaaggucaagaugaaagcaggucauguuguuagcaccucucaccacaggccaugggucgggaguugaggcuaauggaggcaugagacugggugagucucagaagaggagcagcuggagaaucugaaagcugaugggaggggagggcaggugggacagagagguuucucucccaugggggaauggagaucucgaaggaacaaagcaaaagcagaaaccuuggggucugagucucaccuuccuacaggcugucucacugcaggguaggggagucugcuaguggaaucacucccuuuucuugccaugggaaugguaggggaagucaguacugcccaggggccauccagaucccgguuggucuguuuguccacccuugaccuaacagucugauggaggguugagcaaccuggugaaggggaaugagggcagagacucuggagcccagaugggaaagagggaagcgccagagugagucaggacauugccucgcucagccuuuccuccccacgucugucauccugucuuccucuguuucccucuccaccaucuccugcuacaucuuccuuccaccuucaugaaugugugggccugcuucacuuaaucucuuucuccauaagcaguaaacaucaggggguggggcuggagagaagcucagucaagcagugagagaaggaaguagcuuagucccuccuacuugaguagcauugcacacuugaugaaacacuuucaacucauuuaauucuuauaacaauucuggcaaagauaaguauuucaaucucaauucuacagacaaauacuuaaagguuaguuacuuugcccaagaucucacagcucauaagagguggcgccguauuagaaacucagggcuuuggcuguguauugccacuguuucucucaauagccguaacacaacaguucauucccucucauccuucccuucuuccagcuucuggcuggauggccacuuaaggcaauuuggccuuaaucaccuccucccagaauauacaagguccagaccaauagaagaaagaagaaaaacaaaccaccuugggacaguguagagcuugggcuuggguauccucgggagacccaucucuucuccaacuggccgagacuuuggcaaccagguucuucccugggaccuccucccuaccccugaaaugggagggacacauuucgucaaguuaaaugggcuaaagaaggugauggcuauuuuuagauccugguagaaauguuuguuucuguguaucuaaaaaauuauuucugaaaaucuggaagauaucacuggauaggaguagagggggcgcuggaaugaagaagggucuuggaaaaggggggcaggugacaccaaggagaagggaaaaguguucauuguucaagaggauauagaaaacggaaacugagucaagcugcaggccaagcucacuaaacacagguguuuuuaaaggcagaacacuuuucuuuucccugucccuagucccuuuccuuguuauucaucuccuaaggggaagaagagggcauagggugagggguaggguaacagcaggugggauggaaaguagacugaagguuggggugggagacagaaaagaguuggagggucggguccucuucuuucauagagaccuucuuaguugaguugagggaccaugaggucgcuugaaaaaccccaggguucaaauucuauguuuccuggguacccaggcuggaguguggcccuuuaagauucuauccauagcuugcagcacccuccugccccaggccugggagagaagcugaggucccaccccagaucuugucucugggccuccaguggguggaaccuugaggccaagauucuagccucuggcugucuguuuuuaaauuuaguacauuccugagucuuggcugcccaccucaggggaggugagucuggaguucuggggccaggagccucaggccucuugguuugggggaguuccuacacccuccccguagguauacuuggcaggugcaagccaggaagaacaagcuguggcccuggggaaguccuuccugcuuucuaauguccauccagccugaacugggcacgguuuauuuccucuuccuuuuuccuggucuuugcuauuuaaggauucuaaacaggggaaugggugaagaaggaggugaaggaguugcuaggaaggaggggaagccggaggggcaguguggggguagugcugggggugaggagcccaaccagcucagccaguggugagguaguggagcccaaaaauaguggcagaggcuaaaauuggcaccuacaagagugcugaguugggcuugaaaccugcagccuggccccacugcugagccagggcagagaacugcuggaucuggguugggucuccccucccucccuucuucucccacgcccuuuggggccagaaucaggcaggacccugcuaaccgaaggcucugucccaggccucucugugcuucugguuucuccagagaaaugggagacccugagaggcagaaaugaacuucacuguaagugaucauaguuagacuggaggaggaauuuucccaauagcaggaaacucacccaaaggcuggcucaggcuggggaaaaggguccagagagaugaaugccccaccuuacccugcuucuuggggagaggcugguugggcccuaacuuucuuugacuagggcaggcugguuucuggucuuucaguuccggcuuaacuugcaacagagagaacugcaguuagacacauggaaggccuucgguaaaaguggagaaucccaaccuagucccccaaaguagcuggcagaggcggagcuaggaggagggcagaguggggucaggaaggccccagaaggguggggcaugugggagaauucucuccucucuguucuucgaccucugggagugaauccuacccuucccguguacugaagauccagcguuuaguucuccuuugauuuccucucccucuggccaccccugcccccaaucguaaaaggggucagucugcucaggccugcuuugaugggaccccgaaggccaggaaggaacugguccuggguuuucuaagagcugggggcggauggaauucuccugccugcgggucuuuaaagacugagguaacgcaguaggggagggaaaaagggagggcgaggggagaagggaagaaggggagggcagaggggaaagggccaaccuggguccggcgagggcugcggggcuggguuuuaggaaaagaagagcuaagaggcgggucucuggggcuagagggcgcccccaggcgcuggaggggaaauaggcagaggggccucucaaaccuguccuaggacccucguaccucuccgagcugcccccacacaaacccuggcgucccguccugcgcgcgggcaccccg

SEQ ID NO: 13673 - RNA, 10146 nt, Homo sapiens
acgucuuggguuuauuaaacagugucacugaguaggcuuuccauggguacaaaguucucucugaaggggauuggaagagaugggagagcugaagucacagagagacagaaacaaagacauuauaucucaugauggagcucuccagugauuuugccucagauuaugucugacuuaaauauuucuugaaacaucuggggcaauugggauaugucagucuuuaggucauuuagggauuguuucagggauucauaauaggccuuaaucuaguuugggcuauugauuuccccaggcgaugugaggaguugauacauaaaagaggaugggguccgggcgugguggcucaugccuguaaucccagcauuuugggaggucgagguggguggaucacuugaggacaggaguucaagaccagccagaguaacauugcgaauuccuaucucuacuaaaaauacaaaaauuagccauaggcuaggugcuguggcuuacaccucuaaugccagcacuuugcaaggccaaggcgggcggauuacuucaggucaggaguucgaaaccagccuggucaacauggcgaaaucccaucucacugaaaauacaaaaaaaauuaggcuuaguggcaugcgccuguaaucccagcuacuugggaggcugagacaugggaaucgcuugaucccggggaguggaaguugcgcuaagcugagaucacgccacugcacuccagccugggagaaagagcgagacuccaucucaaaaaaaaaaaaaaaaaaaaauuagcuaggcgugguggugcgcagucccagcuacuugggaggcugaggugggaaaaucacuugagcccaggaggcagagguugcagugagccaugaaugugacacugcacucuagccugggugacagagccagaccuuaucucaaaaaaaaaaaaaaaaaaaaagcauggggagagggugggcuguguuguguucauauggcucacaacuuuagcuuccucucuugguaccaaaaauacggccaggcacaguggcucaugccuguaauccuagcacuuugggacgcugagggagggcagaucaagaggucaggaguucgagaccagccugaccaacauggugaaacccugucucuacuaaaaauacaaaaauuagcugggugugguggcgcauaccuguaaucccaguuacucaggagccugaggcaggagaaucccuugaaccugggaggcagagguugcggugagcugacaucgugccacugcaacccagccugggccacagagcgagacucugucucaaaaaaaaaaaaaaaaaaaaaaacaacuuggcagcuaaucaagcccaaguaucuccuaggagacugaauggccagauggggccaaggacugugccugcuccugccaugaaggagguccagauuccaagcugaagaagagcaaaaggcggagcuguagccacuguagcagcaaggugaggaaaguaucaagggucccgaggguaucagagcugcugggggauuguuugcuaccaagaauuguaccuuacugaauuccuaaaaaggcacauauauaaauaacauucaguauacacauauguguacauaugcaaaauaaauggaaucugcuagaaauacgugauagauuuuguuuuuuaaagagaauucugugaguaaagcuuuuggaauuggaaaaacaaaauaccaguuaaaauauuucccucagauauuagaaaaugaaauaaaccucugucgugaaaauagucucuacaaguaauccugguucucuagaauggaguugguuggcaggaaaaacacaguucuuggugagagaaggaguuguggaauccaauacucuauucggggccauuuaaaauccuuggagcagggaggcagagguugcagugagccaugaugauaccacugagcuccagccugggugacagagugagaccguguuuaaaaaaaaaaaaaaucaaauccuuggaggaauagcugggcaacagggcacucaggaggcucaggugggaggaucacuugagcccaggagucugaggcuauaguguaccaccauggucaugccuguguaaacagccacugcacuccagccugggcaagauaaucugugucaucugagacccugucucugucuaucuuuucuuuuuguuugucauuugagacagagucucacuauguuacccaggcugaucuugaacccuuaggcucaagugaugcucacaccuuagccucccaaguaacuagguuuauaggcauguaccacugcacccaguugaaacucugucaacaaaauuguuggagcagacaugcauguggguugacuugaugagcaucaggcagggcuucuuccuuuggugggccccaaccaaagacauaggcagucagaacaccuuugacccggaagaccaucccugcaggucugugacagcaaauccuacaagagcaaggagccccaugaguuggugggcagcagcccccaccgagaggcuaguccuaugccuggugcuaaggaagcugggcagggcaaggauaugauggaagaggaagccccagaggagcgggagagcacugaggccacccagagcaggacugucaggaccaccagaaagggagagaugccuguuucaggugagugauuugccaacgcagcccuucuguuccucagucucguuauccuguacuccagacaggaaccuccaugagccuggauaaauagccuuuucagggauggauauaccaccucuuucacugauggacccauaggaagcccuucugcuguucaggcuuuuucuaucauauggccucacuccucuugcagaauuaagaaugccacaaauuucaugcaauucaacauugucuuguguuuuauuccaaaaacccuucccccugucuccaaaucuaguguaaucuacauccuaaagacugggccguucucagcuuuggcaguaggacuuuauaucuuugcauaagugacauuaugccccccaccuccacccaacucuuuuauuauuuauauuuucuuguagagauggagucucaccauauugcccaggcuagucucaaaccccuggcagucccaccacuuuggcuucccaaagugcggacauuauaggugugagccaccaugcccagcccucuuuuuuauuagaauuuuugcacaguaccuggccacagguaauuucucgugcuuaggugcaucuugaaccugacaguacccugagauccuuauuuuccuccuaagcaggauuggcaguggggagcacuuugccauccccucgagaagugacuguuacagaacggcuccuccuggauggcccaccaccucauucaccagagacuccucaauuuccccccacaacuggagcuguacuguacacuguuaagagaaaccagguugggccugagguucgcuccugccccaaggcaucccccagacuucagaaagagagggagggccaaaaggcagugagugagucagaggcuuugaugcuggucugggaugcaucagaaacugagaaauugccugguaccguggaacccccugcuuccuuccugaguccuguuuccucaaagaccagagaugcagggagaagacauguguccgggaaaccagacacucaagagagauggcugcccucaagcagagcucgggugaagacaagagacaggacgugcccuguccaugaaucuccaucaggaauugacaccucagagacuucucccaaagccccuagaggggguuuggcuaaagacaguggaacacaggccaaggguccagagggggagcagcagccaaaggccgcagaagcuacggugugugccaacaacagcaaggucagcuccacuggggaaaagguuguccuguggacaagguagguaaggguggaugacguguguuuggaaaagagcauagaccacauccauguggcucccuaggguuaaucaugauaccuggguuacagggaagcugaccgugugauccucaccaugugccaggagcaaggggcacagccacagaccuucaacaucaucucccagcagcugggaaauaagaccccugcugagguaggugcggguuggggugaagaccuggcaaaaagaggucaagguggccaacuaacagacagaaaggccaaagaaggaguuuugauauccaagauaauaagugguuuuuguaaagguuugaucuaaggaaaggcuugacucaucagggugguagugguucuagaagagaaaggacacuagauuuugaggauuuuuaaauuuuuauuuauuuauguauuuuagacgcaguuucacuugucgccuaggcuggagugcaguggcacaaucucagcucacuacaaccuccaccucccagguucaagugauuguccugccucagccucucccaaaguagcugggauuacaggcacccaccaccaugccaggcuaauuuauuuauuuuuaguagacacgggguuucaccauguuggcaaggcuagucuugaacuccugaccucagguuauccaccugccucagccucccaaagugcugggaauaggugagauacugcgcccggccaggauuuuaaaguggaagccccaguuuccauuccaguuuuguuuuuaggaguugugugacuuugggcaaaacauuuagccucuugaguuuccuuaucuauaaugacauagcucucccaaccuugcugugaggaauaaacaagagauuuuucaaaucaguauauugugcuucauaaauguuaacauuguuacaaagcaucagugaggcugggcgcagugguucauuccuguaaucccaacacuuugggaggccgagguggguggaucaccugaggucaggaauuugagaccagccuggccaacauggugaaaccccaucucuacuaaaaauauaaaaacuagucaggugugguggugggcaccuguaaucccagcuacucugaaggcugaggcaggagaauugcuugaacccaggagacggagguugcaguaagcugacacagugccacugcacuccagucucagcaacagagagagacuccgucucaaaaacaaaaaaaaaagaccagugaauacagcccuccuccuuucuuagguuucccaccguuuucgagaacucaugcagcucuuccacacugccugugaagccagcucugaggaugaggaugaugcaaccaguaccagcaaugcagaccagcugucugaccauggggaccuucugucugaagaggagcuggaugaaugagacucugggaaucaucuacacaggaccaaacccaacaggcgcccuggcaccggggaggggguaguuguacucugcuuguacaguccuugagcccaguuuacagaucuggagagcaggaggccaggacaaggacaaaggcuggaggauggaguaggacccaggggcucugccauccuaggcaucauucaaggucuuuuaugaagacuuuacagauguccucuguaaauagcaucgagaguggaguucagcuccuuucucuacuuuuuuuuggucugauggcacauauuuauuguucuguggucuaaucacaguguuucuaaauguaaaaagugcauauguugguguagcuagucccgcgacauugagcuccucugcaugaagacacugggcuccugcauccagcuguuuuuauugcaaacuagcuccuuucucccacacugggaacuuuaguccacgaggcugucaccacccugguagcacugggccaggcuuuguagcuccugcagcagcucugcuacgucaucgugcuccacuccagcauccaugaagcuggcccagcgccgcaagucgaguuuggugaggucucuggccaaggcuuccagggucuggugcagggacgaagaggaacacagugccccaaacacugggaugcucuccacugcuguggagggagaggaaacagagaccuguagauggaugauuauucugcccugggacucgccaaacugauaaggaaguccaaccuuaguagacuugauuguaaacucaacaaauuugguguauuguccccuuaguacaccaguacuccagaggaagaaugcuuuucuugggagccauagggugaauaaaggaauguuuaacuguggacuuuuucagcacuuuuaauccaggaauggagauaguaaaaccucucccauacuugaaaucucaguuuucuucaccuccuacauaccugcucccuugggggaaccauccagaaccauacccgguggacugcagcuugagaagagguggggguaaggaggagccacccugcagggagucagcagcagaugggaagaacugugggggcagagaacagccauuaagugcguaagaagucaagggaggguugcgguuggcaagaagggcaggagcaaccguuacacugaccucaugacuccaggcugcugcuguuguaaauacugagccaagauuucuuccccagugguacaugcaugaagggcagaggguggaggugucccuggggugagcuggcugccauaacaaagccaaaaccaccauuagucuguggcagcaugaauaacaaacuaagaauucuuuuucuuuuugagacagaguuuugcucuuguugcccagacuggagugcaauggugugaucucggcucacugcaaccuccaccucccagguucaaacaauucuucugccucauccucccaaguagcugggauugcaggcaugugccaccaugccuggcuaauuuuauguuuuuaguagagaugggguucaccauguuggucaggcuggucucgaauuccuggccucaggugaucugcccaccucagccucccaaagugcugggauuacaggcgucagccaccaugccuagcccaagaaacuuaagaauuuuuauguuaucaggccaucagcuggaucaagauauucaaagcccuucuuuuuauccuuuuuaagggguggggagggaacaacaucauuagaaugcccgagaaauuagggggaaaaggacaugaaacaaaaaucugacaaggacuccuaaggaccaacagcucucaccuuguguggcaugcucugucuauacccucagcaccacugacugggcaaagcaacguguuccagaaggcuccccacaugcagacagugggguccaugggguggcuccuccaaacugcaucagggaaucaggaagggacuggccuggagccaaggggaaagggaugauugcuccugcugucaccacuuaaagagaaggaagagaacacguuauaggacauuuucucagcacugacccaaccccucacaaagcuucauaccuuuuucccacagaagcucagcaugucagccagaugaaccauggaaacuggagaggaacacaggcgauaaggaacagugacuguguccagggcuguagccaggauggcacugcaguggaagggcagaauggccuguaagaagacaccaagaggggcacuuggccucgggccuggaaaagaauguguggaggcagaauguuaacaccagagagacccaggggaugaaucagggguauguuugaccccaggcuggacaagcauaggacagugugaucugagaggccacaucacagcugaguucaagcucgggccucaggaacagagccaguacagacagcgacugacugggagcaugaggaggcccuguagccugccgcagucagaacaagagcaccgagacuuacaucauaaugcagguaagggaaguugacagguggcucaggucgcaggcccaggcucccacccaaggacaaggggcagacgagagcugugagcagucaggugcacgagaccaaaagcuguguuuaauagacgauagauguuucucugggccuccucguaaagaaaaaaaccaguuugcauuaagccacucucccaaugggauucgaauguuuacuccuccaaguuccacucaccccacgaugguagggaccagguagcaggccccaaguuauuauuccccgcccugaauauucaucuuguagcagcucugccgccuucgcgccuaccccagagaagccaucgugcaggucacacaggaucuggaagcccugggcgggggugagugacgaaagauaguuagcaggaugagaagagcuuccacccuggagugcacauugccacgccacuaccugcaaguagucacauuccuccacguagaaaugcagccuguccuccagcucuuccugguacuuggguuccuuuaggacacuuuccccuuggccaaaagccuccagccgaccugcuucccugccacaaguaaacacgauccaagacuuacaucucuucccucaacuccucagccucuuguccuggggaagggcagggaagauggccucaagagccucauccugcauugguggggacccauguuucuugccucaaagccucugggguccccauacccaucgugguuguacuucugaaucauacagaugcuccggggauggagauggacucugaggaagucugaccagacccugaugcuggccucuguagggauaagugguuuuggaguuguagcgguggggaguggugaggaaccugaagacaagcagaggaaauguaccuuucuccauguuucugcucuacccaagcccccauccaucaguaucuggagaagucucaccuuugccauugggaauggauuugacccuccagacaccaucacuacucagcacucccugggaggggucagaaaaaucgacauuuaguuccaggcaguuuagaggcaaagguugcuucauccuccuugaguuggcuggccacaccgcauagccuccuuucuguucaccgagucgcaguccuuaggaaaaggagugcuuuuucccaaaauaucauucuaagacauuuaaaaugauuaaaauccccguuuaccugccccuauggagacccucagguuguggcaccggguuaaaaaguucaggacagaggcccucaccucugcacucagaaagucuuggagauaaggguucuugggauagaguuccucuuuguguguggugagcuuccccugccugaaagaguuuggagauugaucaaagaaacugcacucugaucagaguuauccagcguucugcguacauacacgauccccacccuuauccauacaucaguuacacaccaugcuauugcagcauccaacuguuugucccuguagaguccaccuuccucuuuuagggagcucaaacuaccuguacagaaauaacagagacaauguuaggucaaagccugggcacccuuccccucuagcuaaccuuccucugaucaccugacaaccugcugucaccaucucuccagcacuuggcucuuccaagcuuucugggauauacacuaguugggggaaaaaccuuggcuuaggagaaucuagauuccaucuuucgguucccagcuuagucauuagcugugggacgcggggggaaccacauccaggggucugacaggagugcugcaguucaaguccucacugucuccagggccuagcagccuauucccgaaauggcucuugagcaacugucgugggccccucgaguguuggcauguugugcucagcuccucaucuccgguccuggagcucgguaaagugggagggucuugaagauaacggcagcgcaaggacuaggcacgcggaagggaaauaaggggcaucggcuaacucugccaccaccucacccuucagauccaugaggaugagucgcggcguguaggucuccuggccgugcagcguccggcccguacgauacaggacgucggggcacagcucucccgggggcuccuuggaaucggucgcucggcccagcgcagcauccuggggaagcagagaggacgaggcaggccggcugaacgucgggacuguagaucccgaagggcuccucgggggcagcugccggcugaccucaccugcugguuccaccagugcgcgcccacgaaaccggcaaaaugucccaacugcagugugagcaccucccgggccccgcccgccauacugcgcugcuccacggggccgccgcgccucagccgcgccgcucgcugcuccuagccgauuggcuuggcaggcgcgugggcggguguuauacuggcgacuuauugguccgcaaacacauccuuucccauuggagaaauga

SEQ ID NO: 13674 - RNA, 10146 nt, Homo sapiens
ucauuucuccaaugggaaaggauguguuugcggaccaauaagucgccaguauaacacccgcccacgcgccugccaagccaaucggcuaggagcagcgagcggcgcggcugaggcgcggcggccccguggagcagcgcaguauggcgggcggggcccgggaggugcucacacugcaguugggacauuuugccgguuucgugggcgcgcacugguggaaccagcaggugaggucagccggcagcugcccccgaggagcccuucgggaucuacagucccgacguucagccggccugccucguccucucugcuuccccaggaugcugcgcugggccgagcgaccgauuccaaggagcccccgggagagcugugccccgacguccuguaucguacgggccggacgcugcacggccaggagaccuacacgccgcgacucauccucauggaucugaagggugaggugguggcagaguuagccgaugccccuuauuucccuuccgcgugccuaguccuugcgcugccguuaucuucaagacccucccacuuuaccgagcuccaggaccggagaugaggagcugagcacaacaugccaacacucgaggggcccacgacaguugcucaagagccauuucgggaauaggcugcuaggcccuggagacagugaggacuugaacugcagcacuccugucagaccccuggaugugguuccccccgcgucccacagcuaaugacuaagcugggaaccgaaagauggaaucuagauucuccuaagccaagguuuuucccccaacuaguguauaucccagaaagcuuggaagagccaagugcuggagagauggugacagcagguugucaggugaucagaggaagguuagcuagaggggaagggugcccaggcuuugaccuaacauugucucuguuauuucuguacagguaguuugagcucccuaaaagaggaagguggacucuacagggacaaacaguuggaugcugcaauagcaugguguguaacugauguauggauaaggguggggaucguguauguacgcagaacgcuggauaacucugaucagagugcaguuucuuugaucaaucuccaaacucuuucaggcaggggaagcucaccacacacaaagaggaacucuaucccaagaacccuuaucuccaagacuuucugagugcagaggugagggccucuguccugaacuuuuuaacccggugccacaaccugagggucuccauaggggcagguaaacggggauuuuaaucauuuuaaaugucuuagaaugauauuuugggaaaaagcacuccuuuuccuaaggacugcgacucggugaacagaaaggaggcuaugcgguguggccagccaacucaaggaggaugaagcaaccuuugccucuaaacugccuggaacuaaaugucgauuuuucugaccccucccagggagugcugaguagugauggugucuggagggucaaauccauucccaauggcaaaggugagacuucuccagauacugauggaugggggcuuggguagagcagaaacauggagaaagguacauuuccucugcuugucuucagguuccucaccacuccccaccgcuacaacuccaaaaccacuuaucccuacagaggccagcaucagggucuggucagacuuccucagaguccaucuccauccccggagcaucuguaugauucagaaguacaaccacgauggguauggggaccccagaggcuuugaggcaagaaacauggguccccaccaaugcaggaugaggcucuugaggccaucuucccugcccuuccccaggacaagaggcugaggaguugagggaagagauguaagucuuggaucguguuuacuuguggcagggaagcaggucggcuggaggcuuuuggccaaggggaaaguguccuaaaggaacccaaguaccaggaagagcuggaggacaggcugcauuucuacguggaggaaugugacuacuugcagguaguggcguggcaaugugcacuccaggguggaagcucuucucauccugcuaacuaucuuucgucacucacccccgcccagggcuuccagauccugugugaccugcacgauggcuucucugggguaggcgcgaaggcggcagagcugcuacaagaugaauauucagggcggggaauaauaacuuggggccugcuaccuggucccuaccaucguggggugaguggaacuuggaggaguaaacauucgaaucccauugggagaguggcuuaaugcaaacugguuuuuuucuuuacgaggaggcccagagaaacaucuaucgucuauuaaacacagcuuuuggucucgugcaccugacugcucacagcucucgucugccccuuguccuugggugggagccugggccugcgaccugagccaccugucaacuucccuuaccugcauuaugauguaagucucggugcucuuguucugacugcggcaggcuacagggccuccucaugcucccagucagucgcugucuguacuggcucuguuccugaggcccgagcuugaacucagcugugauguggccucucagaucacacuguccuaugcuuguccagccuggggucaaacauaccccugauucauccccugggucucucugguguuaacauucugccuccacacauucuuuuccaggcccgaggccaagugccccucuuggugucuucuuacaggccauucugcccuuccacugcagugccauccuggcuacagcccuggacacagucacuguuccuuaucgccuguguuccucuccaguuuccaugguucaucuggcugacaugcugagcuucugugggaaaaagguaugaagcuuugugagggguugggucagugcugagaaaauguccuauaacguguucucuuccuucucuuuaaguggugacagcaggagcaaucaucccuuuccccuuggcuccaggccagucccuuccugauucccugaugcaguuuggaggagccaccccauggaccccacugucugcauguggggagccuucuggaacacguugcuuugcccagucaguggugcugaggguauagacagagcaugccacacaaggugagagcuguugguccuuaggaguccuugucagauuuuuguuucauguccuuuucccccuaauuucucgggcauucuaaugauguuguucccuccccaccccuuaaaaaggauaaaaagaagggcuuugaauaucuugauccagcugauggccugauaacauaaaaauucuuaaguuucuugggcuaggcaugguggcugacgccuguaaucccagcacuuugggaggcugaggugggcagaucaccugaggccaggaauucgagaccagccugaccaacauggugaaccccaucucuacuaaaaacauaaaauuagccaggcaugguggcacaugccugcaaucccagcuacuugggaggaugaggcagaagaauuguuugaaccugggagguggagguugcagugagccgagaucacaccauugcacuccagucugggcaacaagagcaaaacucugucucaaaaagaaaaagaauucuuaguuuguuauucaugcugccacagacuaauggugguuuuggcuuuguuauggcagccagcucaccccagggacaccuccacccucugcccuucaugcauguaccacuggggaagaaaucuuggcucaguauuuacaacagcagcagccuggagucaugaggucaguguaacgguugcuccugcccuucuugccaaccgcaacccucccuugacuucuuacgcacuuaauggcuguucucugcccccacaguucuucccaucugcugcugacucccugcaggguggcuccuccuuacccccaccucuucucaagcugcaguccaccggguaugguucuggaugguucccccaagggagcagguauguaggaggugaagaaaacugagauuucaaguaugggagagguuuuacuaucuccauuccuggauuaaaagugcugaaaaaguccacaguuaaacauuccuuuauucacccuauggcucccaagaaaagcauucuuccucuggaguacugguguacuaaggggacaauacaccaaauuuguugaguuuacaaucaagucuacuaagguuggacuuccuuaucaguuuggcgagucccagggcagaauaaucauccaucuacaggucucuguuuccucucccuccacagcaguggagagcaucccaguguuuggggcacuguguuccucuucgucccugcaccagacccuggaagccuuggccagagaccucaccaaacucgacuugcggcgcugggccagcuucauggaugcuggaguggagcacgaugacguagcagagcugcugcaggagcuacaaagccuggcccagugcuaccaggguggugacagccucguggacuaaaguucccagugugggagaaaggagcuaguuugcaauaaaaacagcuggaugcaggagcccagugucuucaugcagaggagcucaaugucgcgggacuagcuacaccaacauaugcacuuuuuacauuuagaaacacugugauuagaccacagaacaauaaauaugugccaucagaccaaaaaaaaguagagaaaggagcugaacuccacucucgaugcuauuuacagaggacaucuguaaagucuucauaaaagaccuugaaugaugccuaggauggcagagccccuggguccuacuccauccuccagccuuuguccuuguccuggccuccugcucuccagaucuguaaacugggcucaaggacuguacaagcagaguacaacuacccccuccccggugccagggcgccuguuggguuugguccuguguagaugauucccagagucucauucauccagcuccucuucagacagaagguccccauggucagacagcuggucugcauugcugguacugguugcaucauccucauccucagagcuggcuucacaggcaguguggaagagcugcaugaguucucgaaaacggugggaaaccuaagaaaggaggagggcuguauucacuggucuuuuuuuuuuguuuuugagacggagucucucucuguugcugagacuggagugcaguggcacugugucagcuuacugcaaccuccgucuccuggguucaagcaauucuccugccucagccuucagaguagcugggauuacaggugcccaccaccacaccugacuaguuuuuauauuuuuaguagagaugggguuucaccauguuggccaggcuggucucaaauuccugaccucaggugauccacccaccucggccucccaaaguguugggauuacaggaaugaaccacugcgcccagccucacugaugcuuuguaacaauguuaacauuuaugaagcacaauauacugauuugaaaaaucucuuguuuauuccucacagcaagguugggagagcuaugucauuauagauaaggaaacucaagaggcuaaauguuuugcccaaagucacacaacuccuaaaaacaaaacuggaauggaaacuggggcuuccacuuuaaaauccuggccgggcgcaguaucucaccuauucccagcacuuugggaggcugaggcagguggauaaccugaggucaggaguucaagacuagccuugccaacauggugaaaccccgugucuacuaaaaauaaauaaauuagccuggcaugguggugggugccuguaaucccagcuacuuugggagaggcugaggcaggacaaucacuugaaccugggagguggagguuguagugagcugagauugugccacugcacuccagccuaggcgacaagugaaacugcgucuaaaauacauaaauaaauaaaaauuuaaaaauccucaaaaucuaguguccuuucucuucuagaaccacuaccacccugaugagucaagccuuuccuuagaucaaaccuuuacaaaaaccacuuauuaucuuggauaucaaaacuccuucuuuggccuuucugucuguuaguuggccaccuugaccucuuuuugccaggucuucaccccaacccgcaccuaccucagcaggggucuuauuucccagcugcugggagaugauguugaaggucuguggcugugccccuugcuccuggcacauggugaggaucacacggucagcuucccuguaacccagguaucaugauuaacccuagggagccacauggauguggucuaugcucuuuuccaaacacacgucauccacccuuaccuaccuuguccacaggacaaccuuuuccccaguggagcugaccuugcuguuguuggcacacaccguagcuucugcggccuuuggcugcugcucccccucuggacccuuggccuguguuccacugucuuuagccaaacccccucuaggggcuuugggagaagucucugaggugucaauuccugauggagauucauggacagggcacguccugucucuugucuucacccgagcucugcuugagggcagccaucucucuugagugucugguuucccggacacaugucuucucccugcaucucuggucuuugaggaaacaggacucaggaaggaagcaggggguuccacgguaccaggcaauuucucaguuucugaugcaucccagaccagcaucaaagccucugacucacucacugccuuuuggcccucccucucuuucugaagucugggggaugccuuggggcaggagcgaaccucaggcccaaccugguuucucuuaacaguguacaguacagcuccaguuguggggggaaauugaggagucucuggugaaugagguggugggccauccaggaggagccguucuguaacagucacuucucgaggggauggcaaagugcuccccacugccaauccugcuuaggaggaaaauaaggaucucaggguacugucagguucaagaugcaccuaagcacgagaaauuaccuguggccagguacugugcaaaaauucuaauaaaaaagagggcugggcaugguggcucacaccuauaauguccgcacuuugggaagccaaaguggugggacugccagggguuugagacuagccugggcaauauggugagacuccaucucuacaagaaaauauaaauaauaaaagaguuggguggagguggggggcauaaugucacuuaugcaaagauauaaaguccuacugccaaagcugagaacggcccagucuuuaggauguagauuacacuagauuuggagacagggggaaggguuuuuggaauaaaacacaagacaauguugaauugcaugaaauuuguggcauucuuaauucugcaagaggagugaggccauaugauagaaaaagccugaacagcagaagggcuuccuauggguccaucagugaaagaggugguauauccaucccugaaaaggcuauuuauccaggcucauggagguuccugucuggaguacaggauaacgagacugaggaacagaagggcugcguuggcaaaucacucaccugaaacaggcaucucucccuuucuggugguccugacaguccugcucuggguggccucagugcucucccgcuccucuggggcuuccucuuccaucauauccuugcccugcccagcuuccuuagcaccaggcauaggacuagccucucggugggggcugcugcccaccaacucauggggcuccuugcucuuguaggauuugcugucacagaccugcagggauggucuuccgggucaaagguguucugacugccuaugucuuugguuggggcccaccaaaggaagaagcccugccugaugcucaucaagucaacccacaugcaugucugcuccaacaauuuuguugacagaguuucaacugggugcagugguacaugccuauaaaccuaguuacuugggaggcuaaggugugagcaucacuugagccuaaggguucaagaucagccuggguaacauagugagacucugucucaaaugacaaacaaaaagaaaagauagacagagacagggucucagaugacacagauuaucuugcccaggcuggagugcaguggcuguuuacacaggcaugaccauggugguacacuauagccucagacuccugggcucaagugauccucccaccugagccuccugagugcccuguugcccagcuauuccuccaaggauuugauuuuuuuuuuuuuuaaacacggucucacucugucacccaggcuggagcucagugguaucaucauggcucacugcaaccucugccucccugcuccaaggauuuuaaauggccccgaauagaguauuggauuccacaacuccuucucucaccaagaacuguguuuuuccugccaaccaacuccauucuagagaaccaggauuacuuguagagacuauuuucacgacagagguuuauuucauuuucuaauaucugagggaaauauuuuaacugguauuuuguuuuuccaauuccaaaagcuuuacucacagaauucucuuuaaaaaacaaaaucuaucacguauuucuagcagauuccauuuauuuugcauauguacacauauguguauacugaauguuauuuauauaugugccuuuuuaggaauucaguaagguacaauucuugguagcaaacaaucccccagcagcucugauacccucgggacccuugauacuuuccucaccuugcugcuacaguggcuacagcuccgccuuuugcucuucuucagcuuggaaucuggaccuccuucauggcaggagcaggcacaguccuuggccccaucuggccauucagucuccuaggagauacuugggcuugauuagcugccaaguuguuuuuuuuuuuuuuuuuuuuuuugagacagagucucgcucuguggcccaggcuggguugcaguggcacgaugucagcucaccgcaaccucugccucccagguucaagggauucuccugccucaggcuccugaguaacugggauuacagguaugcgccaccacacccagcuaauuuuuguauuuuuaguagagacaggguuucaccauguuggucaggcuggucucgaacuccugaccucuugaucugcccucccucagcgucccaaagugcuaggauuacaggcaugagccacugugccuggccguauuuuugguaccaagagaggaagcuaaaguugugagccauaugaacacaacacagcccacccucuccccaugcuuuuuuuuuuuuuuuuuuuuugagauaaggucuggcucugucacccaggcuagagugcagugucacauucauggcucacugcaaccucugccuccugggcucaagugauuuucccaccucagccucccaaguagcugggacugcgcaccaccacgccuagcuaauuuuuuuuuuuuuuuuuuuuugagauggagucucgcucuuucucccaggcuggagugcaguggcgugaucucagcuuagcgcaacuuccacuccccgggaucaagcgauucccaugucucagccucccaaguagcugggauuacaggcgcaugccacuaagccuaauuuuuuuuguauuuucagugagaugggauuucgccauguugaccaggcugguuucgaacuccugaccugaaguaauccgcccgccuuggccuugcaaagugcuggcauuagagguguaagccacagcaccuagccuauggcuaauuuuuguauuuuuaguagagauaggaauucgcaauguuacucuggcuggucuugaacuccuguccucaagugauccacccaccucgaccucccaaaaugcugggauuacaggcaugagccaccacgcccggaccccauccucuuuuauguaucaacuccucacaucgccuggggaaaucaauagcccaaacuagauuaaggccuauuaugaaucccugaaacaaucccuaaaugaccuaaagacugacauaucccaauugccccagauguuucaagaaauauuuaagucagacauaaucugaggcaaaaucacuggagagcuccaucaugagauauaaugucuuuguuucugucucucugugacuucagcucucccaucucuuccaauccccuucagagagaacuuuguacccauggaaagccuacucagugacacuguuuaauaaacccaagacgu

SEQ ID NO: 13675 - RNA, 11862 nt, Homo sapiens
cgcgggcacauugggaguuguagucuaauuauauauuuccgcccuuaguguggggagagcgggaacuacucgacccacagagccgaucgcggagcggauucugcuuuuaggaguacccgccaacaagcgggaccgagcaggaauccguaucugggaacaggugagagaggaugugugcugggccuuggaggaagggggccgagaccgggccuuacuucuguaacgauacugugaggcaucggaaggccagccuguuguguccguuuugaaggucggugggcuagacuggcuggccuucuagggguguggagacuucccaacucugcccuugugcuuuccuggaauccccaauaugcccggaccccgguuuacuccuuugcugcgagcccuucucucccguccagaguugcuccgagccuaucugcucaguccuagcgauuccuguggggcuugggacgcgcgguucaagcaccccggaccauauggaugcagcacccauggguucucgcuccaaugcuucuuuccuccuuggggcguaacucagacccugggcaccccucuccacugcccaggggagaccuggguucuagauuuggcucugccucuacuaucuuccuaccuccuagagccucaguuuggcuuguguaaaauaggaugacuuaaggguccuuucagccccuaauccugggguacuuuacucuguaccgccuccuuacccagccuugugcacgccaucuugaaggcacugaguucuagccuguuuauuguaaguggugauuaguugggucucagucacccagccauacuuuuuuguucccugcguauccuuccuguaauuguccccaagcacauuccacaagagggaggggcacucugggcuaaggcuggggugggaguuaucuggggagcugccaccaugccucugccuuuggugcuugccccugcagggagugcuuagugcccccucccuaugccacucccaggaugccccugucccgcugguugagaucugugggggucuuccugcugccagcccccuacugggcaccccgggagagguggcuggguucccuacggcggcccucccuggugcacggguacccaguccuggccuggcacagugcccgcugcuggugccaagcguggacagaggaaccucggugagugugguuggggugaggggccuuggggaggggagcagcugaucagguuucugacuuguuuuucuucuacuuagagcccuuugcuccucccucagaaugaacggagaccagaauucagauguuuaugcccaagaaaagcaggauuucguucagcacuucucccagaucguuagggugcugacugaggaugagauggggcacccagagauaggagaugcuauugcccggcucaaggaggugagggauucaugacuugggggaguaaggcuuugguucaguugcucuguaccuguguggcauucaccuguggcuuaugggggacuuuugacagaugugagagaaagcuuuuuuuuuuuuuuugagacagagccuugcucugucaccugggcuggagugcgauggugugaucucggcuugcugcaaccuccaccuccuggguucaagugauucuccugccucagccuucugaguagcugggauuacaggugcgugccaccacauccagcaaacuuuuguauuuuuaauagagacgggguuucacuguguugaccaggcuggucucgaacuccugaccucaggugauccacccaccucggccucccaaagugcugggauuacaggugugagccaccgcgccuggccgagaaagcuuuuaccugagggacucgagucugcucuggagagguuggggccugggcaaguauacuuacucaguccaucaaccggacuuuuggcucugauggaaggugggucauccaaacugcuuugcuuuggggguggaggccuugaaccuggcaagucuuagauuuuguguccugaaaucagaagcuguuagguuggcagagaccggggaagaaggcagucugauauuguccuaucucccuggggccugagugaaguuauuguaucauuagaaaccccuauucuagaacaugaacuauugcugugauacuugccaauuuuuuuccuguugauucuggaguaucuauuaaaauucuuuuuauaaaugcugucuaucucauauaucucaggggaaugaagggaaaggggggcuuugccuauacuggaauggggauuaaaagagucuuggcccggcaugguggcucacgccuguaaucccaggacuuugggaggcugaggugggggggaucaugaggucaggaguucgagaccagccuggucaacauggugaaacccccgucucuacuaaaaauacaaaaauuagcugggcgugguggcgcccacauguagucccagcuacucaggaggcugaggcaggagaaucacuugaaccugggaggcggagguugcagugagccgugauugugccacugcacuccagccugagugacauagcgagaugaagucuucccuguuaguuaggucugauugauagccaggcagcagaaggcaaagugagaugcaagaggagacacuacuggaggagugggagauggaucccacagcguggguccccuguaagcugucuucuggcugacuuuggagaggcuuuguuuuaauauaaugaaggaggcuuuucauuugcaggaggguugaacccugguaggcagagguggcuggaaaaguagggauggguugugaaggggaagucuaggagagguggggauggggaaggaaacuggggagggaccugaacaagccagucaucccuauagcauguacugaguuuuccguggguucaagcccuguucuggguuugggagcagcauuuaaucugcacuauggagguuuuaaauuuauugggaggccaaggcggguggaugacuugaggucaguaguucgaaaccagccuagccaacauggugaaacucugucucuacuaaaaauacaaaaauuagaugggcaugguggugggcaccuguaaucccagcuacucgagaggcugagccaggagaauuucaugaacccggagacagagguugcagugagccaagaucgugccacugcacuccagccuggguaacagagagagaauucaucucaaaaaaauaaauaaauaaauaaauaaauaaaaacaaaaaauaaauuuacuaggguagaccaugcagaaagaaugugccuggguacugggaccucuucuagcuuugcuccagaaauuuggggaaggaguaaagacaguagcaauuccagaggcuccuugaagaggaguugggguuggggaggauaaaguuagguggugguuggaaaugggagagagcaaggagaaaacucacaguagcugcuguauggacccugauacccuguaccucuuuccuugcccuccagguccuggaguacaaugccauuggaggcaaguauaaccgggguuugacggugguaguagcauuccgggagcugguggagccaaggaaacaggaugcugauagucuccagcgggccuggacugugggcugguguguggaacuggugagagggguagggcaagggagaagaaguuuccugcaaugguggugacuugggugggaaggggagggaugggccugaaacuuauuucuggguuguguuuguguuucuuugucucuagugugcuacggccaaauuuagagugaaucacuccaaggguuaacuaauguggggagccucuuuuggcauuagguaugaagauggcuguagauaguuguagacaguguggacuggggccucgagacugggcagagaggugucagcucuuuccucugagcagaggauggcuauaaaagugacagaggaggccgggcaugguggcugacaccugcaaucccagcacuuugggaggccaagggggaggaucaucugaguucuggaguucgagaccagccugaccaacauggagaaaccccaucucuacucaaaauacaaaguuagcuggaugugguggcacaugccuguaaucccagcuacucgggaggcugaggcaggagaaucgcuugaaccugggaggcagagguugcgaugagcugagauugcaccauugcacuccagccugggcaacaacagcgaaacuccaucucaaaaaaaaaaaaaaaaaaaaaggugacagaggucuuccaaaggcuauucagaagcagaaauugaaaacuggcagcucacugacaguauuuugaaaauguuuuacaauuaagucuccuaaauuuaacaaagagauuucacacuaaaaccuagauuucuagcauggcuugggaaauuguaagauuuggguccauguucccgcauagcaacaauuggcugaagcugaguggaugcaacuucugcaagacggcauguguucuccugugugcuuucucuaguuugcuccaauccccacauccccuugucuucuauaccaguucgucuuggucuugaaggugucuaguuugcuggcauggccuaaagcuuucauuaguggcagggggacuggguucugggaggggugccaugcccgaggaggguggcagugagcccaaaagggaagagcauucagaacuuggugagugacgaugaugcugagugccuggccugagaggagcagcuggcucaagggaagacgugcugagcacagucagcccggguacguucuugguauggguggagcagguggaucugccuguccugugggcgguggaaauuccagucuggaacuugucggggagaugggucuggagaauagagauuugcuuccaaggagguaauaggcccauggcauccagggagagggcccuggaugacagggaugcugaggggcugagggguucaaaauauggagaugacaggcaaggaaggaagggaaggaggaugagggcagagcagaggaguaaagcuaugggggccaagggaagcaagaccuugaggggccagugguuaacugguagaaucaguucauuuuuuuuuugagauggagucucucucuguugcccaggcuggagugcaguggcaccaucuuggcucacugcaaccucugccucccagguucaagcaauucuccugccucagucuccuaaguagcugggauuauaggcacaugccaccaucccuggcuaauuuuuguauuuuuaguagagacgggguuucaccauauuggucaggcuggucuggaacuccugaccuugugauccaucugccucgcccuccuaaagcgcugggauuacaggcguuacaggugugagccacugcaccuggccuagaaucaguucuuaacccuagcagcacccuaguuucaccuguaaguuuuuaaaaauuuuuaauuuuuuuuuuuuuuugauacagggucuuacucuguuacccaggcuggagugcaguggcaugaucuuggcucacugcaaucucugccucuggagcggaagccacccuuccaccgccucagccucccaaguagcugagacuacaggagcgagccucuacuuggcuuuuuuuuuuuagagacuagguuucaccauguugcugaggcuggucuugaacuuguggcaucgagugaucugcccaucucggccuccuaaaguguugggauuacaggcgugagccaccacgccuggucuaaauuuuuuuuuagagacaaagccucauucuguugcccaggcuugaguguaguggugcaaucaugguguacuguagccucgaccuccugggcucaagcgauccuuccaccucagccucccaaguagcugagacuacaggugccuaccaccacgcccggcuuuuuaaauaguuuuuugguagagauggagugucacuauguugcccaggcuggucuugaacucccgggcucaagugaucugccugccucggccucccagaguacugggauaacaggugugagccacugugccuggccuggguuuuuuuuuuuuuuuuaauuucccuaauaaauagaaagugcuggugggguuaagaaucagugcuaggaggcagaggaaauuuggggaggccauggaauuaauuaucuuggagaccaucaugguugaguggugguggcugaaacaagauuguccuugcagucacccuugggagaggcagugaauggguggcuucagggaaaccaugcuacuccaaauaaacacagagucaauuaaacaugugccuuugauguggaaagcccaggaccuccacacuacucuucugaguuuaggucagagguaaagaugcagauggaugccuccuucccugaggacccugccuauaacagcagugauugcaacgguccuuuccccacggcccaugcugggcucuggcaggcgguguugcaugcuuccuuugcaauguggauccacuacagcacacaggauuaggaugggauaaagucuuaaaaaccaugucuucuaggccaaguguaguggcucaugccuguaaucccagcacuuugggaggcugaggcagguggaucaccugaggucaggaguucgagaccagccugaccaacauggggaaaccccaucucuacugaaaauacaaaauuaggcugggcgcaguggcucaugccuguaaucccagcacuuugggaggcugaggcgggcggaucaugaagucaggagaucgagaccauccuggcuaacauggugaaaccccgucucuacuaagaauacaaaaaaaauauuagccgggcaugguggcaggcgccuguagucccagcuauuugggaggcugagguaggagaauggcgugaaccugggaggcggagcuugcagugagcugagauugugccacugcacuccagccugggcaacaagagcgagacucugucucaaaaaaaaacaaaaaacaaaaaacaaaaaaaaaauuagccaggcguggaggcacaugccuauaaucccagcuacucaggaggcugaggcaggaaaaucgcuugaacccgggaggcggagguugcagugagccaagaucgcgcuauugcacuccagccugggcaacaagagcgaaacuccaucucaaaaaaaaaaaaacacacaaaccaugucuucugcucaagccugggugacagagugagauccugucucaaaagaaaauaauaauaaaaauuaaaaccuggguauagggccgggugcauuggcucacacuuaaaaucccagcacuuugggaggccaagguggauggaucacgugaggucaggaguucgagaccagccugaccaacauggugaaaccuugucucuacuaaaaacacaaaaauuagccgggugugauggcacgugccuguaaucccagcuacuugggaggcugaggcaggagaaucgcgugaacccgggaggcggagguugcagugagccgagauugcgccauugcacuccagccuggacaaugagagugaaacuccaucucaaaaacaaaaaccuggguauguaucuagaaguggaaaaacaaaaaaaggaaauaaguuaugaaaauaaaaaccaugucuugagcugggugcgcuggugugugccuauaucccuagauucucaagaguugagacaggaggaucacuugagcccaggaguucaaguccaacuugggcaacaugacaagacccuugucucuuuaaaaaagcaacccaaaccaugucuugaaaagcuauuuaauggucagacacgauggcucacgccuguaaucccagcacuuugggaggccgaggcaggcggaucacuugaggucaggaguucaagaccagccuggccaacauggcaaaacccagucucuacugaaugaaaauacaaaaauuagcuggccuagcaguuggugguggcaggugccuguagucccagcuacuugggaggcugaggcaggagaaucgcuugaauuugggaggcggagguuacagugaacccacauggcgccacugcacuccagcuugggugauagagugagacucuaucucaaaaaaaaaaaaaaagaaaagcuauuuaaggaaccaaaacauaguuugacugacugcaagaaguaucacagggaauguuagaguguuuuauuaauuucuuugucagacaaguguuuaggaaacucucacuccaggccuaaugcugugcuaggcucugcaaaugcuaagagggggaaguuacugucccugcuuccaaggagaucauggucuagugggaaacccgacacguucagguaccuucagaugggcacucagaagaguaagcccuuaguuaauguuuaaagauguuuaaagaugucugagacucauaggucaaagucagauuucaguuccaccuuauuagaccugcacugcuaaggagcugcuuuagguaaggcuguguuccuagucaccaggguguucaaacacagugcugggggcaaugugggaauagccuucuuuuauuuaggaaguaaugugaagucaguuucaugaauagaucuuacuuuaagcauucauugagguuuuuggcaagaauagaguacgguauaugaagguguuuccuaaucucccugacaccaggaauaaucuagggcucauuagagaugucaaagaucuguucuaguuucuuaaccuaaaacaagaguguuuuaguuccauuuuauaggcggggagucugagccaaacauguuaugucacuuuccaagucuccauagcacagaagucuucugucuccccauccugacuuucccagcucauagggacugucaaaggcagcagcucuggccggcugugaugccucaugccuguaaucccaguaauuugggaggcugaggcaggaggaucauuugaacccagggguucaaaaccagccugagcaacauagugggacccugucucuacaaaaaauaaauuaaaaaaaaaaaauagccaggcaugggguaugugccuauggucucaggaacucaggaagcugaagugggaggaucacuugagccugggaguuagaggcuacagugagcugugacugcaccacugcacuggauaauagugagacucuguccccuaccaaaaaaaagcaaaacuauauacagauauaaaguagcagcucuguugcugauagaaggaacaguaaugaggagcccugcaggucuuauuccacucuuucuagcugcaagcuuucuuccugguggcagaugacaucauggauucaucccuuacccgccggggacagaucugcugguaucagaagguaaugugggcaggaaaauagcaguggguauggggacaggccacagggaggugguuauauauggccugguugagguguuggggugauggcucuuaguaugaaccgagacuagagauugauugcuuguuuuucugucugucaugacagccgggcguggguuuggaugccaucaaugaugcuaaccuccuggaagcauguaucuaccgccugcugaagcucuauugccgggagcagcccuauuaccugaaccugaucgagcucuuccugcagguguauugcagacagggcccgaugcccagagggugcccaugguagccuuggccucuauaggacaugcucaucuagcugguuucaggguacaggauugcagcgugccuggaagggaaagaaagcgaggaaggguguugggaagugggguugugguaguggcaagaaagggcuucucuguccuguguaauuggaagaaagggugauaaaggacuguguguaugaauaugggccuuaaguuuuggggcuuucuccccuucuguugccuuucugauucugcccaguugucagcugguaugggauguugggcuugggauaccaggguuucgcauaucuggagaaagccuggcucauggaccgucuuugucuugcuuagaguuccuaucagacugagauugggcagacccuggaccuccucacagccccccagggcaauguggaucuugucagauucacugaaaagaggugaggggaggugagggacagcgcgaaccaugucuggacagcgagggagggcucaggaugugcauugcccuccugaggaguuucucuucuccccuuacucagguacaaaucuauugucaaguacaagacagcuuucuacuccuucuaccuuccuauagcugcagccauguacauggugagugagccuccucaccccucucugcucugcugaugggggcuuuuggacagcaaggcauagagcagaaaacgugaacacugcuaccccuggugaaaaacugugugaccuugagcaagucggucucgcucagucucuuuccucagcuggggauaaaauuccuacuucacaggacuguaaagauuaagcaaggcaagggauaugaaagugcuuagcacauaauaggggaacaauauauccuguaucugaguauggauaggaguguggagaucauccagguugagagggagaagaguggauuaaagacagucagugggauuaagugucuacccugaccuugcuucucuacauuuccuuuucaucuugaaagaaguuggagguggcaaaaauauuaggaagguggaucagaaugacuuggggacugacauuugugagggaagagacaggcugugcaccucuagaauggauucaucucuuuuaugacucccaggaaggccuagccaaaaauaagugggauugagguuggaccaucagucaggacugucuaggucagggaagccaagaugucugaagagagaggaaagauuuggggcugcaguagggcaagaccccaugggaggaagcagccaggaagaugccggcaccccugggguuuggcuuauuaaccccccuuucccugcaggcaggaauugauggcgagaaggagcacgccaaugccaagaagauccugcuggagaugggggaguucuuucagauucagguaagaaggcaggaggcaguagcagagaacaggcaccagcuucacuccuccucugcccaggaaccucauccuuccucuuuugcugcccucccccucccugcccaggaugauuaccuugaccucuuuggggaccccagugugaccggcaaaauuggcacugacauccaggacaacaaaugcagcuggcuggugguucagugucugcaacgggccacuccagaacaguaccagauccugaaggugccugagagaggguggugggucccugaguugguggaaagggauagagcagugguucucaacuagaggcaguuuuccucccgaggggacauuuggcaaugucagcagacauuuuuugccauugucauuacaacucugugugugugcaugugguacagacaucuaguuggcaggagccaaagauguugccaaacauguaguacacagaacagcucccccagacaggauuaucuggucccaaauuucaauagugccaagguggagaaacccuggaguagaggaugccugguaugaggcaauauuugggauagggaagggaagcuugggauuuuagcuacguagagacacuugaaaauuggagggaggaaaggaguggguggcuuuggagauguucuggaauaugugaaugaggggaguggagggguccuggaggcucuggggaaggccaagcccguuuuccugucuuucaaccucuuccaggaaaauuacgggcagaaggaggcugagaaaguggcccgggugaaggcgcuauaugaggagcuggaucugccagcaguguucuugcaauaugaggaagacaguuacagccacauuauggcucucauugaacaguacgcagcaccccugcccccagccgucuuucuggggcuugcgcgcaaaaucuacaagcggagaaagugaccuagagauugcaagggcggggagaggaggcucucaauaaauaaucguguaaccuucu

SEQ ID NO: 13676 - RNA, 406 nt, Homo sapiens
gaugguaucaguuauaccagugaaggagaagaaacuccuggaugucaaacuaggggagcugccaagcuggauacugaugcaagauuucaccccuaguggcauugcuggagcauuucaaagagguuucuacugguacuacaacaaguacaucgacgugaagaaagggugucucaggggguuccacgguacuggcagcuuacaugcucuucagcuacugccuuuccuacaaggagcucaagcaugagcagcuaugcaaguaccacugaagaggggccugcacggacagcacgcucugucgcccugaccacgaccuccuuugcccacaccuguccuugaggaacgcgauccuugcugaaucuuuuuauauccuaaugggaauuaaccuccacauaaaagacgacugguu

SEQ ID NO: 13677 - RNA, 1198 nt, Homo sapiens
cuuccucgccugccuggccagcuucuguguggaaaccaacaauggcgcaggcuuugggcuuucuauccucuggguccuccuuuucacucccugcuccuuugucugcugguaccgccccauguauaaggcuuuccgguaaguguguuaguggugggagagugauggagaccugggaugggccccacgucugcccauccuucagcucuaauucuucucccacccuccccauuuuuuuccucuuuguaggagugacaguucauucaauuucuucguuuucuucuucauuuucuucguccaggaugugcucuuuguccuccaggccauugguaucccagguuggggauucagguuugugaggcuguuauccacccucaccuuucccucuagauccagccagcacugggugcugggauaggaguuguucagaaaaaggaaaugugguuuuaauccuugggagguacuaguuuaaugagauacaagacauacuuccaggauagagcgcagacagcacucuugacacauauagauugaagggaagaaugcugcauuuggccaaucuaagguggcuuccuggaggaggcauagaaccaugguugaaaggaggaagaagaauccccagaugagugccuggaagagcuuggagagcucagggcuaaugguucagaaacuggaauuaaacuaugaagagauuagauacaguuugggauuguggugcuuggaaugcugcucgauugacagggagccacugcugaugggaaggguaggaacaggggaugcuggugacauaaccaguggagaagcugaggagccccucuucacugguacauccuucccuuuacaguggcuggaucucugcucugguggugccgaagggcaacacagcaguauccgugcucaugcugcuggucgcccugcucuucacuggcauugcugugcuaggaauugucaugcugaaacgggugagggcugugucgaagguggggccgggauggugagaucauggguccccaggggcguggguggaacauucaggagcaacuggcacaggucaggcugcuggguuguucucagcuaauggaccucugggguguguguuucugugugugagugugugugcugggcagcaggcugcugagugguagugaugcuguuaggcugggguggggaaccaguggcuggaaugggcgguaaugucuuu

SEQ ID NO: 13678 - RNA, 6693 nt, Homo sapiens
gacacugcugcuccacgggcccaguucugcaucuccaggaaagacaaacagucuccaguuuugggcccagcuuuccuagucucuucuuuuccuuacccucagcccugaucuuguguuuguacggacagugagcucacccuaggccuggacccaggcccaguuuccaaagcaagcagcacacagcgcauguucacauaagcaugggggcuggggggacacuggggcuuacugaucuuuuucuaggggccuccagccccuggcaccaccuagaggggaaagugagucacccaaaccauugccccugggcuuacgucgcuguaagcucacacuggcccugcugugcccucuuuagucacagacagcgugugagcugacucugucccuuuaaugcccaggcugagcccagugccuccuugaguaucugcuccaucacuggcgacgccacagguaggugugaauggaguagccaggugagauugucuccaggaagcccacagcaggauccuugaugguaagaggcacauccuuagaggagcuagggagcagggaggagaagcugagagugugauccugccaaggcccccaacgcugucuucagcccacuucccagaccucaccauugcccucaccgguuuagcacgaccacaacagcagagccaucgggaugcaucagugccacugcguccaggucguucuucugacuggcaaccagccccacucucugggagcccucaggaaugaacuugcugaaugugggaacagauggucagagucccucgggguaccucccaugaaacccucaucuaagaagucacccacccacggacccaccccauaacuccugcagaggcucugcccuggcucucuaggccuggagccaugcugcugggcacugacccugcuuuucugcaucgcaguccagccucaggcauugggguuuucuguugcuaccuagucacuuccugccuccauggugcaaaaggggaugggugugccucuuccgagguuccacccugaacaccuuccugcucccucgugguguagagugauguaagccauccgauguaggagaugauaggccugguauggaaugggggugcccgcccuccacucaccugaaguggccaaggugguagaacaugggcuguuuguaaaacguguccuuggugaugucuacaaugaugggacugucgacaaaguuacgcacccaauuggguccuccuucgggguucagggcaagguuccagucgguccagccgaccacaugguacaggagguucuaggguaaggacaaaggcaaagagacaaaggcgcaacacuggggguccccagagaguguagguaagggucacaugugggagaggcagcuguggguaggucagcccugugaggggcacauuccuuaguagcuaaggaguugggggugugaagauccaggcaucucaaggggagcugagaagucugaggcagcugcaagugccucaguaguugcaaaaggggcaaugaggugugcagaccugugaaggaaagggaagauagggaaucaugguuccccagaguugcucaaaagggcaggcuagcuggggaaagcuggacaggaagggcuucugucagucuuuggugaaacuaguaagaggucugaggucugcuuugcaggaagggagacugggguggcuuaccgugaugaugcuguggcuguacugcaucccucgaucccaggagccuagccgcacacucugcucccagaacuuggagcccacacaggccucugaggcaaagagcaugguguuggggaacaggcggugugucuccccuaggguggcuuuggcuggagccagaaaguccagguaccaauguacagcaaugccaugaacauauuuagcugcuucugggucugucaguaccugcaaaggaagagcaacugauccuggaccuugcacacaggcuucuggaacuucuaguuccuguuguaggaauccuggaguugggugacgggaagaaugcaacuagagagguuuggggagauuuuuuuuuguuuuugagacaggaugucacucugucacucgggcuggaguacaguggcgcaaucacgacucacugcagccuugacuuccuagggucaacugauccucccacauuagccuccugaguagcugggacuacacgggugccacacccagcuaauuuguguguguauguguguguauguauguguguguguguauauauauauacauauaaacacauauauauguauauacacauacauacaugaaccaccacccccagccuagauaguuuuguuuuguuuuguuucgagauggagucucgcucagccucccaggcuggagugcaguggcgcgaucucggcucaccgcaaccaccaucucccggguucaacugauucucccuucucagccuccugaguagcugggauuacagacacccaccaucaugcccagauaauuuuuuuuuuuuguauuuuaguagacacaggguuucaacacguuggccaggguggucuuaaacuccugaccucaggugaucacccgccucggcuucccaaagugcuggguuugcaugagugagccaccucgcccagccccuagaaagguuucaagcgacaacugugggauccauggcacccuggagguccaggggaauggugcucuaggaauccauaguuggguagagaaaucgcucuaaguuugggagccagucauuuggaugcuggauuugaaggucacuggagcaccauggagguccaggccuuaccaccuuugcccaguggggcagcagcaagcguuggucauccagcaugaguaggcggacauuguggugaguacuguuggcgaggguaggaccuaggucacgggcaaugaagucucgcugauguucaggggugaagcccaggcacuggaagggguauccacucaacagcccagcagaaggcucauuuucagcugucacugcccagaacuguaacuugugcucagcauaggcauccaggaaccuggcaagagaaaggucaugaaugauccggccaagaaaguggaccagaccagcugggugugguggcucacaccuguaaucccagcacuuugggaagccgaggcagguggaucacuugaguucaggaguucgagaacagccuggcgaaaccccgucucuacuaaaaauagaaaaaucagcugggccugguggcaggcgccuauaaucccagcuacuuggaaggcugaggcaggagaauugcuugaacucaggaggcagagguuacagugagugaagauggcgccacagcacuccagccugggugacagagagagagacuccuucucaaaaaaaaaaaaaagaagaaaaauaaaaagaaagugggccagaccgagagaacaggaagccugauggagugggcaagauugacaggcccaaggcugaaaggcccagaagguagaaaggugagcugaggacaggcagaucuggaaguggaacuagguugaggguugggacacagaucagcauggcuaaaugggaggccaguccugaucccacauccuugcugaucccuuacuucacaaaguaucuggcccaggucuggugguagaugucuccgggcugucccuugagugaccccuucccauucaccgcuccauuggucuugagccaagugggugauguccaggggcuggcaaggagugaaacgggacgcugggccaacugcagggcucggugaaucagggguaucuagagacaaagguagugaagagagaagcacccagaguuggaacacauacuagcccaaccagugcauccgguucagccauuagccuccacccucccacccccaggacaaaacagcaggggacaaaaugucuguacaagcagaccuacccuacaguuucucaacccccagacaucagggcccucagggccugaaaaagcuagaaugccuaccuugagcuugguaucuuccucugggaggcugaaguugugcaacuggaaaucaucaggggugucugcauagguguaggugcggauggagaagucacagcuggccauggguacccggaugauguuauauccgauuccuacagaaaaggaugaucaagauaugguaguccgagucaauaggagaguaugggacucugcuuaucacuugccaguccuaauagugucugagucagggccaaagggaacuugggcuccuggguuggaaccuguggaggcuggcaccugggugaagcgcaggccuuucugagccugaguccguagcaguuagcagaugauaggcggugaaaucuuauuucacagggcauuaaaacaggaaccaaaugucagggaugggcagaagucaggguccaaagaaagggcaaagaaaagugucaguggcucacgcauguaaucccagcacuuugggaggccgaugugggcagaucacgaggucaggaguucgcaaucauccuggccaacauagugaaacccugucucuacuaaaaauacaaaaaauuagccgggcgugguggcaggcaccuguaaucccagguacucgagaggcugagacaggagaaucaccugaacccgggagguggagguugcagugagcugagauugugccacugcacuccagccugggugacagugcgagacucugucucaaaaaaaaaaaaagaaaaaagaaaagugucugcugggcucgguggcucacacuuguaauuccagcacuucgggaggccaaggcagguauaucauuugaggucaggaguuuaagacuagccuggucaacaugaugaaacccugucucuacuaaaaauacaaaaauuagccaggugguaguggcgcacgccuauaauuccagcuacucaggaggcugaggcaggagaaucacuauagccugggaggcagagguugcugugaggggagaucacaccacugcacuccugucucgccgacagaaugggcagagugagauucugccucaaaaaaauuuuaaaaaaagaaaagaaaaacgaaaaguuucaauggcucuaugucaucuuguccccuuccuccucaccuucuucagagaaguacgauuuaaguagcaaauuuugggcagggggugacagggcaaggauguugagagcagcagcaucugucauggccccuccaaaucccuucacuuucuggaacuucuguucuggcugcagggucaguagcaggccugaggacauccacagggaauaaggguaucaguacccagcgggaaacuccauggugaucacugacaccauuuaccucuaggaggacccagccuggcccagggggugagggguguaaugguuaccugugcccgugugauuagccuggaugggccccauacucagcuccauccgucgcccacugcguguacucucauagcggcugaagguaccaagggcaggaaaggucggggggucaaaggagucacaguauguggcauugcagacacacaccaccgagcuguagccgaagcuuuuagggaugcaggggcgggcaccugggagggagggaguacaagcagagugaggucugaugaagacauggagaauggacacaucugcuaggagagacugaacacgguuucaaaauuccucaccccuuggccgggcgcaggggcucacaccuguaauccuagcacuuuaggaggccgaggugggcggaucaccugaggugaggaguuugagaccugccuugccagcauggugaaaccccgucucuacuaaaaauacaaaaauuagcugggcguagugguggccgccuguaaucccagcuaccugggaagcugaagcaagagaaucgcuugaaucugggaggcagagguuggaaugagccaaaauugcaccacugcacuccagcccaggcaacagaguaagacucuguuucaaaagaaaaaaaacaaaauccucaccccaaaguuggucucagucacucaaaaggauuuauugagcaccuacuaaaagucuaccaccagcuuacuggaaggcuaccaaaggacuaugaggcagaagggaggcucugugcuaccuccccacugccuugacucacucaccugaugcccacgacacugccugaaguagaagcaauccugugaggcugccagccaugaugcuuacccuacucaaaggcuugggacauuccugaggacagaaugaggaaugacugaaaagcaagccccucuccaccccucaacuacucuccugggcagggcuuagcugccuuugggugcccauggcccggucucccacauucauuaggacaaggcccacagaaaccugggugcagcucucccugcaacccuucugaugacaacucucugcccaccccaaaucaggaugcuccccaccacucuucccacccauuucaacuucgaccccucccuccaucugugccuugcucaaagagccaugauggcccuggauucaaagagagucugucauucauuaaauuccagugccaggauuccagaagcacugugacaaugcugauugggagcucucucucuuaccucucuggaaggacuugaaaacuccauccccucagggucauuagaugaagagaagaccacagggguuccagagucucugaaggauagaggauccacuaaacaaaaacaaggaugcagguaccugccuuagcuauaggcacuagguuagcccugcaaguaauuccggcuucccg

SEQ ID NO: 13679 - RNA, 23460 nt, Homo sapiens
ugcagcugcgggaacagugccaccuccgcaccuaagcacucccauuccuggccagcauccuuggggcucaucucauacaauagcccccggucucagagcuaccuccuucuccagcucuuccucguccucaggccugugcuccccagucagcagcuguagccguuccauguacugccgcugcaugcggccaggcaggaagaaguugaggggaaagggcauagccucugcauaccacuuccgggucacuucuacguaguucuuggugucuauccaaaaaguauguaccuggauugggugggcaggaagaaacaggcaggucugagccagugcaccugucugauucaaggugggcuucugaccuccaugcucuccugagucucugugugggucuguguguucccguccccuccccggcuggccauggaugcugggaggucugggcacacucaccagcaccgggaucaacuucuccuccaggagagacaugaaggccagggugucugccccuugcugagcugacagaucauaaucagcauuguacuucuguggaggaaauauccauggcguggacgcuggggagcugcaagggcacuucaccagggaggaaggaguccugucugguaccccccucacuggccucugagugcaguggagguacagcaaggaacuuuuccugccaaggcccccuugccugggcccagccaguagccuguugcuguuggcaaaaagccugggccuuggagcccgcuggccgucaagguccugggcccauugagaagaaggaagaaagguugggccgcaaacuaggagcagcucccagaauuuccauggaaagcuggaacaaugccugcugacagcaacuuucuaacaguaacuuucccgacccagacaccacaaagcuagcacaacggagcucagaugcaggcuaggacucgguccaugccucaggaaccagggaaagccauccucacacucccuggauccagggaacccacgcccagggccccccagcuuguucccucagugcccagcucuuggcuauuucuuucacuucauuccaucgcccagacaccauuaccacauacacauuccauccauacccccaggucucagccugcccuaccuucccaggcuccagucccuguuccucagcaucccccaccacauccugaguaagcuuuguccccagauaaccucuucagcaugauccuuaaaucucccuaagccucaguuucuccccuguggaauggggguaagaaucucuuucucugaaugccccuguguuaggaaauaauuuagaauacuucggaaacaaaaagcucuguucacaccuaagcaaucagggcaguggcccuggccuugccaggaacuuaggcuuuuaucuggauccucuuuccaggccucucaauuaauuccccagguccuuaaccuuugggaaauuagaaauuaggaagagugucccacuucugacacuguguucccucuuggaaccugaccgucaaugcuagaagaacccuuggaaaacaugcuggcccagcccucuaguuuuacaaauaagggagugcacagcccugagagguuacauggccugcccaagaucacgcagucaauggcagaguaaagagcauagccuaggccuccccacuccucuaguaaugcucuuucaucuucuccaaccuggcucuaagccuuguccauccugagccccauaucuagcccaaccuagucccugaaaacaagaaguggcccuuagaaaucucucuccagucccacuaucagaggccaacugcugucuuccagucuccuucagccugugcuccucucccucccugacugacaggcagaagguaccgugccucuggauauccccacagugcccugagcugcaucucuugccgacugcuuuaauacaucacagugacauugugugugucucugccaccagacuauugcuccuugaugcucugggucaccugcaucuagcauggcauauaucuagugcucaauaaauguguauuguacggaauugacugaacuucucucacuggcagcccccucuauccaaaucacccaccucuuuuugaaggugggugaugaucuugugugguacugaggugaccucuccaugacugguccaaagggcaggcaggguuccugauacugagagaaaaguauaccaaccaggaccuuagcugccuauccauacguaguugcaacacauuccugccuaucuccugcuucuccucuuguacacacccuuccucacccccaagggauacuggguaccugaagggcucugccagggguugcugaucuugugcuauauggugcacaagaaacuuuuaagaaaaaagaaacuuucaagacacacuuuccaaccacgaauucuaucucugcuccuuuucauagcaauagguuuucuuuuucuucccuccacacuuaaacauccauucucuuaucacccacccccaucagacuccuuccccuguguuucuucagccacugcucugaccaaaauuugagugaccaaaaguggugucagacccagugaccauuucucugccugcauuucacuugaccuugaagcagcaauuaaucuccauaaucagcaucuucuugaauuuuucccuuugaggacauugcucuucuacuuugugcucugguuauccuuuacaaacuuuuacaccucuccugaacugguuaacaguagagggccccaagggucucacguaagccuucuuuguuuuuguuuuuuuucuuuucuuuuauuuuuuauauauuuuuuugagacggagucuugcucuguugcccgggcuggagugcaguugcacgaucucggcucacugcaagcucugccucccagguucaugcuauucuccugccucagccucccgaguagcugggacuacaggugccugccaccaugccuggcuaauuuucuguauuuuuaacagagacaggguaucaccauguuagccaggauggucucgaucuccugaccucgugaucugcccaccucagccucccaaaaugcugggauuacaggcgugagccacugcucccagccgucauuuuuauuuuauuuuauuuauuuuuuugagauggagucuugcucuuuugccaggcuggagugcauggugcgaucucggcucauugcaacccccgccucccagguucaagcgauucuccugccucagccuccugaguggcugggacuacaggugccugucaccaugccuggcuaauuuucuguauuuuuaguugagacagguuuucaccuuguuagccaggauggucucgaucugcugaccucgugaucugccugcgucggccucccaaagugcugggauuacaggcaugagccacugcacccggccaucaauuuuuuuuuuuuuuaaauggagucuugcucugucacccagguuggaguguaacagugcaaucuuggcucauugcaaccuccgccucuuggguucaagcgauucuccugccucagccuccugaguagcugggacuacaggugcaugccaccacacccggcuaguuuuuguauuuuuaguagagacgggguuucaccauguuguccaggauggucucaaacuccugaccucaaaugaugugccugccuugaccuuccaaagugcugggauuagaggcgugaaccacauugcccaccguaagcccucuuuucuacuuccacucuuucuguagguggcccuacuacuaacguccauggcuuuaaguaccaucuuucuauguguuaaugcauaaguccagccuugaccucucuugagcgccauccaacucagcauaucugguuggaugucuaaugaguauuucaaauucaacauggccacaacugaacuaacugaacucuuuuuuuuuuuuaggcagaguuuugcucuuguugcccaggcuggagugcaauggcgagaucuuggcucacugcaaccucugccuccaggguucaagcgauucuccugccucagccucccgaguagaugggauuauaggccccgcuacccggcuaauguuuuuguauuuuuaguagagacaggguguugccauauugaccaggcuggucugcaaauccugaccucaggugaucccccugccucggccucccaaagugcuggaauuacaggcgugagucacugcgcccggccacacaacugagcucuucauucccaccccagcaccgguuauuuuuccacuguucccaucucaauggcaccuccauuacccauuugcacauuccaaaagcccaggaaccauggugacuucuuuucccauauccaacacaaccaauccuaucuugaauucauccacgucccaccaccuccccagcuaccuaguuccagccacccucucuccacaaccucugaaucaaucuuucacuuuucccagcaauccauucuccacucagcaaaaugaugauaaagcacgucacaucaaggcucugccucaauuuaauggcuucccauuguauuuagaaucaucuccaagcucucagagacuauggucagcuacaaucuggcccaccuucuguuccagccaaauuuccucacagcacaaggacguuugcaccugcuauuuuccaagcacgaaacccucgggcagauauaucuggugcugucaccuaauuucagguuuuaacuccacucucaccauuucagugaggaccuaauccccaucgcagucauucuaucacauagcuuuauuuuauuuuauuuuauuuuuuuuugagauacagucuggcucucucacccaggcuggagugcaguggugugaucugggcucacugcaaacuuccaucuccugcguucaagcgauucuccugccucagcuucccgaguagcugggauuacaggugucugccaucacgccugacuaaguuuuguauuuucaguagagacgggguuuugccauguuagccaggcuggucucgaacuccuugaccucaagugauccaccugccucagccucccacaauguuggauuuacaggcgugagccacugcucccggccacauagccauguuuuaagcauguaucacuaucuaaaauuauuuuuuguuuauacguuugugucguccuguagaauguaaggucacaagaucagggacuugcucauugcacugggucuaacacacagugcuuccucaacaaacacucguuaagauacuaacguggcagaguggggccuuguaaacaguuucaggacccugugcuuguaagagcaacguggugcccucccaaggaagacagggaggaugcaggagcacugcccagagauggcgucaggcugcaagacaucuugaauaauucaccaucguaacaacccagccucaggaagagauggggcaaggccagaacgaaacauuagguaagaggcgguggacaaugggauucccacagggcagcuuuugggcacuggacguucccuaaccugaggcucucugaagaggaagguuaggaauccucucagcuucggugggcuggacucacugugggaauucaaucgcccccccccacccacuaagggugugcuggcgggaaagcgcugagacgcaugcguaguucucgcgucuggcacccgcucccuuuccaauacgcuugcgccccgucugugcuacggauggucagggagaguuguccgucuucaaauggaccaaugagacuuguggaggggcucugagucccgccucuggaugagugaccgucucuuuuccaagugaggccccgccccgccuccccagggcugcuuuucucgcggcacgggugguggggcugcuucuugacuuccgcgccuagugcgcagggccccauucuccagucccgcccacgcgccuuuggaggcugcggugggauuuccuuuugccuucgguuggggcugcuguuucucuucgccgacgguaggcauuauaaauauuucgcccuuugaauuuuagcucuccccucccggcguucgcacuuagccuuuuucaucauuaucauuauuuuuaaugguaaggauggucaaauuuuacuaaugaagcgauuauaaaaucuucaagucuuuguauccacuugcuuuuugagggcuggagugggaagaaagguauauaauucauucauucuucggacaugugacaaacguucacggagcgcggcaacgagcgccggugucgcgaugcgcacuggggcugcacaugggagccaggauggacuggacuggucccugcccugcccgcugacgauuggcaggccacugccuuugaugagcugggcgcuauaacugccauuaagccauuuguacaauuaaucacaacagugauaagagcgacaaaggagcuauucggguggcugaggcgggaggaucuuuugagccuaggaguucgagaccagccuggggaauagagcgagauccugucucaaaaaaagggggagaaaaagugacaaagaaguugugagggcuaugaguuugcguuagaggaggugugugagguggggaggcggcagggggcgcgguuguucuuagagaaagugacauccgggcuaauuuugaaagaauaaguguuaacuaggcuaagcggugggaaagaguagugugugcugaaggaagggaagaggaaccuggcaaguucauggcaggcuguaauuggaugcuggucucccuccacacuugacuccuacagucugauuucuacacagcacccaaagugaucucuuaaaaauacacaugugaucuugucacuucccagcaccaaacucuacagugaauuuccaucuuagaacaaaauucagacuccuuaccauggccaccaagacccuacacaaucuggccucccaauuuccuuuuccaaggucaccuuuuaccacuauccaucucacucacacugcuccagcacucucuaugcuuuuauuuuucuuucuuccucuuucuuucuuucuuucuuucuuuuucuuuuucuuucuuucuuuccuuccuucucucucucucucuuucuuuucuuuucucuuucuuuuuuuuuuuuuugagaugcagucuugcucugucacccagguggugugaucuuggcucacugcaacccagagcagugggggugaucuuggcucacugcagccuccgccuuccagguucaagcaauucugccucagccuccugaguagcagggauuagcgccaucagucccagcuaauuuuuguauuuuuaguagagauuucaucauguuguccaggcuggucucgaacuccugacuucaagugaucugcccaucucagccuccuaaagugcugagauuacaggcaggagccaccacaccuggcucaguauuuguuuuauuuuuguuguguuuauuuauuuagagacaaggucuugcucuguugcucaggcuggagugcuguggcaggaacacagcucacugcagccuccacuaccucaauucaggcgauccucccaccucagcugagacuacaggugugcaucaccaugccugguuaauuuuuucguuuuaccauguuggccagguuugucucgaacucuugggcucugcuguccuccuaccuuagccucccaaagugcuaggauuguaggcgugagccacugugcccagcugguguucaguauuugaauccauauuuccuguagccgcaaccaaaguuccacuguuaggucucacuuugacuuuaauaauuguguucaggcugggcacacuggcucaagccuguaaucucagcaguuugggaggccgagguggguggaucacaugaggucagguguuugagaccagccuguccaacauggcgaaacccugucucuacuaaaaauacaaaacauucuccgaucguaguggcgggcgccuguaaucccagcuacuugggaggcugaaggaggagaauugcuugaaccugggaggcagagguugcagugagcggagaucacgucauugcacuccagccugggcuacagagcgagacucugucucaauaaguaaauaaauaaauaaauaaauaaauaaauaaauaaauaaauaauuguguucggagucagcaucauucuucuugaaguucaccacuccuuugccaagaacacuuccugaaacacugacaagcaggaccuugaauaaugggguaugguugguaacaacucacucauucaacaaacauugagcaccuauuuugugcuugccucuaaaugaagagcugguuguauuauuuauuuuuuuaggugacagggcuuucccuauguugcccagguucgucucaaacuccugggcucaaaagauccucaucuucucaagugguugaauauacacgcuccagcgaccaugccuggcugaaugaagagcuuugagauuuugaagaaacaggaaccaugaaauuugcuuugcaacuguuugcaaccuuuaaggaagacugaaaaggcauuccugaagcaugugagaagcagucugugugaccugaugacucagaacugcuuggaauuuagauuaggacagauaugagcuuaggcuucacucugccacauauuuaacuucucuaagucuuaguuuucuuuucuuuuuuuuuuuuuuugagauggagucucgcucugucacccaggcuggagugcaguggcacgaucuuggcucacugcaagcuccgccucccggguucacgccauccuccugccucagccacccgaguagcggggacuacagucgcacaccgccacgccuggcuaaauuuuuguauuuuuaguagagacgggguuucaccguguuagccaggauggucucgaucuccuaaccuugugauccgcccgcuucggccucccaaaguguugggauuacaggugugagccaucgcgucuggccucuaagucuuaauuuucuuaucuguaauguagaguugucaggcuagugcauguaauaagcacucaugaaagacugacuauuaucuugcgaaaaauuggaagagaucauaugagguacaaggaccuuccaucugcacugggcuguacauugaauguugugguuacuguugaagcauugguaaaucacaugaauccaaugguaaaaccacacccuaaggucagacucaguggcucacgccuguaauuccagcacuuugggaaaccaaggcaagaggauugcuugagcucaggaguucgauaccagucuaggcaaccuguuucuauaaaaaguuaaaaaauuagcuuggugugguggugugcacuucuggucccagcuacucaggaggcuaaggugggaggaucccuugagcccagguggucgaggcugcagugagccaggaucacaccauugcauuccagccuggaugacagugugaggcccugucuuaaaaaagacaaaaacaaaccaaaaaaacccacacccuaguggguaaggggcagcagaggucccacccaagagugaaaucauuuuuggugucaguaaucagggagaguaauauacccucaggccagaaacuagaggugagugauggcucacgccuauaaucccagcaccuugggaggcugaggcagguggauugcuugaccucaggaauucgagaccagccugggcaacauaggaagaccccaucucuaaaaauaaauuucaaaaauuaguugggcaugguggcauguaccuguagucccagcuacuauggaggcugaggugggaggauccaauugagccugagaggucaaagcugcagugaauugugauugugccaagacccugucucuaaaauaaaauaaaauuacaauuaaaaacuagagcugaaaggacagguucuagguuaacugguaguaguuguucauucaucuguauaaaaaguacuuuuuugagcaccuacucugugcugugcauggaaugaacaaaugucuuuauuugacuugaacacagaccauagaaguaacuaacaguggaacugggaguggcacucuccaugggaccuaaagaccuaggagccugugauaugauaccugucagugugaaagggcuggaguuugcuaucugagccagaccuacacuccaagacaggucuugcugggaugggaucaaaauugcugcugggucagccgaacuauuuuuguacuucugcuuuucacuuauauuuaugucuucccuagguauauagcugucuuuuuuuguuugcuuguuuuucugagucagagucuugcucugucacucaggcuggagugcaguggcgcgucucggcucacugcaacauccaccucggguucaaacgauucuccugccucagauucccgaguagcuaggauuacaggugcccaccaccaugcccggcuaauuuuuuguauuuuuaauagagaugggguuuaguagagacaggguuucacuguguuauccaggauggucuccaucuccugaccucgugaucugcccgccucagcuucccaaagugcugggauuacaggcaugagccacugcgcccggccacuggagaccccuuuucuaccaaaaaaaauaaaaauaaauaaauaaauauauauauauauuuguaaagacggagucucucuauguugcccaggcuggucuugaacuccuggccucaagggauccucuugucucagcuucuuaaaaugaugggguuacaggcaugagccaccguaccaggccuuagcaaacucuuuuucaagugcuauacaaaggggacagaggaacgugauuguggccaccuaguaugccccuauuggccacugcagugaggccuagguguuugaagagaggcaccuaggguaguggcucucaggcacacccuaggggcauuuuggaaauuuguggggcaucuuuaauagagacaaugauuaggaggcacuuugagaauuuaguggauggagcccaggaaagguagacauucugcaacauguaguacauucauacacaaggaagaauucacucauuucaccugacuuacaaauauaaaaucaaauauaaaucaguaggacuuuauuauaaaauauugcagaaaaguuucacaagaauuuuuuguagaaaaagcccaaucagggccgggcaugguggcucaugccuguaaucucaggacuuugggaggccgaggcgggugaaucaccugaggucaggaguuugggacaagccuggccaacaugguaaaaccccgucuugacuaaaaauacaaaaaucagccaggcaugguggugugcgucuguaaucccagguacucgggaggcugaggcaggagaaucgcuugaacccaggaggcgggguuugcagugagccaagaucaagccacugugcuccagccugggugaaagagcaagacuccgucgaaagaaagaaaggaagggaggaagggaggaagggagggagggagggagggagggaaagaaagaaaaaagagaagagaggggaggggagggaagaggagaaaagaaggaaggaaggcaggaaggaaggaauccagucgagaucguuaaauuuguuguaauuuugucuuuggcacaauaaacauuaguccuuauuaaaacuaacuuuacuuagaaaauaaaauagaaaauccucaaggacaaaucacauuguacaggaaauaugaaaugugaaauaauauccaccuuggaaauuuuuuuuuuuugaaacagaguguuacucugucucccaggcuggagugcaguggcacaaucuugggucucugcaaccucugacuccuggguucaagugauucucguaccucagcuucccaaguagcugggauuacaggcgugcaccaccacacccagcuaauuuuuguauuuucauuucagaugggauuuugccauguuggccaugaacaccuguccucaagcuauccacugccucagccucccaaagugcugggauuauaggcaugagcuaccgugcccagccacccuggaaaaauuuuacaaaaugaaguauaaaaagaagaaaagaggggcgggcauggugccuugugcguguaauccuagaacucugcaaagccgaggcaggagauccuuuggguuuaggaguuugagaccaaccugcacaacauagcaagacccuauuucuacaaaaaauacagacacuaggcugggcgugguggcucacgccuguaaucccagcacuuugggaagcugaggccagcagaucacgaggucaggagauggagaccauccuggcuaacauagugaaacccugucucuacuaaaaauacaaaaaauuagccgggugugguggcaggcgccuguagucccagcuacucaggaggcugaggcaggagaauggcgugaauccgggaggcggagcuugcagugagccgagaucgugccacugcacuccagccugggagacagagcaagacuccgucucaaaaaaaaaaaaauuuugcucaguaccuggccaaaaaagaagcagcucacucccuguacacagaggguaagagaaaggagaugguugaacuucuaaacucgcuaaagcaggagaggcaaauguggaaugugcucaggaaauaucugugagaugaaugaauuugagggaaguaagguacuagauaauuaccugcccuacccagaacaaauccugugcaacguuuccuugaagagcaggaagucaggccgggugcuguggcucacgccuguaaucccagcccuuugggaggccaaagugugcgaaucaccugaggucaggagauugagaccagucuggcuaacauggugaaaccccaucucuacuaaaauacaaaaauuagccgggcgugguggugcgugccuguagucccaacuacuugggaggcugaggcaggagaauugcuugaaccugggaggcagagguugcggugagcugagaucggccacugcacuccagacugggugacagagugagacaacaucucaaaaaaacaaaaaaaaaagagaaaagcaggaagucuggaagggguggcuacugacauagugaagcaacuaguucaauucuacaacuugacaacuaccccugugccaggcugucuacaaggauauuuagaauguguaagacauuccuucaaggaacuccaggaacagaggccugacauguugcaauguuuagugucaagcaguguacuagagacacauuaucacacucaaaccucacaacaguucuaugagguaggaguuaucacuccccuuuuauagaugaaauagaggcuuagagugauugauuuacugaaggucaaacagccaguaaaugguguagcaaggauuccaaccuugccgucucacuaaaacuguacaaaaaaagauacaaacaacagacaaauaguucccaggcgccucccaaguugccaggcacugcauuuaccucacugaccccuuugagguuguggcauugccuccauuuucuaggugaggaaauaggcugagagcugggguuagucuggucaugacugugugugccacucccaccaaaucucauuugaugugguucaugaggcaaauggcauggacaacuuccuucacauguccacuaagcauauggccuuuuacaacacuuucugguuucugaacuacuuuaaaaccucacuguccugugaggaaggaagaacaguuauuacaaucugcaucuggaagccaauugcccuuuagagauauggcugcaauugccucacugccugugucaugugacucuccgaggcccuuaaugaguaaaugaggggugcugcaggggagccaagcugaccacuccccucccuccaguccugccaccccacugccagugucccacccuccuugcgcccuacacuucacuggcuaauaaccccccucacuuuuuccuguguugaaggcauccuggauaauuccccacccacgaauggucccuccucaucucagagagcucuccaugcacaccuguuacuguuucuguuuuuaccuguaaauaucugugucugacuuccaugcuucaugcaccucuauagggcaaagacugugucuuaaacaucacgguagccucagcauguugugcaaugaagguuuuuuuguuuuuguucuuuguuuuuuuuuugguauuagcuuuauuuguaucauuuugaaauuuuuaucaaaaaagcagcgugccugcugugguucccauccucugggauuuaggaaucuuuacccgauucuccauccaagucugucuuucguauucuaggcucuuccuaaaguugucauucacauauacccuccagaauuuuauaggguguauaaucuguaacaacucggaggaagccaauugcccuuuagaaauauggcugcaauugccucacuuccugugucaugugacucuccuagucaucacaugacccauccacauugggaagccagaauuacuugcaggaguaaccuagugccuauagcuauggcagguaccugcauccuuguuuuuguuuaguggauccucuauccuucagagacucuggaaccccugugcucuucuccucaucuagugacccugaggugauggaguuuucaaguccuuccagagagguaagagagagagcucccaaucagcauugucacagugcuucuggaauccuggcacuggaauuuaaugaaugacagacucucuuugaauccagggccaucauggcucuuugagcaaggcacagauggagggaggggucgaaguugaaaugggugggaagagugguggggagcauccugauuuggggugggcagagaguugucaucagaaggguugcagggagagcugcacccaggugucugugggccuuguccuaaugaaugugggagaccaggccaugggcacccaaaggcagcuaagcccugcccgggagaguaguugagggguggagagggacuugcuuuucagucauuccucauucuguccucaggaaugucccaagccuucggguaggguaagcaucauggcuggcagccucacaggauugcuucuacuucaggcagugucgugggcaucagaugagugagucaaggcaguggggagguagcacagagccucccuucugccucauaguccuuugguagccuuccaguaagcuggugguagacuuuuaguaggugcucaauaaauccuuuugagugacugagaccaacuuuggggugaggauuuuugaaaccgucuucagucucuccaaacagcuguguccguucuccacauccuugucagaccucaccucugcuugugcucccucccucccagguggugccccugcaucccuaaaagcuucaguacagcucgguggucugugucugcaaugccacauacugugacucuugaccccccgaccuuuccugcccuaggugccuucagccgcuacaagagcagaagcagugggcauuggauggagcugaguacaggaccauacaggcuaauugcaccggcacagguaaccauuacacccuucaccccccgggccaggcuggguccuccuagagguaaacggugucagugaucaccauggaguuucuccccugggcacugauaacccuguggauguccucaggccugcuacugauccugcagccagaaguuccagaaagugaagggauuuggaggggccgugacagaugcaggugcccucaacauccuugcccugucacccccugcccagaauuugcuacuuaaaugguacuucucugaagaagaugaggaggaaggggacaggaugacauagagccacugacacuuuucuuugccaauucuuuggacccugacuucugcccaucccugacauuugguuccugucuuaaugccagugaaauaagauuucgccgccuaucaucugcuaacugcuacggacucaggcucagaaaggccugcgcuucacccaggugccagccuccacagguuccaacccaggagcccaaguuccuuuuggcccugacucagacacuauuaggacuggcaagugauaagcagagucccauacucuccuauugacucggacuaccauaucuugaucauccuuuucuguaggaaucggauauaacaucaucuggguacccauggccagcugugacuucuccauccgcaccuacaccuaugcagacaccccugaugauuuccaguugcacaacuucagccucccagaggaagauaccaagcucaagguaggcauucuagcuuuuucaggcccugagggcccugaugucuggggguugagaaacuguaggguaggucugcuuguacagacauuuuguccccugcuguuuuguccugggggugggagggugggggcuaauggcugaaccggaugcacugguugggcuaguauguguuccaacucugggugcuucucucuucacuaccuuugucucuagauaccccugauucaccgagcccugcaguuggcccagcgucccguuucacuccuugccagccccuggacaucacccacucggcucaagaccaagggagcggggaaugggaaggggccacucaagggacagcccagagacaucuaccaccagaccugggccagauacauugugaaguaagggaucagcaaggaugugggaucaggacuggccuccccuuuggccaugcugaucugugucccaacccucaaccugguuccacuuccagaucugccuguccucagcucaccuuucuaccuucugggccuuucaaacuuggaucugucagucuugcccacuccaucaggcuuccuguucucucggucuggcccacuuucuuggcuggaucauucaugaccuuucucuugccagguuccuggaugccuaugcugagcacaaguuacaguucugggcagugacagcugaaaaugagccuucugcugggcuguugaguggauaccccuuccagugccugggcuucaccccugaacaucagcgagacuucauugcccgugaccuagguccuacccuugccaacgguacucaccacaauguccgccuacucaugcuggaugaccaacgcuugcugcugccccacugggcaaaggugguaaggccuggaccuccauggugcuccagugaccuucaaauccagcauccaaaugauuggcucccaaacuuagagggauuuuucuacccaacuauggauccuagagcaccauuccccgggaccuccagggugccauggaucccacaguugggacuugaaaccucucuaggcugggggugguagcucauggcuauaauuccagcacuuugggaacccaagguggguggaucacuugaaccuaaggaguucaagaugagccugggaaacauggugaaacccuaacucuacaaaaaaaaaaauagaaaaguuagccggguguggugguggcacgccuauagucccaaguauucuggaggcuaaggcgggagguuuaguugagccuagaauuucaggcugcagugagcuaugauugugccacuguacuccagccugugugacagagggagacccugucucaaaaacaaaaacaaaaaaucccucccaaaaccucuguaguugcauucuucccaccaccuaauucaggauuccuacaagaggaacuagaaguuccagaagccugugggcaggguccagggugacuuguucuuccuuugcagguacugacagacccagaagcagcuaaguauguucaugguauugcuguacauugguaccuggacuuucuggcuccagccaaagccacccuaagggagacacaccaccuguuccccaacaccaugcucuuugccucagaggccuguguggguuccaaguucugggagcagagugugcggcuaggcuccugggaucgagggaugcaguacagccacagcaucaucacaguaagccaccccagucucccuuccugcaaaggagaccucagacccauuaguagucucaccaaagacugauagaagcccuuccuguccagcuuuccccagguagccugcccuuuugggcaacucuggggaaccaugauucccugucuugccuuuccuucacaggucugcacaccucauugccccuuuugcaacuacugaggcacuugcagcugccucagacuucucagcuccccuugagaugccuggaucuucacacccccaacuccuuagcuacuaaggaaugugccccucacagggcugaccuacccacagcugccucucccacacgugacccuuaccuacacucucuggggacccccaguguugcgccuuugucucuuugccuuuguccuuacccuagaaccuccuguaccauguggucggcuggaccgacuggaacccaucauuguagacaucaccaagcacacguuuuacaaacagcccauguucuaccaccuuggccacuucaggugaguggagggcgggcacccccauuccauaccaggccuaucaucuccuacaucggauggcuuacaucacucuacaccacgagggagcaggaagguguucaggguggaaccucggaagaggcacacccauccccuuuugcgccauggaggcaggaagugacuagguagcaacagaaaaccccaaugccugaggcuggacugcgaugcagaaaagcagggucagugcccagcagcauggcuccaggccuagagagccagggcagagccuuugcaggaguuaugggguggguccgugggugggcgacuucuuagaugaggguuucaugggagguaccccgagggacucugaccaucuguucccacauucagcaaguucauuccugagggcucccagagaguggggcugguugccagucagaagaacgacccggacgcaguggcacugaugcaucccgauggcucuccuguuguggucguccuaaaccggugagggcaauggugaggucugggaagugggcugaagacagcguugggggccuuggcaggaucacacucucagcuucuccucccugcucccuagcuccucuaaggaugugccucuuaccaucaaggauccugcugugggcuuccuggagacaaucucaccuggcuacuccauucacaccuaccuguggcgucgccagugauggagcagauacucaaggaggcacugggcucagccugggcauuaaagggacagagucagcucacacgcugucugugacuaaagagggcacaacagggccagcgugagcuuacagcgacguaagcccaggggcaaugguuugggugacucacuuuccccucuagguggugccaggggcuggaggccccuagaaaaagaucaguaagccccaguguccccccagcccccaugcuuaugugaacaugcgcugugugcugcuugcuuuggaaacugggccuggguccaggccuagggugagcucacuguccguacaaacacaagaucagggcugaggguaaggaaaagaagagacuaggaaagcugggcccaaaacuggagacuguuugucuuuccuggagaugcagaacugggcccguggagcagcagugucagcaucagggcggaagccuuaaagcagcagcgggugugcccaggcacccagaugauuccuauggcaccagccaggaaaaauggcagcucuuaaaggagaaaauguuugagcccagucagugugaguggcuuuauucuggguggcagcaccccguguccggcuguaccaacaacgaggaggcacgggggccucuggaaugcaugagaguagaaaaaccagucuugggagcgugaggacaaaucauuccucuucauccuccucagccaugcccaggguccgggugccuggggcccgagcaggcguugcccgcuggauggagacaaugccgcugagcaaggcguagcccaccauggcugccaguccugccagcacagauaggaucugguuccggcgccgguauggcuccuccucagucucugggccugcuggugucuggcguugcggugguaccucagcugagggucaaggaaggaagguguguuaggagaacuaguucuuggaucccugcccacucuccccagggcugccccucccaucugccccuuaccuccaucccaggggaaguagagacugagaauguggguacaauaggcacagagguugugcagcccacgcagguggaccugcagcuucccacugggcagcuuugccugcagcagcagggccaaguagcugaagacgaaggcguccaaggaggcagggcuggagcagagagagaagggugggauggaggagaaccacugggguagaagggguaaagauggagcuggaggaagagucagccuugggaggugggcucugggcagcaggcggccaccagggaaggacaggacacacaguucuagaccugguauggggagagauccccagguggcgccagccuggcccugaauagggcucuaucccagggcugcauaaagggcacauucagugccccacagcucuucaggccccuccugugccuggcugcccucccacccuacccuuuuguaccucugagaaggcucuggcccccacacagucacacugucacuagggccaguuucuaucccagggaccuccuauccagagccugagccagccccagccccagccccagcuccagcugcuccaucugaaccuguaucuucuuccaagccacccauuacccucuuggagucagacucacgcaucuccaaagaagaacuuuugagagcccaggcgcugagagagcagggucagacacucccgagccucucgguacagcuguaggggcgacacagguaggcuugcagcugugggaacagugccaccuccccaccuaagcacucccauuccuggccagcauccuuggggcucaucucauacaauagcccccggucucagagcuaccuccuucuccagcucuuccucguccucaggccugugcuccccagucagcagcuguagccguuccauguacugccgcugcaugcggccaggcaggaagaaguugaggggaaagggcauagccucugcauaccacuuccgggucacuuccacguaguucuuggugucuauccaaaaaguauguaccuggauugggugggcaggaagaaacagguaggucugagccagugcaccugucugauucaaggugggcuucugacccccaugcuuuccugagccugugugugggucuguguguucccgaacccuccccggcuggccauggaugcugggaggucugggcacacucaccagcaccgggagcaacuucuccuccaggagagacaugaaggccagggugucugccccuugccgagcugacagaucauaaucagcauuguacuucuguggaggaaauauccauggcguggacacuagggagcugcaagggcacuucaccagggaggaaggaguccugucugguaccccccucacuggccucugagugcaguggagguacagcaaggaacuuuuccugccaaggcccccuugccugggcccagccaguagccuguugcuguuggcgaaaagccugggccuuggagccuccuggccgugaagguccagcgcccaaugcagggaaggaaggaaggcuccgccgcaaacuaggagcagcucccagaauuuccauggaaagcuggaacaacgcccgcugacggcaacuuucuaacaguaacuuccccgacccagacaccacaaagcuagcacaacggagcucagaugcaggcuaggacucgguccaugccucaggaaccagagaaagccauccucacacucccuggauccagggaacccacgcccagggccccccagcuuguucccucagugcccagcucuuggcuauuucuuucacuucauuccaucgcucagacaccauuaccacauacacauuccacccauacccccaggucucagccugcccuaccuucccaggcuccagucccuguuccucagcaucccccuccacauccugaguaagcuuuguccccagauaaccucuucagcaugauccuuaaaucucccuaagccucaguuucuccccuguggaauggggguaagaaucucuuucucugaaugccccuguguuaggaaauaauuuagaauacuuuggaaacuggaaaagcucuguucacaccuaagcaaucagggcaguggccucggcucugccaggaacuuuggcuuuuaucuggauccucucuuuccaggccucucaauuaauuccccagguccucaaccuuugggaaguuagaaaugaggaagaguguccuacuucugacacuguucccucuuggaaccugaccgucaaugcuagaagaacccuuggaaaacaugcuggcccagcccucuaguuuuacaaauaagggagugcacagcccugagagguuacauggccugcccgagaucacauagucaauggcagaguaaagagcauagccuaggccuccccacuccucuaguaaugcucuuucaucuucuccaaccuggcucuaagccuuguccauccugagccccauaucuagcccaaccuagucccugaaaacaggaaguggcccuuagaaaucucucuccagucccaccaucagaggccaacugcugucuuccacucuccuucagccugugcuccucucccucccugccucacagugcccuaaguuucaucucuugccgacugcuuuaauacaucacagugacauugugugugucucugccacaagacuguugcuccuugaugcucugggucaccugcaucuagcauggcauauaucuggugcucaauaaauguguauuguauagaauugacugaacuucucucacuggcagcccccucuauccaagucaccuaccucuuuucgaaggugggugaugaucuuguguggaacugagaugaccucuccaugacugguccgaagggcaggcagaguuccugauauugagagggaaguauaccaaccagacccuuagcugccuagucauacauaguugcaacacauuccugccuauuucuugcuucuccccuuguacacacccuuccuuacccccaagggauacuggguaccugaagggcucugccagggguugcugaucuuguguaccuucaguggagcaccaguaaaucuggcauaggucugcagggaaggaagcagaagucagagaggcagagccaugucccccacagugguaucaagaagagaaauaacauuuauugaauaccuuaugugccauucccuauacuuaguaucuuagucucgaaaaaaaagggggagucacuaccauuucuauuuuacaaauggacaacacagggcucagagagauuccggacaugucugugauuacaggacagccaggaaaauccuuuccucuaucuccucucuugccaucuaccuggugaacaucuauccucagaagcuuuuccuaaccaguaucccucuucuuggaagcacugauaaugcccuucucuuuggcaguaucuguggucuguuccuacuuuaacuuauaugugaauauuuuauuauauuuauuugcuuaccuaucugccuuucuguaaacucgaagggaggaaccaaauuuuauucaucuuugccuggcaauguuuaauauuuggaagaaaucuaauagauccucuuuaaagcaaggag

SEQ ID NO: 13680 - RNA, 23460 nt, Homo sapiens
cuccuugcuuuaaagaggaucuauuagauuucuuccaaauauuaaacauugccaggcaaagaugaauaaaauuugguuccucccuucgaguuuacagaaaggcagauagguaagcaaauaaauauaauaaaauauucacauauaaguuaaaguaggaacagaccacagauacugccaaagagaagggcauuaucagugcuuccaagaagagggauacugguuaggaaaagcuucugaggauagauguucaccagguagauggcaagagaggagauagaggaaaggauuuuccuggcuguccuguaaucacagacauguccggaaucucucugagcccuguguuguccauuuguaaaauagaaaugguagugacucccccuuuuuuuucgagacuaagauacuaaguauagggaauggcacauaagguauucaauaaauguuauuucucuucuugauaccacugugggggacauggcucugccucucugacuucugcuuccuucccugcagaccuaugccagauuuacuggugcuccacugaagguacacaagaucagcaaccccuggcagagcccuucagguacccaguaucccuuggggguaaggaaggguguguacaaggggagaagcaagaaauaggcaggaauguguugcaacuauguaugacuaggcagcuaagggucugguugguauacuucccucucaauaucaggaacucugccugcccuucggaccagucauggagaggucaucucaguuccacacaagaucaucacccaccuucgaaaagagguaggugacuuggauagagggggcugccagugagagaaguucagucaauucuauacaauacacauuuauugagcaccagauauaugccaugcuagaugcaggugacccagagcaucaaggagcaacagucuuguggcagagacacacacaaugucacugugauguauuaaagcagucggcaagagaugaaacuuagggcacugugaggcagggagggagaggagcacaggcugaaggagaguggaagacagcaguuggccucugauggugggacuggagagagauuucuaagggccacuuccuguuuucagggacuagguugggcuagauauggggcucaggauggacaaggcuuagagccagguuggagaagaugaaagagcauuacuagaggaguggggaggccuaggcuaugcucuuuacucugccauugacuaugugaucucgggcaggccauguaaccucucagggcugugcacucccuuauuuguaaaacuagagggcugggccagcauguuuuccaaggguucuucuagcauugacggucagguuccaagagggaacagugucagaaguaggacacucuuccucauuucuaacuucccaaagguugaggaccuggggaauuaauugagaggccuggaaagagaggauccagauaaaagccaaaguuccuggcagagccgaggccacugcccugauugcuuaggugugaacagagcuuuuccaguuuccaaaguauucuaaauuauuuccuaacacaggggcauucagagaaagagauucuuacccccauuccacaggggagaaacugaggcuuagggagauuuaaggaucaugcugaagagguuaucuggggacaaagcuuacucaggauguggagggggaugcugaggaacagggacuggagccugggaagguagggcaggcugagaccuggggguauggguggaauguguaugugguaauggugucugagcgauggaaugaagugaaagaaauagccaagagcugggcacugagggaacaagcuggggggcccugggcguggguucccuggauccagggagugugaggauggcuuucucugguuccugaggcauggaccgaguccuagccugcaucugagcuccguugugcuagcuuuguggugucugggucggggaaguuacuguuagaaaguugccgucagcgggcguuguuccagcuuuccauggaaauucugggagcugcuccuaguuugcggcggagccuuccuuccuucccugcauugggcgcuggaccuucacggccaggaggcuccaaggcccaggcuuuucgccaacagcaacaggcuacuggcugggcccaggcaagggggccuuggcaggaaaaguuccuugcuguaccuccacugcacucagaggccagugagggggguaccagacaggacuccuuccucccuggugaagugcccuugcagcucccuaguguccacgccauggauauuuccuccacagaaguacaaugcugauuaugaucugucagcucggcaaggggcagacacccuggccuucaugucucuccuggaggagaaguugcucccggugcuggugagugugcccagaccucccagcauccauggccagccggggaggguucgggaacacacagacccacacacaggcucaggaaagcaugggggucagaagcccaccuugaaucagacaggugcacuggcucagaccuaccuguuucuuccugcccacccaauccagguacauacuuuuuggauagacaccaagaacuacguggaagugacccggaagugguaugcagaggcuaugcccuuuccccucaacuucuuccugccuggccgcaugcagcggcaguacauggaacggcuacagcugcugacuggggagcacaggccugaggacgaggaagagcuggagaaggagguagcucugagaccgggggcuauuguaugagaugagccccaaggaugcuggccaggaaugggagugcuuagguggggagguggcacuguucccacagcugcaagccuaccugugucgccccuacagcuguaccgagaggcucgggagugucugacccugcucucucagcgccugggcucucaaaaguucuucuuuggagaugcgugagucugacuccaagaggguaauggguggcuuggaagaagauacagguucagauggagcagcuggagcuggggcuggggcuggggcuggcucaggcucuggauaggaggucccugggauagaaacuggcccuagugacagugugacugugugggggccagagccuucucagagguacaaaaggguagggugggagggcagccaggcacaggaggggccugaagagcuguggggcacugaaugugcccuuuaugcagcccugggauagagcccuauucagggccaggcuggcgccaccuggggaucucuccccauaccaggucuagaacuguguguccuguccuucccugguggccgccugcugcccagagcccaccucccaaggcugacucuuccuccagcuccaucuuuaccccuucuaccccagugguucuccuccaucccacccuucucucucugcuccagcccugccuccuuggacgccuucgucuucagcuacuuggcccugcugcugcaggcaaagcugcccagugggaagcugcagguccaccugcgugggcugcacaaccucugugccuauuguacccacauucucagucucuacuuccccugggauggagguaaggggcagaugggaggggcagcccuggggagagugggcagggauccaagaacuaguucuccuaacacaccuuccuuccuugacccucagcugagguaccaccgcaacgccagacaccagcaggcccagagacugaggaggagccauaccggcgccggaaccagauccuaucugugcuggcaggacuggcagccauggugggcuacgccuugcucagcggcauugucuccauccagcgggcaacgccugcucgggccccaggcacccggacccugggcauggcugaggaggaugaagaggaaugauuuguccucacgcucccaagacugguuuuucuacucucaugcauuccagaggcccccgugccuccucguuguugguacagccggacacggggugcugccacccagaauaaagccacucacacugacugggcucaaacauuuucuccuuuaagagcugccauuuuuccuggcuggugccauaggaaucaucugggugccugggcacacccgcugcugcuuuaaggcuuccgcccugaugcugacacugcugcuccacgggcccaguucugcaucuccaggaaagacaaacagucuccaguuuugggcccagcuuuccuagucucuucuuuuccuuacccucagcccugaucuuguguuuguacggacagugagcucacccuaggccuggacccaggcccaguuuccaaagcaagcagcacacagcgcauguucacauaagcaugggggcuggggggacacuggggcuuacugaucuuuuucuaggggccuccagccccuggcaccaccuagaggggaaagugagucacccaaaccauugccccugggcuuacgucgcuguaagcucacgcuggcccuguugugcccucuuuagucacagacagcgugugagcugacucugucccuuuaaugcccaggcugagcccagugccuccuugaguaucugcuccaucacuggcgacgccacagguaggugugaauggaguagccaggugagauugucuccaggaagcccacagcaggauccuugaugguaagaggcacauccuuagaggagcuagggagcagggaggagaagcugagagugugauccugccaaggcccccaacgcugucuucagcccacuucccagaccucaccauugcccucaccgguuuaggacgaccacaacaggagagccaucgggaugcaucagugccacugcguccgggucguucuucugacuggcaaccagccccacucucugggagcccucaggaaugaacuugcugaaugugggaacagauggucagagucccucgggguaccucccaugaaacccucaucuaagaagucgcccacccacggacccaccccauaacuccugcaaaggcucugcccuggcucucuaggccuggagccaugcugcugggcacugacccugcuuuucugcaucgcaguccagccucaggcauugggguuuucuguugcuaccuagucacuuccugccuccauggcgcaaaaggggaugggugugccucuuccgagguuccacccugaacaccuuccugcucccucgugguguagagugauguaagccauccgauguaggagaugauaggccugguauggaaugggggugcccgcccuccacucaccugaaguggccaaggugguagaacaugggcuguuuguaaaacgugugcuuggugaugucuacaaugauggguuccagucgguccagccgaccacaugguacaggagguucuaggguaaggacaaaggcaaagagacaaaggcgcaacacuggggguccccagagaguguagguaagggucacgugugggagaggcagcuguggguaggucagcccugugaggggcacauuccuuaguagcuaaggaguugggggugugaagauccaggcaucucaaggggagcugagaagucugaggcagcugcaagugccucaguaguugcaaaaggggcaaugaggugugcagaccugugaaggaaaggcaagacagggaaucaugguuccccagaguugcccaaaagggcaggcuaccuggggaaagcuggacaggaagggcuucuaucagucuuuggugagacuacuaaugggucugaggucuccuuugcaggaagggagacugggguggcuuacugugaugaugcuguggcuguacugcaucccucgaucccaggagccuagccgcacacucugcucccagaacuuggaacccacacaggccucugaggcaaagagcaugguguuggggaacagguggugugucucccuuaggguggcuuuggcuggagccagaaaguccagguaccaauguacagcaauaccaugaacauacuuagcugcuucugggucugucaguaccugcaaaggaagaacaagucacccuggacccugcccacaggcuucuggaacuucuaguuccucuuguaggaauccugaauuagguggugggaagaaugcaacuacagagguuuugggagggauuuuuuguuuuuguuuuugagacagggucucccucugucacacaggcuggaguacaguggcacaaucauagcucacugcagccugaaauucuaggcucaacuaaaccucccgccuuagccuccagaauacuugggacuauaggcgugccaccaccacacccggcuaacuuuucuauuuuuuuuuuuguagaguuaggguuucaccauguuucccaggcucaucuugaacuccuuagguucaagugauccacccaccuuggguucccaaagugcuggaauuauagccaugagcuaccacccccagccuagagagguuucaagucccaacugugggauccauggcacccuggaggucccggggaauggugcucuaggauccauaguuggguagaaaaaucccucuaaguuugggagccaaucauuuggaugcuggauuugaaggucacuggagcaccauggagguccaggccuuaccaccuuugcccaguggggcagcagcaagcguuggucauccagcaugaguaggcggacauuguggugaguaccguuggcaaggguaggaccuaggucacgggcaaugaagucucgcugauguucaggggugaagcccaggcacuggaagggguauccacucaacagcccagcagaaggcucauuuucagcugucacugcccagaacuguaacuugugcucagcauaggcauccaggaaccuggcaagagaaaggucaugaaugauccagccaagaaagugggccagaccgagagaacaggaagccugauggagugggcaagacugacagauccaaguuugaaaggcccagaagguagaaaggugagcugaggacaggcagaucuggaaguggaaccagguugaggguugggacacagaucagcauggccaaaggggaggccaguccugaucccacauccuugcugaucccuuacuucacaauguaucuggcccaggucuggugguagaugucucugggcugucccuugaguggccccuucccauuccccgcucccuuggucuugagccgagugggugauguccaggggcuggcaaggagugaaacgggacgcugggccaacugcagggcucggugaaucagggguaucuagagacaaagguagugaagagagaagcacccagaguuggaacacauacuagcccaaccagugcauccgguucagccauuagcccccacccucccacccccaggacaaaacagcaggggacaaaaugucuguacaagcagaccuacccuacaguuucucaacccccagacaucagggcccucagggccugaaaaagcuagaaugccuaccuugagcuugguaucuuccucugggaggcugaaguugugcaacuggaaaucaucaggggugucugcauagguguaggugcggauggagaagucacagcuggccauggguacccagaugauguuauauccgauuccuacagaaaaggaugaucaagauaugguaguccgagucaauaggagaguaugggacucugcuuaucacuugccaguccuaauagugucugagucagggccaaaaggaacuugggcuccuggguuggaaccuguggaggcuggcaccugggugaagcgcaggccuuucugagccugaguccguagcaguuagcagaugauaggcggcgaaaucuuauuucacuggcauuaagacaggaaccaaaugucagggaugggcagaagucaggguccaaagaauuggcaaagaaaagugucaguggcucuaugucauccuguccccuuccuccucaucuucuucagagaaguaccauuuaaguagcaaauucugggcagggggugacagggcaaggauguugagggcaccugcaucugucacggccccuccaaaucccuucacuuucuggaacuucuggcugcaggaucaguagcaggccugaggacauccacaggguuaucagugcccaggggagaaacuccauggugaucacugacaccguuuaccucuaggaggacccagccuggcccggggggugaaggguguaaugguuaccugugccggugcaauuagccuguaugguccuguacucagcuccauccaaugcccacugcuucugcucuuguagcggcugaaggcaccuagggcaggaaaggucggggggucaagagucacaguauguggcauugcagacacagaccaccgagcuguacugaagcuuuuagggaugcaggggcaccaccugggagggagggagcacaagcagaggugaggucugacaaggauguggagaacggacacagcuguuuggagagacugaagacgguuucaaaaauccucaccccaaaguuggucucagucacucaaaaggauuuauugagcaccuacuaaaagucuaccaccagcuuacuggaaggcuaccaaaggacuaugaggcagaagggaggcucugugcuaccuccccacugccuugacucacucaucugaugcccacgacacugccugaaguagaagcaauccugugaggcugccagccaugaugcuuacccuacccgaaggcuugggacauuccugaggacagaaugaggaaugacugaaaagcaagucccucuccaccccucaacuacucucccgggcagggcuuagcugccuuugggugcccauggccuggucucccacauucauuaggacaaggcccacagacaccugggugcagcucucccugcaacccuucugaugacaacucucugcccaccccaaaucaggaugcuccccaccacucuucccacccauuucaacuucgaccccucccuccaucugugccuugcucaaagagccaugauggcccuggauucaaagagagucugucauucauuaaauuccagugccaggauuccagaagcacugugacaaugcugauugggagcucucucucuuaccucucuggaaggacuugaaaacuccaucaccucagggucacuagaugaggagaagagcacagggguuccagagucucugaaggauagaggauccacuaaacaaaaacaaggaugcagguaccugccauagcuauaggcacuagguuacuccugcaaguaauucuggcuucccaauguggaugggucaugugaugacuaggagagucacaugacacaggaagugaggcaauugcagccauauuucuaaagggcaauuggcuuccuccgaguuguuacagauuauacacccuauaaaauucuggaggguauaugugaaugacaacuuuaggaagagccuagaauacgaaagacagacuuggauggagaaucggguaaagauuccuaaaucccagaggaugggaaccacagcaggcacgcugcuuuuuugauaaaaauuucaaaaugauacaaauaaagcuaauaccaaaaaaaaaacaaagaacaaaaacaaaaaaaccuucauugcacaacaugcugaggcuaccgugauguuuaagacacagucuuugcccuauagaggugcaugaagcauggaagucagacacagauauuuacagguaaaaacagaaacaguaacaggugugcauggagagcucucugagaugaggagggaccauucguggguggggaauuauccaggaugccuucaacacaggaaaaagugagggggguuauuagccagugaaguguagggcgcaaggagggugggacacuggcagugggguggcaggacuggagggaggggaguggucagcuuggcuccccugcagcaccccucauuuacucauuaagggccucggagagucacaugacacaggcagugaggcaauugcagccauaucucuaaagggcaauuggcuuccagaugcagauuguaauaacuguucuuccuuccucacaggacagugagguuuuaaaguaguucagaaaccagaaaguguuguaaaaggccauaugcuuaguggacaugugaaggaaguuguccaugccauuugccucaugaaccacaucaaaugagauuuggugggaguggcacacacagucaugaccagacuaaccccagcucucagccuauuuccucaccuagaaaauggaggcaaugccacaaccucaaaggggucagugagguaaaugcagugccuggcaacuugggaggcgccugggaacuauuugucuguuguuuguaucuuuuuuuguacaguuuuagugagacggcaagguuggaauccuugcuacaccauuuacuggcuguuugaccuucaguaaaucaaucacucuaagccucuauuucaucuauaaaaggggagugauaacuccuaccucauagaacuguugugagguuugagugugauaaugugucucuaguacacugcuugacacuaaacauugcaacaugucaggccucuguuccuggaguuccuugaaggaaugucuuacacauucuaaauauccuuguagacagccuggcacagggguaguugucaaguuguagaauugaacuaguugcuucacuaugucaguagccaccccuuccagacuuccugcuuuucucuuuuuuuuuuguuuuuuugagauguugucucacucugucacccagucuggagugcaguggccgaucucagcucaccgcaaccucugccucccagguucaagcaauucuccugccucagccucccaaguaguugggacuacaggcacgcaccaccacgcccggcuaauuuuuguauuuuaguagagaugggguuucaccauguuagccagacuggucucaaucuccugaccucaggugauucgcacacuuuggccucccaaagggcugggauuacaggcgugagccacagcacccggccugacuuccugcucuucaaggaaacguugcacaggauuuguucuggguagggcagguaauuaucuaguaccuuacuucccucaaauucauucaucucacagauauuuccugagcacauuccacauuugccucuccugcuuuagcgaguuuagaaguucaaccaucuccuuucucuuacccucuguguacagggagugagcugcuucuuuuuuggccagguacugagcaaaauuuuuuuuuuuuugagacggagucuugcucugucucccaggcuggagugcaguggcacgaucucggcucacugcaagcuccgccucccggauucacgccauucuccugccucagccuccugaguagcugggacuacaggcgccugccaccacacccggcuaauuuuuuguauuuuuaguagagacaggguuucacuauguuagccaggauggucuccaucuccugaccucgugaucugcuggccucagcuucccaaagugcugggauuacaggcgugagccaccacgcccagccuagugucuguauuuuuuguagaaauagggucuugcuauguugugcagguuggucucaaacuccuaaacccaaaggaucuccugccucggcuuugcagaguucuaggauuacacgcacaaggcaccaugcccgccccucuuuucuucuuuuuauacuucauuuuguaaaauuuuuccaggguggcugggcacgguagcucaugccuauaaucccagcacuuugggaggcugaggcaguggauagcuugaggacagguguucauggccaacauggcaaaaucccaucugaaaugaaaauacaaaaauuagcugggugugguggugcacgccuguaaucccagcuacuugggaagcugagguacgagaaucacuugaacccaggagucagagguugcagagacccaagauugugccacugcacuccagccugggagacagaguaacacucuguuucaaaaaaaaaaaauuuccaagguggauauuauuucacauuucauauuuccuguacaaugugauuuguccuugaggauuuucuauuuuauuuucuaaguaaaguuaguuuuaauaaggacuaauguuuauugugccaaagacaaaauuacaacaaauuuaacgaucucgacuggauuccuuccuuccugccuuccuuccuucuuuucuccucuucccuccccuccccucucuucucuuuuuucuuucuuucccucccucccucccucccucccuuccucccuuccucccuuccuuucuuucuuucgacggagucuugcucuuucacccaggcuggagcacaguggcuugaucuuggcucacugcaaaccccgccuccuggguucaagcgauucuccugccucagccucccgaguaccugggauuacagacgcacaccaccaugccuggcugauuuuuguauuuuuagucaagacgggguuuuaccauguuggccaggcuugucccaaacuccugaccucaggugauucacccgccucggccucccaaaguccugagauuacaggcaugagccaccaugcccggcccugauugggcuuuuucuacaaaaaauucuugugaaacuuuucugcaauauuuuauaauaaaguccuacugauuuauauuugauuuuauauuuguaagucaggugaaaugagugaauucuuccuuguguaugaauguacuacauguugcagaaugucuaccuuuccugggcuccauccacuaaauucucaaagugccuccuaaucauugucucuauuaaagaugccccacaaauuuccaaaaugccccuagggugugccugagagccacuacccuaggugccucucuucaaacaccuaggccucacugcaguggccaauaggggcauacuagguggccacaaucacguuccucuguccccuuuguauagcacuugaaaaagaguuugcuaaggccugguacgguggcucaugccuguaaccccaucauuuuaagaagcugagacaagaggaucccuugaggccaggaguucaagaccagccugggcaacauagagagacuccgucuuuacaaauauauauauauauuuauuuauuuauuuuuauuuuuuuugguagaaaaggggucuccaguggccgggcgcaguggcucaugccuguaaucccagcacuuugggaagcugaggcgggcagaucacgaggucaggagauggagaccauccuggauaacacagugaaacccugucucuacuaaaccccaucucuauuaaaaauacaaaaaauuagccgggcaugguggugggcaccuguaauccuagcuacucgggaaucugaggcaggagaaucguuugaacccgagguggauguugcagugagccgagacgcgccacugcacuccagccugagugacagagcaagacucugacucagaaaaacaagcaaacaaaaaaagacagcuauauaccuagggaagacauaaauauaagugaaaagcagaaguacaaaaauaguucggcugacccagcagcaauuuugaucccaucccagcaagaccugucuuggaguguaggucuggcucagauagcaaacuccagcccuuucacacugacagguaucauaucacaggcuccuaggucuuuaggucccauggagagugccacucccaguuccacuguuaguuacuucuauggucuguguucaagucaaauaaagacauuuguucauuccaugcacagcacagaguaggugcucaaaaaaguacuuuuuauacagaugaaugaacaacuacuaccaguuaaccuagaaccuguccuuucagcucuaguuuuuaauuguaauuuuauuuuauuuuagagacagggucuuggcacaaucacaauucacugcagcuuugaccucucaggcucaauuggauccucccaccucagccuccauaguagcugggacuacagguacaugccaccaugcccaacuaauuuuugaaauuuauuuuuagagauggggucuuccuauguugcccaggcuggucucgaauuccugaggucaagcaauccaccugccucagccucccaaggugcugggauuauaggcgugagccaucacucaccucuaguuucuggccugaggguauauuacucucccugauuacugacaccaaaaaugauuucacucuugggugggaccucugcugccccuuacccacuaggguguggguuuuuuugguuuguuuuugucuuuuuuaagacagggccucacacugucauccaggcuggaaugcaauggugugauccuggcucacugcagccucgaccaccugggcucaagggauccucccaccuuagccuccugaguagcugggaccagaagugcacaccaccacaccaagcuaauuuuuuaacuuuuuauagaaacagguugccuagacugguaucgaacuccugagcucaagcaauccucuugccuugguuucccaaagugcuggaauuacaggcgugagccacugagucugaccuuagggugugguuuuaccauuggauucaugugauuuaccaaugcuucaacaguaaccacaacauucaauguacagcccagugcagauggaagguccuuguaccucauaugaucucuuccaauuuuucgcaagauaauagucagucuuucaugagugcuuauuacaugcacuagccugacaacucuacauuacagauaagaaaauuaagacuuagaggccagacgcgauggcucacaccuguaaucccaacacuuugggaggccgaagcgggcggaucacaagguuaggagaucgagaccauccuggcuaacacggugaaaccccgucucuacuaaaaauacaaaaauuuagccaggcguggcggugugcgacuguaguccccgcuacucggguggcugaggcaggaggauggcgugaacccgggaggcggagcuugcagugagccaagaucgugccacugcacuccagccugggugacagagcgagacuccaucucaaaaaaaaaaaaaaagaaaagaaaacuaagacuuagagaaguuaaauauguggcagagugaagccuaagcucauaucuguccuaaucuaaauuccaagcaguucugagucaucaggucacacagacugcuucucacaugcuucaggaaugccuuuucagucuuccuuaaagguugcaaacaguugcaaagcaaauuucaugguuccuguuucuucaaaaucucaaagcucuucauucagccaggcauggucgcuggagcguguauauucaaccacuugagaagaugaggaucuuuugagcccaggaguuugagacgaaccugggcaacauagggaaagcccugucaccuaaaaaaauaaauaauacaaccagcucuucauuuagaggcaagcacaaaauaggugcucaauguuuguugaaugagugaguuguuaccaaccauaccccauuauucaagguccugcuugucaguguuucaggaaguguucuuggcaaaggaguggugaacuucaagaagaaugaugcugacuccgaacacaauuauuuauuuauuuauuuauuuauuuauuuauuuauuuauuuacuuauugagacagagucucgcucuguagcccaggcuggagugcaaugacgugaucuccgcucacugcaaccucugccucccagguucaagcaauucuccuccuucagccucccaaguagcugggauuacaggcgcccgccacuacgaucggagaauguuuuguauuuuuaguagagacaggguuucgccauguuggacaggcuggucucaaacaccugaccucaugugauccacccaccucggccucccaaacugcugagauuacaggcuugagccagugugcccagccugaacacaauuauuaaagucaaagugagaccuaacaguggaacuuugguugcggcuacaggaaauauggauucaaauacugaacaccagcugggcacaguggcucacgccuacaauccuagcacuuugggaggcuaagguaggaggacagcagagcccaagaguucgagacaaaccuggccaacaugguaaaacgaaaaaauuaaccaggcauggugaugcacaccuguagucucagcugaggugggaggaucgccugaauugagguaguggaggcugcagugagcuguguuccugccacagcacuccagccugagcaacagagcaagaccuugucucuaaauaaauaaacacaacaaaaauaaaacaaauacugagccaggugugguggcuccugccuguaaucucagcacuuuaggaggcugagaugggcagaucacuugaagucaggaguucgagaccagccuggacaacaugaugaaaucucuacuaaaaauacaaaaauuagcugggacugauggcgcuaaucccugcuacucaggaggcugaggcagaauugcuugaaccuggaaggcggaggcugcagugagccaagaucacccccacugcucuggguugcagugagccaagaucacaccaccugggugacagagcaagacugcaucucaaaaaaaaaaaaaagaaagagaaaagaaaagaaagagagagagagagaaggaaggaaagaaagaaagaaaaagaaaaagaaagaaagaaagaaagaaagaggaagaaagaaaaauaaaagcauagagagugcuggagcagugugagugagauggauagugguaaaaggugaccuuggaaaaggaaauugggaggccagauuguguagggucuugguggccaugguaaggagucugaauuuuguucuaagauggaaauucacuguagaguuuggugcugggaagugacaagaucacauguguauuuuuaagagaucacuuugggugcuguguagaaaucagacuguaggagucaaguguggagggagaccagcauccaauuacagccugccaugaacuugccagguuccucuucccuuccuucagcacacacuacucuuucccaccgcuuagccuaguuaacacuuauucuuucaaaauuagcccggaugucacuuucucuaagaacaaccgcgcccccugccgccuccccaccucacacaccuccucuaacgcaaacucauagcccucacaacuucuuugucacuuuuucucccccuuuuuuugagacaggaucucgcucuauuccccaggcuggucucgaacuccuaggcucaaaagauccucccgccucagccacccgaauagcuccuuugucgcucuuaucacuguugugauuaauuguacaaauggcuuaauggcaguuauagcgcccagcucaucaaaggcaguggccugccaaucgucagcgggcagggcagggaccaguccaguccauccuggcucccaugugcagccccagugcgcaucgcgacaccggcgcucguugccgcgcuccgugaacguuugucacauguccgaagaaugaaugaauuauauaccuuucuucccacuccagcccucaaaaagcaaguggauacaaagacuugaagauuuuauaaucgcuucauuaguaaaauuugaccauccuuaccauuaaaaauaaugauaaugaugaaaaaggcuaagugcgaacgccgggaggggagagcuaaaauucaaagggcgaaauauuuauaaugccuaccgucggcgaagagaaacagcagccccaaccgaaggcaaaaggaaaucccaccgcagccuccaaaggcgcgugggcgggacuggagaauggggcccugcgcacuaggcgcggaagucaagaagcagccccaccacccgugccgcgagaaaagcagcccuggggaggcggggcggggccucacuuggaaaagagacggucacucauccagaggcgggacucagagccccuccacaagucucauugguccauuugaagacggacaacucucccugaccauccguagcacagacggggcgcaagcguauuggaaagggagcgggugccagacgcgagaacuacgcaugcgucucagcgcuuucccgccagcacacccuuagugggugggggggggcgauugaauucccacagugaguccagcccaccgaagcugagaggauuccuaaccuuccucuucagagagccucagguuagggaacguccagugcccaaaagcugcccugugggaaucccauuguccaccgccucuuaccuaauguuucguucuggccuugccccaucucuuccugaggcuggguuguuacgauggugaauuauucaagaugucuugcagccugacgccaucucugggcagugcuccugcauccucccugucuuccuugggagggcaccacguugcucuuacaagcacaggguccugaaacuguuuacaaggccccacucugccacguuaguaucuuaacgaguguuuguugaggaagcacuguguguuagacccagugcaaugagcaagucccugaucuugugaccuuacauucuacaggacgacacaaacguauaaacaaaaaauaauuuuagauagugauacaugcuuaaaacauggcuauguggccgggagcaguggcucacgccuguaaauccaacauugugggaggcugaggcagguggaucacuugaggucaaggaguucgagaccagccuggcuaacauggcaaaaccccgucucuacugaaaauacaaaacuuagucaggcgugauggcagacaccuguaaucccagcuacucgggaagcugaggcaggagaaucgcuugaacgcaggagauggaaguuugcagugagcccagaucacaccacugcacuccagccugggugagagagccagacuguaucucaaaaaaaaauaaaauaaaauaaaauaaagcuaugugauagaaugacugcgauggggauuagguccucacugaaauggugagaguggaguuaaaaccugaaauuaggugacagcaccagauauaucugcccgaggguuucgugcuuggaaaauagcaggugcaaacguccuugugcugugaggaaauuuggcuggaacagaaggugggccagauuguagcugaccauagucucugagagcuuggagaugauucuaaauacaaugggaagccauuaaauugaggcagagccuugaugugacgugcuuuaucaucauuuugcugaguggagaauggauugcugggaaaagugaaagauugauucagagguuguggagagaggguggcuggaacuagguagcuggggagguggugggacguggaugaauucaagauaggauugguuguguuggauaugggaaaagaagucaccaugguuccugggcuuuuggaaugugcaaauggguaauggaggugccauugagaugggaacaguggaaaaauaaccggugcuggggugggaaugaagagcucaguuguguggccgggcgcagugacucacgccuguaauuccagcacuuugggaggccgaggcagggggaucaccugaggucaggauuugcagaccagccuggucaauauggcaacacccugucucuacuaaaaauacaaaaacauuagccggguagcggggccuauaaucccaucuacucgggaggcugaggcaggagaaucgcuugaacccuggaggcagagguugcagugagccaagaucucgccauugcacuccagccugggcaacaagagcaaaacucugccuaaaaaaaaaaaagaguucaguuaguucaguuguggccauguugaauuugaaauacucauuagacauccaaccagauaugcugaguuggauggcgcucaagagaggucaaggcuggacuuaugcauuaacacauagaaagaugguacuuaaagccauggacguuaguaguagggccaccuacagaaagaguggaaguagaaaagagggcuuacggugggcaaugugguucacgccucuaaucccagcacuuuggaaggucaaggcaggcacaucauuugaggucaggaguuugagaccauccuggacaacauggugaaaccccgucucuacuaaaaauacaaaaacuagccgggugugguggcaugcaccuguagucccagcuacucaggaggcugaggcaggagaaucgcuugaacccaagaggcggagguugcaaugagccaagauugcacuguuacacuccaaccugggugacagagcaagacuccauuuaaaaaaaaaaaaaauugauggccgggugcaguggcucaugccuguaaucccagcacuuugggaggccgacgcaggcagaucacgaggucagcagaucgagaccauccuggcuaacaaggugaaaaccugucucaacuaaaaauacagaaaauuagccaggcauggugacaggcaccuguagucccagccacucaggaggcugaggcaggagaaucgcuugaaccugggaggcggggguugcaaugagccgagaucgcaccaugcacuccagccuggcaaaagagcaagacuccaucucaaaaaaauaaauaaaauaaaauaaaaaugacggcugggagcaguggcucacgccuguaaucccagcauuuugggaggcugaggugggcagaucacgaggucaggagaucgagaccauccuggcuaacauggugauacccugucucuguuaaaaauacagaaaauuagccaggcaugguggcaggcaccuguagucccagcuacucgggaggcugaggcaggagaauagcaugaaccugggaggcagagcuugcagugagccgagaucgugcaacugcacuccagcccgggcaacagagcaagacuccgucucaaaaaaauauauaaaaaauaaaagaaaagaaaaaaaacaaaaacaaagaaggcuuacgugagacccuuggggcccucuacuguuaaccaguucaggagagguguaaaaguuuguaaaggauaaccagagcacaaaguagaagagcaauguccucaaagggaaaaauucaagaagaugcugauuauggagauuaauugcugcuucaaggucaagugaaaugcaggcagagaaauggucacugggucugacaccacuuuuggucacucaaauuuuggucagagcaguggcugaagaaacacaggggaaggagucugaugggggugggugauaagagaauggauguuuaaguguggagggaagaaaaagaaaaccuauugcuaugaaaaggagcagagauagaauucgugguuggaaagugugucuugaaaguuucuuuuuucuuaaaaguuucuugugcaccauauagcacaagaucagcaaccccuggcagagcccuucagguacccaguaucccuugggggugaggaaggguguguacaagaggagaagcaggagauaggcaggaauguguugcaacuacguauggauaggcagcuaagguccugguugguauacuuuucucucaguaucaggaacccugccugcccuuuggaccagucauggagaggucaccucaguaccacacaagaucaucacccaccuucaaaaagaggugggugauuuggauagagggggcugccagugagagaaguucagucaauuccguacaauacacauuuauugagcacuagauauaugccaugcuagaugcaggugacccagagcaucaaggagcaauagucugguggcagagacacacacaaugucacugugauguauuaaagcagucggcaagagaugcagcucagggcacuguggggauauccagaggcacgguaccuucugccugucagucagggagggagaggagcacaggcugaaggagacuggaagacagcaguuggccucugauagugggacuggagagagauuucuaagggccacuucuuguuuucagggacuagguugggcuagauauggggcucaggauggacaaggcuuagagccagguuggagaagaugaaagagcauuacuagaggaguggggaggccuaggcuaugcucuuuacucugccauugacugcgugaucuugggcaggccauguaaccucucagggcugugcacucccuuauuuguaaaacuagagggcugggccagcauguuuuccaaggguucuucuagcauugacggucagguuccaagagggaacacagugucagaagugggacacucuuccuaauuucuaauuucccaaagguuaaggaccuggggaauuaauugagaggccuggaaagaggauccagauaaaagccuaaguuccuggcaaggccagggccacugcccugauugcuuaggugugaacagagcuuuuuguuuccgaaguauucuaaauuauuuccuaacacaggggcauucagagaaagagauucuuacccccauuccacaggggagaaacugaggcuuagggagauuuaaggaucaugcugaagagguuaucuggggacaaagcuuacucaggauguggugggggaugcugaggaacagggacuggagccugggaagguagggcaggcugagaccuggggguauggauggaauguguaugugguaauggugucugggcgauggaaugaagugaaagaaauagccaagagcugggcacugagggaacaagcuggggggcccugggcguggguucccuggauccagggagugugaggauggcuuucccugguuccugaggcauggaccgaguccuagccugcaucugagcuccguugugcuagcuuuguggugucugggucgggaaaguuacuguuagaaaguugcugucagcaggcauuguuccagcuuuccauggaaauucugggagcugcuccuaguuugcggcccaaccuuucuuccuucuucucaaugggcccaggaccuugacggccagcgggcuccaaggcccaggcuuuuugccaacagcaacaggcuacuggcugggcccaggcaagggggccuuggcaggaaaaguuccuugcuguaccuccacugcacucagaggccagugagggggguaccagacaggacuccuuccucccuggugaagugcccuugcagcuccccagcguccacgccauggauauuuccuccacagaaguacaaugcugauuaugaucugucagcucagcaaggggcagacacccuggccuucaugucucuccuggaggagaaguugaucccggugcuggugagugugcccagaccucccagcauccauggccagccggggaggggacgggaacacacagacccacacagagacucaggagagcauggaggucagaagcccaccuugaaucagacaggugcacuggcucagaccugccuguuucuuccugcccacccaauccagguacauacuuuuuggauagacaccaagaacuacguagaagugacccggaagugguaugcagaggcuaugcccuuuccccucaacuucuuccugccuggccgcaugcagcggcaguacauggaacggcuacagcugcugacuggggagcacaggccugaggacgaggaagagcuggagaaggagguagcucugagaccgggggcuauuguaugagaugagccccaaggaugcuggccaggaaugggagugcuuaggugcggagguggcacuguucccgcagcugca

SEQ ID NO: 13681 - RNA, 13628 nt, Homo sapiens
cugcccuccccugccugggcccgccccccgccaccgccccuccgaucguugcggucagggggccuggggagauccccggggaggcgaggcuucuucuggcccgacuggcagcugaacugcgggggacugggccgcgggccucgggggagggcggccgccggcccauccagagguggcccacguagcgggacagcgcugucggcccggcgcgccucggagugucacggcgccucguccaaguggagccccgaaccccugaaggcgcggcaggcucuggagagcggggucuugugcgccugggccaggucugggggcucuugccaaacugcacguggccuguacugcuccagggccccuuggggcucguccccgagcggggacugcgggggggucccccgagcagcauguuuuccacagcgcguuauguuuggagcgggcccugcgccgccugucgccauggaaacaaaacaggggcgguggcggcggccggagcggaggccgggcuggggcuugggugggggaggggaagagaggcucgcaggcugucgcuuaggugacgggaacucaggcgccccucugcuucauccgggucacggcccguccgcuaguacccacaguguuccacagucugguccuuggcuccucgccuguaccccuggucuucugcgccugucccuggugucccuuuccucuuuuuugguuucuucacucugaccucacugaccacugcuuuagauucucccuucaguucccgucagacgcuuccagacucccaagcuuuccuacgaaugagggaaaauggagaaacaggcacuugucaggggaccccccacccuaauaaagagcacuugcuccgccagaacagcaaaauucaugccaugugggcaucccugggcacuauagcaagcuaguugcggccacucccuuggcauccuuuccugccagcuguggaauaaugcccacugucuagcacugccccugccagggguucuugccuuccacaaucguggcuuccagaaaacaguggcauucgguagcgcugugugccgagacccccaacaaugaugacugcggagagggaggcaccugggggaggaucauuagggagagguagaaagcagggaggccuccaggauucuuucccagugccccugguucccagagcugaugaugccuccagggugauuggcagcucuuuguuucagcccccccucacccgccugcuggcccccccuccaauucugucccuccgccccccggcuccugcucucuccgccuagccuuuuccccucccagcugccugccugccagggguagugagccggcugagaggcauggagacgcaggaacuucggggggcccuggcucuucuccuccuuugcuuuuucacaucugccagucaggaucugcaggguaagccugucuccauccucuuagaccgcucucugcuucuuccccauuugcccucagcccaaguagcagagaacaugugggcaaggggagaggggaagaguccagaaauugagccagaggaaaacuuaagacugccuagaguuggugaaauuauggccugguggagaggagugggcaccggagaguagugggggagcuggaacaggacagggucaggcaugaggccagggcagaggacucaggaacuggaugcucaggcugccuggcuggggugguuccugagcaucuguaggcacccuagggucugggagagcagccugaaggugggcguacuguaggucccugggcuucgucccccugggcuccuggcugcccaaggacagggcggggguggggaccaagaagccugggcucucccggaggucugguggugggaugggccgauggaugugggagagguagcuggagcagaugacacaggcauagauucuuuacuggcuggagggaaaaccacagauuggccaggacacaggaggcagaggagcuggguccuacauucccgugggagauagcccagauggugggaggguuagaguccucagugggcagcuguucuuauccagagcgagugugcugcgccccuaggaugggaggaggggaacuaggguguggaacgagccaaacccaggaguggaaagagaagcugccuuccauuucuacguuguggacaccaggugccacuccugugggggaucagcacagcaucuccuuugcgccaccuggugggggcaucucaaauuuguggggugcuguuucuguguuuccaagugagucucaaaccugcagguuccuggaagguaguaauaggcaauaauggggaaaggaaggcacagugccucuguccucugagagcaacaaggguugagguuuuuuuuuguuuucguuuugucuuuuugagauggaguuucacucuuguugcccaggcuggagugcaauggcgcgaucucggcucacugcaaccuccaccucucagguucaagcgagucuccugccucagccuccugaguagcugggauuacaggugcccgccaccacgcccggcuaggugguuuuuuuuucuuuuuuguuguuguuuuuguauuuuuaguagacacgggguuucaccguguuggccaggcuggucucgaacuccugaccuuaggcgauccaccugccucaaccucccaagguguugggauuacaggugcgagccaccaugcccagccaaggguugaauuuugaggugacuaacgcugccuggugguggggguagggggugaugugggcucgggggagggcauaccuuagcauuugaucccauucucuaaccuugauaaccccugccugaccaguaauugaccugcugacugugggcgagucucggcagaugguagcuguggcagagaagauccggacagccuugcucacugcuggggacaucuaccucuuauccaccuuccgccugccccccaagcagggugguguccucuuuggccucuauucucgccaagacaacacucgauggcuggaggccucuguuguaggcaagaucaacaaaggugacuggugggcaucuccuuucuugcaauggugaccuccuuaagcacucucccucaucccuacuucccaagugcuuccucauucuccuuggccuccauuagggaccaaggucccaucaggcugugcccagacaucaggggcaccugguauggggugcuuauaaggugcuuuaggagcccauguaccaaacaauagggugaggcuugaguccugauauuuauagggaugggagguuguacuuggggaugccuggaaggagggugaggcaugucucugugccucagcggugauacagaaaggucuuucagaucccuggaacaggucaguggccacaaaaccagcugucacccuaggagaggauacagucaucugauaccaaugaagacuaagaaaguauuugucucuaaaccaauuauuuuuuuaaauggagucuugcuuugucaccuaggcuggagugcagugguacaaucucagcucacugcaaccucugccuccuggguucaagcaauucuccuaucucagccuccugaguagcugggacuacaggugcccaccaccaugccuggcuaacuuuuguauuuuuaguagaaacaggguuuugccauguugaccaggcuguucucgaacuucugaccucaagugaucugcccaccuuggccuucuaaagugcugggauuacaggugugagccaccgugccuggccucuaaagcaauuucaaaaacauuuauuguguaccuauuaaauacaagguguugagagccacauaguagaauuagggauaggggcccuagagaugugguaucuagcagaguugauccaaggcucagcugggaggcagggggugggggauagcgcccauacugaucuccccuccugggcaguacuggugcgauaccagcgggaggauggcaaaguccacgccgugaaccuacagcaagcgggccuggcugaugggcgcacacacacaguucuccugcgacuccgaggucccuccagacccagcccugcccuacaucucuacguggacugcaaacugggugaccaacaugcaggccuuccagcacuggcccccauuccuccagcggaggucgaugggcuggagauuaggacuggacagaaggcguauuugaggaugcaggugagccgggaggagccucugaguucuguggaaauagaguuugcaccagcuggggaagggguugguagaccuucccaccuuacucugcugcuauccccccagggcuuuguggaaucuaugaaaauuauucuggguggguccauggcccggguaggagcccugagugaguguccauuccaaggggacgaguccauccacagugcagguaacacagagacuuguuugcugacauuggaccacggauccuguggccuuuggugacuccugucuucuugaucucccucucccuuaaaacccauuccuuuggcucaccuguuccuaggguuucuaacccuguuauuccaaaucuuucaccugacuccacaaucuccaauacacccauccgagaaaaaaagugaucuaagagaagaauugguuaauugcuuggccuuggcugaccaagagauacuggucucgaguauuuuuuuuuuuuuuggugauggagucuuguccuguugcccaggccggagugcaguggugcaaucugggucacugcagucuccacugaguucaagugauucuccugccucagccucccaagcagcugggauuacaggcgcccuccaccaugccuagcuaauuuuugcauuuuuaguagagaugggauuucaccacguuggccaggcuggucucaaacaccuaaucucaagugaugcacccaccucggccucucaaagugcugggauuacaggcguaagccaccgcgcccggccuggucucgagucuuuuauaguucucacuggcagcugucaccagcaauuucucugaguguugcccaucugccuggucucucugacagggauguucagaagcucucaccuaaauaaaagacccaccuuucccagauauuugagggagagcucuugaagaagggaaugggauggcgggugugguggcucacaccuguaaucccagcacuuugggaggcugaggugggcugaucccucaagguccggaguucaagaccagccuggccaacacugugaaaccuccucucuacuaaaaaauacaaaaaauuagcugggcaugguggugggcaccuguagucccagcuacuugggaggcggaggcaggagaguugcuugaacccaggagguggagguuguggugagcagagaucacgccacugcauuccagccugggaaacagagcaagacuccgacucaaaaaaaaaaaaaauggggauauacuggggcccuggcccugcuuuggguccaucccuucugccacuaccaugccuaggaaccaggaggauuuggguucuaacuuccugugaagcaacucccuuagagggccuuuugccccauagaaggagcuggcacugcuugucugccagcucugcccucccagcauccagcaccccaucuuuauucuggggcuccagcccugucccuguccucaccuuccuuccuccuucucaccaaccaggccucucuucacuucaccucaccccucugacuauguuuucuucuccucuccagugaccaaugcacugcacuccauucuaggugaguaggccacacugaagcggaagcggggagcggggaggaggccccaggcucuggcagcugccugaaacuaaguccucuucagucaggaauguaguagguuuaaaggcaggggugggcagccguggcagguacuggcuuauugcccauggagggcccaggacuggugcuccaguacugaaccccucacacccugggucccgacaggggagcagaccaaggcgcuggucacccaacucacccucuucaaccagauccugguggagcugcgggaugauauacgagaccagguuugggugggcuggcgaaggguggcacugauucugggguaggguggcagaugucaagugcugacuccuccccauccuucuccaggugaaggaaaugucccugauccgaaacaccauuauggagugucaggugugcggugagugggagagcaggggaggcuccacaugaccgugccacguuccccacccaauggcuuuggcuuucccuucugguggcuuaaauagugaccaccggguagcucugacuguguccaccccucaggcuuccaugagcagcguucccacugcagccccaaucccugcuuccgagguguggacugcauggaaguguacgaguacccaggcuaccgcugugggcccugccccccuggccugcagggcaacggcacccacugcagugacaucaaugaggugagggaggucagagcccagaaggguacagaaaacuggggugaggaugucaggaggcacccaagagggugggauaaaugcugguccggaggagaggaaucuggaguuuaggagaggucagaggcaagagaaaugcaagaugggagagacagaaggccuggggcaaagacugaaggccauacagggaaggagcuggggaaacugcaggggaggcuugagauggcgaccaguggcauggggagggagagagggaaccccgagggaagugggguggggaccaggagcacaaggcaguuguguggggagagcugcacaaaggggagaccuggagcaaugguuccuggaucacaggcagggaccugaguuucccagagggcggccugaccucugccuucucaucugguccccagugugcucacgcugaccccuguuucccgggcuccagcugcaucaacaccaugcccggcuuccacugugaggccuguccucgaggguacaagggcacacaggugucuggugugggcauugacuaugcccgggccagcaaacaggucagacuggguaguguguguggacaagggaucuuggccuuguagaggccaggggcuucuggguuggacaugggacccuugugaugaaugggacauggauggcuuugcaucggcuuugggucugggcuuaauguugauguucacagauaaggccauaccaguguccucugcuguaucugaggagacccaccauaggucugguuccacccaaagucugccccuucaggucugcaaugacaucgaugaaugcaacgauggcaacaaugguggcugugacccaaacuccaucugcaccaacacuguggugagcugaauauccugaguguauucugggguggugggaaugguaaaaccccaacccccgccccuucuuaccuucaaauuuccugcugccuuuccuccuccccagggcacuacacagauuagguguucacauggacuugguuuggaauacugguuugccucuugcuagcucuuuagcagguuauuuaacuuuucugagccucagcuuccucaucugaaaacugaggcuguuauccacccugaaagguugucaugauaaccuaaaggagauacugauaugccuggcauaacugagugcccagcccacacuccgcagguggagcagugcugguccugggugccuggugggcucacccuccuuccuaagaugcugccucuccacucuuagggcucuuucaaguguggucccugccgccuggguuuccugggcaaccagagccagggcugccucccagcccggaccugccacagcccagcccacagccccugccacauccaugcucacugucucuuugaacgcaauggugcaguguccugccaggugagcuaggcuucaggcguggaaggaaaagggagggucuggggaaaggaguagggcuauguuuagggccuggguugggggucuucauaggagagaggugggccugggcccaggaacuguuugguggggagaauaggaccugaagcagggaaaauauagggaggaggggagccagaccaaacugcuagcuccuacccuuuguguugcccuaguguaacgugggcugggcugggaaugggaacgugugugggacugacacagacaucgauggcuacccagaccaagcacugcccugcauggacaacaacaaacacugcaaacaggugcagggagcaggcgggcaagggggcguaguggggagcccaagcugggucaggccagaacucauccauccucuuccccugaacuuuaggacaacugccuuuugacacccaacucugggcaggaagaugcugauaaugauggugugggggaccagugugaugaugaugcugauggggaugggaucaagaauguugaggugacucccagacugcccugccccuugaagcuccucuccccuccuccuguccucucugugccucacuuaccucaucuggcagcucucuaguaagggccaaauacuccaaaucagggaggcaaaaaccucgugcccaggacaaggaggcugggugggugggacuguacugagcaguuuguccaucacaagggugugaucuuagaaaaggauacagagacaagguaggugcaagaugacaagugauuuaggggagaccugacccuuccccucccaccccucugcccaggacaacugccggcuguuccccaacaaagaccagcagaacucagauacagauucauuuggugaugccugugacaauugccccaacguucccaacaaugaccagaaggacacagauggcaauggggaaggagaugccugugacaacgacguggauggggauggugcaggccuggggcugaagggguggcugggggaccugugagaauuuggaucagguggggaugaagcagggaagcuaggaagucucugugaaauagggaggcaggcuuguggacguuggccugggugaggagagauuaccugcagcagaugucaauaggaaugugagguagggcguaguguuaggcagaguguggacuagagggugagacaagaaacaggcagauuuccuggccaguuguccucuggguggggagacaaaguucgggacuuucaccaaccuagaagagagaauauggcauguucuaguaacaaccuugugcuacccaugucuucuaggcauccccaauggauuggacaauugcccuaaaguccccaacccacuacagacagacagggaugaggacggggugggagaugcuugcgacagcugcccugaaaugagcaauccuacccagguacagggagaugguaaggacaggggagggaugaggguacugauggaugaagccccagcccuuuggauggaaaguggucagaucacccucuucagaguuaucaagaggagauggugagaacaggucccucucucucagacagaugcagacagcgaccuggugggggaugucugugauacuaaugaagacagguaaggucuuggucaagagacgcaaggucuuucuuuuuuuugucuuucugagacggagucuugcucugucaccuaggcuggaguacaguggcacgaucuuggcucacugcaaccuccgucucccagggucaagugauucucaugccucaaccucccugaguggcuaggauuacaggcaugugcuaccaagcccagcuaauucuuguauuuucaguagagacaggguuucaccauguuggccaggcuggucucgaacuccuuaccucaggugauccgccagccucugccucccaaagugcugugauuacaggugugagccacugugccagcgaaaugcaaggucuuauaggggauauuuuacuuuccucuaguauauccuuuuuuuuuuuuuuuugagacggagucuugcucugucgcccaggcuggaguacaguggcaugaucucggcucacugcaagcuccaccucccgaguucacgccauucuucugccucagccucccaaguagcugggacuacaggcgccugccaccacgcccggcuaauuuuuuguguuuuuaguagagacgggguuucacuguguuaaccaggauggucucgaucuccugaucucgugauuugccugccucagccucccaaagugcugggauuacaggcgugagccaccgugcccggccuccuuuuuuuuuuugagauggagucuugcucugucacucaagcuggagugcagugauaucggcucacugcgaccuccaccuccaggguucaagcgauuuuccugccucagccucccgaguagcugggauuacaggcgcgugcuaccaagcucagcuaauuuuuguguuuuuaguagagacaggguuucaucguguuggccaggcuggucucgaacuccugaccucaggugaucugcccgccuuggccucccaaaguacugggaauacaggcaugagccacugugcccaggccauaguauauucuaaauuccuucuaugauuuagccuuaauucucuauugcuauucagcaggaauuuauucuuacagucaucccuccauuccuacugccagaccuucaccucaccuggcugacugccaggggucugauuguauggagagcaggcuccagagacucccaggcagaagcgaagggaaggacaaggaguaccuuuaaauccuuuauuugguaccuguucuucugauuagcgauggggaugggcaucaggacaccaaggacaacugcccacagcugccaaauagcucccagcuggacucugauaacgauggacuuggagaugagugugauggggaugaugacaaugauggcaucccagauuaugugccuccuggucccgauaacugccgccugguacccaaucccaaucagaaggacucagaugguaagccugcggacccagagcacguuagacugguguugccuuugcccagguggaggcagcaagcccuguugggaagugaggaagggcaagguggggaaagaugucaggaaugcaggcccaacagaugguauuguugccuaauggcaguggccagggccuuccugagcacccagccucacucugcccaggcaauggcguuggugaugugugugaggaugacuuugacaaugaugcuguggucgacccccuggauguguguccugaaagugcagagguaacgcuuacggauuuucgggccuaucagaccgucguccuggauccugagggugaugcucagauugacccaaacuggguugugcucaaccagguaacucggggcagugggcugggcaggugcuaucagacagggcuacugggacggggggccugggagggauagcacaccugcaucacagcuuuuucuuuacuauacaaccccagggcauggaaaucguucagaccaugaacagugacccuggcuuggcaguugguauguaagggauaugcaguucaaucacuuccaaauggaggaauccuauaggggcagaggguaggggaggaaacagacagggagaaugggcaaaguggcgagagagaaggcaguggcacaagcuggccacauacauagcaggcaucccuucccaacuuuaccccaugaugggccgccaguagcuuugcugccccugaccuuuaucccacccccaccccaggauacacggccuucaaugguguggacuuugaaggcaccuuccaugugaacacagugacugaugaugacuacgcaggcuuucucuucaguuaucaagacaguggccgcuucuacguagucauguggaagcagaccgagcagaccuacuggcaggcuacacccuuccgggcgguugcccagcccgggcugcagcucaagguccccagcugcucagauuccgcaacccagggcccuuucccaaagcucuccucugcagccccagggccucccccacugcuugacugggaacccucuuacccagacaucuggcuuggaggccggcucucuggggccccagggcauuuucaugaccgccuugaaucccuuucccaccugcacuuaccgaccuguugucuccccucacuccaguucugcaguugacccacugucuuugccaaugucuccuaggcagugacaucagugucuggcccaggugagcaccuccgaaaugcccuguggcauacuggccacaccccugaucagguacgacugcuguggacagacccacgaaaugugggcuggcgggacaagaccuccuaucgcuggcagcuucugcaccggccucaaguuggcuacauucgguaaggagaggggcugagcccaccugugggacucaggccgggccuguccuuccucuuuagcugggauucaccagugaccucuccaugggugggaacugcagccacuucucuccaucacccuucucaccacggacacaagcaccuaugagugauguuggugaagucacuccuccaugacccauuuucccgucuguaaaaugagggcauuggguuagaugcccuuuacaguucuccagaagccuccaaacccaggccaaucugugaaggggcacaucacaucuggucccuuaguugguaugaccuggaaccugucuuaucaacguggauagggaucaucugaccuggaaggcaucaucauuuacagaagagaaaaucaaggcccugacuucacaggccucgguucaacacuuuguccacaacuuugcauuucucuccaacaaguagcccuaguugguggagaugaacaggaagggaggggaaaugggucugcuuagaggcuggacuuuccauggccaagagcccagaguccaggaaccuggguugguuccccuuuaaggugccuggggcuguggggugccaggacaggggauaaaaggggguggacuagagccugggaagcgggugacuucaccccccagcccauugugcuuauugucauggcaacccaauccucgcuuggaaugcggcuggugcuuugagaugcaaaaggagcuggacaaagagcuaggggccccaggccugagaaaagcaccccccuucccucuccuuccugccucccuuucccucccucccuucucucucaggccuggugagcucaaggggggcuggggaaaagcaaggccccaggcaugguggcacagugcccacuggcacccuagcaccaauggauacuccuauccuggaauccuggacagggugaagcucuaugagggaccccagcuuguggcggauucuggggugaucauugacacauccaugcgaggggggcgucuugguguauucugcuucucccaagaaaacauaauuugguccaaucuccaguaucgaugcaauggugagguggcugauugagaucaaccuaauccuucaugccuugugggagagccacauccucugaccuuacuuauuuccccuucuucagacacagugccugaggacuuugagccauuccggaggcagcugcuccagggaagggugugaggaggaggccaccagauucagaauucagaauuuuagacccuuuggccuugggguccauccuggagacccugaggucuaagcuacagccccucagccaaccacagacccuucucuggcucccaaaaggaguucagucccagagggguggucaccccacccuucaggggaugagaaguuuucaagggguauuacucaggcacuaaccccaggaaagaugacagcacauugccauaaaguuuugguuguuuucuaagccag

SEQ ID NO: 13682 - RNA, 3101 nt, Homo sapiens
uggggcuucggcgcaguuuccggagggacggcccgagcgugcgggggcggagccgagugcgcggggcggggcuccagagccgcaggucugggcugcaguaggucccggcaaccgcaggcucgcggcgggcgcugggcgcgggauccgacucuagucguaauggaggcgggcggcuuucuggacucgcucauuuacggagcaugcguggucuucacccuuggcauguucuccgccggccugugagagugcggccgggcuggguuggggaggacuaggcagucaggaaaggagagagaggggacagagacguggccacagcaccuggcucguccggaaccgggaucaaagugggaucgggucgaggggaccgggguacaagggcgaggcuggucacuaggccugaaggagaaggcaggauagcuggcgggggggagagggggcggggucugcggugguccggaaaggaugacaggcauugggcaucccccucuagcacucugcuucucccuucccacccccaccccucccuucggggccccauuacagcucggaccucaggcacaugcgaaugacccggaguguggacaacguccaguuccugcccuuucucaccacggaagucaagugaggggccgacggcugcgguagugggaaaggcuaccagagggaggugggggcggggcaggaggagcaagagugaaagagguuuggccgggcgcgguggcucacgccuguaaucccugcacuuugggaggccgagacgggcggaucacgaggucaggagauccagaccauccuggcuaacacggugaaaccccgucucuacuaaaaauacaaaaaauuagccgggcguggugccgggcgccuguagucccagcuacucgggaggcugaggcaggagaauggcgugaacccaggaggcggagcuugcagugagccgagaucgugccaccgcacuccagccugggcgacagagcgagacuacgucucaaaaaaaaaaaaagagugaaagacccuuuggguccuccucucacacugaacccuuugagccauguccauccccuccacccugcagcaaccugggcuggcugaguuauggggcuuugaagggagacgggauccucaucgucgucaacacagugggugcugcgcuucagacccuguauaucuuggcauaucugcauuacugcccucggaagguagaggcccucccuuggacccaccuaucugcugcacgcccugccuugcuggcagggcaaacacuauuuccuagaagacuguaacagcuggcacugccaccuuuuccaggaaggccucuccagccuugcagguccccuuccucuaugaagccagccuucugagaugaacacauugcccccauuuaggcaaggcugguagcucugccuagccugagaugccuaugcugccugcccugggcuucagccaacaagcuaaggggaaagggcuuuugucucugauauuucuuucagagccagggccugugggugagaaugagaugauuagcucugcgucccugcuaaaucacacaagcauuuaugaagcuccuacugugugugccaagcacacagaaaaaaacacauauuuaucucccccagaagucuccaguguuguggguggauaagacuuuccuaucaaguugguggugggaaagaagcugugacagugcagugcuggaggccuagacagcuuggcuuccccauuggagcacuggagaaggcaggaugaauuaacucuagcagggaagucagagugcacaucuggaaguaaggguacucucuccccugcagcguguugugcuccuacagacugcaacccugcuagggguccuucuccuggguuauggcuacuuuuggcuccugguacccaacccugaggcccggcuucagcaguugggccucuucugcagugucuucaccaucagcauguaccucucaccacuggcugacuuggugaguggggguguccaaggagguaggagagauaagagucaggcucucauagccaaauacuauggcuuacagucccgaggaaggggagauccaaacccuggaagaagacaaggcaguagaagugggcgagugggaggcaggaaagguugggugacagaucagggagggugucugaccuuuuucuugaggaaauucuuaggcaagugaagcuuuacgaugugcuugggccaagagagucuuccauucuuucccacaggcuaaggugauucaaacuaaaucaacccaaugucucuccuacccacucaccauugcuacccuucucaccucugccuccuggugccucuauggguuucgacucagagaucccuauaucaugguaagcacaacugggauggggugacaggggugcaagauggaaaacuggcuccucuccucauagcaguucuugugauuucagguguccaacuuuccaggaaucgucaccagcuuuauccgcuucuggcuuuucuggaaguacccccaggagcaagacaggaacuacuggcuccugcaaaccugaggcugcucaucugaccacugggcaccuuagugccaaccugaaccaaagagaccuccuuguuucagcugggccugcuguccagcuucccaggugcaguggguugugggaacaagagaugacuuugaggauaaaaggaccaaagaaaaagcuuuacuuagaugauugauuggggccuaggagaugaaaucacuuuuuauuuuuuagagauuuuuuuuuuuaauuuuggagguuggggugcaaucuuuagaauaugccuuaaaaggccgggcgcgguggcucacgccuguaaucccagcacuuugggaggccaaggugggcggaucgccugaggucaggaguucaagaccaaccugacuaacauggugaaaccccaucucuacuaaaaauacaaaauuagccaggcaugauggcacaugccuguaaucccagauacuugggaggcugaggcaggagaauugcuugaacccaggagguggagguugcagugagcugagaucgugccauugugauaugaauaugccuuauaugcugauaugaauaugccuuaaaauaaaguguuccccaccccugcc

SEQ ID NO: 13683 - RNA, 9413 nt, Homo sapiens
aggagggcggagggaagggcugggggcguggccuaaggcugggggccgacggcggcggcagcagggagcugggaagcggagaagccgggagcgcggggcucagucggggggcggcggcggcggcggcuccggggauggcggcggcuccgcugcugcugcugcugcugcucgugcccgugccgcugcugccgcugcuggcccaagggcccggaggggcgcugggaaaccggcaugcgguguacuggaacagcuccaaccagcagugagucggggacccugggaguccgcgcgucccgucucagugagagggggagccggugggcccgagaaguccugggggaucccggggugggaguccugggagaccagagcugggggcugggaggggacggagagggggacgcacucugugggcgucuaggaaacucgggggugucugaagaggcuguugggcuauaguaaggagcgcucgggccguguggaggaggcugcuggaggggccccccaccccaucuuggcuucucuccgcacccgccgcuggaauagcaugccccugucccauagucccaccaguugggcugggguuuggggguagcgcugugcuggggauaggccgcugcauuuuggggcccagggaugaccuguuuuuggccaugagggcuuccagggguucugucuaggacuccugcuuuuaaaagugggguccagagcugaggcagggaguccgaccgagcaccucccuagaaggaaggcgaauggguugucuugguuguguggauaagcccggcuagggugagcuagggcugggucgcugaguuggggggcccugggaaugcugcuugguuaggaugggaacgugggguaccggcgagacggaaggcggcagagagaugucggugugucacacacgcacacacacgcccgggcuggggacggcgaauggcuccaagugugagcgggcgugcgcggcugucagugugcgugugugucugagugugugauuugugugucugcgucggcgaucgucugggggugggagcgggcugcgggucggggaaggggcugcggucgcuguccgcgcggccagcugcgucugggcugggguggcuguuggcgccgccgcggucugggcgggugucagggcggccgugugguuucccgggguguguggcgcgguggccgggugcuggcugcggggccggguccucauucugcucaguccuugcugcccuugucuucuccuccccgccaagccgccguguguaucucccuggccacaucagugugugucuguguguuaguagggggagaucccuggggacgcgggggucacugucacaccugcccgggcgguggcggcagcacugccucuggcugcccaccccagggaccgaccgaccagggagcaaauggccagaccccaggggaggggaccgggagggccgggcggccgcgacccccaaccucucggaggaggggcugccgcucgccgcuccgcucuuuguuguuuggggcuccgcgccucccccucucucccuccucgcgcccggagugucagacuggggguggggaugagccaacgacgccccccucucgcuucccauggaaaccucggggguggggacguggccccucccccccggagcgggacuccaagaacuccggggggcgcugggggcugacuuuccagcucuaucuagcucagcccccucccccagacucacacguccgccccccaccccgcuagagucuggcggggaacggagagcucgcaggugaggggccccggguuccccgccacccuuggagcaccucagcguucuuaggggaagccagagccggggaggaugcgggaauagguuugguggggggagguguugaucagguuccccucccccgcauacaccugggcgcaggugaaagcucagggagcgggugggggagcccggguuccgggagccuccuuucuguccucucuacuccgugcgggccugggccggcagagguaggagggggcgcacaccgggccaggaggcugccgccgcccccgccucgcuucccgggccuuuguugccgcugcgcccgggcuccccggcucccucacugcggcagccgcggccccauaaaucgugagagcgacgugcuccggagccgagaauggagagggccggggagcugggggcggggccgaccgagccacaggcucccgcgcccccucccccuagucacgugagcugggcuccuggcucccaccucccgucacgugcggagggucucugccccuuggggucacguggggagggucuugcgaccccgccuccugggggggucacgugcgucggccuccuuugacagaccuggggacugugccuugcacaccggccgcgaccuagcccucugccccccacucaguacuuccauuuagucccguggaacaggagagaccuguucccaaucuggcccagaaacuagggauggggggacuguauuggagcgaugcauuagaguaugaggucgaggaguccccuaagccgggaaucgaacuuggugagggggguugggacggccgauggccaaauauaugcccccuggccuguguuucauuucuuugcagaacugagcaaggauguugguauuugcuccguucucaaggagcuucgggaacaucuuucuauauagcugucucucgaccuaucucugaaaugcuucuguugcugaucucucuuucauucaugcauucauucaacaaauauuuauugaggcucuacuacgucccugauggucuuucucuguguuuucucccagucucugagucucagccuugcacccuucccugucccugcuucucuccuuugcgucucugucuccgucuccgccgucugugggccucucuggccugccugucucuccuguucuccaagacucucgguucucguucucuucccugccucucucgguuucugcgucucucucgcacugugucucccuuccuuuccccuuucagugaauccggccucugccacccuccccuugucggugugugucucccccucacuccgucucugugucucgcuuucggcaggucucucgcuccucuccgccgcugcagaucaauaaaccuucgccgccgccgccgccgcugucgcagggaggaggggcggaggugucgggcgcgcugauucucccccacccgacgcggcccagggaagccuugcgcccagaccugggcuguccagacugggacgggcggggcgccgaggcccagggcgccugaggggcgcagaggugucagcgugcaaccgccgccccccagcguucccgccaccaccgccaccacccucaaagcccgggcgcgcggaccccacgccgcgcacacgugguccggccucgccugcuggagcgggcggcgcgcagccucgggggcgcgcgcuagagggaagaggaacccgggucuacauucguccuccaccccuguaacucugcagcccggcgucuaagaccggggcuggggguggaggauggcgaggauuugacaaguucagggcccccugggauccuuucccuacucccuggucuuguuggacacccuguuuaccugcccuaauugccccgggcugggggagaaguuugcuccuuccccgcuccgcccgccugcccccuccgcggacacuccggguuaaguggagccaggcgcgggccggcagggcacugaaagcgagagagaggugucgggaugcgccucagaggcugugagagccaggagagaccgaaauaacggggugaggggacacccccuccaaauggggugugucggcauucgccuuucugcaagagaggcgagaggcuauaggggaugaaguggagcaagaagagagaacaguacgaaggggcagggcacaacccgguccccaggucccagcccacccccacccuuccgcaggaggcgcggcccuagaggcgggguuagcugcggagcuucgcgugggcccagcggcaccucucucuccgcacugcuagggagaaggagggaggaugacagauucaauuaaagugcccaagccaagcagacacguugggucuccaaagaguuguggcugggaauuccuggcucucaccccguuuguccccgugcccucuguguaccaacugggcccagccaccccaccggcaggucuuucucucacaugcccagccuugggggggcauuucaggagcuguuccugccacccagcgcaggaguacauaacagauggcuucccuucaccuguggucgcccugcaaccuuuuuuauaaggcuaguccugcccuguugaggaaauggaauuaccuguaggaauaccuuggguguuggcuuccucccugcuggaaugggguguguuguagggggaacugggcgguacagcagggaggggcugcuucagagugggacuggaaacaugggugaggcucaaagacagagaucccaguguggcugugcagcugcuccagaccuggcacccucaccacuggaggcccccuccccaaggccugaggggaggaacagacuguggguuggugacggacaggcaagccuaggauggcaguuuggagccaggccuggucuaacccguuuuccugcucccagugccgcaggccgaggcuccugcccaccugagugccagggcaagggaggggccugagugacccauuaaucccaugggaacagaguggggcugguggcauuccugaugaccaaaggaggcugugccaauucuuacugggguacccaaacaucagcucucugccugccucacugucaggcuuggaauggguugcugguggaggggacagcacaagcaaagccaaggaaguggggucaggggggagggacccccaaggccccaccgugugcagaagccuccacgcucauuucuuuaauggaucuaauuacuguuuggggaacuggguggugccuggugacauagggagccagucucuccccccagggagcucccagggacuagggaccccgugguaugacauuuugccaaggaccccaugccuuucuguguccaccacucuccuugcacugccaagauaugugcauucuuacgcuaaagaaauuagggaaaacuccugcccccucuccgaguuucuuucuccauucagagguuucuccauccccacaccgcucacuacugccaucgaggguguuaagaccaacacuuugauggugacuagcaaggcagguggggauuacaagggacccagcaucugcuucucugucccaaagagggaucagggaaauaagaggcgcagccaucuugucuaggcccugugcccacugcucugcccagcaucauuaaggggggccguugugccagguugaggaaggaggugcacaaugagacagaaguuugggcugguuggcaugaugccauguggagucuugguacugagucccuuagcgcccucauguguuuaaaguuccugggagccuaacuguccuuggccucaggguggggucucugucacgggacucaagguacagaagccagugauacuguaguauggggagggcagggggagacccccagauugguggggucaaccaauacuggcaugcgggccagcacacauacagcccagcuuuucugugugucugcugccuaugagugggcgguggacauauuugugcgugugccauagaacuuaugcauguauaugcaugaagccgccauacaugcgucuguaagggcagguccuguuggacuggccuccgggguggacuggcagccgcagggaagcauggugggagaagcgauggagggugugugcgucccucggaggggaucccucccacguucacccuuggcuuccaucccucccaucccuccucccggcugcugaauuaugggggauggacggaggaaauccgggccugggucugagagucgcuggggccugcgccguuucuguggcaaccaaagcguacguucccuucuucccuccgccccucucccucgccuccuuuucuuuggaggcaggccgggcuucccugcgccuuugcuacccucugguggccaacaggagaaggacagaccaagaaggagggcacggaaggagacuuaggggagcggcggcacuagggccccgggggcagagacagggcugagccgcgaggaagcucggaggaaaagucggaaggcuacgcggacccuggggaggggcugcggagcggucagauggaaagcggcuuugcucugggguuucuucucucugagccgcuuccucuuccccacagccugcggcgagagggcuacaccgugcaggugaacgugaacgacuaucuggauauuuacugcccgcacuacaacagcucgggggugggccccggggcgggaccggggcccggaggcggggcagagcaguacgugcuguacauggugagccgcaacggcuaccgcaccugcaacgccagccagggcuucaagcgcugggagugcaaccggccgcacgccccgcacagccccaucaaguucucggagaaguuccagcgcuacagcgccuucucucugggcuacgaguuccacgccggccacgaguacuacuacaucugugagugacggcggccgggcgggcgggucugaacgcgagagucugagugacagccgggggguggagccccuaggcuccggggcggggccggcgcggcgggcgccaggucucgcggcugagaccagggaggaggcgugggcacgggacgccugagggguucagcucagacgaggucguggggccaagagaggaguuuggugacagucccaaguuugggcugcggagaaucgcuguuucugugagggacauuccgggguuggaacaucagggaucccaguuucuugaggggugggaccaaaggggcgucuagggccgacggcagagcuaaagugacccguguccaaaggguaggggagcuccugaaggagaccgcccgacggggacaguuuggagggggugagaaauagagccgucgagggagggcacaggcacacauugggcgaaagugacucaggcccggucuccuccccagccacgcccacucacaaccugcacuggaagugucugaggaugaagguguucgucugcugcgccuccagugaguagaauaggcuccgagccgcgcccccauccucagcucccugcuuuggggcuccccuggcuuccugggggugggggcggagggcacaggugaggggggcuugcuccccagccguagcaaggggagggaauccuggcccugacucuccccuccucucuccccacccgcaccccaccccgcagcaucgcacuccggggagaagccgguccccacucucccccaguucaccaugggccccaaugugaagaucaacgugcugggugagucugcgcagcgcccucugguggccacugcuggaaccgcagccccccgccccggugccugcucaccucgcaugccuucccugggggcacugauacuuccuacccuguggguggucacgucccuggcuccauugcugcugccgcgugccccugcccuggcgcgcaacccagcccucaccagucugucuguuccucuguccacagaagacuuugagggagagaacccucaggugcccaagcuugagaagagcaucagcgggaccagccccaaacgggaacaccugccccuggccgugggcaucgccuucuuccucaugacguucuuggccuccuagcucugcccccuccccuggggggggagagauggggcggggcuuggaaggagcagggagccuuuggccucuccaagggaagccuagugggccuagaccccuccucccauggcuagaaguggggccugcaccauacaucuguguccgcccccucuaccccuuccccccacguagggcacuguaguggaccaagcacggggacagccaugggucccgggcggccuuguggcucugguaauguuugguaccaaacuugggggccaaaaagggcagugcucaggacucccuggccccugguaccuuucccugacuccuggugcccucucccuuuguccccccagagagacauaugcccccagagagagcaaaucgaagcgugggaggcacccccauugcucuccuccaggggcagaacauggggaggggacuagaugggcaaggggcagcacugccugcugcuuccuuccccuguuuacagcaauaagcacguccuccucccccacucccacuuccaggauugugguuuggauugaaaccaaguuuacaaguagacaccccugggggggcgggcaguggacaaggauggcaaggggugggcauuggggugccaggcaggcauguacagacucuauaucucuauauauaauguacagacagacagagucccuucccucuuuaacccccugaccuuucuugacuuccccuucagcuucagaccccuuccccaccaggcuaggccccccacaccugggggacccccuggccccucuuuugucuucugugaagacaggaccuaugcaacgcacagacacuuuuggagaccguaaaacaacaacgcccccucccuuccagcccugagccgggaaccaucucccaggaccuugcccugcucacccuauguggucccaccuauccuccugggccuuuuucaagugcuuuggcugugacuuucauacucugcucuuagucuaaaaaaaauaaacuggagauaaaaauaacugagugugugugauuucaaggggccaucacccuucuguuacacugguuaaaccucacagggcacagggccugaguaggagagggaauucuggggccaaagagucacaacgagguguucaaaucuuguucuggggcucaucuucauuacaaaggcagcgcugcuuggaaagagcaagaggggccuccaggcagggccugguugacuuugggcaaaucacucaaccucucugauucucagguaucccaccagaaaaacugguugugguaucucucucuuaggguugguguagggauuaaaugacgcagggaguuaaaggcuccaucaauuaugguuuccaccuuuucuuccccuuccaugcuguaauugagguucuugacuggagucuauggauuucaggggauuugagaaccuagacagaaaaaaaacuaucuuuauuuucacuugccuauaacuaaaauuuaacauucucuugugugcuugggcagcaagccauaauaguauuaauaguaccugugacuuuguaaccagaaaucacacguuuucaggcugcauuauaguuguugaagauaucucaaaauacaauuuacacucaucaguacuuugaaaugaucauaguuguuaggccuuccucauuuuuaauguguuaauaagaaagcauauauauuacuauaucaagaaau

SEQ ID NO: 13684 - RNA, 3539 nt, Homo sapiens
gggggggcauuucaggagcuguuccugccacccagcgcaggaguacauaacagauggcuucccuucaccuguggucgcccugcaaccuuuuuuauaaggcuaguccugcccuguugaggaaauggaauuaccuguaggaauaccuuggguguuggcuuccucccugcuggaaugggguguguuguagggggaacugggcgguacagcagggaggggcugcuucagagugggacuggaaacaugggugaggcucaaagacagagaucccaguguggcugugcagcugcuccagaccuggcacccucaccacuggaggcccccuccccaaggccugaggggaggaacagacuguggguuggugacggacaggcaagccuaggauggcaguuuggagccaggccuggucuaacccguuuuccugcucccagugccgcaggccgaggcuccugcccaccugagugccagggcaagggaggggccugagugacccauuaaucccaugggaacagaguggggcugguggcauuccugaugaccaaaggaggcugugccaauucuuacugggguacccaaacaucagcucucugccugccucacugucaggcuuggaauggguugcugguggaggggacagcacaagcaaagccaaggaaguggggucaggggggagggacccccaaggccccaccgugugcagaagccuccacgcucauuucuuuaauggaucuaauuacuguuuggggaacuggguggugccuggugacauagggagccagucucuccccccagggagcucccagggacuagggaccccgugguaugacauuuugccaaggaccccaugccuuucuguguccaccacucuccuugcacugccaagauaugugcauucuuacgcuaaagaaauuagggaaaacuccugcccccucuccgaguuucuuucuccauucagagguuucuccauccccacaccgcucacuacugccaucgaggguguuaagaccaacacuuugauggugacuagcaaggcagguggggauuacaagggacccagcaucugcuucucugucccaaagagggaucagggaaauaagaggcgcagccaucuugucuaggcccugugcccacugcucugcccagcaucauuaaggggggccguugugccagguugaggaaggaggugcacaaugagacagaaguuugggcugguuggcaugaugccauguggagucuugguacugagucccuuagcgcccucauguguuuaaaguuccugggagccuaacuguccuuggccucaggguggggucucugucacgggacucaagguacagaagccagugauacuguaguauggggagggcagggggagacccccagauugguggggucaaccaauacuggcaugcgggccagcacacauacagcccagcuuuucugugugucugcugccuaugagugggcgguggacauauuugugcgugugccauagaacuuaugcauguauaugcaugaagccgccauacaugcgucuguaagggcagguccuguuggacuggccuccgggguggacuggcagccgcagggaagcauggugggagaagcgauggagggugugugcgucccucggaggggaucccucccacguucacccuuggcuuccaucccucccaucccuccucccggcugcugaauuaugggggauggacggaggaaauccgggccugggucugagagucgcuggggccugcgccguuucuguggcaaccaaagcguacguucccuucuucccuccgccccucucccucgccuccuuuucuuuggaggcaggccgggcuucccugcgccuuugcuacccucugguggccaacaggagaaggacagaccaagaaggagggcacggaaggagacuuaggggagcggcggcacuagggccccgggggcagagacagggcugagccgcgaggaagcucggaggaaaagucggaaggcuacgcggacccuggggaggggcugcggagcggucagauggaaagcggcuuugcucugggguuucuucucucugagccgcuuccucuuccccacagccugcggcgagagggcuacaccgugcaggugaacgugaacgacuaucuggauauuuacugcccgcacuacaacagcucgggggugggccccggggcgggaccggggcccggaggcggggcagagcaguacgugcuguacauggugagccgcaacggcuaccgcaccugcaacgccagccagggcuucaagcgcugggagugcaaccggccgcacgccccgcacagccccaucaaguucucggagaaguuccagcgcuacagcgccuucucucugggcuacgaguuccacgccggccacgaguacuacuacaucugugagugacggcggccgggcgggcgggucugaacgcgagagucugagugacagccgggggguggagccccuaggcuccggggcggggccggcgcggcgggcgccaggucucgcggcugagaccagggaggaggcgugggcacgggacgccugagggguucagcucagacgaggucguggggccaagagaggaguuuggugacagucccaaguuugggcugcggagaaucgcuguuucugugagggacauuccgggguuggaacaucagggaucccaguuucuugaggggugggaccaaaggggcgucuagggccgacggcagagcuaaagugacccguguccaaaggguaggggagcuccugaaggagaccgcccgacggggacaguuuggagggggugagaaauagagccgucgagggagggcacaggcacacauugggcgaaagugacucaggcccggucuccuccccagccacgcccacucacaaccugcacuggaagugucugaggaugaagguguucgucugcugcgccuccagugaguagaauaggcuccgagccgcgcccccauccucagcucccugcuuuggggcuccccuggcuuccugggggugggggcggagggcacaggugaggggggcuugcuccccagccguagcaaggggagggaauccuggcccugacucuccccuccucucuccccacccgcaccccaccccgcagcaucgcacuccggggagaagccgguccccacucucccccaguucaccaugggccccaaugugaagaucaacgugcugggugagucugcgcagcgcccucugguggccacugcuggaaccgcagccccccgccccggugccugcucaccucgcaugccuucccugggggcacugauacuuccuacccuguggguggucacgucccuggcuccauugcugcugccgcgugccccugcccuggcgcgcaacccagcccucaccagucugucuguuccucuguccacagaagacuuugagggagagaacccucaggugcccaagcuugagaagagcaucagcgggaccagccccaaacgggaacaccugccccuggccgugggcaucgccuucuuccucaugacguucuuggccuccua

SEQ ID NO: 13685 - RNA, 10389 nt, Homo sapiens
cuuguauagcauuuauuaugugccagguacuaagugcuugugcucauuuaauccucauaacagcccuauaagggauauacuaucauguauuauuguccucacuuuauacaugaggaagucaaggcacagagagauuaaauaacuugccccaggucacacagcuaguauguggugaaaaccagauuggaauucaaauaaacuaacagagucaguggcccaaccaguauacuuugcugccccggggucaggaguggaaaaguuggcugcggggguugccugguccccagccccacaaccaccuucaagccucugcuugucaaugcacgaccugggaaguggcuuuagcacugccuucuuuuucuucacuccacagggaguuggucccaggccgcccaacccuggugugguaccagcccgauggcacucggguggucagugagggacacacuuuggugagucaggcccucuugugccauuuuuggcuuaggggaaagagggaggggguggcuggaaggugagaggacacugcauauuuuuaccgucaagcuaggcuccucaguuccaguccuggugugcucucugagacagcacuaauguuguucccaugcugcaggagaacugcugcuaccagggaagagugcggggauaugcaggcuccuggguguccaucugcaccugcucugggcucagguauacugggcggauuuaaugacaguagagaaaguaaggagacccaggcauggagcugaaauguucucugacuuucuuuuuucuuagaggcuuggugguccugaccccagagagaagcuauacccuggagcaggggccuggggaccuucaggguccucccauuauuucgcgaauccaagaucuccaccugccaggccacaccugugcccugagcuggcgggaaucuguacacacucagaagccaccagagcacccccugggacagcgccacauucgccgggugaggaugaauggcaggggggugggcuuugguugucuugagggcugauccccagacacuuagagcuaugugugcacaguaacaacagcuccugcgaauggagcacuuuccacaugcugggcacuuugugaacauuagcucguguacuccucccauaccuaggagguaggugcuaucaauagcucuauuuuaaaaugacgaaaccuuacaaaaaguaucugggcaugguggcgugcacccguaguuccagccacucaggaggccgaaguggaagaaucgcuugagcccaggaggcagagguuucagugggccgagaucgagccacuacacaccagccugggugaaagagugagaccucgucucaaaaaauaaaauaaaaauaaaauaaaauaaaaucuagcugagacagauuaggugguuugcccgaggcccuacaacuaauaaauggccuauccauuuauuaguuguauuuggcucuucaucugucuuaugaucccauuugcagagagcucucacuugguuauagauaauacauaguuaccaaugaugaagcaauauaaacccaauuuccuaauuuguaaaaugaagauaauaaaacuacuugcugcauagaguugcugggaagauuaaauaaguccauauagauguaaagugcuuaaaacuaugccagaccuaugguaagugacaagaguuguuauugggauuuuuaaaaauuauuauuauuauuauuauuauuugagacagagucucgcucugucucccaggcuggagugcaguggcaugaucucggcucacugcaagcuccgccucccagguucacgccauucucuugccucagccucccgaguagcugggacuacaggcgcccgccacuacacccggcuaauguuuuguauuuuuuaguacagacaggguuucaccguguuauccaggauggucucgaucuccugaccucaugauccacccgccuuguccucccaaagugcugagauuacaggcgugagccaccgcacccagcuaaauuacuguuuuuuaaaaauuugaaaaaaaccacugaguuuggagccagaaaagcaggggucuacuccaaccuucauuaucuacuuccugguccuccuuggcaaguuccugggcccucuggccuucaguggcucaucuguaaaaugggcucuucacccuccuauuugacccacagaguaggaguggcugccucuuggucagcccggcacagcugcuggcugcgagcggcagguuugccugauaauucuucuuguccauaguagaggcgggaugugguaacagagaccaagacuguggaguuggugauuguggcugaucacucggaggugagccugcuggccccugcacauccuccucccccugcacugcccugccgccuuucaugucaccucucuuggccuacaggcccagaaauaccgggacuuccagcaccugcuaaaccgcacacuggaaguggcccucuugcuggacacagugagugcuggacagggcaacccccaccccaggccccugaccauggcaaccccucuucugagccccagcugucuuucaguucuuccggccccugaauguacgaguggcacuagugggccuggaggccuggacccagcgugaccugguggagaucagcccaaacccagcugucacccucgaaaacuuccuccacuggcgcagggcacauuugcugccucgauugccccaugacagugcccagcuggugacguaagggccccagacucagccagagaggccaguccuguccuggccaaauucacaccccuucagcacccuaccucagccccugaagcucugaccaccguggcuucuggcccugaacuuuagccucucugucccacagugguacuucauucucugggccuacggugggcauggccauucagaacuccaucuguucuccugacuucucaggaggugugaacauggugaguuauuuccaggucuccuccucauucccaauucaguuccucccaagugugguggcauuuaugcacugaaaccccccuauaaaguugcccaaccccaaagcuacagguauagaggguggagguacgugauguggccuuugcuaucagggagcccucgcuuauggccagcuagucacaguguacacagucauccccugugcagucuucccauuucuuagaggaggguaggaggcagcuaaggcccaaagaacagaggugaucucccuccagugagggagggggacagagcugagcuagaacccaaguuucugccauccaggccuggguucuccuacuuuagaagcaauucaggagggaagcagugccugcugagugcccacgaggucagacguggagggaacaggagcagagaggguggucugggcauugugguggaggcaggcugggacuggaccuacaguaccccuccccaaugacaggaccacuccaccagcauccugggagucgccuccuccauagcccaugaguugggccacagccugggccuggaccaugauuugccugggaauagcugccccuguccagguccagccccagccaagaccugcaucauggaggccuccacagaguaaguagcugcaggauggagagaggguguggggcagggggcagggagaggcccccagccccaaccuuccuugccacccuccccagcuuccuaccaggccugaacuucagcaacugcagccgacgggcccuggagaaagcccuccuggauggaaugggcagcugccucuucgaacggcugccuagccuacccccuauggcugcuuucugcggaaauauguuuguggagccgggcgagcagugugacuguggcuuccuggaugugagccccuuucccaaagccucgccccacucacuucuguacccucacccuggcucauuagcccuaucccagccuccugagcucuuggguucugaagggacuuuccaccccucuccuacuugcccugucuguggggacagcacauggguuguugggcucuagcccucgcuugcuguguagcuucuggucuuggccugugggaggaggagagauuggagggaggcucacaggccccaccugcucugaugcccggcccccgugcuccugcccacaggacugcgucgaucccugcugugauucuuugaccugccagcugaggccaggugcacagugugcaucugacggacccuguugucaaaauugccagguggguagagacuagacuggccacccggagcucaccugccggggccaagguggaaagggucauucugacccccggcuggauuugcucagugcccacacugaugcucauccacccuccacagcugcgcccgucuggcuggcagugucguccuaccagaggggauugugacuugccugaauucugcccaggagacagcucccagugucccccugaugucagccuaggggauggcgagcccugcgcuggcgggcaagcugugugcaugcacgggcguugugccuccuaugcccagcagugccagucacuuuggggaccuggagcccagcccgcugcgccacuuugccuccagacagcuaauacucggggaaaugcuuuugggagcugugggcgcaaccccaguggcaguuauguguccugcaccccuagguaagugaggaaaccuggcuccuccuuuggguuucugagagccuuggcccugcuccuacuaacucugugugcccuucccccuccccacagagaugccauuugugggcagcuccagugccagacagguaggacccagccucugcugggcuccauccgggaucuacucugggagacaauagaugugaaugggacugagcugaacugcagcugggugcaccuggaccugggcagugauguggcccagccccuccugacucugccuggcacagccuguggcccuggccuggugagcagccugggugggcaagaccaggugugagaagggacauuuggaccacaaugaacagagcccagacuucaccauucaccaaugucaaaggcagggacuccaagggaagucaguuucuuacuucagauggagcaaaguccuaucaacucacuaugccuugguuuccccaucuguaaacgcaggguauggccucaaccuuauuggccucccagucccauuaaagcuuugugggaaucugauccaggcucuucucucccugggucagguguguauagaccaucgaugccagcguguggaucuccugggggcacaggaaugucgaagcaaaugccauggacauggggugagcugggaugggggaaguggaaggggagcagagagccucuagagaggaaaaggauacugggcuuuggaaauagacauaucuggguuuuaauccuugcucuacuacuucccaguugugugaccucgggcagguuacuaacuuugcugagcucaguuuccccaccuaucaaauggcuauaauaauaguauccccauccaggguacaugagaugaguaugaaagcaucuagcacaggcugggcacaauggcucaugccuauaaucacaguuuuuuuguuuguuuguuuguuuuguuuugagacagagucucgcucuguugccuaggcuggagugcgcuggcgugaucucggcucacugcaaccucugccucccaggcucaaacauuacucaugucucagccucccuacucgcugggauuacagucacccgccaccaugcccagcuaauuuuuguauuuucaguagagauggguuucaccauguuggccaggcuagucuugaacuucugaccucaagugauccucccgccucagccucccaaagugcugggauuauaggggugagccacugcacccagccaaaucacaguacuuugggaggccaaggcaggaggauuacuugaggccaggaguucaaaaccagccuggucaacauagugagacccccaucucuuucaaggaaaaauuuaaaaauuauucaggccugcuggugcacaccuaugcucccagcuacuugggaggcugaggcaggaggacugcuugagcccaggaguuuggggcugcagugagccauaauugcaccacugcacuccagccugggcaacagagugagacuccaucuuacuugcugucuaaaauaaaauaaaauaaaacaaaacaaaacaaacacaaagaaagaaagcauguaccacagugcccagcacacagaaggagcucaguaaguguuaguuugaucuaauuugcucugguauggauaaagacccucccuccgggcugucucuacacacauacccagcacaacccccaguuguagaaaucugagaucuugaaaagcuagagacaaggaaauaguuccagagugcagagcuccucauugcucgccuuguaccuccuaggucugugacagcaacaggcacugcuacugugaggagggcugggcacccccugacugcaccacucagcucaaagguagcaugggggugggggacaggggcagcugggagggcaaagcgucucaugcuuuaucuugcccccucggcccucucuuucugaccccccuuugcugcugguucccugagucugugccccuugaacccuucacucucccugaucacuugacuucacucccugcccccugcgccuucauggaucuagaguucuuagccccguccucccuuaaaccugacuuccgcccacagcaaccagcucccugaccacagggcugcuccucagccuccuggucuuauugguccuggugaugcuuggugccagcuacugguaccgugcccgccugcaccagcgacucugccagcucaagggacccaccugccaguacagguaugagcaucaccucccugcuaccacuuccuucaacuggggacagugcugaaggcugccucaccucugcagccccugccaccugguucugagccccaggccccuuggaccuuaaaguugcugacugccauaccccacaccucccuucccuauaugugcccacagcuuuuuaccucacagcugugccccugugggguggcuggauugcuagggccauuucuccccaggagccccugugcuggauaaguagggucuucccucaagcuaauaaauacugccccccaccccggcccuaccacaauuuuaccuaaaccacacauaagugccugcaaaggguuaaccccacucagggauggcauaugguagaaaacagggucugaggcugggcccucucccuucuugccuuuccucaugcauagggcagcccaaucuggucccucugaacggccaggaccuccgcagagggcccugcuggcacgaggcacuaaggugaguccuggaugccagaggaaggggacuccaccuuggccgggcauccagcuugggcccuggggggugcgcauuaaaggcuccagacucagagaaaggcuagcacugcccaagagucagucgaaggagucagggccagcccugcccuccccuccccuggcuacaggcagggaagcugaguccagaagaguggggagggcagccagcuggagcaggagcugcugggcuccguccgcuggccaagagguggcuuugagagguggaucuauccaugcccccagcagugaccccaggagggcacaagggcaguggugcucagaauggccuuccguaggcccaggucaccauguuagaagggcuggugagcauccccacccugagcccucugcuuggaugaugggagugugugcacaccuccuccccacucgcuccccaccugcaugcaccugcauaacugcaugcacagcacccacugcccugggccccugcuggcccccccugggcacugacccuucccugcccacucugucucucugcuuccucuucccccucugugccuaucugccccuccugcccucucagcaggcuagugcucucagcuucccggcccccccuuccaggccgcugccgccugacccuguguccaagagacuccagguaaaucugggccagggcccgcccugagccaaggcaggugggaggcuugguacccaacugcaguucucaucccugcucccugccaguggugcucuucauuaggugaucggggugccccucagccuucagacacucugagccccagaagcagcaaagggugagccuccugccuugguuucuaccaccaucugguggucaauggcgggacugcagucggccagggacugcgguugaccuacaccuuccuccccugagacaucagcuggcaugccuccaagcccucugcgcaugcccucauucucuccugcccccuggcugacuuugcauguugacuugaaccccucuggggaaucucugugcauguccacagccccugguuaugcucucacagccacugccccucucucuguucaggcugagcuggcugaccgacccaaucccccuacccgcccucugcccgcugacccgguggugagaagcccgaagguaacgguggggggagagaagggcacggccucuccccccaccuagggcuguggugcugguagccaugacggugguggccguggcgagaugcccccucagugcaugagggcacauaucccgguggugccuuuaauggugacagguuuguuugcagacaagggugaccgcuggugcugcccccaagcugguguuccccagcaccagugcguugggggugggcaacaugacacccccccaccuaagccggccuccugccuucucucccucagucucaggggccagccaagcccccacccccaaggaagccacugccugccgacccccagggccggugcccaucgggugaccugcccggcccaggggcuggaaucccgccccuagugguacccuccagguaggaggagcccugggcaugggugggcggggcgagugaccugggggaaaggggccucugacucuuuuuucuuggcuucccgcaauccagaccagcgccaccgccuccgacaguguccucgcucuaccucugaccucuccggagguuccgcugccuccaagccggacuuagggcuucaagaggcgggcgugcccucuggaguccccuaccaugacugaaggcgccagagacuggcggugucuuaagacuccgggcaccgccacgcgcugucaagcaacacucugcggaccugccggcguaguugcagcgggggcuuggggaggggcuggggguuggacgggauugaggaagguccgcacagccugucucugcucaguugcaauaaacgugacaucuugggagcguuccccagaguuugucugcuucuagaacccgggucgcuccugcugcgguuccagguuuggccgccagaagacgcugccgccucagacgagggcgggcuguguggggcgggaguaccagaaagggucggcguguguccccgggaugcucgcagcuucccucugcccagacugggguggcuuucggcgcaaucugucaagcuguuggaccugccguccccacucugaccauuggcugggaaaaguggaucuggcugaugcucccagagcccaggagccagggcggagcggggcggcggcugcucccacgaucccaaggccgcgcaccugccuccucccccuccgccgccgccaccugagggaucgggaacaaaggugcuuuguacaggccgcaaccaccucauuacuucgucuuagggacuggggccgcgugggcccccagcccggaacgaagguguggagcggcaagggacagacgccaauccuaaagugagcaucuagcgcgccaccuaaggcucuuuagggaagguggucccagagcuguguugucccuuccgcuugcacugucccuagaugugcaaagaaaacggggcagugcaugaaggugguuggacaggcuucauggauccucgcccgcgccucacuuuccccuaucugggcaaagguuauguacccuuauuuaaaaucuuccaaacuucuaauaaggcagucuacccugcacuaaagcagacacgaaagagaugaccucccuaaaaauacugcuguuggaauacguccuuccuucccgcccccucgcagugcggugcagccucaguggaagcuuuggcgaaccuggcgcgcgcugcggugcacagaggguuaacuggaguuggcgcuggguggagaggaggagacgcgcucccauuggcggaaaguuauucaggggcggggucagugaaucuccguaccccacuccccuuuccgcaacuucccucuucacuuuguaccuuucucuccucgacugugaagcgggccgggaccugccaggccagaccaaaccggaccucgggggcgaugcggcugcugccccugcugcggacuguccucugggccgcguuccucggcuccccucugcgcgggggcuccagccuccgccacguagucuacuggaacucc

SEQ ID NO: 13686 - RNA, 12310 nt, Homo sapiens
cggggcgggcuuugccgggggcggagcuuggcuuggggccgggugggagggggcgggccggggcggggccugguggccgcgcggcgcugcuggguucuccgaggcgaccuggccgccggccgcuccuccgcgcgcuguuccgcacuugcugcccucgcccggcccggagcgccgcugccaugcggcuggcgcugcucugggcccuggggcuccugggcgcgggcagcccucugccuuccuggccgcucccaaauauaggugaguccuccgccuggagugggucggggggcggacugggagggaggugcaggaaagucggaaggcauuaggguaauggggccggacggagacccugggagagcccagccagagcgcggcccgcccugguccgcuguccugggccuagggcccggugacuuggcgauggggugaaaagagaaggaggggggaugccggcgcccccugccuccugccuggucauccucugcgcggucccugcggacacuuucaggcucagguaccagguaccgaggggccuguccagcgccacuucaagaucgugaugagagggucgcugcuccccaggacuggcaucuucgcugcucuggggccuagcuaaccguucgacccggugccagggcgcugagcgggcauggcuuguaggguuuagugaagaggauucucucuagccucuauuccaggccuggggccgccaggcacuccucacccuggugcuguugccaccagugccuggccgagcgggaggggcccgagaugagccaggagaagggagaauuggccaggaaagaggcugggacaccaacuccuccuuggaacuuucacuucccgcugcugucuugggccgggaccgagagggcaggcgcggguggaguguccggaggagagagggccauuguguguuggggggguggggggugcucgaggaggaagcagaggcuguaggcagcgggugugccugacugggcaugaggguguuuagggagguggggguguuugcacugcucacccagaaaugggcguuccuggcaucuccgaugugagcgaaggggagggugagcgggcacccggccacaaggcuuagcucagucucgagagggggcguuccugaaguggggggagagugauugggagggagugggaaccggggaggguccugugagaaccugggauuggccggaaggggacaaggagggccacaggcugcgcaagccgaaagucuuucuuggggacuugugaauggguugguggguggaaagccauaaauuagagagacacccucuccuuccaguauucuucuuuaagucucagcaugcaauguggaagccccucagguaccuaagggucuugaugggcugggagcugguggaucugagggcaccugucacccccagcccugcugucgauucccucaguacugucuugggguguccugggaccugcagguggcacugaggagcagcaggcagagucagagaaggccccgagggagcccuuggagccccagguccuucaggacgaucucccaauuagccucaaaaaggugcuucaggugagcucucacuccccucuaauaaauaaacgaauccacacacgccccgguauagccaggugucucaaagccaaagcuuggcugaggagcugguggguagagcucacuguagugggucuaucccaggcccagcugccucucccaccacaccccagcaccuggcuucacuuaucucccucucccucugcacacacguguaucugucugccucagccccacccaacccauccaucuccacuggggaaauugugaagccaaacuugcuuucuucaucucauguugucgguuuucucaguggggggauuuggaaagagucaggaccuuaccaaacccccccccccccaccccauucuaaagcugagucagaggaagggcuggggcuugugcuggguccuacacggugcuuccucucugggcaggaagccgagaagggguggcucagauaccuuccuugaccuccgcacacaaccccccagaacaaugcuccaggccaggcaggguuuccuggccccuccccugggauccccccaccagugaucuaauugcuggugcucuucugugggccugagguuuucugguuagagaggcugggaguuguggacaggucuagggaggugaccugcccucuggugcccacagaccagucugccugagccccugaggaucaaguuggagcuggacggugacagucauauccuggagcugcuacagaauagguaauagugaugguggcaauaacagugaccacauggccaacaacuuguauagcauuuauuaugugccagguacuaagugcuugugcucauuuaauccucauaacagcccuauaagggauauacuaucauguauuauuguccucacuuuauacaugaggaagucaaggcacagagagauuaaauaacuugccccaggucacacagcuaguauguggugaaaaccagauuggaauucaaauaaacuaacagagucaguggcccaaccaguauacuuugcugccccggggucaggaguggaaaaguuggcugcggggguugccugguccccagccccacaaccaccuucaagccucugcuugucaaugcacgaccugggaaguggcuuuagcacugccuucuuuuucuucacuccacagggaguuggucccaggccgcccaacccuggugugguaccagcccgauggcacucggguggucagugagggacacacuuuggugagucaggcccucuugugccauuuuuggcuuaggggaaagagggaggggguggcuggaaggugagaggacacugcauauuuuuaccgucaagcuaggcuccucaguuccaguccuggugugcucucugagacagcacuaauguuguucccaugcugcaggagaacugcugcuaccagggaagagugcggggauaugcaggcuccuggguguccaucugcaccugcucugggcucagguauacugggcggauuuaaugacaguagagaaaguaaggagacccaggcauggagcugaaauguucucugacuuucuuuuuucuuagaggcuuggugguccugaccccagagagaagcuauacccuggagcaggggccuggggaccuucaggguccucccauuauuucgcgaauccaagaucuccaccugccaggccacaccugugcccugagcuggcgggaaucuguacacacucagaagccaccagagcacccccugggacagcgccacauucgccgggugaggaugaauggcaggggggugggcuuugguugucuugagggcugauccccagacacuuagagcuaugugugcacaguaacaacagcuccugcgaauggagcacuuuccacaugcugggcacuuugugaacauuagcucguguacuccucccauaccuaggagguaggugcuaucaauagcucuauuuuaaaaugacgaaaccuuacaaaaaguaucugggcaugguggcgugcacccguaguuccagccacucaggaggccgaaguggaagaaucgcuugagcccaggaggcagagguuucagugggccgagaucgagccacuacacaccagccugggugaaagagugagaccucgucucaaaaaauaaaauaaaaauaaaauaaaauaaaaucuagcugagacagauuaggugguuugcccgaggcccuacaacuaauaaauggccuauccauuuauuaguuguauuuggcucuucaucugucuuaugaucccauuugcagagagcucucacuugguuauagauaauacauaguuaccaaugaugaagcaauauaaacccaauuuccuaauuuguaaaaugaagauaauaaaacuacuugcugcauagaguugcugggaagauuaaauaaguccauauagauguaaagugcuuaaaacuaugccagaccuaugguaagugacaagaguuguuauugggauuuuuaaaaauuauuauuauuauuauuauuauuugagacagagucucgcucugucucccaggcuggagugcaguggcaugaucucggcucacugcaagcuccgccucccagguucacgccauucucuugccucagccucccgaguagcugggacuacaggcgcccgccacuacacccggcuaauguuuuguauuuuuuaguacagacaggguuucaccguguuauccaggauggucucgaucuccugaccucaugauccacccgccuuguccucccaaagugcugagauuacaggcgugagccaccgcacccagcuaaauuacuguuuuuuaaaaauuugaaaaaaaccacugaguuuggagccagaaaagcaggggucuacuccaaccuucauuaucuacuuccugguccuccuuggcaaguuccugggcccucuggccuucaguggcucaucuguaaaaugggcucuucacccuccuauuugacccacagaguaggaguggcugccucuuggucagcccggcacagcugcuggcugcgagcggcagguuugccugauaauucuucuuguccauaguagaggcgggaugugguaacagagaccaagacuguggaguuggugauuguggcugaucacucggaggugagccugcuggccccugcacauccuccucccccugcacugcccugccgccuuucaugucaccucucuuggccuacaggcccagaaauaccgggacuuccagcaccugcuaaaccgcacacuggaaguggcccucuugcuggacacagugagugcuggacagggcaacccccaccccaggccccugaccauggcaaccccucuucugagccccagcugucuuucaguucuuccggccccugaauguacgaguggcacuagugggccuggaggccuggacccagcgugaccugguggagaucagcccaaacccagcugucacccucgaaaacuuccuccacuggcgcagggcacauuugcugccucgauugccccaugacagugcccagcuggugacguaagggccccagacucagccagagaggccaguccuguccuggccaaauucacaccccuucagcacccuaccucagccccugaagcucugaccaccguggcuucuggcccugaacuuuagccucucugucccacagugguacuucauucucugggccuacggugggcauggccauucagaacuccaucuguucuccugacuucucaggaggugugaacauggugaguuauuuccaggucuccuccucauucccaauucaguuccucccaagugugguggcauuuaugcacugaaaccccccuauaaaguugcccaaccccaaagcuacagguauagaggguggagguacgugauguggccuuugcuaucagggagcccucgcuuauggccagcuagucacaguguacacagucauccccugugcagucuucccauuucuuagaggaggguaggaggcagcuaaggcccaaagaacagaggugaucucccuccagugagggagggggacagagcugagcuagaacccaaguuucugccauccaggccuggguucuccuacuuuagaagcaauucaggagggaagcagugccugcugagugcccacgaggucagacguggagggaacaggagcagagaggguggucugggcauugugguggaggcaggcugggacuggaccuacaguaccccuccccaaugacaggaccacuccaccagcauccugggagucgccuccuccauagcccaugaguugggccacagccugggccuggaccaugauuugccugggaauagcugccccuguccagguccagccccagccaagaccugcaucauggaggccuccacagaguaaguagcugcaggauggagagaggguguggggcagggggcagggagaggcccccagccccaaccuuccuugccacccuccccagcuuccuaccaggccugaacuucagcaacugcagccgacgggcccuggagaaagcccuccuggauggaaugggcagcugccucuucgaacggcugccuagccuacccccuauggcugcuuucugcggaaauauguuuguggagccgggcgagcagugugacuguggcuuccuggaugugagccccuuucccaaagccucgccccacucacuucuguacccucacccuggcucauuagcccuaucccagccuccugagcucuuggguucugaagggacuuuccaccccucuccuacuugcccugucuguggggacagcacauggguuguugggcucuagcccucgcuugcuguguagcuucuggucuuggccugugggaggaggagagauuggagggaggcucacaggccccaccugcucugaugcccggcccccgugcuccugcccacaggacugcgucgaucccugcugugauucuuugaccugccagcugaggccaggugcacagugugcaucugacggacccuguugucaaaauugccagguggguagagacuagacuggccacccggagcucaccugccggggccaagguggaaagggucauucugacccccggcuggauuugcucagugcccacacugaugcucauccacccuccacagcugcgcccgucuggcuggcagugucguccuaccagaggggauugugacuugccugaauucugcccaggagacagcucccagugucccccugaugucagccuaggggauggcgagcccugcgcuggcgggcaagcugugugcaugcacgggcguugugccuccuaugcccagcagugccagucacuuuggggaccuggagcccagcccgcugcgccacuuugccuccagacagcuaauacucggggaaaugcuuuugggagcugugggcgcaaccccaguggcaguuauguguccugcaccccuagguaagugaggaaaccuggcuccuccuuuggguuucugagagccuuggcccugcuccuacuaacucugugugcccuucccccuccccacagagaugccauuugugggcagcuccagugccagacagguaggacccagccucugcugggcuccauccgggaucuacucugggagacaauagaugugaaugggacugagcugaacugcagcugggugcaccuggaccugggcagugauguggcccagccccuccugacucugccuggcacagccuguggcccuggccuggugagcagccugggugggcaagaccaggugugagaagggacauuuggaccacaaugaacagagcccagacuucaccauucaccaaugucaaaggcagggacuccaagggaagucaguuucuuacuucagauggagcaaaguccuaucaacucacuaugccuugguuuccccaucuguaaacgcaggguauggccucaaccuuauuggccucccagucccauuaaagcuuugugggaaucugauccaggcucuucucucccugggucagguguguauagaccaucgaugccagcguguggaucuccugggggcacaggaaugucgaagcaaaugccauggacauggggugagcugggaugggggaaguggaaggggagcagagagccucuagagaggaaaaggauacugggcuuuggaaauagacauaucuggguuuuaauccuugcucuacuacuucccaguugugugaccucgggcagguuacuaacuuugcugagcucaguuuccccaccuaucaaauggcuauaauaauaguauccccauccaggguacaugagaugaguaugaaagcaucuagcacaggcugggcacaauggcucaugccuauaaucacaguuuuuuuguuuguuuguuuguuuuguuuugagacagagucucgcucuguugccuaggcuggagugcgcuggcgugaucucggcucacugcaaccucugccucccaggcucaaacauuacucaugucucagccucccuacucgcugggauuacagucacccgccaccaugcccagcuaauuuuuguauuuucaguagagauggguuucaccauguuggccaggcuagucuugaacuucugaccucaagugauccucccgccucagccucccaaagugcugggauuauaggggugagccacugcacccagccaaaucacaguacuuugggaggccaaggcaggaggauuacuugaggccaggaguucaaaaccagccuggucaacauagugagacccccaucucuuucaaggaaaaauuuaaaaauuauucaggccugcuggugcacaccuaugcucccagcuacuugggaggcugaggcaggaggacugcuugagcccaggaguuuggggcugcagugagccauaauugcaccacugcacuccagccugggcaacagagugagacuccaucuuacuugcugucuaaaauaaaauaaaauaaaacaaaacaaaacaaacacaaagaaagaaagcauguaccacagugcccagcacacagaaggagcucaguaaguguuaguuugaucuaauuugcucugguauggauaaagacccucccuccgggcugucucuacacacauacccagcacaacccccaguuguagaaaucugagaucuugaaaagcuagagacaaggaaauaguuccagagugcagagcuccucauugcucgccuuguaccuccuaggucugugacagcaacaggcacugcuacugugaggagggcugggcacccccugacugcaccacucagcucaaagguagcaugggggugggggacaggggcagcugggagggcaaagcgucucaugcuuuaucuugcccccucggcccucucuuucugaccccccuuugcugcugguucccugagucugugccccuugaacccuucacucucccugaucacuugacuucacucccugcccccugcgccuucauggaucuagaguucuuagccccguccucccuuaaaccugacuuccgcccacagcaaccagcucccugaccacagggcugcuccucagccuccuggucuuauugguccuggugaugcuuggugccagcuacugguaccgugcccgccugcaccagcgacucugccagcucaagggacccaccugccaguacagguaugagcaucaccucccugcuaccacuuccuucaacuggggacagugcugaaggcugccucaccucugcagccccugccaccugguucugagccccaggccccuuggaccuuaaaguugcugacugccauaccccacaccucccuucccuauaugugcccacagcuuuuuaccucacagcugugccccugugggguggcuggauugcuagggccauuucuccccaggagccccugugcuggauaaguagggucuucccucaagcuaauaaauacugccccccaccccggcccuaccacaauuuuaccuaaaccacacauaagugccugcaaaggguuaaccccacucagggauggcauaugguagaaaacagggucugaggcugggcccucucccuucuugccuuuccucaugcauagggcagcccaaucuggucccucugaacggccaggaccuccgcagagggcccugcuggcacgaggcacuaaggugaguccuggaugccagaggaaggggacuccaccuuggccgggcauccagcuugggcccuggggggugcgcauuaaaggcuccagacucagagaaaggcuagcacugcccaagagucagucgaaggagucagggccagcccugcccuccccuccccuggcuacaggcagggaagcugaguccagaagaguggggagggcagccagcuggagcaggagcugcugggcuccguccgcuggccaagagguggcuuugagagguggaucuauccaugcccccagcagugaccccaggagggcacaagggcaguggugcucagaauggccuuccguaggcccaggucaccauguuagaagggcuggugagcauccccacccugagcccucugcuuggaugaugggagugugugcacaccuccuccccacucgcuccccaccugcaugcaccugcauaacugcaugcacagcacccacugcccugggccccugcuggcccccccugggcacugacccuucccugcccacucugucucucugcuuccucuucccccucugugccuaucugccccuccugcccucucagcaggcuagugcucucagcuucccggcccccccuuccaggccgcugccgccugacccuguguccaagagacuccagguaaaucugggccagggcccgcccugagccaaggcaggugggaggcuugguacccaacugcaguucucaucccugcucccugccaguggugcucuucauuaggugaucggggugccccucagccuucagacacucugagccccagaagcagcaaagggugagccuccugccuugguuucuaccaccaucugguggucaauggcgggacugcagucggccagggacugcgguugaccuacaccuuccuccccugagacaucagcuggcaugccuccaagcccucugcgcaugcccucauucucuccugcccccuggcugacuuugcauguugacuugaaccccucuggggaaucucugugcauguccacagccccugguuaugcucucacagccacugccccucucucuguucaggcugagcuggcugaccgacccaaucccccuacccgcccucugcccgcugacccgguggugagaagcccgaagguaacgguggggggagagaagggcacggccucuccccccaccuagggcuguggugcugguagccaugacggugguggccguggcgagaugcccccucagugcaugagggcacauaucccgguggugccuuuaauggugacagguuuguuugcagacaagggugaccgcuggugcugcccccaagcugguguuccccagcaccagugcguugggggugggcaacaugacacccccccaccuaagccggccuccugccuucucucccucagucucaggggccagccaagcccccacccccaaggaagccacugccugccgacccccagggccggugcccaucgggugaccugcccggcccaggggcuggaaucccgccccuagugguacccuccagguaggaggagcccugggcaugggugggcggggcgagugaccugggggaaaggggccucugacucuuuuuucuuggcuucccgcaauccagaccagcgccaccgccuccgacaguguccucgcucuaccucugaccucuccggagguuccgcugccuccaagccggacuuagggcuucaagaggcgggcgugcccucuggaguccccuaccaugacugaaggcgccagagacuggcggugucuuaagacuccgggcaccgccacgcgcugucaagcaacacucugcggaccugccggcguaguugcagcgggggcuuggggaggggcuggggguuggacgggauugaggaagguccgcacagccugucucugcucaguugcaauaaacgugacaucuugggagcguuccccagaguuugucugcuucuagaacccgggucgcuccugcugcgguuccagguuuggccgccagaagacgcugccgccucagacgagggcgggcuguguggggcgggaguaccagaaagggucggcguguguccccgggaugcucgcagcuucccucugcccagacugggguggcuuucggcgcaaucugucaagcuguuggaccugccguccccacucugaccauuggcugggaaaaguggaucuggcugaugcucccagagcccaggagccagggcggagcggggcggcggcugcucccacgaucccaaggccgcgcaccugccuccucccccuccgccgccgccaccugagggaucgggaacaaaggugcuuuguacaggccgcaaccaccucauuacuucgucuuagggacuggggccgcgugggcccccagcccggaacgaagguguggagcggcaagggacagacgccaauccuaaagugagcaucuagcgcgccaccuaaggcucuuuagggaagguggucccagagcuguguugucccuuccgcuugcacugucccuagaugugcaaagaaaacggggcagugcaugaaggugguuggacaggcuucauggauccucgcccgcgccucacuuuccccuaucugggcaaagguuauguacccuuauuuaaaaucuuccaaacuucuaauaaggcagucuacccugcacuaaagcagacacgaaagagaugaccu

SEQ ID NO: 13687 - RNA, 15142 nt, Homo sapiens
cuuggggggagaggagccuagcauggcgagagcugugguucgcagcgugggagguuuuacccugggcuugucuuuagccacggccuacgggcuucuggagcuacugguggaaggccacagccccugggguugccuggugggcacccucacuuuggcugccuuccuuagccugggcaugggauucucucgccagguccgagccacuguccuccugcugcugccucaggccuucuccagugagcuuggcacccagggcuagggggcagguccuggggcuggugcuggggcagaagagaugcuggaggagaggcagggguuaagggaaauauucugaaggcuuauguaagggacuugcugccauguuuggggcuggggucuugguucuaacaaagcugucgcccccagggcagggccggacacuacuguugguggcugcuuuuggguuggugcuucaagggccuugugccaacacucuacgcaacuucacccgggccagcgaggcuguagccuguggggcagagcuggcccugaaccagaccgccgaagugcuacagagggccaagcaaccucuugucaguaagucccccaccucuaccacugucucccacgggccccccucgccccccucauccugcauguucuacaguccuuuggccuccuucucugcuggugcuaaucgcggagcaucugggccuggaagggacucugggcacagcuaaacccucucuccuugcucucuggccuccuccacucccagauuaacgaucucccaggccccagaauccaggcuucccgccucuggaaaugguggccuccucucuacucccugcuuaaggggcaauggugagaaccagccccuagaggagaagacuccaaagugccucugucccucacccaucaggugcccugaacaagauuaaagcuauugcccggaagaccaaagagguggcugaccggguccgcaaguucuuucggucaaucauggauggugugaaacacauagguaagcacauuagcaugucuaucccggggacucaaaaugcacccaguccuggccgggugcgguggcucaugccuguaaucccagcacuuugcgaggccgaggugggagaaucacuugagcccaggaguuugagaccagccuuggcaacauggcgagacccugucucuauaaaaaauaaaaaaauagaaaauaaauaaaacuagccagauguaaugacacaugucuguagucccagcuacuggggaggcuaugguggaaggaucucuugaacccagggguuugaggcugcagugagcuaugaucgugccacuguacuccaauccagccugggugacagugugagacuccaucucuaaagaaaaaaaaaagcgggggggccaggugcgguggcucacaccuguaaucccagcacuuugggaggcugaggcgguggaucaggaggucaggagaucaagaccauccuggcugacaucgugaaaccccgucucuacuaaaaauacaaaaaguuagccgggcgugguggcacgcagcuguagucccagcuacucaggaggcugaggcaggagaaucucuugaacccaggaggcggagguugcaaugagccgagaucacuccacugcacucuagccugggcaacaagagcgaaacuccaucucaaaacaaaacaaaacaaaacaaacaaacagaaacaaaaaaauucagucuccucaccuguacccuguccaggguuuuuugggccccuucugggcgcuggcuaguguucacuggacacagcacagccaggucccugaccacaggccucuccagcccuggauacugugguauuguuccccaaaacccugagaagaggcuguaggauuccagcccugggugccaacccugcagcuguccccagccagggcucuccggaauguguggcaguggcuccugcacaucggcgaugugugcaacucggaacugggcaacccuuaccugaagugugcacggguuuucgaugaugccaaggacagcugcaugauggucauaccacaagccuaccaccuguguuacgugcucaugcccuucaaacuggcgcucuguggacuugccagccgugagaaaaccagggucugccagcggggaggagccgauguggggugggguggggugggaaugugggggucaguugggagggcaggcucaggaggacgauuagagggcaacagagaggaaccaauaagcuugguaggaccaguauugggggugggggugggcaguagggagggacugguguugggagagaagggcgacagggaggugcuacaagguuuugagcaaauguggaggccaauaggaaaaucgaaaagaggcccugugagaagaggucuccagaggucgggggcaggccuggcugugccccuccuuccgacacucagccgacuccgccccucagugguccagguguucugcgucaucccuaaguacauucaacccuucuugcgccagaccaucggcacccgugagugacccccuccugccacauauggugcucccuaguggucucccucccucaucccgguguggccauggccagcccccagugcucccagcccauaaaggagaauguaagagaaagaaaggggcucaagugaucacccaggcccauauccaugcuguacagaucaggaaacggguccagcgaagggccagugccucaccacagccugcccugagagcaggagcugggaacagaaccagggccuccuguccacauucagguccacacucaggucaucaagaucauuccuuaggggcaucuguugcaugcccugugucaugcugggugcugagcaugugauggcgauggcacagauacguggaggcuuuguccccuccucaguccaccuugacccaagcacugggggguucccagcuggucuguaagcugcgcccccugggcugugccaggccccuccccaggggcagcuccacccucuccuaacucuccuugcccacgucuccccugaaccugcuggccccagccgugauucaguugcucaaccgggugcgucaggaguuugaguucaacaugacagccacccaccacuucucuguggaucucaaugccucucggagccugucccagguagccauggaccuccacgaggcugucagcaugaagcugcaccguguccgagaggcccuggcucugaugggcuucaccacgccucugcugcuugugcuucucuaccuccagugaggggcugccgggcagcgugggggaugcagggccgggggugcagggccagggcugcagggagcagcucauuucucccugccccagcauccagggagguugaaguugugggguugaagcgcggaugcccuguggggucuggccugggguccuaaggggccucacaugugcuccaccuccccuucccagagcccuauuuuaccgguauuguuaccugaacugggaccauuaugacaauaucuacaucacuagccgauuccugcgcauggaggcugugcgcuccacggcagggcugcccacagugcuaccgcucagugcucacgaggccaggcgcuacaucccaccgggugagggcccugaggacagggagagcccaagccagggaggccagggcuuccccccaccccgcugcccugccccuaagccccugcacaggcagggcucaggaugggcuuggggcaggggccagagggaggagacacaacccagagcuuaaggaacuuucaggcugagggaagacacugcccgguccuuggggagcccgcagucugaaagggggaacauagacacccuuggagaaaguagccagagacaagaggggcagauggugcuucugggagcacccuggacaucaggacagcaggggauggacacagagcgagggaagucaaguugggagggcuuccccggggugggcaggaagugcuaauauggagggggaggacugccugugagguggggaggcagguaaggggaugagggaugcccuaggagggagggcuccuuagacuggaaugggccacagggccagguggagaugcuaggcaggccccucccuucuagccacggagcccccuccccugaagaguauuuuccauccuugccagaguccucacagcuucuuuucuuuuccguauuccugaugagcagacgggcccacaccugauuaggggcaggaggccucuccaagaacugggaucugguggacgggagaacuggggagcauccuccugaccaucccacuccugcucaggcuccaucuucuugucccaaugggagaaguuuuuuuacauucuggagaccuucaaccuuauccgacaccuccuccucgugcuguuccuagucuuccuagacuaugcugucuucugggugcuugaccuggcccggcaccagcugcagggggagauuguggcccgcagugagugccuacgugacagccuccucccacucacccacugcagcccccucggccuguuucugaucuccccgccugcucccaagccuucuccucuucccauccucaguccuggugacugccugaauguccccaugucacuguuacucagcagcccacaagugugccacucuuucaacucuaugcuuugccuaguaacaccuaugucuaggucaagauuauaacuuacagaguaguuaaaaaugcaagcucuagagucacacuggccaggguucaaaucccagcucuguccuuuauuaggcggugaccuucagcaaguugcuuaaccucuucagcuucaguuuccucuuuuuuuuuuuuuuuuuuugagacagagucucguucugucaccaggcuggagugcaguggcgccaucucggcucacugccuccgccucccagguuuaagugauucuccugccucagccuccugaguagcugggacuacaggcacaugccaccaugcccagcuuauuuuuguauuuuuaguagagaugggguuucacuguguuggccaggaugguguugaucucuugaccucaugaucugcuggccuuggccucccaaagugcugggauuacaggugugagccaccaugcuuggccuuuuuuuuugagauggagucucacucugucacccaggcuggagugcaguggugcaaucuuggcucacuacaaucucugccucccggguucaagcaauucuccugucucagccucccaaguagcugggacuacaggcacaugccaccauguccaguuguauuuuuaguugagacgggguuuaaccauauugcucaggcugcucucgaacuccugaccuccggugauccacccaccucagccuuccaaaguguugguauuacaggcgugagccacuguccuggcccaguuuccucaucugaauaguggaauaauaaugguagcaaccucucugggucacuguaaggaauaaauuagauuauguguguuggggccaggcggguggcucaugccuguaauccuagcacuuuaggaggaugaggcggguagaucaccugaagucaggaguuugagaccaggcuggccaacauaaugaaaccccaucucaacuaaaaauacaaaaaauuagccaggcgucguggcaggugccuguaaucccagcuacuugggaggcugaggcaggaaaaucacuugaaccugggaggcagagguugcagugagccgagauccugccacugcacuccagccugggcaacaagagugaaacucugucuaaaauaauaauaauaaaauaaaauaaaauaaaauaaauuaugugugucgagugccugguaagccauuaauugagaaugugagccaggugcgguggcucacgccuguaauccuagcacuuugggaggcugaggcagacagaucaccuaaggucaggaguucaagaccagcauggccaacauggugaaaccuugucucuacuaaaaauacaaaaaaaugagccaggcauaguggugggcaccuauaaucccagcuacuugggaggcugaggcucaagaaucacuugaacccaggaggcagaggcugcagugagccgagaucacaccacugcacuccagccugggugacagagugauacccugucucaaaaaaaaaaaaaaaaaaaaaaaagaaguaaaaaacuccuaaaaaacaaaaaccaaaaccccaaaacaaacaauaaagcacuugguuaagugucugcuacacagucagugcucagccaauaaauguuucugggggucuuacucgguggcucacaccuguaauccuagcacuuugggaggcuaaggcaggcgaagugucugcuacacagucagugcucagccaauaaauguuucugggggucuuacucgguggcucacaccuguaauccuagcacuuugggaggcuaaggcaggcggauugcuugagcucaggaguuugagaccagccuggccagcauggugaaacccuaucucuuuacaaaaaaaaaaaaaaaaaaaaaauagccggucgugguggcacgugccuauagucccagcaacuugggaggcugaggcaggagaaucacucaaaccugggaaguugaggcugcagugagccaagaucacaccacugcacuccagccugggugacaaagugaaacccugucucaaaaaauaaauuaaaaaaaaaaauaaaugcuucuggguggucauggaggccgggggguggacucacugaccauuaaggucaucuuagauaugguggcuuggauaggaagaccagacaccaguaccacccaguuggaccauggggccaguccuaggagccagaacugaggucaggccccagggcaccaugagggugccugaggcaucagaggcccccagccaagggucugagucauccuaugaccugcgcugcuccacuuuccucauuccagaaggugugggguuuucugcauagcaacugccaugagugucacucacacagugucuuugugccagguccuguguuggugucucuaaccguggaagguacuggcuacgcugggaauauuuaucgugaccuggugucagcauuugauguccugcagcaaggcaacaucaguauuuugucccggcguugucuccuucgucccucggagccugacagcacuggcuacauagucauugguaucaacuacacccugaggucccugggggcguggacaccaugugggaaaugaggggugcagacugcugaggauguggggggcgccaggggugggcuggcacuugugccugcuggugaggcugacuguggcugcugugcucccaggcgucauguauggccuaugcuucuucaucacccuguuuggcagcuaugucagccggcugcggcgagucaucugugccuccuacuacccaucccgggagcaggugagggguccggggcugggagcuagucccugcccccuccccagggggcuuagcuaguggcuggcuuuuuuggcuuugggagcugacuuccuucagcagccccagcccgcucuccucugguugaacuccaaagcaaaugaccuggacugcaagccucuggacccaagauggggcugggagaaauggugccucugggguggggcuuccugagacagcauuuacauccaaaguuuuguuaaaaucacagggguguugagggggugggggaugagggacgggggagaguuggagaguggagcaggcagcauggcucacaccuguaauccagcacuuuggaagggugaggcaggcagacugcuugaggcaaggaguuauagacccuuucugcaacaaagugagccucugucucuauuaaaaaaaaaagaaagaaagaaaaaaaaagaaaauaaaacgccaggcaugguggugugugccuguagucccagcuacuagggaggaucgcuugagccgaggaauucaaggcuguagugagcuaugauugcaccacugcacuccagccugguaauggagugagacccugucucaaaaaaacaaaacaaaacaaaacaaaaaaacaugguggugaggugggggcaguguuggcauguugagguguaauuaaaaacucaccaucggggcuggguuugguggcucaugccuguaaucccagcacuuuaggaggccgaggugggcagaucacaaggucaagagauugagcccauccuggccaacauggugaaacuccaucucuacuaaaaauacaaaaauuagccgggcgugguggcacgugccuguagucccagcuacucgguaggcugaggcaggagaauugcuugaacccggaagguggagguugcagugagccgagauugcgcaacugcacuccagccuggcgauagagcaagacuccaucucaaaaaaacaaaacaaaacaaaacaaacaaaaaacccucaccaucgguuuacucauuuacuaaucauuuacugagcauguacuguauuccccuaucucuuugccagucuccaaggaugccaagaugaaccagacacagucuggagcucacagauucgaggcaggccagacaagcuuucuuuucuuuuuuuuuuuuuuuuuugagacagaauuuugcucuuguugcccaggcuagagugcaaugacacgaucucggcucaccacaaccuccgccucccggguucaaacgauucuccugccucagccucccgaguagcugggauuucaggcaugcgccaccaccccaguuaauuuuguauuuuuaguagagauggcguuucuccauguuggucaggcuggucuugaacucccgaccucaggugauccacccgccucggccucccaaagugcugggauuacaggcgugagccacaacgcccggccagacaagcuuuuaacaagacguuguaauuuaaaaagcacuuuuauuuaggaaugaauaaaaguguuauggaaacccagaggagagagugguaacuccaccugggcaaguccagaagacuucccagaggaaggggcauuugagccaaaccuagagggauucauaggaguuggauagaaggaaaagguagguagugggugcagagggcauuccaggcagacaaaacagggucaagugggaccccaucccugaucuccccgcaccaggagaggaucuccuaccuguacaauguacuucugagccgccgaaccaaucuguuggcugcccugcaccgaucagugaggcggcgggcggcugaccagggccacagaagugccuuccuagugcuggccagucggugaggccacugucuuuucuauagggguggggcaagaggggauagaaaaagagccaggaguuggaauggauuucugugcuaucuaagugucaagagauuugguugaagagaaugcccauugcauacccuuaacgcugugaaaggugggaauucuuuuuuuuaauuuauuauuauuauacuuuaaguuuuaggguacaugugcacaaugugcagguuaguuacauauguauacaugugccaugcuggugugcugcacccauuaacucaucauuuagcauuagguaugucuccuaaugcuaucccucuccccguaaggugggaauucuuaggggugaggagugaagggaggaaggaaggcagggccauggagagguugcugcugaaaucagagggauggaggauguacugcaggaagucaggaaguccucccugccauuuggagguuggugcuggaguggggaggguuaagcuggcugggcuggccugcuuagugucugugacccuuuucucaggugccccugccuagguccauuugucagccacuuuuggcugcaucaggccuacugccugggcugugggcagccccaggaugagggagacauggagaacacuguguccugcaguacccccggcugccaaggugagacccccuggggcgugugccucucccugcucggacuuaccccacuugcauaugacaauccacugugguccuuccuugauggacuucucuuguaccucaucuuuugugccccucccuucauuacuaugcacguucucauuuacacagagccuucagguagcucauuuucuccaugcuugccuuuauucucccggguauuuaugaauaggauuuauaugcaaguggcauugcagcagcucccuagugugcaccccuugacaaggaugguucauccaggucugugauaggggaggcaggggcuggcaaccaggaagcacagagggugggugggugaacucggguucaccuccauuccccauggccuccaccaggucucuacugccucacuugcuuccgccuccuggacaauaccugcuccgugugugcaucuccccucuccuaccagggggaccuggaccuggagcugugagucuuucagugacaugggguggcuggagucuguaggggcaguggaaguaggcacccuucucccaggaugucugcaggccacugagaugagagucuucuccagggacuccagcgaugaggagggcccucagcuauggcuggcugcagcucaaaggaaggacccugagcaggcaugguuauugcagcaacagcuccaagaagugcucggcaggagccucucaauggaguccacuuccgaguccaggugagcaggaagcaggaguuggcaccugggaauugugaguccuaagcauguucuguuccauuugcaaaggccuuccugggugucuggaccuuugccagggcuugaaacagacaugaggggaggggaaguaacugagguuugccaagcggcugcucugugucagcaccguggcccaggaggagcucaccaugcccuuggggagagugacaucgaauagauaacaggguggacagcacccugauaaaggagugaaguacacucuggacagcacagaggacacaacagccaauuugggaaaaggggcauauuaaugaaggcuucauagaagaggugauacaugagcuggauuuuuguuuuguuuuguuuuguuugaaacagggucucacucugucacccaggcuggaaugcaguggugcaaucccaguucacugcaaccucgaccuccugggcucaagugauccucccaccucagucuccuggguagcugggaugucaggaacaccaucacaccugccuuauuauuauuauuuuguuauuauuauuauuuuguagagacgggggucucacuauguugcccaggcuggucucaaacuccugagcucaaaccauccucucgccuuggccuuccaaagugcugggauuaugggauuauaggugugagccauggugccuggccacgggcuggauuuugggggcaacuuggugguuuguuaggcugagaaguagaggaaagcauuccaaggggaggccuguguggguuuggagaaugugaggcauucagaaggguagagcccaagggauggguguggcuggguagagaccucagagaaugcugggagaugagguuggaagucaaggugggaagagaugggcaagaaccuuaacuugucauuugaaaagcuuagguuggaaagugauaugcucauauuugucuuuuaagaccauaagcgggccgggcacgguggcucaugccuguaauccuagaacuuugggaggccgagguggguggaucaccugaggucaggaguucgagaccagccuggccaacauggcgaaaccccaucucuacuaaaaauacaaaaauuagccggguuugguggugcaugccuguagucccagcuacucgggaggcugaggcaggagaauugcuugaacccaggaggcagagauugcagugagccaagaucacaccacugcacuccagcccagccuggaugauagagugagacucagucuccaaaaaaaaaaaaaagaccauaagcaaagaaggcagaguggagguugggcaggagcagggaggucagagagaagcuugucuuagucuaggagaaguucgugauggccucaguacugaagugcugagcgugacugggauuucuaugcuugggccugggcagguguuagggcaggaagauaaacagguucuggggaaagacgacuggcccaguuugagaucuuugaggugucuguagggcauccagcuggagaugcccaggggggcaguuagaaaagggcagggauccgggcuggagguauauuuuugggggguuaaguuagagacuguaagagagaggaugagcuagaucauccuggcagagggcauggcaggagagugggaggggacagggaggggagaggcucaagaaagcaggagagccaaacauaugaaaucaaguagggggaugggcacaguggcucacaccuguaauuucagcaauuugggaggccgaggugggccgaucacuugaguccaggaguucgagaccagccugggcaacauggcaaaacuccaucucuacuaaaaauacaaaaacuugccagggcaugguggcucacgccuguaaucccagcacuuugggaggcugaggcgggaggaccacuuaaggucaggaguucgagaccagccuggcuaacauagugaaaccccaucucuacuaaaaauacaaaaauuagccaggagugguggcacgcaccuguuagucccagcuacucaggaggcuaaggcaggagaauugauugaaccugggagguggagguugcagggagcuaagauugugccaccgcauuuuagccugggugacagagggaggauuggucucaauaaauaaauagguaauaauacaaaaauuagcugggcaugguggcgugcaucuuuagucccagcuuucaggaggcuaaggugggagggaucacuugagccagggaggcugagacugcggugagccaagauugcaccacugcacuccagccugggcaauaguacaagacccagucucaaaaaauuagaagauuaaaaaaaaaaaaaucaaguaggaucaugugaagacaggugacaggcaguuaagacaucacuggaguagcuugugggaauauuuuucauggcaucgggaagaccaaaacuggaucugucaugauggguugaggggugucagguaaagaagacucagaaaggcugggugugguggcucacgccuguaauccuagcacuuugggaggcugaggcgggcagaucacuugaggucaggaguuugaaaccagccuggccaacaugguaaaaccuugucucuacuaaaaauacaaaaaauuaggcaugguggcaggcgccuguaaucccagcuacuugggaggcugaggcagaagaaucacuugaacgcgggaggcggaaguugcagugagccgagaucgugccacugcacuccagccugggcgacagagcaagacucugucucaaaauaaauaaauaauaaaaggacucagaaauaugguauguggcuccugcaucacuguugccaggaguuugauaaugcuuuuaaucuaaugagugcuguaguuugaaaaaaauguaagcuugauggugaagagaaagagagaguuagcuucacagagcaagaaaguagcuugaaggggauucagcacuaaaaggguuuucuagaucuaagaacaggaagauuugagcauuuaggcaguguaaaagcacguuggggagggagguuugggcuccagggccagguggaccagguggccugccugagaaaggagcaggcuggcagaggcagagggggagaguauagguuccccugagcagcugagcccacuccagccugguggccucgcuucucuuuggggaguaggaggcaagagcaccugcugagagagcagagcaggcagcugggaguggaauaaagguuucaaggagugggugguagagguugaaagaccugccguggcaagugugcaaagaagccgacuagggagguuaagggauuuccagguagcgucaaaggcccagaugaugcuggaagcuguaacuuguaaugauugcuccagugcgcucaguuaugugauuuucucuggcaaaugugguagccaugaauaggauucacagguggagggcuuuuucugggcaggucaggaggacaagauggagugagaauugaggugucuuugguaagagugucugagaugacuggggaagaggaggggcuaaggccccugggggcagcccagggucucugucuugaugacguguuagagcaggggcaguggccaggagggagagcuggcugaacaggagggacucagagagggggccauggccagggaagaacucuggaaugaauccagugaaaggccaaggcugaggaagacgucugagugggaacagagaugacggucaauagaaccaaggagguuagggauugagaggccagagaauuggguggguccucuagcgacgagguugcaggaccauacaaacagcaggaguccagagccggcaucuuaaacagauguggcaggugucuggcaggccugaggagacagccacagcacuggugguacagcuaucauggcagccaggggcuuugcaaaaaaacacuacgggccagcuggguuugagaagguuaagcugccuccucuugggaggacugcaaagaaaacuguccagugggcacauuccagugugaauggggcgguagaggucaugaugagucaagagguugaaggggaagcaaagcuuucuuuucagagguucuagagggcccagugaaaggauaagcugggucagcagaggggacagcuugagccuugagcaggugugacuacugaggucacuagugauucugcccuuccuagccauguggccucaggcaagucacugcccaccccccagcaucagccuaaaaucagaaaauaucuacagccaugggcugguacgccucgugggccugagagagcaggaguugcucagaaagaacaggagcuggaucugaacagauggggcagggcagggggcagggaugcaccugugaagacagaaggugggugauccggccacccccuuccucuccucacuagugaccuggaugaggagaaggggccucagcagaggaagcacgggcagcagcccuuaccugaagcccaucagccugucagcauucucaccagcccugagccccacagaccaccugagacauccuccgccacuaaaggagcccccacuccagcuucagaacccucagucccucucucaccucccucucuuccugauccuucccacccaccccccaaauaaaccaaaaguggacaca

SEQ ID NO: 13688 - RNA, 6388 nt, Homo sapiens
gcacccgcuccaugccacuucccaccucagcccuaagcucccuguucucagcccauuuggagguuucaggugcagcccuuucaccuaauccacacagccaagagaucuuuccuggcccauggcuccccacucuguggcuguucccccacaaguaucucuccccgacuagggcaacucagguuuugaguguccaaauuacucccucaggaacucaaguggaguaaggugggagggaggugaaggagacaggguaccaagauauuagguuggugcaaaaguaauugcggccuuugccauuaaaaccucaccuaccccucggugcccuggugcccucuaauggucacagggggugggggaauggguggaguaggaauggagacaggagggaccagcuggaugugacccucaaguacaacagcgagaggagaagccugauauccaggauucccggcggauuacaucggauacaggacccucguuggcaugcaaggaacaguuggaggagaggggucacggcccaagggucugaggagcggcaggcaauaaacuggauaucauagcaauaaucuggcggcggggagggguggguggguggggaugucccacguuuucccaacaccaagaggccggcaaaaagggguguguggcaaucauuucacuggcagcgccagagcgcagacccauccccaagggcauaggcuuuuuuuuuuuuuuuuuuuuuuaaagacgggguuuggcucuuguugcccaggcuggagugcaauggcgcgaucucggcucaccgcaaccuccgccucccagguucaggcaauucugcuucagccuccugaguagcugggacuacaggcgugugccaccacgacuggcuaauuuuuguauuuuuacuagagacaggguuucaccauguugguuaggcuggucucgaacuccugaccucagguguuccacccgccucugccucccaaaguguugagauuacaggcgagagccaccgcgcccggcaugggcauaggcucuuauuugcaucauauuuacaucugucuugcaugugaguuauuucccuccacccaacuuucucaguuacucucagacucuagaguguucgccagccuuggagcguacccguuccuccagccauucuucggccucaguuccuuuccaucauucgcccucaggccuucgccuaccccagcuucaaagaagcgaccguaaccuccuagcuggcuggguucgagaagccggggaccugcgccuccugguggcugaucggaaggaggcugagugcagagggguugucuugccuucucugggacguggaguuuuggaaacuguuccccugagcuuccugaagcuaaauuugccucccccggccuuggggggcgcagagaucccggcggcgauuagcgcugcgcggcagccggcuccaacccagaggcccggaauaggcgcggaguuauaaauagugccacccgcagguguuggggggagucggcgggagggggguaccccuggcggccacggccccuucagguggguugggcggucgcggugggagcgcuggggggcggggggcguggggggucugcggucugagcgcccccagcgguuuccugggcggcggguuuuucgagggaagcggaggcagcggaggaugggggggagcagcggagaagaggugggcgccuggcgcaugcugacgcuccgcuugcagcucagccccccacauuccgaaacaggcccccagacccacucacgcaggaccccgcccaggcaaagccucgccuuucuuaacaccugaaggccucauucccccagguucugcaagcaucuaacuucuaugcuucuacccuucggcgcacguggcccggccaguccgcgcaccuggccgucauuccgagucgcuguccccagccccagguauucaguccucccacucggggcuuucauuccucucuuaggguaaacacuuccuucucuggguauuuguccaacucgugcuacucuccccaaauuuaaggucuagcuggucaccuaaaaauuuaagucuuaacaugcggaucugggacgcucuccuauccccaggcggccccugcaggccccucacuugcccuccagcucccaguuccagucugggccuaguggcggggcgggggcggccggccccuggggcccagcagggguuucaugggagggggcgggguccccagucagcguuucucugccgccgcuguuucagucguuuggcgugguuagggguugggguaagagggaauuucaaguagggguuccccgcuccgauuucugaguaaggaggggagcuauuugcaccaggagaaaaagagagacaagggagggugggcgucacugaggaacuaacugcggguuccaggaccauugggaaugaggugaggaguggcaaucuagccgcagaaagaucagucauguucagccagacgcagaacgcgacccucaaacaugggggaaguugggcgaggcgagccugaggcacugggcaccuuucgaguuucuguacccaaaggcuggugccagggagcccgcccuucuauugccucuggaagcccuggcucugcccuccccgggccacguucccaccccccccgccccccgcccccugccccccgcccccuuuccuuggcuauccuccuuccuccccaaagcagcccccucuccauuucacuuguggcacugccgccuagccccuagcacagcccuucaccaggccugcacgacccagacggcuggaguaggaaggggaaaaccccggccuggacggcuccgggccccuccggaccaggaucuguccggcggggcugagaagaaaacccggagcagugaucagccucgcgacccaagggggucagggacgauaggaaaacccggagcggauuacucgagccagagcgccccaugccugccgcuaccuccuccuuccuauagccccccuaauucuccagugagauaaugucugggguggggggcuguuugguuuggccugagcccucaggggcgccucacacuuuccgccccuggcuggggcgcagggcagcggccccgaggcugagucacggcccggcgcggagagggagagagggagaaagagggagggagggaccuggacuccgccccucgugcgcggggaucccgggucagcccgggugagggccagggccccccuggcgccgcccauugugguccaacagguugagcuggugucccgagaagccaccugcuggaaagggagggaggcccccugcggagggggguugggaggggaaagcgaguccgacccgguucggccuggcuugucgcaggggagccaaaccuggcccuagguagccggauuugauuccauuugacacuagugggaggggcccuuugggguacgcagcuccgcaggcucagucagaaacauccuucacccgcuaccuuucucaguugggggacuccuaaguauuuaucccgguccuccccaaaaccuacacauaccacacaucccaaaacauccaggcaccccucgccaccugggucucucagcgaauucaugucaagcuaucccuccucgguggagacucaguuucuccacuuagggaacccgcgggauggagguggggagcaaaagcgucggcgcgcccccucccccuucgcagacugggccccuccccuccgacaaugccaaggccgcagcgggcacuggcgacagcacagaggcugcuugccuggggcgcccuucccuccccgcggggcaccgucacgcguggggagggacgcagggcgcccgcaggcucaacuccccggcucccuccgagaggggguggggcguaggggccggagccgaaggccugguggcucccccucccccucccuucuaggucccugaccugauuacagccccucacgggacccccucccucaagacccuaaguccccaauucacccccacccagccuaucccuaaccucucauacccuucccuccugagguccugacccuacagaagccccucuugaaggagagggagccccuguagggggugcucgauucccuggccgcugcggacacugcccccuccccccuccucuccagguuccaggccagccccucggcuccgcccccucccuggacgaacgcaaggcgagaccuacuggagaugagcggguauucaggccaaugagcggacagggcgguggcgugcagggggcgggcagagcagcagcaaagggcuggaugggggccgggggcggaguuugaguuaagguggacugggagagauaggggcaggagaaaggggggggagagagggaccgcggcaggugaagggagacagagagaaggaaagaaggagggaaaggaggagggugggaaaggcuaggagagcuaaguaagaguuuggagaagggggcaaaaaaggagggagggacccaucugcgcucugcagggacuggcuggacgaagggguugaaguuuauguccuuauugggcggagggagggggccugggggggcgggugaaaaaccaggaagugacagaggguguuucuaaguguuggggggggggaguuugggggguggcaggggcggggggagggaggggagggauggggggaaagcaagcuggaggacaggugagacagcaggacaggugaggcgggcccugaggggggggcgggugggagccaggugaauguacggcucuuggcggccgagggggggcgggcggcaggaggaggcagagggcggcggaggaggagccccccagcagcgagcggcgagcaacugaccgcggccuucugaccaggaccggagcagggccccaagcccccgggccuggugggggacgcgcuucuucccacacugugagccucagcagcuccagccagcggacccgacggcugagaggugaguguaccccacuuuugucuccuggcucgggguucacuaggcucgagacuacugcaguguccuucguccguccuguaagugggacccccagauacacacgcaugcagaucacauucccaccacuccccuucccugugcuuucccaacaccccgggucucuggaauugguuuuaacugagaugaaagacagagaaggaacugcggaugccccccaacccuaggcggaggguccccagaaaguuuaucugcacuucuccugggaucagacagacagacggcuucgggauggagagggggugaggcgacgcugagcguucccccagucuccuucgugacuuuagggggagaccccagaccggacugaguugagggaauggaaacgcugacggacucuaacuaggacaacgcgcaccccccccccaccccgcgcccccuggcgcgguggauuggccccaggccaguugcauggggguugggggggcgcaggaggagccgcggcuugggggaaaguuaccggcuggacuauucgguuucuugcgcuuccagagccgcgcucucuccagcgguaguggggcucagcaacaaccucugaaccgacauagaacgaccgcucucuucccugccccucaaucccacucccuuccuucaggcuccagucccgccgcuaccuuuuccacgccagcucaugaccacagaacccaagagcgagggcgggugacuaggaagaauucuccuaccuacuacccguccccccaccggcgccggcgcaccugccccagcccagagugggggucgcuacuguguuguuguagaaccuacagagugcgccuggcagaaggcugccauucaaagggguggggggcgcugcuuucaauuuccagcuuucucucccuccucccaccccaucccaaguaagagagcgacgugucccggccagagcgaggugggggcgggagugggggggcggcgugggcagcggguugugcccggacacgugccugcccaggcgccccggcccugcugguguuuagagagagggcggguccccugccccccgccccgcacaacccccacguaucaaagggcggcugagacauggugagaccucggggcgcccuggggggcaggggggcggggagccuggguccggagcaggggaggggcagaggcgccggugcuagcugacccacaggaaacgagcgcugcugaccuaguuugggacaccggaagugggugcuggggagagggggagaccggcaggcuguccaggcuuccgggccagguggaggguguucuugaauugacccccgcccgaaugccuuggagaccccuagcugcagccgagaaugggaaugagucagcgcagcuauucccccuucccccaacuuauuccuggaggagggagaccgcuuaucagggacgggggaaccagauugggcugugagggguuaaagcaggaugggaacugu

SEQ ID NO: 13689 - RNA, 12695 nt, Homo sapiens
ggaagcugccccgggacaugaggaaaggaacaagggaaagagccggugaaggggcagaacaggcaggugagagucuaagagggcucaguaaucugaagcuuggugggaagaagggauucugggcuagaaagggugcagaagccugaaguagaaagagacgggauuuugguccgggguggagagcgaaugcauugaaaagggccaaggcccaggauaagguagacauuuaaagggguacggaugcccaagguagagcagacacuugaggagaccagcucagcaaacggaagacacuuaaagugguagguucucaagagagaagaaguuuuuaagacuagagcuaagcaagacauuuaaaaggacauggguugggauuugggaacacguuuauuccagaggcaggaacaaaggagucgcuugucaaggaucugguuagagaagacuagggucuuccucgaaggaagcacgcgcacgccugcucucccccauugucuuuucuggcuucuccagguucccucgacccaggacccccuguucccaggcuauggcccccagugcccuguagaccuggcaggccccccgugcuugcgaccccuauuugggggucuggguggcuacuggagggccuugcagaggggcagagaaggcaggaccaugacaucuagggccucugaacuuucuccggggcgcagcgugacggcuggcaucaucauuguuggagaugagauccuuaaggugugucugggacagaaaaggggggagggcgcugcguucuccuguccuuaagggccugcugcacaucccuccauggaaggaggugaaacagggugggagccucuuugcugcaguaggauccuggagugaauccagcauauuggaggaaaauuaacccucauucuuucaauuacucuacugaaaaacuuguagcaaagucccuacaauuuuucaaccugagagagcugauugaaaaaaagaaaaauaaaaaggucauugcaauuuaccaagcaguaugguagagggcagaggagcuacacaacaaugacaggaagccccucgaguagaggagguacagguguguguauuguauauuuaagaguuuuggccgggugcgguggcucacgcauguaaucccagcacuuugggaggccgaggcggguggaucacgaguucaggaguucgagaccagccucaacauggagaaaccccaucucuacuaaaaauacaaaauuagccaggcgugguggugcaugccuguaaucccagcuacuuggcaggcugaggcaggagaauugcuugaacgugggaggcggagguugcagugagcugagaucgugccauugcacuccagccugggcaacaagagcgaaacuccgucucaaaaaaaaaaaaaaaaaaaagaguuuuacccagccuuuuuggaaaugacucaagguacucagcguaguggauaagugagcuagaaggaagguacuagaagggaugaauccccuccgaaugaucaggaaagucuuacuagaggacauaacagaugacacggguuuuuuuguuuuugagacaagauuuugcucugucaccuaggcuggagugcaguggcacagucacagcucacugaagccuccaucuuccaggcucaagcaguccuccugccucagcaucuggaguugcugugacuacagguguuagccgccacaccuggcuaauuuuuuuuuuuuuuuuuuuuuuuuuuuuuuuuucagaaacggucucacuauguugcccaggcuggucucaaacuccugggcucaagcaauccucccacaccuugcugggauuauaggcaugaaccacugagcuuggccaaaugucaaguuuuaauaauaaucuuuuuuaauauucuuuguaaauuuguguuuuuuuuguuuuuuuuguuuuuuuuuuuuagauagucucacucuguugcccaggcuggagugcauuggugggaucucagcugacugcaccuccaccucucgcguucaagcaguucucaugccucagccacccgaguaguugggauuacaggcaugagccacugcacucagccuuaauagacccuuuuuuuuuuuuuagacagagucuuguucuguugcccagguuggagugcaguggcgugaucaauuuuggcucacugcaaccuccaccucccagguucaagcaauucuccugucucagccucccaaguggcugggacuacaggcaugugccaccacaccuggcuaauuuuuguauuuuuaguagggacggaugggguuucgccauguuggccaggcuggucucgaacuccugaccucaagugauccacccaccucagccucccaaaauguugggauuacaggcgugagccaccucaccuggcccugaccccaauuuuuuuuuuuuuuuuuuuuuuuuuugagacagaguuucacuuuuguugcccaggcuggagugcaauggcucgaucuuggcucaccguaaccuccgccuccuggguucaagcgacucuccugccucagcuucccgaguagcugggauuacaagcaugggccaccacgcccgguuaauuuuuguauuuuuaguagagacgggguuucuccauguuggucaggcuggucucgaacuccugaccucaggugauccacccgcuucagccucccaaagugcugggaggcaugagccacugcgcccggcugugugugugugugugugugugugugugugugugugugacggaguuucgcuccugcugcucacgcuggagcgcaaauggcgcaaucucagcucacugcaaccucugccuccuagguucaggcaauuaucucaccucagucucccgaguagcugagauuacaggcacccgccaccacgccuggcuaauuuuugugggguuuuuguuuguuuguuuugagacggagucucgcucugucacccaggcuggagugcaguggcgcggucucggcucacugcaagcuccgccucccggguucacgccauucuccugccucagccucccgaguagcugggacuacaggcgcccgccaccacgacuggcuaauuuuuuguauuuuuaguagagacagaguuucaccauuuuggccaggcuggugaccccuauauuuuaagugccuacuagagucugguaguguccuauacaucacauauaugugauuuuacuaaucuucacaacaaccccacacaaaaaucccacgaaguuggcacuuuuuuucuucuuuaaaauuuuauuuuucugugugcauuuguuuuauaaacgggguucucgcuauguuaaacaggccagccucaagcaauucucccacaucagccucccaaagugaugggauuacaggcaugagcaaccuugcccagccccccacccuuuuuuuuuuuuuuuuuuuuuugagacaaagucucacugucgccuaggcuagagcuaauuuuuuguauuuuuuuguagagacaggguuucaccauguugcccaggcuggucucaaacuccuaggcucaagcaauccucccaccucagccuccaaaaaugcugggauuacaggcgugagccaccacaccuggucggcaaaaaaucccaauugaugaaacugggggucagagagguugagaaaccugcccaggguuacauaccuaggaaguuguagagaugggauuccagccuaaugccugaugcucccuuacuccaaaacacagacccuuuuuuuuuuuuccuuuggugacagggucccugucacccaggcuggaguacaguggcaugaucucggcucacugcagucucugccucccaggcucaagcagcccacccacuucagccucccaaguagcugggacuacaggcaugcgccaccacgccccgcuaauuuuuguauuuuuuuguagagaugggguuuuaccauacugugccgguuggucucgaacuucugagcucaagcgagccaccccacuccaccucccaaagggcuggaauuacaggcaugagccaccaugcccggccaucagaacacagacccuuaaccacuaaacccuuuguagacaauuagagggagauggggcuggaaaagaagauaggguauacgccacagacagccccaaauacucugcaaaggaauuugaacuuucuucuguauacaguuggaaacaacaaauggcuuuugaguccaagagugaugcaaucacagugacgcauuaaaacgguuacuccggagacaucagagcacuguggcuggaggcugggagccuggccaggaagcugucgccauuguccaggugaaaggugcuaaggaccugcuugguggcaguggggacagaaagaagaaagcaggccaggcgugguggcucacaccuauaauuccagcacuuugggaggcugaggcaggaggaucacuugagaccaggaauucaacaccagccugggcaacauggcaagaccccauuucuacaaaaaaaauuuaaaaugagcugaaugugguggcacgcgccuguagucccagcuacucggaaggcugggguggcccuugaagccaggagguugaggcugcagugaacugugacugagccacuauacuccagccugggugacagagacccagcuuuaaaaccaaacaaauggauuuucccacucuuguguccaguccaggccccucagcagccugaggugguguccuucaaagagcagagcacugcaucaucagguggaugcagccaucaucuucaaccccuccccuucaucccuacaguacugauggccucaucuuccccuucaacccccagggacacacucaggacaccaacaccuucuuucugugccggacacugcgcucccuagggguccagguuugccgagucucaguuguaccugaugagguagccaccauugcagcugaggucacuucuuucuccaaccgcuucacccauguccucacagcagggggcaucggccccacucaugaugaugugaccuuugaggcaguggcacaggccuuuggagaugagcugaagccacaccccaaguuggaagcagccaccaaagcccuaggaggggaaggcugggagaagcuaucauuggugcccuccucugcccgccugcauuauggcacagauccuugcacuggucaaccuuucagauucccucuggucuccguccgaaacgucuaccucuucccaggcauuccagagcugcugcggcgggugcuggaggggaugaagggacuauuccaaaacccagcuguucaguuccacucaaaggagcuauauguggcugcugaugaagccuccaucgcccccauucuggcugaggcccaggcccacuuuggacguaggcuuggccuggguuccuacccugacuggggcagcaacuacuaucaggugaagcugacucuagacucagaggaagaaggaccccuggaggaaugcuuggccuaccugacugcccguuugccccagggaucgcugguccccuacaugcccaacgcuguggagcaggccagugaggcuguauacaaacucgcugaaucagguagggaccuuauggaggaggggcauuaugcccaaagccauugguggcaccccagaucucaguaaugcaggggcuguugggugcuuccugcaaaucccugagagggcagaagauagcuucuguuaauucauuauucuuccaauaaauguugauugaguaccuauuuucaucagcacugugcuagguguuggggauauggcucaauaggauaauguaugcccugcucuuauggaccaguguuuuaacaaaaaaagauggacauuaaacaggugauccugcauggggugaugaaaggagugaucucccacagcagggagaucagccuugaucuggggucagagaaggccaaaugacauaaacugagugauaaggaggauuugaucaguucaguaggugggcaagagccaacaguaugaaugagggccugcaaggaagcagcaugggguuagggaauggaaggaagcccacaccccacacccccugcuacagaggaaugacacugaggcuacugugagguguggcuggguggcagauggcagggcaggucaggggcagacugcagggccuagcgggcagcaugaaggaguuuggacuuuauccucagaacacugggaagauauugaaggguuuaagcaagggcagcaugccuucacuccccuuugauagccauauguguccaucugaugcccucuucccugccugcuuggcagggucuucuuuggggaaaaagguggcaggugcccuacagaccauugagaccucccuggcucaguacagccucacccagcucugugugggcuucaacgggggcaaagacugcacugcccuccugcaccucuuccaugcagcugugcagaggugagccugcccccgggagacaagaccccugaucuguuucuccaguuccacaucccagaaagcaaggagaaaggggguguacagguggaguucaagagggagauagucauggugaccucucaguuccauucucccaccauauugaguauaugauaugugccuggccuuguguauggaugugcaggccacuaucccugacgacagggaggucacaguccugcuggggagaugagagauuuacauaccugaaccagggaugcgugcuuagauuugagaggugaaaggucagagugggcuucccagaggaagugggucuaauggauggaaaggacaaggaaaagggagaaggggugagagucuguccuaggggccaacgagaacagugagcuguuucaggggagccauuuccuuguccaugcucacaagccuguggauucuucccccucugcaggaaauuaccugauguuccaaacccccuccagauccuguauauccgcagcaucuccccuuucccugagcuggaacaguuucuacaggacacuaucaagagguacuaggggccuggagguuugggcuccaagagaagcuugacagagcccacgcccgaccccuacuucuguuucuuccuaagguauaaucugcagauguuggaagcugagggcagcaugaagcaggcccugggugaacugcaggcacggcacccccagcuggaggcuguccuuaugggcacccgccggacugaccccuacuccuguagccucugcccuuucagccccacugacccaggcuggcccgcauucaugcgcaucaacccacugcugguaauggggaagaggguuuaucaccuucagucucacgugccccagcagucacugcacccuagcucaccugcaguaguggggaggcuagagccuggaaccuggaugaaggggccucaucauccaagggaggcagugcuaucuguucauucauccuuuugaccaauauuuauugagcccaaauucaauagcaggcauugcacuuccuacuguggauagaauagugacuuagacuugugcuguccaauauagccauuaauuauuuauuuauacuuaaauuuuaauuaauuagaaugaaauacauaugacuaaaaaccacugaauuauauacuuuaaaaggaugaauuugaugguauguggauaccucaauuuuuaaaauuaaguacaauuaaaaauucaguucuggcugggcgcaguggcucacgccuguaaucccagcacuuugggaggccauggugggcagaucacuugaggccaggaguucgagaccagccuggccaacauggcgaaacccugucucuacuaaaaauacaaaaaauuagccaggcgugguggccuguaguccuaguuacucgagaggcugaggcaggagaauugcuugaacccaggagacggagguugcagugagcugagauggcaccacuguacuccagccugggcaacagaacaagacucugucucaaaaaaaaaaaaaaaaaaaauauauauauauauauguauauauauauauacacacacacauacacaggccgggcguaguggcuuacaccuguaaucccugcacuuugggaggcugaggcagguggaucgccugaggucaggagaucgagaccagccuaaccaaaaugaugaaacccagucucuacuaaaaauacaaaaauuagcggagcgugguggcaggcaccuguaaucccaacuacucaggaggcugagguaggagaaucacuugaacccaggaggcagagguugcagugagccaagauggcaccacuauacuccagccugagcaacagagugagacuccguccaaacaaacaaaaaaaaaauacaguuauucaguuguacuagccacauuucaaaugaccaccauauuagacaguagagauacagaacauuuccaucaucacaggaaguucuggccaggcacaguggcucacaccuguaaccccagcacucugggaggccgaggugggcugaucaaugccuguagucccagcuacucaggcugaggcgggaagaucgcuugagccagggaagucgaggcuguagugagccaugaucaugccagugcacuccagccugggcaacaguaaaggcccugucuaaaaaaaauagggcugggcacgguggcacacgccuguaaucccagcacuuugggaggccgaggcaggcacaucacgaggucaggauuucaagaccagccugaccaacauggugaaaccccaucucuacuaaaaaaauacaaaaauuagccggcugugguggcgcaugccuguaaucccagcuacucaggaggcugaggcaggagaauugcuuaaaucugggaagcggagguugcagugagccaagaucgcgccacugcacuccagccugggugacagagcaagacuccgucucaaaaaaaaaaaaaaaaauagggccgggcaugguggcacacgccuguaaucccagcacuuugggaggccguggcgggcggaucaugaagucaggagauggagaccauccuggcuacacagugaaaucccgucucuacuaaaaauacaaaaaauuagcugggcacaguggugggcgccuguagugccagcuacucgggaggcugaggcaggagaauggcaugaacccgggaggcagagguugcagugagccaagaccacgccacugcacuccagccugggcgacagagccagacuccgucucaaaaaaaaaauagacgguuucucccuguccucaagcuccacccuugcacuagagggugguucaagaauggaaagcagagaguggagaagaugaaguccuucucuuucucuuugcauacauagagcaagcuauaccagagaaucagauagcaagcccucccucagaggccaagggagcagaagagccauggaugggccccuucccaggacagcagggguagaagugggaaaggugagcauuugugacuauucuauuacucugaccucccaggacuggaccuacagagacaucugggauuuucugcgucagcuguuugucccauacuguauccuguaugaccgaggguaaggguauuaggggaagggaauggguaagggaguuuuuagggugcugggauagggagggccaauaggaucgcccacccuaccacaugcuugcccuccacccucccugcuccagauacacaucacuggggagucgggagaauaccgugcggaacccggcccugaagugccugagcccaggaggacaccccacauaccguccagccuaucuacuggagaacgaagaagaggagcggaacucccgcacaugaccucccacccuaggagggagggaaggacaccguccuaggguauaaccuggcaauaaaccgugccucucacugugccuguugcucuagcugugucuuccugcuccagaggaugggagaagcagaagugggucaaaugcugccagcucugacuggcugugcucacucuaaggggcccaggggcagggcagaacaggcuggaaaggagcucucacugaugguucucaaugucagccucagcaggagcccaccagagggcgaaagcaggaguugugccaaccacugggaaaagggcaaucaggcagggcaccaccugggcuggaagaggggaagcugccuuggccuagcuguggaggaugaaagauggaguggccaggcccucccucccacuaaccccacccucccaucccugucuagaggggcugacucagccuguucccaggccuagaaccuucccuuugcuagacccuggauccuuugucucuguagucaugaggcugaaggggguggggacaguguugauaaaaggcacuagaggcagcucccacacccuuccucggaacuguugcccacaugcagccccggacacagccccuagcccaaacccuacccuucuuccucggaggggccccucgagacacugggcugcgggugccugucauuaagaugggcacagggugggagggcuuccagcggacccugaaggaagucgccuacauccuccucugcugcugguguaucaaggaacugcuggauuaaugguagcagggaacugccuccucuccccaccagcaccauggcuggcaucgcucaggugggcaggguagaguaaacaggaggcauagcugcagcuucuguggcagagcuugccuuagcuucucauucucuucuuuagcccccagcccaauugccaucaagacuccugaagccagcugugcuugaccaaggaugggccauaaacaaugaguaaacaguaaaguguggauccugcuuugagcugugucaucuagcagaccugccucaucucugagccuccuucauucccaaccccugccucugguggaccucuggugggcaggagcuuggacugcucuggcuaggaccccaguaagauuguggcaagaccuggcacuccuccaagcuuggcacagugagcccaccagcucagaugguugaucuuaccauacccucauaguaccaagaauggacugcccccuaagaaaccuguuugagaaucacugaauuauaaauauaauccauaggccuugaggcccaagauuauaagugucuaaaggggaaucagaaaaagucagcacuagaacggucugggagcaagggugcagaccagggagggaaggagcuuguccugaauagaaccaagauugaaagccagguuuucugacucacugguuccugaguggggaggguggaagacaguucagguuccucucaaucuguggguaaggaggggacccagcuugaguagggucuucaucugugaggccaaggguguguggaaacccagaggacccagcccuuucccaaauagaagaccugguccaggcagcuuccugccucugaggaucuuggggaaagcacugcgcugaggcuaguccccagcucaucaaggaaguaggaccccaugagcuacaagagcucccagcucacauacaaaguuaccagagaaagacaccuguguggccacacaggucccucaggcuuaucaugacacagcccuaucaggacauaaacagcuagauugagcagaauuggcucuuuacuuccucuugguagccacagcugguauuuuccaugaguuacucccggugguagauauacaccagccauguguaucgucuugcucagggggugcuuaugcuuacugaucugcccacccacagccccccaaaccucagagccagccuguuugggacuguucaguauuucccugggauucccauccagcauucucuggccccuccuggggggccaguuaucaucccccagcccuuugucacuuggggcacuggccuggagauuauagauagugcccucuuccucccugccugggaccagcucuuccucagccuucuucuuaguuaacucuuuuuuuuuucuagauucuuuuuguaaaggugauauaugcccagaguaaagaacuuuaggccaggccagguacaguggcucacaccuguaaucccagcacuuugggaggcagaggcgggcagaucaccugaggucaggaguucuagaccagccuggccaacauggugaaacugcaucucuacuaaaaauaauuagcugggcgagguggugagugccuguaaucccagcuacuugggaggcugagacaggagaaucacuugaacccgggaggcagaguuugcggugagcugagaucaugccacugcgcuccagccugggggacaagaaugaaacucugucucaaaaaaaaaaaaaaaaaaaaaggccgggcgcgguggcucacaucuguaaucccagcacuuugggacaaggccgagguggguggaucacuugaggucaggaguucgagaccagccuggccagcauggugaaaccccaucucuacuaaaaauacaaaaaaauuagcuggacgugguggcacaugccuguagucccagcuaccugggaggcugaggcaggagaauggcuugaacccaggagguggagguugcagugagccaagauugcaccauugcacuccagccugggugacacagcaagacuucgucuuauaaaaaaaaaaaaaaaaaaaaaagaacucuaauaguuaaaagucuccacgucuaucccccaauccuuuagcgcucccccuggaggcaaccaugguuaccaguuucuuggagaacauuccagucugugcauagacugcaucuucauucauucaacaaauauugaguuauugaguguauauuauaugucacugugggucuuuggaugcagcagugaacaaaacagauccuuguacuug

SEQ ID NO: 13690 - RNA, 4677 nt, Homo sapiens
acuagauuauaaaaacuuccucuuuaaucaaggcuuuuaacaugaacagauuucuugaauaaaauggaaaguuuccaguacacugaaacauaaauccgcaagucaccacacauacaacacccggcaggaaaaaacaaaaacagcaaguuuacaugaucccuguaacagccauggucucaaacucagaugcuuccuccaucugccaaguguguucuggauacagagcacaucguggcuucuggggucacacucagcuuaggcuguggguccacagagcacucaucuggcugggcuaugguggugguggcucuacucaagaagcaaagcaguuaccagcacauucaaacaguguauugaacaucuuuuaaauaucaaagugagaaacaagaaggcaacauaauaauguuaucagaaagauguuaggaaguaaggacagcuguguaaagcuugaggcugaaaaguagcuugccagcuucauuucuuugguuucuuggguagugggcgccggaacagcaagaugugagguucugaaagagugagggaaaucuaagagacaagcucacaccauucuauguacaaccuauaguguauuccacuaccaccuccccagcuaucacccacucagaucuuuauaacuaaauaaagacuuaagcauauggccuuagaagcagacccagaagucuggacugucugccaaguacagaauuguuaauaucaguucuuuugcuauguuuauacagccccagggugucccuuauuaguuuugccuggcagcugggugucuggugucuuaucaauaaauauacuuuccuuugcuuauuuagaacacauccaagaauguuuucgauggagaaugaggcaggggcuaugaucaggcuauauguggccuuaaaaagaauacccucugauugaaugaaagauuacaggagguuuuucagugacagguugucucugaacuucccagauauuuuagucuuauuuuuggucacuaguuuuuuuuuaaaaaaaucccccacgacuggagggggaaggaaccaguaaaccauuuccuaucucccuauuuggguuauacaaucuuauucuuucauucucucaguguagcaguucuauaugguuguuuuuagccagugcacugaccugguucauggaucauauaauggacccaucccugacucugcugaacgccaagauuccuccauucagauucagacaucagauggguuuuagggaccagcuuggcuauguccuugggcagcaugacaugucuguaacagaaacggggaaguggggaauuuauguuaguaccagauacagucucuuagacaaaugccuguuuacaaggccaagaaaggaaagaaaaacugguuuuugaugucagaguuuauauaauuuuauugugggguagcagcagcuagaaauacaggcuauguuauauaaauuccgagaguauauuaaaaauacaaauuagugaauaauuccagugaaugagcacuuaaguucaaggcacauuuucuccgccuucauggaccuuauagucuucuaguugauuaucuacaacauaaugggagccccacggagcacacaguguuaauaauuagaaggaaggaagagaaguuauuuuguggcgaggaaaggccuuuuaugaaguacuguguggacaaguuauuacaaaggaugaaaugaacuaucuuguccuuuaaaaucuaagccaggcaugguggcacaaaccuacagucccagcuacuugggaggcugaggcaggagggucauuugaacccaggaguuugaaaaagauacaguaugaaguuugaaaucugauuaaaauacagaagaaauaggccaggggcgguggcucaugccuguaaucccagcacuuugggaggcugagguggguggaucacuugaggucaggaguuggagaccagccugaccaacaacgugaaaccccgucucuacuaaaaauacaaaaauuagccgggugugguggcaugcaccuguaaucccagcuauuugggagguugaggcaggagagaaucccuugaauccaggaggcggagguugcagugagcugagaucugggcgauagagugagauuccgucucaaaaaaagagaaaaaaaauaagaaaaaagaaagggcugcaaugcacaaugguugugccugugaauagccacugcacuccagucugggcaacaaagcaagaccuugucucuuaaaaaaaaaauuaaaucuauccugaaucuuauuuuccuaacucuggagggauguaccuugagacuuucuggguaaauuccgugcuuuucuaaccaaggauaagucucccuucauagcaaaaaaauuauuacccugaugugaaucaaacuaauccacauagucuucgucaugcucaaugaaaauguacuaaguucucccucugugcuaguaacagugauuccccaccauucuccuaaaagaaaaaauucuaguccaaauauaaugaaaauagcucacauucuaacaccacccuggcacgaaauuuggcuucaauacauacaccaaaaaaccccucuuaaaccaaagugccacugccaagaguuucaucuuccaggggaugaaauggugauuccuucccagcuccacaaaucucuuauaagcacauacaguuuuaaguuaguuuaguucagauguagaggaaaacagcugaggaaaagaaaguuaauuaaaggagggucuggagccgucuuggcauaaagaugauuauguauuugucaaugcacaucgaguucucuggaagacccaaagcccugaacuaggcugggugaagagacacaagaaaagcaaguuuucauuuuauguucuccaacugaggagacaagauacaaaccaggaaguggucuuaauuauuacaauuaauacagauuagcauaaugccaacauuuguggaauccugugucuucccuuauucccaaucuagauuaugcacuuaaaauuuaucaagcccgaaugccacauccagugccaggauuccaucaucaccauccuuggcagauggcuauccagugucuucuaaacaauuucagucaagaggugcuuccucccacauaccuuuuucuuagagucucaucucaggcucugcccucuaggaagcuuuccccaacauucccucuuccguuuuuccucucaguauuuuaaguuucauguucaaggguacaugugcagguuuguuauauagguaaaauccugacucggggguucgguguacagguuauuucaucacccagguacuaagcauaguacccgacaguuuuuuuuuuuccugaaccucuaccuccucccacccuccucccucaagcaggccccaaugucuguuguuccccucuuucugucccuguguuuuuaucuccgacauauaaaugaaaacacgcguaguuuacuacugguuucguuuucaaugguggugaaagagacaucacgcugaauuggcccuuaggacacucccccgcccccaaaccaagcccagggaagaagaccgaccgaaaguaagaggucagccuccaaggcgguggcggggcggggggcguucucgaagcgugggaugggggagcguccuggaguuagcaaaaguaggggacugacuuucuagccccaccucaacccccgcucacagcuaggaagccgcagccuucgggucgccaguucccucuccuuagcaagucuugugugcucccaucacacccuguaauggcuccuugcauagcgugugucaccuuucuggugucugucgguaccacccacagauuuuuaaauuugugaacagcagagaccauguguuauccuugcacuuuagcagaacaccugaaaccuguuaaguauuccguaacuguucccuuugauauuuaaagggcaucuauuagacccauauuaaguauuuucucaaugcuccuagccaguuuuauuccauugcagucccaagcgauccccuuccuuacacaagccagacaaccacgccccuugucuuuuucacgaguuaauaagcaauauucaacucucucagcgcuacucuccuguuagggacgccaggaaacuuccagcuccgcuuuugcuacguucucccacuggauucgacaagauuacugugaaacagucucuacaaggcaaguuaaguuugcccgauaaaguucagagaaugauccagaaagccucaugggugaggguggucaguacccuaaccacgcccaccccucucuccucucuacugagaggcgacuccaaauucgcaaccacuuuguuuuacgagcgccucccaccuccgcgcaugcgccuuacgccuuccacaauaucacaccauugcccguucgcaccucguacgcaugcgccaauucuaucgccucaguuccuguuacuaauuccuugugcccucagcggccaaagcucacgacccucgcuauugcucccgcgccagcacuaaccgauacucaaacuccucgucgucguauuuguccgaauaguaaauuuguuugugcgacaugaucgcucgguuugcuagccuucagccccgcgccgccaaccuccaagcaacucccaacagcacgcgcucccacccacuuuggccucgcuuucaaacacgccgcccgcacuuccuauugguccguuuggcucgaggcgggacaccucuacuuucaagccuccgauuggcuua

SEQ ID NO: 13691 - RNA, 5078 nt, Homo sapiens
aggcgggagccgggccugcccggcgccccagcaccggcccccgggcuaccugggccucccgggugcgccuucggcucgcgcgcgccccuccgcggcggcuccaccgcccgggaugguacgguccggcagccgggccgcgcgcugccgccccucggugagcuggugugggccgccgcuagcggagacgacccuuuccacucgcguggugccgugguaagccucgucccucgcccgccgccuguuuucaggcguagcgucucguccgguccuugcucccccuccccgcagcgcucaguggugguggccgcgacgaguuccgguuccgguugcugccgccgcuggcgggcggcgagucuggagagagcgcgcaguuugcgcggcggcucggcgcuucccugucgucgcacuuugugguugcugcagcucgggggccugggcugccccugacaccccuucugggcgauggugcagcccaagggcgccuccaucccccgccgcugccgcuaacccgggucccccacuccauggccgccucggcgccgcccccaccggacaagcuggagggagguggcggccccgcaccgcccccugcgccgcccagcaccgggaggaagcagggcaaggccggugagcgcgcugcgaggggcgggggcugaagaggcccaggacuugggaaccucagaggggagggauggugggcgggggguguuucacagucugaaggcuugaagggaggcucaggugaaaaggauggguggguguaauccuccagggguugggggcaggugucacacauugaggacucuaggguuuggagccacauggaauucaguacucacuuggagcuugaggauaucgaaagaugggauaucuuucauuuaaaggaagacguagcugagaguaugaucaucuucacaaucuauuuuucauauugcaccccuuguuagcauuuguugaauaaauaagcaaguauguauugacguuaaaggaguuccucagagcauggcugagagaaaagagguuggggaaaccucagggaaacuugucugcgucuuccuuuugccgcucuuccaggucugcaaaugaagaguccagaaaagaagcgaaggaagucaaauacucaggugaauggugguuggugguggguuugguucccagcagccccuuggcggcacacugucuacucugccauuccaguaucuguuuguaucuuguaucagcugcagggaggagagagaaaacugucuuucuugcuuugcuucuuguucuuucgcugaaccuuauaacaaguuuaggggaaaguauccucuccuaagagaugauucgaccaaaguucuuaccacgcaggguuccagucuccuccauguuuccuguccugguuuccuccugaugauaacguaacaccuaccacuuacugauccuuuuuuuagugccagggauugcgcuaacaugcuuuaacaguuuggggagauaggcauuaucccuauuuuacagaugagaaaucuggggguuaaaaauguuaaauacaugcuccacagucuugagguuguuuuucagggucagagcugggauuccauccuaguucugccuguuuuuaaaacauaguuacugcacuauguugguuccacucuccacccucuuuuucuugucuuuuuuuuuuucuuuuuucuuuucuuuucuuuucuuuuuuuuuuuuuguaguaacagagacuugcuguguuacuacucaaacucaugggcucaagggauccuccugccucggcuucccaaaauguuagcauuacaggugugacccacugugccuggccugugguccauuuuuuuuuuuuuuuuuuugagacggagucuugcucuguugcccaggcuggagugcagugguauggucuuggcucacugcaagcuccgccuccuggguucacgccauucuccugcuucagccucccgaguagcugggacuacaggcgcccaccaccacgcccggcuaauuuuuuuguauuuuuaguagagacgggguuucaccguguuagccaggaugaucucgaucuccugaccucgugaucugcccgccuuggccucccaaagugcugggauuacaggcgugagccaccgcaccuggccugugguccauauugauuuuagaccugagcugcccacaguaucagccuccaaaauguguauuguguugguagugcucucuugguuuagcucuguguuucccuccaugacccucuuucccucaacuguuucucacuagggcccugcauacucacaucugacggaguuugcaccacccccaacucccaugguggaucaccugguugcauccaacccuuuugaagaugacuucggagcccccaaaguggggguugcagccccuccauuccuuggcaguccugugcccuucggaggcuuccgugugcaggggggcauggcgggccagguacccccaggcuacagcacuggagguggagggggcccccagccacuccgucgacagccaccccccuucccucccaauccuaugggcccugcuuucaacaugcccccccaggguccuggcuacccacccccaggcaacaugaacuuucccagccaacccuucaaccagccucugggucaaaacuuuaguccucccagugggcagaugaugccgggcccaguggggggauuuggucccaugaucucacccaccaugggacagccucccagagcagagcugggcccaccuucucugucccaacgauuugcucagccaggggcuccuuuuggcccuucuccucuccagagaccuggucaggggcuccccagccugccgccuaacacaagucccuuuccugguccggacccuggcuuuccuggcccugguggugaggauggggggaagcccuugaauccaccugcuucuacugcuuuuccccaggagccccacucaggcuccccggcugcugcuguuaaugggaaccagcccaguuuccccccgaacagcagugggcggggugggggcacuccagaugccaacagcuuggcacccccuggcaaggcaggugggggcuccgggccccagccucccccaggcuugguguacccauguggugccugucggagugaggugaacgaugaccaggaugccauucugugugaggccuccugccagaaaugguuccaccgugagugcacaggcaugacugagagcgccuaugggcugcugaccacugaagcuucugccgucugggccugcgaucucugccucaagaccaaggagauccagucugucuacauccgugagggcauggggcagcugguggcugcuaacgaugggugacgcuggugaaguggcccagggaagugcacaugucucucccugcucuuccagggugauuuuuuugauguuuggcucuugguccuuguuuccacuggcuuuccauccccauggggcagaaacaguggcuccugggagcagaaaaggaauugaggugggcaggcagaagagccuggauugcucacuguuuugggaaacuuacauguugagaucuacagagauccaggaaaccaaagcccugcugagcagagccauuuuguggcuauuucuggaggcccaggaguguggcugcaagagaaaaggggcuggaggaagauccggagggcagggguguucccucugcugaugauggaugccccuaacaccugugccuaacaccccuacugaaccccacagcuccagccuuaguuuuuggagucaaguguuaaagguuucuggccagaggaauuggggucuugccaucccugcaauagcccuuuuaugggcucugggagacagcuuuagggaauaaauggggauuuuccccuuuuucuacccacuccuuugcuuccuccaagacuuacccaacuccuucccccucagagaaccaaauagccugaggaagcaggagaguuccugguuauggcaguuucuuggugauuuggggcuucaagacaguaggugagagaugcugucaggacguaucuucuucauaccaaagucacugguccuuucucagccucucucgugcuuuucuccuaaugaccauauuuuugccaaaaauugggauauguuaucugacagaccagaauauuugaaguuugggcuguccugaaagucuggacuuuggugguacccuccucccccagcccaucuguugcacauuauacuccguguguucuucaacuuucggcgcccuuauuccccugccuuccuggcuugauugaaggaaagcuugaaaaggcgcagagcccuauaccucauuuccuccaugauaaaaggauccaagugaggcccugucacagccuguggguaggggaugcggcgggauccucauugccaugguacucaaagguagaagagccuggaguuuguugcuucucuuugcuauucuuucauauccucuugggccuggugauuaauuagcaauucucauuccucucagccaaaggccugcacugggcuuuauuugucuuuuuuuauuuuuuaagcacugccugccagagaugggccuggggccugaugaggaccuuagcgcugcucguucuccuuuucuguucaugcacacauuccuccaugggguggggaaggcaggcaugggguguggcccucggagaaguuaggagucccccagcucaagauacaguggcaaagaccuagugguccccuacccccacuucucucaguuccuggcaugaggagagaagacccugcucugguggagcugacaaccuuugaggcugggaggagagcagccucugggcaucguucccagugucccucacacuaaaacggcguagauggcaaccccccacccccaccccgcugcucaacucuuguguuuguuguucuguuugccccauuuaucuguugcuguuuuuguguugucuuccccugcuccgcauuuuguaaaauggccccugggggaguguuuuugcuggaucugcucccucucgcucucucacuccacuacuuuuuggaacaaagugauggcagaaugcggugguggugggggucuuuuguacuguuggauuaauaaaaugauuuuaaaaucccagac

SEQ ID NO: 13692 - RNA, 13475 nt, Homo sapiens
caugauuuucuucucgggcugcaaacaaagggaagccugcaacaaguuaagcugaagaccgaagcaagagcugguucagguaaugccuuagcugggaagggguccacagauucgcuuugaaggggguggaauaaggaaaagggaaggcggaacuaaucuagaaggaaugagcugcuuuucauuucugggcugggggaggaaggccaggugccgacgcuaacacaacaggaacuugcucuggguaccccaggcaaguggcccuagauccuuugcuuuagcgguuuggaggagcaacuguuagaggaguuuaaauuaacuagaggcgagacuuccuagcuuuaugcugagugggagagcucccccuuuagcuguuuuuuagaaauagcagaagucucugucauaauccuuacaggagguguuuguugaauccugccugaaugaaaagaaggggguggagggagggaguggagguggguuuucuuccagaaggucgaugaaaagaaaaagaucuggaaacacagcagggaaggguggagauuagacagcagaaggaacuuccuaauaaggcagugagaugcuggcuugggagaagagguguuuuuuugaacccuggguuaaccuaaccaagaaagagguaucaggguuuggaacccagaguauaggaguuucagagugucuccuauuugggucucauaaguauuuguuuuguugacccaaauaccuuugcugguuuccauggagacagugggucugacaucacugugguugccauggugccugguucuagaggaccugagcaggcugcacacacagcuagggauaaacagggacuucagcccaagcugcugccacuuccuuccugccaccaccuguuaacagucagcaacuggggauggggagaugauaacaagggcggggguggagccacaagcggaaggcugaacagccauggcucuauggauacuuacagaugcaugccaggguguccuguuggauuugguacagggaggucauugcagccauucuccugucuccguguggaaugggugcaugugucugggaggaugggcauugggaaagaccuauccaggacuuggaucuugacuggcaggagccacaggagguuacuuagggcaccacgcaggacuugaaaacagcucaaacagaaggggauaaugugguugguuucaaagguagaacugccauacucucccagccucacuucccuuuuccugaguuuucuuauaaagugcucgggaagcagucauuuauccuguucugagggaucacaauccaguacucuugagaggucagcucaucuauccuuccaccuuuaugccuggucccaacaggagcugccugagggaacuguuuuagccuuggaugaaggggcggaucccucucuucuuacccugcuuugugucagucaggcuuuggaaacuggagugauucccuccccuaucccugucaagucagagcagauuaaccgggugcaggaccauagcccugauuuuugucuauuuuuugcaagcuauaaagugauguauauauacaugauaguugccauaaauccauuuucccagucaccuucaaguucccuaagaccaaacucuggcgauuacuaagaagguaaacagaauuuaggaugaagacugagagugaugaggagacuuauaaaaggugcauccagguggaucuaagcuaugccaguggcucuuaacccuggcugcgcaugagaaucauuugagugguuuuuuaaaagacccacagccgggccuaccccccaacucaauugaaucaaaaucuuaggugauuccaaugugcagccaagauugagaaccacugaacuagaccauaccaaggacuuaugcugggcaaguggugggacacuuagggcugaaggaggccauugagucuucccuuccagguccugggggagaagguagugauuguguagguaccugguguugugaagggagggcuguguuguuucccugcucuucuuauuaacaagucuucuuauuggcaaguugagucugucaaccuugcugggcuucaucuucccugacucaaaugucagggggcuggacuggaauuccccagagccuuuccagccuaugcuacuuugaccuuucaaggucaguucaguuuuccaaggcccuguuggucccuggaagaggcuggcuucucuguggguguuggcagauucugauuugcaaggcaaauacugcuuagaagagcuggggugucagggagagaaggacuggaaccaggcuugguucuggaggcugcugcccagcacuugaaccuuggaacccagccaaggcugcuuucugcauucugccccuccugaagggagcucccauccuuaagagagcuuucuucugcagguggcagccacagcagccucagggaccucagcaacuauggccuccugcccagacucugauaauagcugggugcuugcuggcuccgagguaggaagagcgggccugggaaccaugggggugggguugggggguguuucugcagugcugggcuucuuucuugguggguccuuuuccuuaguccugauggucaccuacaucacuuccugcuggcuguuagaggaauuccaguagcaggaagaaguagaucaggccccaggggucagguguuggcacuuggaccaugccaugaaggaagggaccaguuggguaagcugagacaaguagggauggauuucgaauggagagaccaaugugaacaaagguccugaggcgauaguggggaacgccaugcugggggagacugugggacacccaugggugauguggagacguggguuggagccaguguuggagugagguuggggacagagccugggaaccccuggaagagaccggaagagccuggcugaggccuucaggccucauccugaugggaaaucaguguggggcuuuggguuagagggaucaggacaaucauugucucaggcagagggugaagccacugugcaugcugggugggaacagggagagaguguuucaaagacccccugcagcaguccagguagcagcugguggggcagaagcccacugaggagggagaaggggguuggcaggauggggaacugaguggcuagagaagggauggcaaaaauuugucaaaggcaucucugagaguuccaagacguagcgacuuuguauauuagagccaccaggaggggaggaggagagaagcucaguuucaacauguugaguuugaggugcccuugaggaacccagcugggaguaaggaguugaccuuggggaugacgcuggagcaagauaauggacuggggcucacuggcagagggaaggcagguaugagcagacgggcaccaggcucucagagcccuggccuccuguugaggugucuuuguugacagcugggggaccuugggcaugccauuucaccucucuguccucuccuguaaaacgggcgucaugauuuuugccuuguaggggggaccaugagaauaaaaauguuuugaaaauagcaaagacauaacuaaggugaagcauuacucucagagggauaguuggagccacggggcggguggcaggccagggcccuauggaaggggaguaggcagagggaggaggccgaggcuguguggccagggcuggauguccaggcugagagugcccuggagacaggcugucugugguugggguggguugggcuucugugagcagcugcugggagacgggugucgggggagugucaggggccagcgggaaaggccagaaaggcuugagagauguaaguaguuguccaguugagagggcagcugcagggacacccugggaggcauaacugugacccgugggcacccaggggacuuuguucucuugccuucuucccacccuuaauauuauaauaucuggguuguucaucuguggggaaggaagugcugcugaucuugaugggagggaaacguaggcucuagcucaccuucuggaggcggggcaccagguuuguacugcaaccagugccuuggucugguggugcggcgcuguguagcggaaaccuggccccugaaaguuccuccucgcagugagugaggcuggggaaugccgagcacuuggugcugccccgagccccuuuuugggccagcucaugacugaauguguguguuucugggaugugggcuggggccccauucuugggugcagcccuucuccuugcacuucuccucccagagccugccaguggagacacugggcccggcauccaggauggacccagaaucugagagagcccugcaggccccucacagccccuccaagacagaugggaaagaauuagcugggaccauggauggagaagguacugggcccugcuuaggacauagcuuaccggacaaagcuauucuccauauuuugggguuucucaguuuccucagagaaagggaggcugguucguuuuaguuccuccauuaaucucaguugacaaacuccuuuucucauuccauccuggcuuuuuccugccucuuccaaccugguaggggcccgugggauggacagagggcugcaaaggaaauucagcuggggcaguggguuuuucugcgccuuuucuccuaccgcagggacgcucuuccagacugaaagcccucagucuggcagcauucuaacagaggagacugaggucaaggugaggagauuugcugugggaaggaagggaggcggggagggcuagcagcugcucacugcugcaucugcauuagggcacccuggaaggugauguuugugguguggagccuccuggcccaggagacacaguaguccagggagaccugcaggagaccaccguggugacaggccugggaccagacacacaggaccuggaaggccagagcccuccacagagccugccuucaacccccaaagcaggugagagucuuccuugccucuccugucacucuccuucuagaagguaugggagagggaucagccaucacuacugagcacaugcugugguccaggcccuagggcugagcagcuuggugcucuccuuucucaccacuaccccugggacguugaggcccagaaagguugaaugacuugaccaaggucacacugcugguaaggggcagggcccacaucugguugacucuuuccucucugccauggggaccuccucuuuucuugcuuccagaauucaacccucauuucuggagucccuuccuugugcuggcccugggccugggcagagggaagaugguugguuaccgccuauguaagcggcagaucagacugagccaaggugcauaucagaccuaagagugguacagaacuguaauuaagguacucccaaaggaaggagaggccauucagucaggggacugguugagggcaagggagaggcugggacagugagaggugacauuugaguggagcccugagcacagaguaggcuuuugguacguagggcagggaaaagagaauguuuuaggccaaggcugcagcaucagcaaaggaguggggaccaccugucuugugcuaaggagcucuguuccaggcuuguggcagaggaguguaggaauuggucccuguugagugacaggauggagggccugggggccauuuaggaggcaacugcaguggucaggcaaagaugaugcagaccugggccaggcaugguggcucgugccuauaaucccagcacuuugggaggcugagguaggaggauugcuugagcccaggaauucaagacugcagugagccauggucaucccacuucacucuagccugggcaacagagggagacccugucucuaaaggaaauaaaaauaggcggcagggugcaguggcucacgccuguagucccagcacuuugagaggccaagguggguggaucaccugaggucagaaguuugagaccagccugggcaacauggugaaaccccgucucuauuaaaaauacaaaaauuagcucggugugguggugcacgccuguagucccagcuacuucccagcuaccugggaagcugaggcaggagaaucgcuugaaccugggaggcggagguugcagugagccaagauugugccacugcacuccagccuggguuacagagguagacucugccucaaaaaauaaaaauaaauaaaauaaaauaaaauaaaauaaaauaaauaaaaauaaaaauaggcugggugugguggcucacaccuguaauccucacacuuugggaggcacaggcaggaggggcugggcuaggguaacccaccuaggccaggcgucuguccuagcauccucccccaaaaggaauguuuccuauuuacccacacauccugacccuccccucucccacuauagucagggcgucuucccaguucuugguucacaucccuugugcuaagguuugggccagggcuggcauaccuguuccacaugguacaugaaacauacaugguaucaccugugauugauugguguggucugccuggagcacuguguggaaaaggauuuaaagaacaugccaggugccaugaucaguuaacacuguuccagguaugggagguggaaacaagacugugagagccacacauuggcuauccuuaggugaaucuaggaagugugugcuuauauaaagauguagaugccgaggcucaggauggaauuuggggaucccugugucucauucaugauggagaugggguggaggaugaaaaccaaauccucuggguguuccaggcagguggaucacuugagcucaggaguuugagaccagccugggaaacauggcaaaaccccgucuuuacaaaaaaauacacacacacacacacaaauuagccggguguaaugaugcaugccuauagucucagcuacucaggaggcugaggugggaggaucgcuugagccugggagguggagguuacagugaguugugaucgugccacugcacuccagccuggacgacagagccagacccugucucaaaaaauaaaaauaaauaaaaauaaauaaauauuaaaaaaaaaagaaagaagaugcagaccugaacuaaggcagguacaguguggguugugaacagggguggacugucaagauguuuaaguguagaacugugaaacugucuggaugugagguggagagggagggcuuagguuagcuagaugguggaagcagugccuuccccugaauuggggaaacaccagaaaagaaccaguuugcagagcaguguguugaauguuuggucccagagggaguggccagcaggcagucagacauacaggcuuggagcucugggaggccaagugaggaguuacacacuaaggacucauugcugaaggggggugucaguggugugggucagagaauugugacuauguguacagugagaagagcagagaaccugaaauggugccagggagaccacugacuuuaggaucagggaagagccagggagggagaaugggaaggaguggccagagaguuuggaggcaacccaggagggugguaauagcugcagaaguuugaugcacagcgcacacugaggaaggaggaugcuuucaggaugaaaauggcuuuuauagcucguagauugacagcacuggucuccugccuccagacugggcagggacagucaucaaugcccaggcagaagugggcaagugggcaaggucuucaugugccccucucuggggucagggcugacgaccucccucccugugccuuccucugauuccccucucucccugugucuccccaucucuccagucaccucacugcccugucccuguccuuuccccuagcuuggaucagggaggagggccgcugcuccagcagugacgaugacaccgacguggacauggagggucugcggagacggcggggccgggaggccggcccaccucagcccauggugccccuggcuguggagaaccaggcugggggugagggugcaggcggggagcugggcaucucccucaacaugugccuccuuggggcccugguucugcuuggccuggggguccuccucuucucaggugagugguaccucugaggcuggggcuuugggcuuccaugccugccugccuuccugccauguucucaccuuaccucacaucaccccuccccgagggccucaucagacuccucugucucuguccuuagguggccucucagagucugagacuggugaguagggaggagccugucuugugcuggggaguuguauguguucucugguucugugggucaggaguaggggugcugggggcucacauuuauuucucaguuaguggccuugucagcuguucagggugccccuuggcccuuuaucucaccaaaccgcucagccacaggguggguccugagcaggagugguggcugugugaaugggaagguguggggagaaugggcucugugugccucaggaccaguuucaggguuucccuuucccacagggcccauggaggaaguggagcggcagguccucccagaccccgaggugcuggaagcugugggggacaggcagguaugugugaaugucuccagaggcagguggggccuggcuggggagaaccugggcugugggguagcauggcauaacaggcucuucugcccucaggaugggcuaagggaacagcugcaggccccagugccuccugacaguguccccagccugcaaaacaugggucuucugcuggacaagcuggccaaggagaaccaggacauccggcugcugcaggcccagcugcaggugggcacaggcaggaggggcugggcuaggguaacccaccuaggccaggcgucuguccuagcauccucccccaaaaggaauguuuccuauuuacccacacauccugacccuccccucucccacuauagucagggcgucuucccaguucuugguucacaucccuugugcuaagguuugggccagggcuggcauaccuguuccacaugguacaugaaacauacaugguaucaccugugauugauugguguggucugccuggagcacuguguggaaaaggauuuaaagaacaugccaggugccaugaucaguuaacacuguuccaggaaauaagacugugagagccacacauuggcuauccuuaggugaaucuaggaagugugugcuuauauaaagauguagaugccgaggcucaggauggaauuuggggaucccugugucucauucaugauggagaugggguggaggaugaaaaccaaauccucuggguguuccaggcuguaaaacgggcucaggccaccugcccacuauaauagaauggaauugggguagaaggcauuggggcuauccugacaagaacucuuugugacuuccuuugucccaaaccauauucuaggcccaaaaggaagagcuucagagccugaugcaccagcccaaagggcuagaggaggagaaugcccagcuccggggggcucugcagcagggcgaagccuuccagcgggcucuggagucagagcugcagcagcugcgggcccggcuccaggggcuggaggccgacuguguccggggcccagauggggugugccucaguggggguagaggcccacagggugacaaggccaucagggagcaaggccccagggagcaggagccagaacucagcuuccugaagcagaaggaacagcuggaggcugaggcacaggcauuaaggcaagaguuagagaggcagcgacggcugcuggggucuguacagcaggaucuggagaggagcuugcaggaugccagccgcggggacccagcucaugcuggcuuggcugagcugggccacagauuggcccagaaacugcagggccuggagaacuggggccaggacccuggggucucugccaaugccucaaaggccuggcaccagaagucccacuuccagaauucuagggaguggaguggaaaggaaaaguggugggaugggcagagagaccggaaggcugagcacuggaaacauaagaaggaagaaucuggccgggaaaggaagaagaacuggggaggucaggaggacagggagccagcaggaagguggaaggagggcaggccaaggguggaggagucggggagcaagaaggagggcaagcgacagggcccgaaggaacccccaaggaaaagugguagcuuccacuccucuggagaaaagcagaagcaaccucgguggagggaagggacuaaggacagccaugacccccugccauccugggcagagcuguugaggcccaaguaccgggcaccccagggcugcucagguguggacgagugugcccggcaggagggccugacuuucuuuggcacagagcuagccccagugcggcaacaggagcuggccucucugcuaagaacauacuuggcacggcugcccugggcugggcagcugaccaaggagcuaccccucucaccugcuuucuuuggugaggauggcaucuuccgucaugaccgccuccgcuuccgggauuuuguggaugcccuggaggacagcuuggaggagguggcugugcaacagacaggugaugaugaugaaguagaugacuuugaggacuucaucuucagccacuucuuuggagacaaagcacugaagaagaggugggcagcugugggggaguugggucgggugggacagaggcagucgggaggaugugaagagcaaggaucauuaguuugaguauccuuacuuuugguccccagcuggcuucccuuagagaaggcauucagguccgcuuccuuucuucccuugaggguaggaagcugccugugcccaccccagagugguccugagcaguccccuuuugggcagggggauucuuucuccugaguugcccugcccuaccucuaccugcauggcccaggggacgagggagauccccaucuuccugucuccccgacuggagccuuuauccugggagaccagguuuuucccacauaugcuugguggugccugcucaagucagcuucauugggaggagcaggguccucucuccuuggggaacccguuuucauugcaugguauuguccccuaaaggccucuuccuccccacaggucagggaagaaggacaagcacucacagagcccaagagcugcggggcccagggaggggcacagccauagccaccaccaccaccaccggggcugacacccugccccacagggaauggccuuggccuggcccagcccaagaucccagcguuaucuaacuccuggaggguggacucuguccuggcuuguuugguguccucagauaucuuucacacaguagagcaaaaucaccagcccugcacugaugucacuuuauguagaaaaaggccuuagcuggaccugcguugccgucuaugcaaaugcaugcaaauacuccaggcccugggaugugggcuuguguuuugucacugugaagggggagaugggagaggagccuguuuugggguggggucuggggaaggcaaucugauucugaagcuaaagagcuuucauccucuugaguguauguccccauagugggccccuugacccacaugcugaccggugccuugggauuugacuagaguugcuggcucgaggcccagcacgaggacuuacccugggguuuuguuagguuuggaagcagcugucccuagggggugaaguccccccccuuuuuuuuuuuaccccugcuucucccacggcuucaccucccuaugugaacuguagacucagaucccaauaaagugcuguugcagcuaugaugcuaggugguuucuaagcacaggggacaccccacacccccugccugaauggauggguccaucccaggcacugguacuugcccccuuguucuguaucccccuuugcccuugccuugcccuuccaacaaacccuaggcccuugagaagcugauacuucuccuuuugcucacagcugccuuggccccaccccugggagauguagcaaauugaguguggguuuuggagucugagccucaggcucaaauccaggccaagugaucuugggcaaguuaaucucugggaacuuuggguuucuuauccucaaaaaaggcgauggaagggcuggggaagugauuaaauaaaagcaacgcaagaaaaaugccucuccuguuuugggcacucaaaaguuauugccuucuuuagggaaggguguggaggagggaaaagaacccaggcccagaaggaagagcuucuggggcuggggaggugagggaaccacuagguggcacccuggcuccauuuugcuccagaccucgccucucccacuacucacuguccccaaaaucucagacccuaccccacugaccccagcgccugcuccacuggccagcucucccaggaugaccagacuccccuuggcuauucucuaggaaguccuuccugagaucuaaccuuagucccuucggcaauacacugggcuuuuugaugacccuggaaaugcccaggaaguacaggagacagaauaauguggugugacugcucaggcaggaggcgggggacuacagguucuagaaggggcuguaacugauuucuguauuauuuagcaagcgaauauguaacucuguuuaagggcuuaaagguauuaguucauugaauucauguguggguggggcagggguuagggcaggcuggggauggaacaaggaccacuaauucagcaaacauuuauaaagucuacuguguaccagaaacagagaggcacugggaauacagaggcaccuuaagaagccuaaaguugggucgggugucguggcacacaccuauaaucccagcacuuugggaggccgaggcggacggauugccugagcucagcaguuugacaccagccugggcaacacggugaaacuccgucucuacuaaaauacaaaaaauuagccaggcgugguggugggcgccuguagucgcagcuacucgggaggcugagguaggagaaucacuugaaccugggaggcggagguugcagugagcugggaucgugccacugcacuccagccugggcgacagagcaagacucuggcucaaaacaaaacaacaacgacaacaacaaaaaacagagaagccuauaguccaguggaaacuuucuacagcaggaggaacugcaguuagaucuaaggaagaacuuccuuucagguagaaggucagugauaugggcuggggaggcuuaggauuugguacccaggccugugaaccacugcuccuugaagaagccuaguuuuacccuguucacauugcucaccuucuguaggugcucaaaauucuugcugccugaacagcugacugguaaaguuggguugcugagagacagauucaggcuagaagguagguaggauucaguguccuggggcagguggcugggccugggaaaggggauacaaacuggccuaccugaguucccagaggguggugacucucacuguggccccuuggggcuucucaguuucauuuuuagggcucauuuccuucguuugcauaacgaacgcucagggaggcugccagguuccccuaa

SEQ ID NO: 13693 - RNA, 13475 nt, Homo sapiens
uuaggggaaccuggcagccucccugagcguucguuaugcaaacgaaggaaaugagcccuaaaaaugaaacugagaagccccaaggggccacagugagagucaccacccucugggaacucagguaggccaguuuguauccccuuucccaggcccagccaccugccccaggacacugaauccuaccuaccuucuagccugaaucugucucucagcaacccaacuuuaccagucagcuguucaggcagcaagaauuuugagcaccuacagaaggugagcaaugugaacaggguaaaacuaggcuucuucaaggagcagugguucacaggccuggguaccaaauccuaagccuccccagcccauaucacugaccuucuaccugaaaggaaguucuuccuuagaucuaacugcaguuccuccugcuguagaaaguuuccacuggacuauaggcuucucuguuuuuuguuguugucguuguuguuuuguuuugagccagagucuugcucugucgcccaggcuggagugcaguggcacgaucccagcucacugcaaccuccgccucccagguucaagugauucuccuaccucagccucccgaguagcugcgacuacaggcgcccaccaccacgccuggcuaauuuuuuguauuuuaguagagacggaguuucaccguguugcccaggcuggugucaaacugcugagcucaggcaauccguccgccucggccucccaaagugcugggauuauaggugugugccacgacacccgacccaacuuuaggcuucuuaaggugccucuguauucccagugccucucuguuucugguacacaguagacuuuauaaauguuugcugaauuagugguccuuguuccauccccagccugcccuaaccccugccccacccacacaugaauucaaugaacuaauaccuuuaagcccuuaaacagaguuacauauucgcuugcuaaauaauacagaaaucaguuacagccccuucuagaaccuguagucccccgccuccugccugagcagucacaccacauuauucugucuccuguacuuccugggcauuuccagggucaucaaaaagcccaguguauugccgaagggacuaagguuagaucucaggaaggacuuccuagagaauagccaaggggagucuggucauccugggagagcuggccaguggagcaggcgcuggggucagugggguagggucugagauuuuggggacagugaguagugggagaggcgaggucuggagcaaaauggagccagggugccaccuagugguucccucaccuccccagccccagaagcucuuccuucugggccuggguucuuuucccuccuccacacccuucccuaaagaaggcaauaacuuuugagugcccaaaacaggagaggcauuuuucuugcguugcuuuuauuuaaucacuuccccagcccuuccaucgccuuuuuugaggauaagaaacccaaaguucccagagauuaacuugcccaagaucacuuggccuggauuugagccugaggcucagacuccaaaacccacacucaauuugcuacaucucccagggguggggccaaggcagcugugagcaaaaggagaaguaucagcuucucaagggccuaggguuuguuggaagggcaaggcaagggcaaagggggauacagaacaagggggcaaguaccagugccugggauggacccauccauucaggcagggggugugggguguccccugugcuuagaaaccaccuagcaucauagcugcaacagcacuuuauugggaucugagucuacaguucacauagggaggugaagccgugggagaagcagggguaaaaaaaaaaaggggggggacuucacccccuagggacagcugcuuccaaaccuaacaaaaccccaggguaaguccucgugcugggccucgagccagcaacucuagucaaaucccaaggcaccggucagcaugugggucaaggggcccacuauggggacauacacucaagaggaugaaagcucuuuagcuucagaaucagauugccuuccccagaccccaccccaaaacaggcuccucucccaucucccccuucacagugacaaaacacaagcccacaucccagggccuggaguauuugcaugcauuugcauagacggcaacgcagguccagcuaaggccuuuuucuacauaaagugacaucagugcagggcuggugauuuugcucuacugugugaaagauaucugaggacaccaaacaagccaggacagaguccacccuccaggaguuagauaacgcugggaucuugggcugggccaggccaaggccauucccuguggggcagggugucagccccgguggugguggugguggcuauggcugugccccucccugggccccgcagcucuugggcucugugagugcuuguccuucuucccugaccuguggggaggaagaggccuuuaggggacaauaccaugcaaugaaaacggguuccccaaggagagaggacccugcuccucccaaugaagcugacuugagcaggcaccaccaagcauaugugggaaaaaccuggucucccaggauaaaggcuccagucggggagacaggaagauggggaucucccucguccccugggccaugcagguagagguagggcagggcaacucaggagaaagaaucccccugcccaaaaggggacugcucaggaccacucuggggugggcacaggcagcuuccuacccucaagggaagaaaggaagcggaccugaaugccuucucuaagggaagccagcuggggaccaaaaguaaggauacucaaacuaaugauccuugcucuucacauccucccgacugccucugucccacccgacccaacucccccacagcugcccaccucuucuucagugcuuugucuccaaagaaguggcugaagaugaaguccucaaagucaucuacuucaucaucaucaccugucuguugcacagccaccuccuccaagcuguccuccagggcauccacaaaaucccggaagcggaggcggucaugacggaagaugccauccucaccaaagaaagcaggugagagggguagcuccuuggucagcugcccagcccagggcagccgugccaaguauguucuuagcagagaggccagcuccuguugccgcacuggggcuagcucugugccaaagaaagucaggcccuccugccgggcacacucguccacaccugagcagcccuggggugcccgguacuugggccucaacagcucugcccaggauggcagggggucauggcuguccuuagucccuucccuccaccgagguugcuucugcuuuucuccagaggaguggaagcuaccacuuuuccuuggggguuccuucgggcccugucgcuugcccuccuucuugcuccccgacuccuccacccuuggccugcccuccuuccaccuuccugcuggcucccuguccuccugaccuccccaguucuucuuccuuucccggccagauucuuccuucuuauguuuccagugcucagccuuccggucucucugcccaucccaccacuuuuccuuuccacuccacucccuagaauucuggaagugggacuucuggugccaggccuuugaggcauuggcagagaccccaggguccuggccccaguucuccaggcccugcaguuucugggccaaucuguggcccagcucagccaagccagcaugagcuggguccccgcggcuggcauccugcaagcuccucuccagauccugcuguacagaccccagcagccgucgcugccucucuaacucuugccuuaaugccugugccucagccuccagcuguuccuucugcuucaggaagcugaguucuggcuccugcucccuggggccuugcucccugauggccuugucacccugugggccucuacccccacugaggcacaccccaucugggccccggacacagucggccuccagccccuggagccgggcccgcagcugcugcagcucugacuccagagcccgcuggaaggcuucgcccugcugcagagccccccggagcugggcauucuccuccucuagcccuuugggcuggugcaucaggcucugaagcucuuccuuuugggccuagaauaugguuugggacaaaggaagucacaaagaguucuugucaggauagccccaaugccuucuaccccaauuccauucuauuauagugggcagguggccugagcccguuuuacagccuggaacacccagaggauuugguuuucauccuccaccccaucuccaucaugaaugagacacagggauccccaaauuccauccugagccucggcaucuacaucuuuauauaagcacacacuuccuagauucaccuaaggauagccaauguguggcucucacagucuuauuuccuggaacaguguuaacugaucauggcaccuggcauguucuuuaaauccuuuuccacacagugcuccaggcagaccacaccaaucaaucacaggugauaccauguauguuucauguaccauguggaacagguaugccagcccuggcccaaaccuuagcacaagggaugugaaccaagaacugggaagacgcccugacuauagugggagaggggagggucaggauguguggguaaauaggaaacauuccuuuugggggaggaugcuaggacagacgccuggccuagguggguuacccuagcccagccccuccugccugugcccaccugcagcugggccugcagcagccggauguccugguucuccuuggccagcuuguccagcagaagacccauguuuugcaggcuggggacacugucaggaggcacuggggccugcagcuguucccuuagcccauccugagggcagaagagccuguuaugccaugcuaccccacagcccagguucuccccagccaggccccaccugccucuggagacauucacacauaccugccugucccccacagcuuccagcaccucggggucugggaggaccugccgcuccacuuccuccaugggcccugugggaaagggaaacccugaaacugguccugaggcacacagagcccauucuccccacaccuucccauucacacagccaccacuccugcucaggacccacccuguggcugagcgguuuggugagauaaagggccaaggggcacccugaacagcugacaaggccacuaacugagaaauaaaugugagcccccagcaccccuacuccugacccacagaaccagagaacacauacaacuccccagcacaagacaggcuccucccuacucaccagucucagacucugagaggccaccuaaggacagagacagaggagucugaugaggcccucggggaggggugaugugagguaaggugagaacauggcaggaaggcaggcaggcauggaagcccaaagccccagccucagagguaccacucaccugagaagaggaggacccccaggccaagcagaaccagggccccaaggaggcacauguugagggagaugcccagcuccccgccugcacccucacccccagccugguucuccacagccaggggcaccaugggcugaggugggccggccucccggccccgccgucuccgcagacccuccauguccacgucggugucaucgucacugcuggagcagcggcccuccucccugauccaagcuaggggaaaggacagggacagggcagugaggugacuggagagauggggagacacagggagagaggggaaucagaggaaggcacagggagggaggucgucagcccugaccccagagaggggcacaugaagaccuugcccacuugcccacuucugccugggcauugaugacugucccugcccagucuggaggcaggagaccagugcugucaaucuacgagcuauaaaagccauuuucauccugaaagcauccuccuuccucagugugcgcugugcaucaaacuucugcagcuauuaccacccuccuggguugccuccaaacucucuggccacuccuucccauucucccucccuggcucuucccugauccuaaagucaguggucucccuggcaccauuucagguucucugcucuucucacuguacacauagucacaauucucugacccacaccacugacaccccccuucagcaaugaguccuuaguguguaacuccucacuuggccucccagagcuccaagccuguaugucugacugccugcuggccacucccucugggaccaaacauucaacacacugcucugcaaacugguucuuuucugguguuuccccaauucaggggaaggcacugcuuccaccaucuagcuaaccuaagcccucccucuccaccucacauccagacaguuucacaguucuacacuuaaacaucuugacaguccaccccuguucacaacccacacuguaccugccuuaguucaggucugcaucuucuuucuuuuuuuuuuaauauuuauuuauuuuuauuuauuuuuauuuuuugagacagggucuggcucugucguccaggcuggagugcaguggcacgaucacaacucacuguaaccuccaccucccaggcucaagcgauccucccaccucagccuccugaguagcugagacuauaggcaugcaucauuacacccggcuaauuuguguguguguguguguauuuuuuuguaaagacgggguuuugccauguuucccaggcuggucucaaacuccugagcucaagugauccaccugccuggaacacccagaggauuugguuuucauccuccaccccaucuccaucaugaaugagacacagggauccccaaauuccauccugagccucggcaucuacaucuuuauauaagcacacacuuccuagauucaccuaaggauagccaauguguggcucucacagucuuguuuccaccucccauaccuggaacaguguuaacugaucauggcaccuggcauguucuuuaaauccuuuuccacacagugcuccaggcagaccacaccaaucaaucacaggugauaccauguauguuucauguaccauguggaacagguaugccagcccuggcccaaaccuuagcacaagggaugugaaccaagaacugggaagacgcccugacuauagugggagaggggagggucaggauguguggguaaauaggaaacauuccuuuugggggaggaugcuaggacagacgccuggccuagguggguuacccuagcccagccccuccugccugugccucccaaagugugaggauuacaggugugagccaccacacccagccuauuuuuauuuuuauuuauuuuauuuuauuuuauuuuauuuuauuuauuuuuauuuuuugaggcagagucuaccucuguaacccaggcuggagugcaguggcacaaucuuggcucacugcaaccuccgccucccagguucaagcgauucuccugccucagcuucccagguagcugggaaguagcugggacuacaggcgugcaccaccacaccgagcuaauuuuuguauuuuuaauagagacgggguuucaccauguugcccaggcuggucucaaacuucugaccucaggugauccacccaccuuggccucucaaagugcugggacuacaggcgugagccacugcacccugccgccuauuuuuauuuccuuuagagacagggucucccucuguugcccaggcuagagugaagugggaugaccauggcucacugcagucuugaauuccugggcucaagcaauccuccuaccucagccucccaaagugcugggauuauaggcacgagccaccaugccuggcccaggucugcaucaucuuugccugaccacugcaguugccuccuaaauggcccccaggcccuccauccugucacucaacagggaccaauuccuacacuccucugccacaagccuggaacagagcuccuuagcacaagacaggugguccccacuccuuugcugaugcugcagccuuggccuaaaacauucucuuuucccugcccuacguaccaaaagccuacucugugcucagggcuccacucaaaugucaccucucacugucccagccucucccuugcccucaaccaguccccugacugaauggccucuccuuccuuugggaguaccuuaauuacaguucuguaccacucuuaggucugauaugcaccuuggcucagucugaucugccgcuuacauaggcgguaaccaaccaucuucccucugcccaggcccagggccagcacaaggaagggacuccagaaaugaggguugaauucuggaagcaagaaaagaggagguccccauggcagagaggaaagagucaaccagaugugggcccugccccuuaccagcagugugaccuuggucaagucauucaaccuuucugggccucaacgucccagggguaguggugagaaaggagagcaccaagcugcucagcccuagggccuggaccacagcaugugcucaguagugauggcugaucccucucccauaccuucuagaaggagagugacaggagaggcaaggaagacucucaccugcuuuggggguugaaggcaggcucuguggagggcucuggccuuccagguccugugugucuggucccaggccugucaccacgguggucuccugcaggucucccuggacuacugugucuccugggccaggaggcuccacaccacaaacaucaccuuccagggugcccuaaugcagaugcagcagugagcagcugcuagcccuccccgccucccuuccuucccacagcaaaucuccucaccuugaccucagucuccucuguuagaaugcugccagacugagggcuuucagucuggaagagcgucccugcgguaggagaaaaggcgcagaaaaacccacugccccagcugaauuuccuuugcagcccucuguccaucccacgggccccuaccagguuggaagaggcaggaaaaagccaggauggaaugagaaaaggaguuugucaacugagauuaauggaggaacuaaaacgaaccagccucccuuucucugaggaaacugagaaaccccaaaauauggagaauagcuuuguccgguaagcuauguccuaagcagggcccaguaccuucuccauccauggucccagcuaauucuuucccaucugucuuggaggggcugugaggggccugcagggcucucucagauucuggguccauccuggaugccgggcccagugucuccacuggcaggcucugggaggagaagugcaaggagaagggcugcacccaagaauggggccccagcccacaucccagaaacacacacauucagucaugagcuggcccaaaaaggggcucggggcagcaccaagugcucggcauuccccagccucacucacugcgaggaggaacuuucaggggccagguuuccgcuacacagcgccgcaccaccagaccaaggcacugguugcaguacaaaccuggugccccgccuccagaaggugagcuagagccuacguuucccucccaucaagaucagcagcacuuccuuccccacagaugaacaacccagauauuauaauauuaagggugggaagaaggcaagagaacaaaguccccugggugcccacgggucacaguuaugccucccagggugucccugcagcugcccucucaacuggacaacuacuuacaucucucaagccuuucuggccuuucccgcuggccccugacacucccccgacacccgucucccagcagcugcucacagaagcccaacccaccccaaccacagacagccugucuccagggcacucucagccuggacauccagcccuggccacacagccucggccuccucccucugccuacuccccuuccauagggcccuggccugccacccgccccguggcuccaacuaucccucugagaguaaugcuucaccuuaguuaugucuuugcuauuuucaaaacauuuuuauucucaugguccccccuacaaggcaaaaaucaugacgcccguuuuacaggagaggacagagaggugaaauggcaugcccaaggucccccagcugucaacaaagacaccucaacaggaggccagggcucugagagccuggugcccgucugcucauaccugccuucccucugccagugagccccaguccauuaucuugcuccagcgucauccccaaggucaacuccuuacucccagcuggguuccucaagggcaccucaaacucaacauguugaaacugagcuucucuccuccuccccuccugguggcucuaauauacaaagucgcuacgucuuggaacucucagagaugccuuugacaaauuuuugccaucccuucucuagccacucaguuccccauccugccaacccccuucucccuccucagugggcuucugccccaccagcugcuaccuggacugcugcagggggucuuugaaacacucucucccuguucccacccagcaugcacaguggcuucacccucugccugagacaaugauuguccugaucccucuaacccaaagccccacacugauuucccaucaggaugaggccugaaggccucagccaggcucuuccggucucuuccagggguucccaggcucuguccccaaccucacuccaacacuggcuccaacccacgucuccacaucacccaugggugucccacagucucccccagcauggcguuccccacuaucgccucaggaccuuuguucacauuggucucuccauucgaaauccaucccuacuugucucagcuuacccaacuggucccuuccuucauggcaugguccaagugccaacaccugaccccuggggccugaucuacuucuuccugcuacuggaauuccucuaacagccagcaggaagugauguaggugaccaucaggacuaaggaaaaggacccaccaagaaagaagcccagcacugcagaaacaccccccaaccccacccccaugguucccaggcccgcucuuccuaccucggagccagcaagcacccagcuauuaucagagucugggcaggaggccauaguugcugaggucccugaggcugcuguggcugccaccugcagaagaaagcucucuuaaggaugggagcucccuucaggaggggcagaaugcagaaagcagccuuggcuggguuccaagguucaagugcugggcagcagccuccagaaccaagccugguuccaguccuucucucccugacaccccagcucuucuaagcaguauuugccuugcaaaucagaaucugccaacacccacagagaagccagccucuuccagggaccaacagggccuuggaaaacugaacugaccuugaaaggucaaaguagcauaggcuggaaaggcucuggggaauuccaguccagcccccugacauuugagucagggaagaugaagcccagcaagguugacagacucaacuugccaauaagaagacuuguuaauaagaagagcagggaaacaacacagcccucccuucacaacaccagguaccuacacaaucacuaccuucucccccaggaccuggaagggaagacucaauggccuccuucagcccuaagugucccaccacuugcccagcauaaguccuugguauggucuaguucagugguucucaaucuuggcugcacauuggaaucaccuaagauuuugauucaauugaguugggggguaggcccggcugugggucuuuuaaaaaaccacucaaaugauucucaugcgcagccaggguuaagagccacuggcauagcuuagauccaccuggaugcaccuuuuauaagucuccucaucacucucagucuucauccuaaauucuguuuaccuucuuaguaaucgccagaguuuggucuuagggaacuugaaggugacugggaaaauggauuuauggcaacuaucauguauauauacaucacuuuauagcuugcaaaaaauagacaaaaaucagggcuaugguccugcacccgguuaaucugcucugacuugacagggauaggggagggaaucacuccaguuuccaaagccugacugacacaaagcaggguaagaagagagggauccgccccuucauccaaggcuaaaacaguucccucaggcagcuccuguugggaccaggcauaaagguggaaggauagaugagcugaccucucaagaguacuggauugugaucccucagaacaggauaaaugacugcuucccgagcacuuuauaagaaaacucaggaaaagggaagugaggcugggagaguauggcaguucuaccuuugaaaccaaccacauuauccccuucuguuugagcuguuuucaaguccugcguggugcccuaaguaaccuccuguggcuccugccagucaagauccaaguccuggauaggucuuucccaaugcccauccucccagacacaugcacccauuccacacggagacaggagaauggcugcaaugaccucccuguaccaaauccaacaggacacccuggcaugcaucuguaaguauccauagagccauggcuguucagccuuccgcuuguggcuccacccccgcccuuguuaucaucuccccauccccaguugcugacuguuaacaggugguggcaggaaggaaguggcagcagcuugggcugaagucccuguuuaucccuagcugugugugcagccugcucagguccucuagaaccaggcaccauggcaaccacagugaugucagacccacugucuccauggaaaccagcaaagguauuugggucaacaaaacaaauacuuaugagacccaaauaggagacacucugaaacuccuauacucuggguuccaaacccugauaccucuuucuugguuagguuaacccaggguucaaaaaaacaccucuucucccaagccagcaucucacugccuuauuaggaaguuccuucugcugucuaaucuccacccuucccugcuguguuuccagaucuuuuucuuuucaucgaccuucuggaagaaaacccaccuccacucccucccuccacccccuucuuuucauucaggcaggauucaacaaacaccuccuguaaggauuaugacagagacuucugcuauuucuaaaaaacagcuaaagggggagcucucccacucagcauaaagcuaggaagucucgccucuaguuaauuuaaacuccucuaacaguugcuccuccaaaccgcuaaagcaaaggaucuagggccacuugccugggguacccagagcaaguuccuguuguguuagcgucggcaccuggccuuccucccccagcccagaaaugaaaagcagcucauuccuucuagauuaguuccgccuucccuuuuccuuauuccacccccuucaaagcgaaucuguggaccccuucccagcuaaggcauuaccugaaccagcucuugcuucggucuucagcuuaacuuguugcaggcuucccuuuguuugcagcccgagaagaaaaucaug

SEQ ID NO: 13694 - RNA, 1184 nt, Homo sapiens
ucugucaagucaggagggcagccaugaacguucugaugucuacugagcacguguggcccagaccgugugucagguguuuaggugccauccacagaaccuuccuaauaacccugggcagcauaggcuuucuuaucucugacagaugaggaaauggagacucagauucugaaccgaagucacagacacaguagaugguaggucuaaauggggacccaggucuaucugacugcaaaguccaaaccguuuccuugccucugcugcagccugcgaggagcagcugggcagaaagacugugccuuuacgguggugagucuuccgaugcccaagccucaccccagaccgaugaaaucagaaucucuggagacccgacccagacauugguggguuuuagggcuccuggcugauuccagugggcaaccgggcuaccaagcacuguuuuacccuaaggguaagaggaacaucgccuccucgagggcucuccaggugugccuuucacagcguaaucccguucacgaaaccaaaaaucaaaacuaggccacugcccacugguggcugauacgcccuuuucucaucaacagaaccgggaggaagggcucugguggggcuggcgguccccuguucuccccgcucaggugcggcgcuguggcaggaagccacccccucggucggccggugcgcggggcuguugcgccauccgcuccggcuuucguaaccgcacccugggacggcccagagacgcuccagcgcgaguuccucaaauguuuuccugcguugccaggaccguccgccgcucugagucaugugcgagugggaagucgcacugacacugagccgggccagagggagaggagccgagcgcggcgcggggccgagggacucgcaguguguguagagagccgggcuccugcggaugggggcugcccccggggccugagcccgccugcccgcccaccgccccgccccgccccugccaccccugccgcccgguucccauuagccuguccgccucugcgggaccauggagugguagccgaggaggaagcaugcuggccgucggcugcgcgcugcuggcugcccugcuggccgcgccgggagcggcgcuggccccaaggcgcugcccugcgcaggguaagggcuucgggcgcaccuggagggcuggggcagcuagcggcugggggaaaccg

SEQ ID NO: 13695 - RNA, 3367 nt, Homo sapiens
agauaaagccuuucaaauuugaggaagaccuucggucccgccuccauuucacguccggcuuaccgucguuuacgacagugucaggaucgcgggcuugcuuuccgguagcgugggcugacgccucgcucaauuucucacagggcugcgcagguuucccccgucugcgaauggaccacuggagggguucaaagguucgcgucccaguacgggaaugagccucuuugaucucuuccggggcuuuuucggcuuuccuggaccucggaggugagaguagguccggcucggacaagggugggggucgucugaggggagcuugaccccuacgucuuauuuuuggaaaaacauccucugucccacuccuucaacuccugcagagaggacagaagucgcaacauugaacacucaccccgccacaguaaccaaggcggucauuaagaggagaaacagcaaacuaagccuuucuccaaccuggggugaugcaacagggacccgggcggggaagaccgugagggucuggggaauaagacagugagcaagugagcaggaccuugggagagagaggagggacuggggcacacugaagaaaaacugggggaagguguaugaagggagcugcgagcugaggucugacuuugauuaaaaaaaaaaaaaaaaaaaaagaacugucagccauuguauuaauguuuugauguggcagccaguccuccgacccucucccuagcuucccagaccccuugcucuugucccacuuugccacccaugaguugauuuaauggcuuaaauagugcugaaauauugguggccaaucugccuccacucucagccacagagaucccuuuuuuggagggaugacucgagaugaagaugaugaugaggaagaagaagaagaagggggcucauggggccgugggaacccaagguuccauaguccucagcaccccccugaggaauuuggcuucggcuucagcuucagcccaggaggagggauacguuuccacgauaacuucggcuuugaugaccuaguacgagauuucaauagcaucuucagcgauaugggggccuggaccuugccuucccauccuccugguguguggcuuucccuaaggggcaaccugugguuucugguggguuggugggugaaauaaagagccugcagggaguagcugggggaugggaagugugagaagacugaugauuucagagagauuaauagagcccaaguccuuucccaucccagcaaacaccugccaccuuucugcagaacuuccagguccugagucagagacaccuggugagagacuacgggagggacagacacuucgggacucaaugcuuaaguauccagauagucaccagcccaggaucuuugggggggucuuggagagugaugcaagaagugaauccccccaaccagcaccagacuggggcucccagaggccauuucauagggugaguaucccaucugguccugaagugagagcuugugagagaccacuaauaaagugcaaagacuggcuaggugcgguggcucacgccuguaaucccagcacuuugggaggccgaggugggcagaucaccagaggucaggaguuggagaccagccuggucaacauggugaaaccccgugucuacuaaaaauacaaaaaauuagccgggcaugguggcaggugccuguaaugccagcuacucaggaggcugaggcaggagaauugguugaacccaggagguggagacuccaucucaaaaauuguuugagacccagccuugcucuguugcccaggcuguagugccguggcacaaucucagcucacugcaaccuccaauucccagguucaagugauucuccugccucagccuccugaguagcugggauuacagucgccugccaaacgcccagcuaauuuuuguguuuuuaguagagauggcguuucaccguguuggccaggcugcuuuugagcuccugaccucaggugauccacccaccucggccucccaaagugcuggaauuacaagugugagccaucaugccuggccaaagauugcaauucuuguuugaaucugauagccuuggguuggaauccuaagcccuccauuuaguguuuucuguuuucuauauuaagcuugugggauuuucuuuggggggagauggguguucuguuucuuuuaaaaaacaaaaacaaaaaaacaccacuggucuagauaauucuuggauaaggcaggauugugcacagaggauaggaauauaucaguucaggaagucuuucugguagaaggauacauaaaacagccaggaaggaguguguaaauaaggcuauucugaauggaauuaucucuucuguggaaggggguuuuggagcucgggaguaguuugaggucuaugaccuuucaaauuucagauuggaaggagucuuuucacuuacuaugguuucuucugcaguuugaugauguauggccuauggacccccauccuagaaccagagaggacaaugguaagucuggaggaaggggaaguuuaccagccuuuuguuauucuucugaaguucuguguguucucccucccugaaguuucuuccuguacacuugucuccuuuuuuccuuuggacucuuucucuccugcuucuucaucucucugcucuuccagaucuugauucccagguuucccaggagggucuuggcccgguucuacagccccagcccaaauccuauuucaagagcaucucugugaccaagaucacuaaaccagauggggugaguugaaagaaagagguaaaggaaaguauggccagggaacgaaugcccugaaacagggaucuguguaaagaaacugcugagcauaaccuuuaguaacauucggaauaugguggggacuucucuuuguagauaguggaggagcgccggacugugguggacagugagggccggacagagacuacaguaacccgacacgaagcagauagcaguccuaggggugguaaguuaaaagacaaagggguucaucucaagauuccuuggggaagggaaaucuuacucuucuacccuuguccuuugcuucugccuagucucuuucauuuagccuauuuacguguaugacuuucuuccuuagauccagaaucaccaagaccuccagcccuggaugaugccuuuuccauccuggacuuauuccugggacguugguuccggucccgguagccuuguuaacccucagaggccuucaaguccuuuccaccucucacccauugcccaccauuaauaagcuuagcuucucuugccaccucaggggcuuggauauguggaauagugaacuggggccaugucaguuugucacucacccaaacugaccaauaaaaccuuuauuuaugcuaauuuu

SEQ ID NO: 13696 - RNA, 50812 nt, Homo sapiens
uugcgugcgcgccccuuuuagcgucacgcgcugagggacgcaggaaggcaagugggcgggggaaggcgcgagagcgagcgcgagagggaaaaggagggaggggguggggaagagggaaucuuauaucacgugacaggggcggcgcggcccggggugucaguguggaggagacugagguaaaguugggagcgcagcggcguuggcggcggcggcggcggcagcggcagcgcggcggggccggguauuguccgcggccccuuuaaauccgcgaucccccuuuuacccucccucuuuucuccccugcccccgccguauccccucccucgguaggcccccccacaccguguguucccccacuguacacccccccccgagucaugcgagcccuggcgccccccaccucgagucggcccccggagguuuuguuuaugguuggguucgcggccuagugggccgcgccagagccggggccucgauuugggagcguggccggggcggggcuuggagcagccguaggaagggggggccaugcggcuagagccugagaggggagagcgagaaagagcgcgagcgagcgaggccugggccuugccugagguagggcucucucuucaccccggccggugccugcggaggagagggccuccucccuuuccacccacugcgggccuccucugauccggauccggccugguuuggggguggcgugggggagggagggcgaugggguggagcucccccaaacucccccauguggcccucaguuuggugugcgaaggauuaauuuguuccggcugggagguagggaggagauuggccccgugggcucucgauguggcgcugaggggggugagccucccauccuccacccgugggcuugcguccccucuccguuuccaggcucuuugucagcuccucuuauuacccucccuucuuucucaccaacccaguucuuggaauauguuuuugcugcugucuuuagcuuccuguuuauacuguaguuuggguaccccaaacaauuguguuauuugggaagcuggacauggaggcccccauaggguguauuuacgcuuaagggacgucacuagagcacugggguauuuguucacucuucucauaaugguacaggaaugcccaguuucuucaaacccuuaaccuuguggacagcccuuaaauugcuuugcaaacugaugucacaaacuggagacugcuccuuuuccaccauucuugaaauguagccaccucugguguaggauguuguggaaagaaaaacaccacaguaacaggcguuuuuguuauuauuguuaacguuuuugccuuugacucucccugauuauuaaauggagaaauccuuuuuuuuugucuucucucccauccuaccuuccuccgccgcauauccuguuuuggggauaccugaugugacuugcugggaggugauggacauuacuaguaaccagcguuucuagagaauuaaaacauuuuggcuguguaucaguugauaaaacugcuuugagaucugucuccauuguacuuaaagauuagacuaucccaaugauuacagagaauuaaaacauuuuggcuguguaucaguugauaaaacugcuuugagaucugacaccauuguccuuaaagauuagacuaucucaaugauuguuuccuuugugaaugggaaauauugcuggcacauaaacuagugaugaaaggccuaaaaauguccuguuuuguuuuucaucuuuaaagcuccuccuugcuauguccuaacugggaaguacucuuacuaacuagauaucaaggugguggggaaggggaugcaggggccauuucaacaaagcaucuacagaaauuaguuguucuguuagagguagcaaauuuuacccaacucagucuagcuucaguuucugaauuguuucuuaaauuagauuguaagcucccugagggcagcuacuaagucauacugcuuuuguauuuuccugaaguauuggacacauaguagauucucaauaaauauuuguuauuuaguuuuuucagugaaauuucucuggcuauuuuuuuaaguagcuaguuuucaaaaaagagucaagggcacuccuguguugaaaccucuguuuacucucgcacgauuuccuuggucuccaauacuucucacccuacuuccuuuaaaucuuuuuauuuucuaagaaagagcaaguaaguaacaagauucuucaucuccagugugauagcugggaaugggucugcuugcuacuaauucugugcccucaagugauccauuccagaucacuuacuuuugaccuguugcucaguguugucacuacuaggugguaaaaauuuucuuagucacauuucgaagcacuuguaagagggaaauguuacuagcaagagugauuaggagaauuuuuuucuuucuugguuaauuauaucuuucaagaugacuuuuuaauauguuuacaucugacugguacaguauaugcaauaguguauagcuagucaugcaguuuauaccugcaauauaacuuauccucacaaauagauaucacauguggaguagaaaacagucaauauuuguaaguuacaguaguggguuggaaaugacuaugccauauuagaaacuucaucuuagagccaauuuuaaaacaaaauaguuuuccucucgucuuuauauauauacguauauauguguauauguagucuuguugauuuggauucgggguacuugguuaaacauuuuuuuuuuuuguaaaguugaaacgacuauaaugcuaaccugggaaaaugggcuacuguguagcaaauaauccuuucuagcuugaaauacuuaugggcuuuugugugccaauauguguagggggaagagguaauggguuaaaaauuaccugagaagcuaccuuaaaaaaaucuuucuugauacaaagaccuaugcaaccuauugacgcaacuuggugaagaauuuaugcacagaaaaagucagcuuucucugugacauccaagaaagucagaugaaauucacuucccuaauaguuaauccuugcauauuucuuuagaaguccuuccucccacucaaauccaguaauaucucugggcagucuagaauuacguuguauaagguuucauuaacaagaaaaauuaaauauagagcagaaaaguauaaacuuacccucuuuggaagggaauaaaugcagaguaaccuauuauuuugaacacucuaucauaugauuaauguuuucuuuuuuacuaaaugcagcagcugagauuguauuauaaaacaaaguaugaacuaaaggaacuugaauucaguagaauccuuccuuguuagaagucuuguaacaaaaacuauauucugguuuggggaaggcccuguguguucugugucucuuuaaagacucaacuaagucaucuugccagcauuaaggucucaaguuuaaaaugauuucuuagaagcacuuucuuccaaauaaaacuuugugcuagaugcuuuugguuugagacaaauuugagauucccuguauauuaaggugagugguggaggguaauugccauuuugguuucuugaaaauguggacuaggagaccaagagaagcaccuguaaaagcaguguguuggaauuauuuuccagagaacagagauucuggacaaagucauuggggcuaauacguacccuguugaaggcugugguuuaaaaaaacaaaaaacccccacaaacacaaaacaaacccauagcauacugagagagaugaaacuugagggacaaagaagagucuagacuugaacuuguccuuucccaagcaauggaggucacaugcagcuuacauaaaaaagguuguaaggcagguaaggcuguuuucuuaggugauugaauacaguauuuaaaauuauuucucuggaguguagacuaaucuccuuccuggaagguuuuuguuuccagacuuuacugauuaucuuuccuucugucaaagguacuucagauacuugcaucuauguaaaaggcuuuugauuauuaguuaaauguaaagucugcuuaugggggacuaguaaccaaacugcuguaacuucuuaaaaaaauccaucacuuacacaugcuuuauacauuucuuguuacauaaaaauggauuaacagccauagcuccuuaaggaauuuaucaagcuaauuauguuguaagaauaaaugaaucuuauugauuuguuccuuugaagaagugaaaguguuugguggugaaggugcugaugagagaguuaaaaacauauuuugcccacauuuaauaccuaauuuucuuuuaaaucuuucaguauucuaccuuguaaauacuguuauuuguauauacuguaaaugaugacaucggugggcacuaaccgagcccggggaaacugggaacaaccucaaaaccaaaaccagacacagcacaagcagcggccacagguaaauaauccaaggcauacggauucauggauagcguugccugcugauacugguuuccaugcaguacagcaucauucugugcuuugaacuguugguuuagguuccuuauuuuuguuuucuaguccuuggcucuuuuuuuacuuagguccugauaacuguucaugacaugcuguaaggcaagaugcuuacuuuuuuguuguuuaauacuguauuaugaggcuuagcacuuuauuauggguccugugcuuuuuaucuuuuuuuuuuuuguuuuguuuuaagauaggagcucccuuugccuaggucaaagugcaguggcacagucaccauucauuuguagccucaaccucuggggcuuaagugauccucccgccucagccuccugaguagcugggacuaccagugcacacuaccaugccaggcuaauuuuaaaauucuuguagagaugguagucuugcugcauugcccaggcuggucuugaacucaugggauuauaggugugagucacugcccggcucuauaacucuuaagauagcauuucccuucucuuaccugggccauuuuagcaauaccuuucuauuucuuagaccuuccaccuugauaucucucucuuuuguuuuugagacggagucucgcucuguugcccaggcuugagugcaauggcgccacuucggcucacugcaaccucugccuuccagguucaagcaauucuccugccucagcuuucugaguagcugggauuacaggagugugcuaccaugcccagcuaauuuuuguauuuuuaguagagacaggguuucaccguguuggucaggcuggucucgaacuccugcccucaggugauccaccugccucggccucccagaguacugggauuauaggcaugagccgcugugcccugccccaccuugauaccucucuagcaagccuuuuccauuccagauuuuauccuuugcuccucuuuuccccaacuugucuuuuauuuuccucucugguuccauugagaccuuaccugauuauuccuuucccaugaggagcuggcaacuucacuauguuucuucaaaauuaaaugaaacaccuuagagcauugcucaauuuuaaguuuuaaagaguaaauuaaccucuuggauauuaacuuugauguagauauauucuguuucucauaccagguugauguuaguugguauguaaugugaaugaauuacuuauauuugauuauggucagauaaaucgaauauguaagauuaggacaucccccuuacgcauuuuucuuucaucuguguuuucaaguggauuucuaguagaauuauaauacuuaguuggggcaguaaaauuccuaguaucugaacauacacuggauauauagaagauguguugagucuauugucagacuuguauucuaagcucuaggaauaagaggauggcguugguuauuacagaaauaagaauagaguuuacacauggcuuugugacuuaauaugaauuaaggggcagauguuucagagcgguucugugauucuaagacggaagucccuuuaacugugaagauuggugaaugaguuccuuacucuuucuguaacaguuucacucaauuuuuugucauuuuacugauuuaagcaucuuuuuuuuugagguggagucuugcucuaucacuuaggcuggagugcagugccacuaucucaguucacugcaaccuccuccucccagauucaagcaauucuccugccucagccucccgaguagcuggaccuacaggugugcaccaccacacccggcuaauuuuuguauuuuuaguagagacgggguuuugccauguuggccaggcuggucucaaacuacucacaucaggugaucugucugccuugggcucccaaaguguggaauuacaggcgugagccaccacccgcaccuaucccugaucccccauuaagcguccuaaauggugcuuuauuacuugcucauuuguuacaaggaaaagaaaauuggggcaguggaggcugacgaaauagguuccuguucucuaaacuguugccucaugauuaugcuuucuugaucucaucucaauuccuaggccacugcagaacaaauuagacuugcacagaugauuucggaccauaaugaugcugacuuugaggagaaggugaaacaagugaguguaucacuaauuuacuguacacuaugagaaaagauaccaguauuaaggcauaaucaaauacuguagauggaugccaggauacuuucuacuauagguauugaaagaauuuugaccugaaauauaauaggucaggccaauaaauaagugcuuucauucucuaauuuuuuguagcccuuuguuuuguuuuuuguuuuuuuuucagaugaagucucacucugucacccaggcuggagugcaguggcaugaucuuggcucauugcagcuucugccucccgaguucaagcgauucucgugcuucagccucccgaguaguugggauuacaggcgcucaccaccaugccuggcuaauuuuuuguauuuuuaguaaagaugggguuucaccauguuggccaggcuggucucgaacuccugaccucaagugaucugccugccucagccucccaaagugcugggauuacaggugugagccacugcacccagccuauuguagcccuuuggauagauacuuuguuuggaaauuuuaucuuaauuuuaaccucuugccuguugcugaugccauuuuguagaaacugagcaguuguggguauaggaaauguggaaauucaugcugaagccuguguguuucagaguuugauucuguauuugaugcuuaauugcuuuguaaauacuuuugaccucaucccugaaccacagauguuaauauuuggcuuuuggaaauagaauaccaaaauucuacauguuuuccuuuuuggcggggguugggggggugguucuggaaaaccugcuaggcaaauucuacaucauuuuucuuucuuucuuuuuuguuuuuuuuuuuauuuugagacggagucuugcucugugguccaggcuagagugcaguggcgcaaucucagcucacugcaaccuccgccuccuggguucaagcaauucuucugccccagccucccaaguagcuaggauuacaggcgcccgccaccacacccagcuaauuuuuguauuuuuaguagagacagguuuaaucauuuuggucagguuggucucaaacuccugaccucaggugauccgcccaccucagccuugcaaagugcugggauuauaggcgugagccacugugcccagcccucaucuuuugcuuuuuaaacuuguuuuuuucaaacucaacugauagcguuucccuucaccuaguuuccuuucauugggagugugagcauaagccuguucaugaugguugcuguuuuuucucuuucaguugauugauauuacaggcaagaaccaggaugaaugugugauugcuuugcaugacugcaauggagaugucaacagagcuaucaauguucuucuggaaggaaacccagacacgguagagugcuuauagaguguucuaggacauggguccucaauugggaggcuaguaauguucuaaaaguagcaaauggcaacauaccuuaaagcagagcaccuuuuucuugaaguaaaguugggaacuuucuuggagauuguucaccacagguuauaaauacuuaaaauuuauguguacuacauccuuuuuaugaggauaaugcucauaggagaaaacagugaaaucagucucugcuaauuggccuggaauaaauuauuuauuccaggcuagugacuguuuucaggcugugggguuaggcugaauuagaggugcgauuugauagccuuggauauugcuguugaacaaagucacacacuauacuugauucuguuuuuuuuucuuuuuauuuuauuuuauuuuauuuauuuuacauauuugauucugaauucaggacauuccccucaauaucagcuucgcauugcacacuacuguuucauugccugaacuuccuucuguugagguagcagagaaacaagcuuuguagccugcugaccaucccuggagaugauaggggauaucuuggaggaucucuugcccuggaauuuagacaagucgcuuucacuucuccuucccacuucaugagaauucuguuuuuaugcuugucuuauguuuguaccaaauuguaauccucugacugccuuauugaucuucagaauguuccugcagugcuuacuagagaaauuuuguuuuuuuaaugagcaguguauuauuauuauuauuauuauuuugagccagggucuuacucuguggcccuggcuggaguacacugacaugcugcaaccuccucguccugggcuuaggugauccuccuacuucagccuccugaguagcugggaccacaggcaugggccaccauguccagcugauuuucccauuuuuaguagagccaggguuucuccauguugcucaggcugauuucaaacuccuggacucaagcuagcugcccgccucguccucccaaagugcugggauuaugggcaugagccaccgcaccuggcccaguguauuauuuugaaaucauuuucauuuauugggucuuauacuggggcucuuugguuggaauagauaucaaaauucauccuuacagauaacaacuuguuuuuuuucuugagucagagucuugcucuuguugcccaggcuggagugcaguggcgugaaccugcucucugcagccuccaccucccagguucaagugauccugugccucagccuccagaguagcugggauuacaggcauucaccaccauacccagcuaauuuuuuuuuuuugagacggugucucucucugucucccaggccggaguacaucucggcucacugcaaacucugccuccuggguucaagcaauucucaugccucagcuucccgaguagcugggacuacaggcaugcaccaccaugccuggcuaauuuuuuguauuuuaguggagacaguguuucacuauguugcccaggguggucuugaacuccugagcucaggcaauccuccugccucggccuuccaaaauguuaggauuacaggcgugagccaugaaaccuggccucagauacaacagcuuucugauacuacagagucacuccagcuaaaugcaggagguuugucaauuucuuugagacaaugggaaauaauaauggaaaacuuuuaaaaacaauugaauuuaaauugguggguuuuuucuucaaaaguguuauccuggauuaaauuuuacacuguugaccuuauuugaauauuuacuaucuggccaaucaagauaugcuuuugauuuguuuuggguuuacucuagaauaauugucuccagauuuuauggggggaaucagguggggcuauuuauguuuuuuuaaaagucugaauguuuuuucgcaaaucacauuuuaucuuaccuuccagcaucuucugucuagugcuauaaggcugauguuauacaguaucaaaaaggaaaauaagcuggagaauauagguuuauguuacgaauaaacuagcuacuagugaaaccaaugggaagcaaagucagcucccagggauauuggauguauuugggugggugagaucauuucagaaaacugaagucgccuuugggaagauaauaguaauucuuucuccugacccaucuugugccagcaacagaugugcauacagaggagggagaaagguuacaguuuccugaaacuugccagguuuugagauagcagcauaaauucuaaaagcuguuuugagucuagcuuccagaguguuccugguguauauuuagcuacaggguuguucuaacuuacugugagcauaaaaugacccacuaacuguaauguauaauaggcuuggguuggaagaguaggcagcaacaaacuaccaagucuuggguagguaaucuuuuuaaaacaaaugaauuaagagauggggucuugcccugucacccaggcuggagugcaguagcaugaucacugcagccauggacaccuggguucaagcaauccucccaccucagccucuuuaguagcugggacaacaggugugcgccaccacacuuggcuuuuuuuuuuuuuucuuuuuucuuuuuuuugagauggagucuugcucuguugcccaggcuggagugcaauggugagaucucggcucacugcagccucugccuccugggcucaagcguuuuucccaccucagccucccaagcagcuagggccacaggugugugccaccacaccuggcugauuuugguauguuuaguagagacaggguuuugccauguugccuaggauggucucuaacuccuggccucaagugauccacccuccuuggccucggaaagugcugggauuauaggugugagccaccauccccggcccuguuuucuauuucuaugaauuugccuguuuuagagaucucauguaagugaaaucauguaauauuugaccuuguaugucuaacuuacuucacuuaguguaauguuucaagguucguccauauuguggcaugggucagaauuucauuccuuuuuaaggcuaauauuccguuguacauauauguggcauuuuguuuacucaucaguggacacuuggaauuaucuggaaguuguagacauaauacuugauacccuuaaguucuucaacaugcuucccuuaaaggaggauacucuuacauuaccauaauacuauuaucaauccugauaagguuaauaauuuuguauuaucuaauacucagcccauauucugaaagugauuagacauuagguagcuguuacugagcacuagggccaugauugaguuugaugguaagauaauaaagaucugaggcugugcacaguggcucacaccuguaaucccagcacuuugggaggccauggcgggcggaucacgaggucaagugaucaagaccauccuggccaacauggugaaaccccaucucuacuaaaaaugcaaaaauuagcugggccugguggugcccuguagucccaguugcuugggaggcugaggcaggagaaucacuucaaccugggaggcggagguugcagugagccgagaucgcaccacugcacuccagcauggugacaaagugagacuaaguuuccaaaaaaaaaaaaaggaaagaaaucugauaguguugguguuuguccuggaaguuccauuuguacagguuuuuuacaaaaauauguguaaaucaagguaugcauuuuuuuaaaaacuuuuaaguuuacaaugcucauuuuccugaggaagaguguuuugcaaggguguuaagcuuauuuuccuuaccacagacuuucccucuugcaguuaggaauguaucauagauauguauuuuucacuggggaaaguuaaauuggcugauaccaauuuaggaaauauagggagaacacugcaaguaaaaccuggauggaaggcuuuguauaaucaguaucucuuggggucagggcugcgacugucguuuggucuucuuuuauuuuuauuuuuauauacuuuuugagacagggucuuacucugucaccuagacugaguacagucacauaaccacgacucaccgcagccucaaucuccugggcucaagugaucauucugccucagccuucaagugguuugggugacaggaguguaccaccauacuuggcuaauuuuuaaauuuuuaguagagaccagagucucauuugguugccugggcuggucucagauuccuggccugaaaugauccuccugccuugaucucucgaccucccaaagugcugagguuauaggugugagccaccacacccagccuuaccuuuuuuucuuuuuuuuuuuuuugagauggagacuccucugucgcccaggcuggagugcaauggcaggaucucagcuuacugcaaccuccgacuccuggguucaagcgauucuccugccccagucucccgaguagcggggauuacaggugccugccaccacgcccagcuaauuuuuuguauuuuugguagagacaggguuucacuauguuggccaggcuguucucaaacucuugaccucaggcaauccacucuccucggccucccaaagugcuggaauuacaggcgugagucaccgcgccuggcccuuuuuuuucuuuuuuuuucuuugagauggaaccuugcucuguggcccaggcuagagugcagugguguggugcgaucuugcgucauugcaaccuccaccucccagguucaagcaguucuccugcuucagccuccugaguagcugggauuacaggugcgcaccaccacaccuggcugauuuuuguauuuuuaguagagacgggguuucaccguguuggccaggcuggucucaaacuccugcccuugugaucugcccgccuuggccucccaaagugcugggauuacaggugugagccaccgcaccuggccacccagccugaucuuuuaaaugaaauugcugugugugugugugugugugugugugucuguagguagguagcucuaguuguuuuccuccuaaauuuaugggugagauuagagaacgugcccaagaguagaaugcugcucauucauucugaauucauagguaacuuuuagaaacauuuucuuuuuugcuuuauuugguaugaaugaugcuauaaaaaguugugggucacugacuccgaaggaaauuaguuuuuucuuuuuuuuuuuuagcccaggaaauaacacuugaaagauagggaccaauaacuugguccuuugacuaauaugcuaagugacugaauuagauagaggucuuuguaauccucuuggaagugaucccugcaauguuuccuauaaguaccuucccuacaaaaaagacuuuauggcugggcuugguggcucacgucuguaaucccagcacuuugggugcaguggcucacaucuguaaucccagcacuuuaagaggccgagguggguggaccaccuguggucaggaguuugagagaccagccuggccaacguggugaaacccugucuuuacuaaaaauacaaaaauuagccgggcauggugucgcgugccuguaaucccagcuacuugagagacugaggcacgagaaucgcuugaaccugggagguggagguugcagugagccaagaucacaccacugcacuccagccugggcaacagagcgagacucugucucaaaaauaaauaaauaaauaaauauaaauaaauaaaaaauaaaggacuuuacuuuuuguagugauauguauaaaauauuuaaacagaaguaaaagcaaacuaauggaaguguuuuagacauggaugcugaguggagaaugguuaagucaaucagucaucccagcuuucaucucuaguguccugauagcacuccauauugauuagauaugaaugcucuacccuucuauagcauuccugggagauggucgggaagaagaagggagucucaggccagaaggaugguggccagacggaauccaaugaggaaggcaaagaaaaucgagaccgggacagagacuauagucggcgacguggugggccaccaagacgggggagaggugccagccguggacgagaguguaugcauggggcuuuaucaaaaccagcugugggucaguaaugucuagacucuagggaugugccagggcccugcuagucaggaccuaggaaccauuauauuauccuuuugcuuuucuugccgucgucuguucugagaccuugacaucucuugcauguggccuuuucuaccaacugccaccagucuggcaugagauuacccuguagucauuuauaaaguuaaauuugacuugcagcucuccauuaaggcacauuaccauucccugagaaacauguucccauccuuccagcucauuuucucuucguuguuuuuuuaauucccaauaccauauuacauaccauuuauauauuuguauauauccuguugacugugcucuggccaucugugguuugguuuuuuuguuguuguuguuguuuuaauuuuuauuuuuauuucaguucgaggucaggaaaauggauuggauggcaccaagaguggagggccuucuggaagaggaacagaaagaggcagaaggggccguggccgaggcagaggugaucaguuuguugggggauggauauugggggcagguuacucuuuauucauuaauggucugcuuuauuuuuuuuuuuuauuggagguagucucacucucacccaggccggagugcaguggcacagucauagcucacugcagccucagacuccugggcucaagugauccuccugccucagccucccuaguagcuaagacuacagguggccgccaguaugccuggcuaauuuuuuuugagauggagucucgcacugucacccaggcuggagugcaguggcgcgaucuuggcucacugcaaccucugccucccggguucaagcgauucuucugccucagucucccaaguagcugggauuacaagcgugcgucacuacgcccagcuaauuuuuguauuuuuaguagagaugggcuuucacuacauuggccaggcuggccucgaacuccugaccuaaagugaugcgcccgccucgcuaauuuuuaaaugcuuuuguagagauggagucucaauauguugcccaggguggucucaaacuccuggcuucaagagaucuuccugcuuggccucuccaagugcugagguuauaggugugagagacagcacuuggcuccagggucuacuuuguuuaaaaacaaauuaacaugaagucuaguuaguuaauuccugaggugucaugcauauacuagagauugcagaaggggagagugagaaagaagguagaugucauuuccucuagucuuuauugcuaguauuguauuugcuugaggacaugguagucugagagcaaaagaaaaaucucucaacaguaaugauuguccuacucuauuacugauguguaacaugggacagagagaaagaacaucugauaguaucaaccacuuuuuauuccagagcugccucagcuggcaggguaguuuuuuguauuuuugaggcaagguuucacugucacccaggcuggagugcaguagugcggucuuagcucacuguagccucugccuccuggauucaagugauccuccugccucagccccucaaggagcugggacuauaggugugugccaccacacucagcaaauuuuuguacuuuuuauagagauaggguuuugcucuauugccuaggcuggucucgaacuucuggaugcaaccaauccgcccgcccucagccuuucaaagugcugggauuaccaccgggagccacugugccugccuggcaaggaaguuuuauaucaacuucuaaaauacaucucucuucucuuuuucucauucuuucuuuagguggcucugguaggcgaggaggaagguuuucugcucaaggaaugggguaaguuucauugaucuagugucuuaauuuuuuuucccuuaaaaauuacuguaggcagccuuaaccaaaaugaucagaaugauuucuagacuggucagaaagauauggggacuuagggcucauuucuuagggauaaaccuuuaccaccuggaucauuaccuauauuuuauauaucuuuauuugaaucaauauaccuguucuuuucucagaauaucuuagauauauguugagauuauaccaugaaauuuuggguagagugauaagugagaaaaaguagaugacacacaggauuauagaauggggccaugacagauuuguacuaggaaggaugcagucaagauuuugauucuuugaguuaauauuugccaaagcugcuuagaggucagagacucuuaaguuuuauuuuuuccagaaccuuuaacccagcugauuaugcagagccagccaauacugaugauaacuauggcaauagcagcggcaauacguggaacaacacuggccacuuugaaccagaugaugggacgagugagugaccauuuaucauucauuucuugucucugggaaucuaaggaaauaguuuuuucugauuauacuuacauuaaaacguggaagaauaguguuugguuauggagauagggugagaaagggcuggcaguuguauuacuguguguacuguuuauguaacgugcauaugggcacauuacacauguuauuucgcuuaaugcugcuugauauuguaugaaauaaucauuauuuaucaucacuuuccagaugacaaaacuaaggccgaaagagagguuauaaauuugcuaguauuugaacucagcauuguuugacccugaaaguccaugcccuuucaacuaugcuaugucacugcuauuagguccaaguguauuuucuaguguuuauguuaggguaguguugccuuuugaaaagauagccagaauuaaucaagccacugcuuguaaagaugaacaaggccuagaaucaaaguccacacuauccauuuauuuguuuucuguuacugagauaagaauauccuuuuuuucccuuuauuuuugggacaugucaguaucugaacaagaagauuucgaaaucucucuagccuuucuggugcccuguugaacagccuucuuggugugauggaguauucaggguuugaauaagauuacuuuuuuguuaacugacuuuggugccugcgucugggcuggauauaaauguuuaaggauauguuaagcugugguauacaccuaagauguguuuggggguggauacgugugccacuuucaauaagagcaguucauuuuaguaagaaaacucuggagugcuuucuugaacagcugccucauucuggcugagcuaacacaugagagccuaaggcuuuuuuuccucuuacaaagggggaugaguagggccugaaauguuugacuccuuaccuguuuaaauuugccuugucaccuuucacagauacgugaucucugggccuuuaggagagccuuuggcacaaauaguuuuccaccuuuuuccuacaauauauuauuccugaggcucugaaugucgucugcuuuuuguucgccaaguugcuaucuuauaaauucauuuuuaacacauuucauggguggaggcugaaguugaguuacaagauagguaucuuugaauuucugcaucauuuaguuacgaaauguccuguuauaguuuaacuuacuauacuucggaggcauuagaacuguucuucauucaucucuugauggcuuuguagaggcagugguagcagucucaauaacaaauaaguuacuguuuuugagcuguagcuuauuccuggguauuuggcuuuuuaucuuuggcagguaagauggcagaaguugaaaaguuuguuuuuaguugugaauagaaauucaggcauggggucccaguccuuagccuucgcugucuucaguaaggaucugguuggaaaaacagcgaaagguaguguguguguuaauuucuacugaguagaaaagggagcagaugugcaaggcuggaauuggaaaucugauuuguagcugaaugugacgccacuaucgucuuguuagugcaaaaguguugguuauagcuucaugaauucccauugucauuaauuuuuuuuuucuuuucuuuuuuucuuuuuugagacagagucuugcucugucacucaggcuggagugcaguggugcgaucuuggcucacuacagccucugccuccugaguucaagcuauucucaugucucagccuccugaguagcugggacuacaggugcacgccaccacgccuggcuaauuuuuguauuuuuaguagagaugggguuucacuauguuggccaggcuggucucaaacuccugaccucaagugauccaccugccuuggccucccaaagugcugggauuacaggugugagccaccacgccuggucguuguuaauuucaugauaugaacauaccuucaugcaugguuucuuuuuguguuuuccugauagcaaacuugaguuuccccuuuaaauuaaaaaaaaaauccaaaccuaccuuuaaaauauccacagguacaauggggauuauguauuggggcagacuuucucauuuacaagcaaaauuucacugguuguuuuuucuuuucuuuucuuuuuuuuuuguuucaggacuugauuucauugggguugaggggucaaauuaucccccaaaauuaucccccagacugcuccugguaugauacauccaggugccuaacugccccagauauuuuuguagauuuuuaugagcugaaauaucuguggauaugucauuuuuaugucuuucugcuuuuucucuuucugccuuuuucucucauuuuucuguguccacuuaccuuucuguucauuuaaugaauauuugacaguuacacugauugcuuucugcuaauggaauggaaacccuagucuguuguuuagagcauuuccaucuauucuguuccuuaaugcuuccucagcucucucucuuccucagccaugaccguauauccugaauaggaacauaccaguuaggugucuacguuccuccuuuccaucccaguugaagucaucagugugcagaaaaaaauucuugcaucaagagccuagauuaaauaaccuguuagaucaugucuaacucuaggauuguguauaagugcuaaugcaacuuggauuccaucgagccaggauaagauggaugucaaugagaagaaagugugguaucaaugaaggagaaaagaaugugguuuguaacuugucuguacugagauuggacuuugguuuugagaauauugucauuauuaagugguuuaggauuucccuggugcaauuuuaauauuuuccugggaaagucuuuacaaugaauauauuuuccucuaagaaagaagauuuuugcauuauuaaauguuuagaagaauuuuagaugggcuuuguauuagaauacuucuaaugugguguuagaauacuucucuucaguggcacagcaucugaaugucagacuuuucauuucauucuuauaagcuuuuuuccaguaggagggaaggauugaagaguuauuuaauauauauuauucuagcaagaaaauaagggugcucuugucccuucuucagacagguucuuguuuuuacugugccuuuggcugaagggaagaauccugguucuuguuagaaauucucacccuuauuuuuuaagaaaggacauuuuuuuuuuucugaaaauauauguauacaugaagcacaaaaaaggaauguggaaggugguuugauugcuuuuggauuucuccaguagaaacuguaucccagcuuccguauuaccaacaaacacaaggacaguguauacucccguugucugugccaugaccauagcaggucagguuucaaguucuauaugaguaagguuaggacaguaacuaucauucauaccugauuuuucagucuuguucauugucuuuugaagaggacagcucuauaggggcuuuucuuauacaguuaaaccaauaagaucuauaaacuugacuucugcugaguaugcauuuuuaaucuaauucucauagcagauaguuuucaaugcccucaguucggguuucaaacccacccuucuucacugcucuuucacuaaccauuaugugguaaccauuuguguuucucuaucagugcuacuauccuucuucagacugccuacaguauuuuuugucuuauacuagauaaauagguguaguuugcauguuaugguuuaaauuggcugcugccauuucacugaauugaccacuaaaucaaccugaggaccuuaaagauacugcuuugagcauugggugguugucugucuguccccccccccacccccauuccugcuuuguaacaaaaacugaaaguagcuaugaaaucauaaucuuauuaaaacccugguacucugagauauccuuuucuaaagaguguuuccuuaccuuugaagcccaagaauuucuuuuuuuuuguuuuguuuuuuguuuuuguuuguuuugagacaguuucacucuuguugcccaggcuggagugcaaugccgcgaucucagcucacugcaaccuccaccucccagguucaagccauucuucugccucagccucccgcguagcugggauuacaggcaugugccaccacgcccagcuaauuuuguauuuuuaguagagacaggguuucuccauguuggucaggcuggucucgaacucccgaccucaagugauccacccaccucggccucucaaaguauuaggauuauaggugugagccaccacaccuggccuucugauuacuaaauuuuagucauacuuuuggcugccaaaaaaauuaauacauugauguuuucuauacaugcuuuguacuggcauuuaauagugaaguuacuucacuauuuuucuuuauucucaggugcauggaggacugcaacagaggagugggggacugaagauuggaaugaagauguagguauucccaggucauuccucacuaaugccuucuaucccuaaguguuguuuagggauagaaaauggguauguuucuaccccucaaaauucacccuuaagauucugacccaaaacuuuuacauccaaaauaguguucugagccagaacauuucacauauguuauaugaaggagacugggcaugaacaggacucuguggaaccacacuauggaaagggcaagugcacuuguguaaguccaauaucugauugucggauuuaucccaggaagagauuggugguuggguagggcaccagaaguggaguuaggcagguagugcauugaguaacagcugcuggugguacaugacuacuuggugcauuuaaguauuugcuauaagguccuguaauggauuggcaguggauccaaagcgaguguugugguaccaaauccucaaacuuguaaucugguugacucuggaacccuuguauuuauuugaagcccaacuguauaauugugauugagaugaauaucuguagaauuggcuaucugccagcuugacuuaacuuggaaaccucauagauggguggcacguaaacaagcucugugaauucauuugaguacuaccugaguaagaauuuugcugauuccuggucacagucaagcuucugcugugaauuaugguuuucagugaucauggauaaacucuuguuuuaacauuuuuaaucuauguacuuuucuauacuuucauguaguuaggcaagacagcuuuugugauaagaggaaaugacaugugaagacuguuuugguugccaauucuggguuuuuuaaauuucagaggcaucagcaucacagggugauuauuuucuauuguauaaucaaugaacuagacugcuuugugaaaaugggcaaauuauguuccuuucugagauuuggcuuguccgcuuaagcaacuuucagagaaugauaaaugguguugggcauugaggggagaguggauuuucugugcuuuagcgauuuuaaucaagaaauaaaacugaaacccaaaucaacuuuugaauaguaggaaaaguuaaucccugcauuugcuuaccuaaguuugaugccuuaauaguggaaggacuagaugucacaaagucaaauauuaaggcaaaaauaacaucuaguuaaaacgaucucccauaaaaaccuuaauucagcagcacuugggcccuuacugcucaaaagcuaaaaaugaacuucuuuuauuuauuucuucaucuugguuaugaucuuucuuugggagggguggggcugugaagggaguaguagaagacaaaugugguuugggaagaggugggaguugggaacuguaaugggaaaauauagagggauuuucuuucuuuuauuuuuuuuuuuuuaugucuagcaugccuguaaguucaguaugcauaugaucaugugacuccacuauauuuuauuggguuccuugcuucuacucuuucuuuggcuaaaacuauugagcauauauugaagggcuugaaagucaauccauucaggauuccucaggguagauaguuuucucuuuauagggcuuucacuuuuucuugauguugaauuccccuuaccuaugccaaguuucugacuguagcaucccugacaccaagagugacuaaucccucuguuuuccagcuuucugagaccaagaucuucacugccucuaaugugucuucagugccucugccugcggagaaugugacaaucacugcuggucagaggcaagugugcaguaaaauuuaguaccauuucuuaaacacaucugcugagauuacuguaaagagaaguggcacuggccuuuguaaacucccauggugucaauaauaauaaccaaauuacauuacaucauuacauuccucuuaaguugauggagagacuucuuuuuuuuuuuguuuuugagacagagucucacuguaucggccaggcuggagugcaguggcacgauuucggcucacugcaaccucugccuccugggcucaagcaauucuccugccucagucucccgaguagcugggauuacaggcgugugccaccacgccuggcuaauuuuuguauuuuuaguagagacgguguuucaccauguuggccaggcuggucucgaacuccugaccucggguaauccgcccaccucugccucccgaagugcugggauuacaggcaugaaccaccgcgccaguugauggagagacuucuaagaguuaguacuaguuaaucugcugaauggaaguugauauguuacaauuuuaaaguugauucucccugcaaauagcacuuuaauuacaaagaucagccuuucauaucaccagcauugaguauauaacuuguuuugaaguaagucagggaaagaagagccaaaaguggaaauguuuucauuuauuucugaaucuuuuagaacuguucagcaguuuauucuccuguucucugagcccacugaguauaacaguuguuuuuuuccuuuggaucagcaggauccagcuaauaaacguuuuagaauuuaaaucucuagggaucagugguaggagauacacucuucagggaauauuuuuaauucgcuggaaaccucuuggauuuuuucuagaccugagccugauagcucaaaaauucaguucugacguuaacuacccagaguuaaugcagaccccacaaguugaaagcucaguucuacaagagugccccaacuucagagguucugccagccagcuacaaauuuggagguucccaugaccgccuuucaaguuugauaacucacuagaaugacugaacucaggaguuuuacuugccguuacuguuuuuuuguuuuuguuuuugagacgagacggagucuuguucugucacccaggcuggagugcaguggcgugaucuuggcucacugcaaccuucuccuggguucaagccauucuucugccucagccucccuaguaucugggauuacaggcaugcaccacuauacccagcuaauuuuuuauuuuuaguagaggcagcguuucaccauguuggccagccugaccucaggugauccacccaccucagccucccaaagugcugggauuacaggugugagccaccacaccuggcccauuacugguuuauuauaaagguacaacucagcaacagcuaaacggaagaaaugaguagggcaagguaugaauggguauguggguggggcacacacaaccuccuuguccucugcagguauccugaagcucuccaaaucuuauuguuaugaguuuuauuaccuaggcaugauugauuaaaucauuggccauuggugauuggacuuaauagccaccucgccuacaccccuggaauuuggugggauugggaggggcuucugaaaguuccaacacucuuaccuggucucuuuuuuugagacagagucucacucuguugcccaggcuggagggcaguggcacaaucuuggcucacugcaaccuccgccucccagguucaagcgauucuccugccucagccucccgaguagcugguauaguaggcacccgccaccacgccaggcuaaguuuuguauuuuuaguaggguuuuaccauguuggccaggcuggucucaaacuccugacuucaaguauccgccugcuuuggccucccaaagugccgaguuacaggugugagccacugcauccagccuuaucuggucuuucuagugaccaacccucauccugaaacuaucuggggccccacccugggcuaccucauuagcauucagguaugguugaaagaaguguguuaugaguaacaaaggacacuaucacuuaggaaauucuaaauguuuuaggagcuccaugccaggaacaaggcaaagcucaaguauauauuauaccacagguaacuuuugaaauuuuacgaaaauugugggaaaaaauaucucucagacugccccuguucuaaagccauuugaagauuccaguguucugguauaugauuuucuguuuuaggaauugguaaugacagguauucaguauuaaaaucauggauaaguacuuguaaguuuuggcugaguuauugagcugccauguuaaaacuagcauuugaggccgggugcggugcgguggcuaacgccuguaaucccagcacuuugggaggccaaggcgggcggaucaugaggucaggagauugagaccauccuggcuaacacgugaaaccccuucucuauuaaaaauacaaaaaaaaaaaauuagccgggcgugguggcaggcaccuguagucccagcuacaggcugaggcaggagaauggcgugaacccaggaggcagagcuagcagugagccaagauugcaccacugcacuccagccugggugacagagcgagacuuucucgaaacaaacaaacaaacaaaaacuagcauuugauauuucauuaaauuaauaacuucacuuaaaaaauuaaccauuauuauuggcaacaucaguggaauucagcuauauacuguagugacucuuaugcaucaguuauuuugggacauuuaagcauuucaaggcuuuuguguuugaacccuuuuagaagaagccccagcaaguggcuucauuuugaucuaaucugauuugaguguuggggaauguuagcguguucagucauucuucaugaagaucccuucccuuccccauuagaauugaccuugcuguucugcuggggaagacaccaucuacaauggagaaugauucaucuaaucuggauccgucucaggcuccuucucuggcccagccucugguguucaguaauucgaagcagacugccauaucacagccugcuucagggaacacauuuucucaucacaguauggugaguaggaaacgugguuuauccuaaucaaaccuuccugcuaauccuagcacacauacacaguuccuuccaaagacagucagguuuuuggcaggugaagcauccucuuugucuucuuaagcagacuugguuguagaaauguuugaguuggguaauaggggguagcucuaagagaggacuuaguucuggacagacugaauauucuuauaagaauaaguuaacauuauuuauugacuacucauugugcugaaugaacaccauuugccauuacucuugagagaaaaucaaugacauaaacuugucaauacauuuuaauccuuuugcagcccucauuaaacuaugaugggagauuguagcaguuccccauuucuugauggaucagaauugucuuguauauuuacuuaaaccagguauuuguagacaaggccuccagaaaccuauggucuucccauuucugccacuuacuagcugugucuccauuucuauguaaauagggauaaaagugcuaguccuucccaucuucccaaagguggcuauacaagugugguuucaguagugauauuauaaauaacuuagaacuuaugacauauuacuuguugacucagagcauuuaaaacauccaaggucauuaacgacaucaaaggaaucauuuaaacuaaacaaagaugcuacaaguaccaguuuucucauagucauugaguccugagaaguacugcuuuuucuuuuuuucucuuuuucucuccuauuuuuugauggagggauacuaaaguuguaagcagaccaugugugugcauauaauuuuauuuuuccaguuagaguaauuaguuuaacuagaaaacugccaagcuagcuacuaauucagaacucggucaguuuuuaauuguugucuuaaaauguuuuuuguguguguuaaguuaguaauuugguggucgauguccugccacauaggaaagguaacaggugagaagaggugggaggagaagggaaauggagagaaguguugggauuaaauagaaaaagaagaaagaaaauaggacaaagguuguaagaagguguaaugaagaucaagaaguaacuaccaacccuuaaagauaaaugacuggaaaaugugauuaugugaucuaugucucuuaauugcccucuuaaugucuggaauugugaaaauuuacaacgaaaucagacuuuugauaucaaaaagauguuuucagcuggggacagugacacguuccuguagucucagcuacucuggaggcugaagugggaggauugcuugagacuaggaguucaagacuauagugagcuuugagcucaccacuguacuccagccugggugacagaaugaaacccuuucucuaaaaaaaaauuuuuuuuaaauaaaaaugugaaaacuaaguauaaauacuauucuguuuuuuuguugccuguacuaaucaauauguuagauaauguaauuuccuuucuauugagaauaaauguuagaggauuaauuucacuuaaaauuuaauagagcuaaauaacaugggaguuucuuuauauuuuuauguauaauacagugaacacuagguaauuuuaauuguuuuuauuuuuuauuuauuuuuuauuuuuuuuugagacagaguuucacucuuguugccuaggcuggagugcaauggcgcgaucuuggcucaccgcaaccuccaccuccuggguucaagcaauucuccugccucagccuccugaguagcugggguuacaggcgcccgccaccacgcuuggcuaauuuuguauuuuuagcagagacaggguuucaccauguuggucaggcugguuuaggacuccugaccuaaggugagcugcccgccucagccucccaaagugcugggauuacaggcgugagccaccgcauucggcccagugauuacccuauagaacuuguauguacauggagaaaacaaucaaaucauacugacuugcuacuugauugucuagugcagaaguugggaugcccuuuaacuuuuccuuuuugccucugugcuaguuauuagcagcaucgagaugaggcuccaguuaauuguuguuucuuuugaguuuuuuuaaugagaagggcaaggaccuuaauggcaaaaguaaaaucuuauauuacauuuauguuaauuguauugguugauuuaaaaauucucggcugggugugauggcucacgccucuaaucccagcacuuugggaggccgaggcggguggaucacgaggucaggagaucgagaccauccuggcuaacacagugaaacgcugucucuacuaaaaauacaaaaaauuagccgggugugguggcgggugccuguagucccagcuacucgggaggcugaggcaggagaauggugugaaccugggaggcggagcuugcagugagccgagauagcaccacugcacuccagccugggugacagagcgagacucugucucaaaaacaaaaacaaaaacaaaaauucuccagucagccaaauuuuaucccugagaagcagggagaaggaaguaaugaugauaugaaguuuuaauggcucuguuuuuuuagugauuacuaugugccauacauguauuaagugcuuuaauuuauuuaauccuccuacagcuuuacuuuuauuccuauuuccagaugaggaaagagagauuaaaaaauaguuuuuccaagcuuacauagccaggauuucaaucuaagacagucugacucuagguccuauacucuaguggacuaugcuguauacucagugugacaguauucuuuacuugccugaucuauacuggcucucggucuggauaagugucuuuaugaguagcugaacaagguuacuggcuguagguuucucucaucucuuuguugaucuacaggugagcauguuagggaaaggauuuggugaugucggugaagcuaaaggcggcaguacuacaggcucccaguucuuggagcaauucaagacugcccaagcccuggcucaguuggcagcucagcauucucagucuggaagcaccaccaccuccucuugggacaugggcucgacgacacaauccccaucacuggugcaguauggugagaagauggaaagugacuugaaucuuuaaagcauuggagcauuacugucaagaggcuagcagggggaggggguggagaauguguccugaagugaagaaaaggggcagcuaguugguuaccuucccacauguauuuccccuaaucaaauaagcugaauucaagaaguuggggaauaauaaaauuugaggcuauguauuucucaucacauuuagaggcugggcaugguagcuuacaccuguaauccuagcacuuugggagguugaagugggaggacagccugagccuuaggaguucaagaacagccugagcaacauaucaagacuccauuucuaaaaaaauuguuuucaauuagcugagugcgguggugugcaccuguggucccagccccuagugagggugagcuagugugaagcuagcuuuccgcaaaaaaaaaaaaaaaaagaaaaauuuuuaaccauauacauaguugcagucuucuguugauugggguuuuaauuauuauuauuauucuccuuagauuuaucuucaguguuugaaaauaacauauugccuccagguucuuaggcuuagccaucuuaagaccuuauacaguaagucuucacuuaaugucauugauagguucuugcgacuuuaugcgaaacauaagacaaggucuaguucugucauccagaccggaguacaguggcacuaucuuggcucacucaucuuccugggcucaagcaguccucccaccugagccuccugaguagcugggaccacaggcuuguaccaccaugccuggcuaauuuuuaauuuuuuguagagauggguuuucaccguguugcccaggugugucucuugggcucaggcgaucugcuggucuuggccucccaaagugaugggauugcaggcgugagccauugcaccuggccauuuuuuuuuccucaucaacauuauaaugaaaucauguugaaggaaacaacguuaugccaagauaugccaugccuuguuuuugcuuaaagccaguuuccaagcaccuauggauguuaaaugagaacuugcgguacuuuaaacuuggacaauuugugcauuccugucuuacacagacaggguaauguugauuuaguuaggcuuuauuuaaggaugguuguaggccaggugcggcagcucaugccuguaauccuagcacuucgagaagccgaggcggacggaucacuugaggucaggaguucgagaccagccuggccaacaugacaaaaccccgugucuacuaaaaacacaaaaauuagccaggcaugguggcgcgcgccuguagucccagcuacucugaggcaagagaauugcuuuaacccaggagucggauguugaagugggcugagauugcaccauugcauuccagccugggugacagagcaagacucccaucucaaaaaaaaaaaaaaaaaaaagauguaauccagugauugucaccuauagaaaugagauuaagccccaaaagagggccugcuuauaugaguuucugauuuuuacaguccucauucauggugcuagugcaggacaauagcauuuccuugagauucauuagcaucucuggcuucauauacuggguuuccucuugcagauuugaagaacccaagugauucagcagugcacagccccuuuacaaagcgccaggcuuuuaccccaucuucaaccaugauggagguguuccuucaggagaagucaccugcaguggcuaccuccacagcugcaccuccaccuccgucuucuccucugccaagcaaauccacaucggcuccacagaugucgccuggaucuucagacaaccaguccucuagcccucagccggcucagcagaaacugaaacagcagaagaaaaaagccuccuugacuucuaagguacuuaaacuuuuagguagauaccauuuuauggcaagggguguggggcuugagaauugagauuaaaaggguaaguuuggaaauuuaaagggaaggguuuuuuuuagucuuuaguaagguuguauuaaagccauuacuuucucuucuccuucaacuuuauagauuccugcucuggcuguggagaugccuggcucagcagauaucucagggcuaaaccugcaguuuggggcauugcaguuugggucagagccuguccuuucugauuaugaguccacccccaccacgagcgccucuucaagccaggcuccaaguagccuguauaccagcacggccagguagaggaaacauuaaccauaagaccucucuuauuaaccuuuacuacuuuuuuaaucugugggagauuucuagaacucuggagaggccaagccccucugcauggcugagggggaaaguagucagucauagcauuuuuagugcuuuaaaauauuguuauuaggguuaucuguaacuaaacagguagaaauaugccccuuaggggcugggugugauggcugacacuuauaaucccagcacuuuggguggccaaggcaggaggauugcuugaggccaggaguucaagaccagccugggcaacauaaugagucccugucucuacaaaaaaaauuuuuuuuuaaacacagaguuucacucuguugcuuaggcuggaaugcaguggugcgaucucggcuuacugcaaccucugccacccggguucaagcgauucuccugccucagccucccgaguagcugggauuacaggugcccaccaccauaaccagcaaauuuuuguauuuuuuaguagagaugguguuuuaccauguuggccaggcuggucuagaacucaugaccucaagcgaucuacccaccucggccucccaaagugcugggauuacaggggugagcaaccgugcccagcccagauuuuuuuuuuuuuuuuuuuuuuagauggaguuuugcucuguugccaggcuggagugcaguggugugaucucggcucacuguaaccucugccucccagguucuagcaauucuccugccucagcuuccugaguagcugagauuacuggaaugugccaccacauccggcuaauuuuuguauuuuuaguagagacaggguuucaccauguuggccaggcuggucuugaacuccugaccucgggugaucugcccuccucggccucccaaaggacugggauuacagucaugaggcaccacgccuggcucagaguuuugcucuuguugcccaggcugaagugcaauggugcaaucuccgcucacugcaaccucugccucccagguuuaagcaauucuccugccucagccucccuaguagcuggaauuacaggcaugcaccaccaugcccagcuaauuuuguauuuuuaguagacaugggguuucaccauguuguucaggccagucuugaacuccugaauggagaugaucugcccaccuuggccuccaaaagugcugggauuacaggcgugagccaccacacccggcccaaaucuuauaugguucuugagggagccuagaauucagaauucucuaaaaugagugugaacaaaagauggcuuuuccugugcuuaggguccauguuauaauguauagaaggggccaagaguaauguauccuguauaccgacauuuagccacuuuuuuauuuugagacagagucuugcucuugucacacaggcuggagugcaauggcacgaucucagcucacugcaaccucugccucccagguucaagugauucuccugccucagccuccugaguagcugggauuacaggcgcccaccaccaugccuggcuauuuuuuguauuuuuaguagagacaagguuucgccauguuggccaggcuggucucgaucuccugaccuuguaaucugcccaccuuggcuucccaaagugcugggauuacaggcaugagccacggcuuccggguccacuuuuucuuauaacagcaaaauguaggggggagccaagggacuuuucucuuccuugaagacuugaagauguuuuuaagauuuuuuuuuuuuuuuuuuugagauggagucucgcucugucacccaggcuggagugcaguggcuugaucucggcucacugcaagcugcgccucccggguucaugccagucuccugccuacucccaaguagcugggacuacaggugcccgccaccaugcccggcuaauuuuuuuguauuuuuaguagagaccauguuagccaggauggucuugaucuccugaccucgugauccgcccgccucgaccuuccaaagugcugggauuacaggcgugagccacugcgcccggccuagauguuuuuuuaagauuaauucuuaauucagaucucuggcgcuauagaagguagggauuccuaguguuaucaggaggaaauuuugguagauucuucuauuuguugcugaaaaauuucuucuugauucaaaucaaguuauuccacuaguagaucuccacgauuuccuuaguaugaguagauaugcucuauuuuguuucucugagauuuuucucuucguuacucacagugaaucauccucuacaauuucaucuaaccagagucaggagucugguuaucagagcggcccaauucagucgacaaccuauaccucccaaaauaaugcucagggcccucuuuaugaacagagauccacacagacucggcgguaccccagcuccaucucuucaucaccccaaaaggaccugacucaggcaaagguaguggcuucaugaacccuugggaauugguuaggagaauagugggcaaaaauuccuuaaauauuaguguuuuacuuuucagcaaguggugcuaagaaacuuuggaaguagugauugagaauuugaaaaaggcacacaucuguggcuagugaauuaaaaguucuuaucagcaaacccggagacugaagagccaggaaaccauucucuuuguacuaaaaauucauugccucuaguagaaucagucucaagugccuguccugucuucugggaagaugugauugccagauuucugggugcgugucaguagaccucaccuugcuaaguccuggcauggugagggagacagcaugugccagaggugauguggagugagugucagaugcagccagcggaauaggugguguggcugaacuguuguacuuacccuuccccaaaaaucacuggauguggacuuugggccuuuccucuaucuguuuuagguuuggggugucuucaacaauuuguaggguuuccuucuuuugcuuuuggucacacaguguugguauaucucaguuuuguuguuuaauuuuuguuccuauuuugguuuuuuggauagucuacauuguauuaauauuaauccuuuugguuaauuuacagaguuucuccuaaagauuuguugaccaaaauaaagcugcaucagugcuaacuuuccucauucacaugaguuugucuguuucuugcucuucuguuuuuuuuuuuuuuaccagaauggcuucaguucugugcaggccacgcaguuacagaccacacaaucuguugaaggugaguguucuucaggcuuuuccccuccuaaguuucugguuuucuaucuuaaaauggugauaauccauuaguucccuucacuggacaauugagacccaugcuguguaauucucagcauuaaagaaaaaagauucuaccuaauauaguccauuguuaaauaacucauccuuuugucuuuggaacugccuuggacuguggucaccucucuauagacauucccuuuuuucugaugagaggaauuccuuucuucuaaauuucuaggugcuacaggcucugcagugaaaucugauucaccuuccacuucuagcauccccccucucaaugaaacgguaucugcagcuuccuuacugacgacaaccaaucagcauucauccuccuuggguggcuugagccacagugaggagauuccaaauacuaccaccacacaacacagcaggugauuuggggugaggauggagguugggguuggugaauagcaauaacagagcucucugguccuuauuacucccuugaccuggcagagaccacauuagcccugcuuuugucguaagugggugaccuaagaacugugggaagugaagacagaggaggcuuguuuuaauuuuccccuuucaacauccacuuuugcuuuaacugcucucuaccccuggcuggccauugugcuuaacauaugaucucagaccuccuuggugucccauauuaugucuuauuuccuuguuauguucuugacugaagcuccaggucacguaacuauagcacuauggcugauggcagccucuuuuuuucugacagcacguuaucuacgcagcagaauacccuuucaucaucaacaucuucugggcgcacuucgacauccacucuuuugguaagugugaugcugagagggaugugugguuuucuuacacuuagaacuguccaacuguaagauugucccaagagagaauuauugaaaauuucuucaugagguggcaaaauaauugauuugagguugcaggaaaaggaguaaagggauguuaggaagccaagagaggcagaagaaucccuaaacauugagcucugggucauuccuaaaagcccugaaagugacuuucugauuuuuuuccccuacugaauauauaguugggcuuuguaugcuuuaauaaauucuggaagaacauaccuuuccaacugguagagcuguucucuuuccuuggucuuggguaugcccaaguucugaaaagaaucagugcaaggcuggacauuuuugugaaaguagaugccaggugagagcuuuugguccaagagucaauuuuauuguuuugauuuguaacaacuauuaauagaauuaagcugagccuguaaagggaaggacccauuuuggacaaaaguaucagauuugccggaagccuggggagguaugagggcuaaggcuccuuuaggagucucuauucaaauacacaguuucagauuuaaagucagaauuguggacaggugcaguggcucaccucuguaaucccaacacuuugggaggccaaggcaggaggauugcuugagcccaggaguuugagaccaaccugagcaauauagugagaccucaucuccauaaaaauuuuuugaagauuggccaagcauggugguacauucguagaguccuagcuacucgggaggcugaaguggaaggacuguuugagcccaggaggccaggguugcagugagccaagauugcaccacugcaccccagccugggcaacaggaugggacccugucucaaaaaaaauguaaaaucagaauuuuugcuuuuuccuaguccacaaacuggucucaacuaguaaagaaaaguuggggagagaaagcugugauauauuuuuuacaucucaacucucucuguuccuuuaucagccaguguuagucucuggggaaucugucuccauuugcuuuacugucuuucugaacaggaugaugaugugcagugagucuguuaccauucuugccagaugagucuugaggaauauguagcuggagauuauuucuaacuacuuuagcaggguguacuuugguaccuugccuacuuggccucuuuaauuaggaaguugacaucauaauauauucagcaggagggauugucuuauuuuuccugaccuaugaugcugaucucuuuucuucuucucucuuccacugcucccccuuuugaagcacacaaguguggagagugaggcgaaucuccauucuuccuccagcacuuuuuccaccacauccagcacagucucugcaccucccccaguggucagugucuccuccagucucaauaguggcaguagccugggccucagccuaggcagcaacuccacugucacagccucgacucgaagcucaguugcuacgacuucagguagccuugcauaagcagauggcauuccucugggauggaggagguaaguaauugugugaugggauaaaaauguaauuucucuuuuaggaaaagcuccucccaaccucccuccuggggucccgccguuguugccuaauccguauauuauggcuccagggcuguuacaugccuacccgguaagugggacuaaaggaucuucuucaaaaggugaggauguuguggcuacucuuuuuauagcucuggcuucagauggaccccugugaauaccaaaacuugcacauacucaagcccugcaguuggcucuguggaauccauguauaugaguuuugcauucuguaaauguggccguauuuuugaucugugugucugguuggaaaaaauucauauauaaacagcgugcaguucaaaccuguguuaagggucaacuguaauuaaaauauaaaauaaaugagggauugccacauguaaucaaacugguuuuuaaucuuugcaguuuuggaaaaaauacuaaacugaggccaacccaucuauuguguaucugcuuugguuuauggugcacacauguaugcaugugugugugugcguacaauguguauguauaugugugaugagaauaucugcccuguuugaaacacagcuucugggccucagaagccaaaggccagaauguucaucuggaauccuuuuugguuucuuagauaauuaugacuauuauuuuauuuuuugaggcagaucuugcucuuuuacccagguuggaguacaguggaacgaucauagcuagcucacugcagccuugaacuccugggcucaagcaauccucucaccucagacuccccaaguagcuaggacuacaggugugcauccccaugccuggcuaaguuuuaaaaauuuuuuuagagacagggucuuccuauguugccuaggcuggucucaaaaucccagguucagacaguccuccugccucagccucucaaauaacugggguuauauauaggccugagccacuacuccuggccccaagaauuauuuucucugauuugauuaaaucccuaacucugaguguguuugcuggucuggccugguuagaggaaaguuuccugacucaaucugggacuuugagaauaaguggcugacauuaguagcuuuuugcccuaguguaucuucugugaccuucaaguauuugguaccuauuaagaugaaggauauauggaaacguuuuagaagauaccuguuccugcccucauagacaaagucuagauaaauuucauaccgaugacacauccaaauaacacaguuacacauuuuuaauuuguggucacuaccuuaaaacccugacauuggagaaaagugaaguauucuuuccagaggagauuauuuuuaagccagauuuugaagaguauaagagacagagacuuguagaauagagaguaaaacugguuguucguguauguuuugugucuacucuauugguaucaagaagccagccuacuagaaucaguaguauuuagcucaaggaaagcuucaagaccuuucaugaaucauuuaaucucuguguacuuuacugcuuuuuccuuaaauaaaauugaaggaaauaauccguguccuguucuaacccagaaugaggaugaauguucuguugaauuagcuugucucuuggcuccuuguuuugcuaacaucaugaccaguuccuguuauugcuauaugucuguaucuuucagccacaaguauaugguuaugaugacuugcagaugcuucagacaagauuuccauuggugaguaugugggauagagcuuuggaaaagaaaguagucuuaaaauuaguguugggagaauuaucuccgucacagacauagcucuuucccaucccagcccuccauacacucugauuuaaggcauauuagaauauagggauuugggggaggguuuccaacagaagauaacuuuuuuuuuugagacagagucuuucucugucgcucaagcuggagugcaguggugugaucuuggcucauugcaaccuccgccgccuggguuaaagcaauugucugccucagccuuccgaguagcugggauuaaaggugcccaccaccacccccagcuaauuuuuuuuguauuuuuaguagaggcgggguuucaccaucuuggccaagcuggucuugaacuccugaccuuaugauccacccgccucugccucccuaagugcugagcuuauaggcaugagccgccgcacccagccuuuuuuuuuucuuuuuuuaaaucagaguuguggcaucuuaguaaauacauuuuaaccuauucuauagcccaguaaaguacucuggagcacucagggugcuuucuguuugucccagacacuuuaaauuaucgaaugaucuguuuucucaguagaauaagcuugguauaaacugauagggaugacaccuagaggguugaaaauauugguccucguggacuuugauguauucucaagugggcauacccguagaccuugucugacugugcucauggccaggcaggggggacaguguaugcaagaguaauguggaguuugugcuaacucuagccagcuuaauuagugacuggauaaauugcacaacucucacauucuucuguuuuuuccuccguggaaauaguacucaugcuggggaaugagugacauugaaucucugcucuuuuuuccccucuuuucuaggauuacuacagcaucccauuucccacacccacuacuccgcugacugggagggaugguagccuggccagcaacccuuauucugguaggauugggaugggacuaaauaaauaaaaagggagauaguguugggauugauggcagacaccugauugguagcaagaagggaugugauaaaucaggauugguagauucaaaauccugcuaaaguugggcaugucauggcuuuuccuauucaucccacuuuguguugucucccugugauuucuagaugauaucuuagccaggcaugguagcacacacuuguagucucagcuacuugggaggccaaggugggagaauugcuugagcccaggaguucaagaccagccugggcaacauagcaagaccccaucuccaaaaaaagugauaucuugacuuaguuucaagccauuugcuagcuuuuuccaggaaauacagugguugagguggucuucucugcucaucucugccccuuuaugcuacuacucacaguggcaaucucacugccuugccacuccuucuuuuaccugaccuaucauuguccucauugacuuaccguuuucccugauccaucguuguccuucaaguccagcaugggguauuccccauggaggagaagaggggagggaagaagagggaagaugaaagagaacacaagugggcagagaaauugugcaggugccuuauuccaagagccuccugccauagcauugcacaguuauucaacauuaguccuugacuugcagcaacugugcuaaguguaugcugagcaacaauaauuggagccacuaagaaauguaauucaaggaauugaacuuuaauagucuuugaacaggaucuccuggaaucaugugaaaucagaagagguaauucuguauugguauuggggugaaagaggcagguacauuuagcuucuccugucacaggugaccucacaaaguucggccguggggaugccuccuccccagccccggccacaaccuuggcccaaccccaacagaaccagacgcagacucaccauaccacgcagcagacauuccugaacccggcgcugccuccuggcuacaguuacaccagccugccauacuauacaggggucccgggccuccccagcaccuuccaguaugggccugcuguguucccugugaguaccuggcuuuggucacuccuuguggugaaggauccuagcccuggacacuauccuagcugcuuuuaagggucaaugacuuuaauaauggaugaggaggaacaguuuccaccucuggccuguuuuuggccugaugcaggguggugggggaauggggcuggaauugguggaauuaggauagggauugccuagucuuagaauuugccaaagggagaauaugauaccauacagcuuugcuucacucagauucauucauucccugcugccauugucccuuuuucuuccuccaaacuaccauuucuugacuucauuaguagauucuagaacaguuaguaaggagcuaauuucacuaagcaaacuguagucaacuugcaucaggauagguagccaucugaauggccaguaccuggagcaggacaagugggacagaugguauucugcugccaagucacugcaaaucuggccuuuuugcucuuuagguggcuccuaccucuuccaagcagcauggugugaaugucagugugaaugcaucggccaccccuuuccaacagccgaguggauaugggucucauggauacaacacugguaagcugaccuugucucuggcucgguguuaucugugggguguuauuggauaaauuucagggaggaagacuuggugcuugagaaaaugggauuggugagggugugccgcugccccagguaugauuguuaaugcuuggcugacuuggguaucugugggagcagcaccaacagaggagcuugauacuaggacauguguccacuauuugugacgggaaugcccaagaguauguguugguuuuuagaauauguugguuggccaaaaguguggguggaaguagggcaaggagccccaagauuuugcugaaaugucaguggaggcaaguguuaauaguauguauggcacugauaguacaaaagggggguguauucacugaguagaaggauuaaauggguucauagcuagcagccuacgauagguuuggcuuaaaucacuuuguagcacuacuuuucuuauguguccuuuuuuauucccuagcuagaagaccuaaacuguggagaaaaaggaguaggcgugaccauacuuaauagagugggaauuggacugggagaguugggccuuuagguuccuucauuuguauggcuggucucuuugcaagucuuuuugcauaugugauggcagggagggaauuguaggaauccucuggauggguacuuaccuaaaagauacucagccucucccuugcuuccauaccugacaucugugcucuacuuuuggaggacagggagugagaaggaaucuuugaauaauauaauuguaccuuuucagcgacuuguagaugaauaggggaggaguagguuucucugauugcuuaggguuggggauggggguuguccuucaaagcugucagcucaguuacaguuucauggugauuuggauagagcagcauguguuuuucacccuuaugugggcucugggugggucaguugcccacaguuuucaauaauugggaagagcacagaaggcaguaagggcuaggaacugauagccaaguggagcuuugaacugugcugcaugaguuagagugggucaugaguuaaauuaaacaaauccugagaagccccauugagauuuaauacauagacuccuuguggccaccccugucauugagcaagguucacccuaaaucuugguggggaggauuauaagccuuuugacuuggagugguggccccuuucugaggacauuagguugaagucuuaguuggaccagguucacgaauuuuaagagguaggugauggauaauauaagagaauuggcauaccugauucuagaaaucccaccuucuugccucccuucagaauucagaaacguauuauaucagcccuugagaacccccaguucccaaccccacaaagggcuuuugucauuccauucauuuauuuuuauguauuugauuccuuuuaggaagaaaauauccacccccuuacaagcauuucuggacggcugagagcuaauuuggcccaaggcugggggcuguguuuuguguguguguauaaauuugcacugaagucuuguuucagaaaccagaccacugaggagagccugcugagcugaggccauggccugcguggcuuggggaaaugaguugguggauaccuucugggcuuuugaacuugccccucccccauuucccucucccccaugugucugacccugucuuacccauuucaaguucaagcggugcagcaccuucgaagcaucaaugcacacaccugcuguugcuuuugauuucuggaaggcauguaguuucaacuuguaacaaaaauauuuguagucuucaauaaacugugguauuucuuuagcuaacucuggcguucuuuccgugcaugucuuuguggacacuaggaaccaaugcugugcuguggaugaaggguggaggguggccuuuuuaaucaaaccccagcauagccaaagaacuauuaauuuuucaguauggugguuuuaugaagguggggggaggggaaacagccucaguuucccaccuguugauuaguugguaaaggaaacuauuuguagaaauaccugauucuccaugcuuauguugcuucauuuuuccauuuagaucuuuccuuugccucuuacauaagcagugggggaaaggacaaaaaaguuuggagugucaugucauggugaaaggcaaaagagagaguuuucagagcuguuagagaaguaucuuucaaggcuuaauucccacaucuaucugguuccuaaaggccaaguggcuaagaucugauaaagucauuagugauaagcuaguugaugacucaggcucuguggcgacugugcuauccuggaacauuguucuuagucccuugauggcuuuucagagaucguggauuaccaguuuugcauuuguggguauaagcuaaggaugugcaggagcgguuuggucagauaucuccuugacuauggaaauucuaauucccucccaguccagcuagcauacaacauuagcccuuuguuuauaaaguuaacguggacagugagaucaccacccugggugaauuagaaaccaaaguauucagcuuuccuuguauuuguucccagcccuuuggaguaauuuugcucuguggagugugaccaccuuucccaggggcugccauggugggagagauagauucaugugucucugcccugcugcccacgugauucugguauugucacuguuuggggauaaguaggggguguugauguuggaaggaaagcaagagaacucuguagucugaagaucuuccuaauaacuggugagggguagugaaaucaguacccauuauuuucuaggucucuaauacuguaauugagauuauuauggcuacuacagaguauuaugguuccugcauucucagucccuucaaccucauaucaaagauaaggccucuggacuagaagcuguuuuuagccuaaacucuggaaagaaugagaucagguaggggcacacuggagcugaauuccucccuaccacucggcuugagaauccaguuagucauuucuuccauccaauauaggcagccuagccucacugcagaaggugaccaacuaugcuauuuuuuauuuuuuuauuuuuuuuuugccuuugcaguaaagauaaauucucucuuuugguuugacuuaaaaauguucuacuuauauccuguuuauuccaccuuuacucuccacccuuccacaugaacuuacuagcuuaagccuuuuccauaacugaacuuccuauucuuaaaaguuaugccuguuacucagugauuugccagaugggcaccucggguuugaaaagggaauggaaaaaauaccccauuagcccuuuaagauacuccuguaucguucccuucuuuuacuucagugucuuuagacaguugaugcuucggagaugaggaaguauuuucucuugcuugguuuucuguaguuccguuauuuuuccuaguuaguguuugccccucccaggaacuaucuggacuuaggauguugggaagguuuuccagauuaagauaccacuucaaaagugacuguucaaggugggcuuaacuuuggaaggcugccuuugucugaggcauugggaggauuuagguucuagaguuugaauugugggugaauggaggauuccuuauuugugauuuggccacucuaguacacugcuucuaaaacucuuuuccaucaguguuccugauagcagaggagaaggaaauguguaccucugaugggaaggauccaagggcauagacaggcaaaguuuuucugaagcuuuguuuuauuuuuauaaaaacuaauauaucuuuuuaaaaucaugcuuuauauuccuaguuaaauuacuuacuuuucuucacaucuuuguuucaaaauggaaaguauaaaagauguuagguuauuuauuucauggcuuuuccuaucuucuugacccgaugccuuauaccccaggugauggaauauaguaugaguauuuauuuguuugaggaguacaaauuagaaugacauguuguacuacucugguuucuuuaaaguuguagugguuaguagggaguuuuuuucaacaggaaauaugagaguugggguaugagagcuuuuaucuuacggagaagcugaaguuguauacugaaaaugacgugguuuuuguguuccaccuaggcuauaggagauggccuacuccugucuaccuaucccuccccaccccgcuacacuuaggcuuaaauuguguacauggaaauugaucuugauacuagaccuuuacaucuuaaguuugaagauuuagccuagaugcuccaagacuaaagaagcuggacuaauugagcugaggcucugagaaugagagugcccuuggggauuaaaguggacugcuccucuaguacuuaugcaguggaggcauggauuuugagcccagaaaugucacuucaggaagagagagggccagacugccccagucuccaggaauaaaacugaguggcauuuggguggauugauuugaaauggacauuaaaauuaaaaguuuauuauauuccugcuagacuuuggcacagaaguguuuugaaaacaguguaugcuagugagguuuggucauauccccuugcccaccaaaaaacaacuuaccucacucucucucacguauacucaacacguaccugggaagggccaaagaacccuuagggagcuuuuguuucaugaacucuuaccucucaggacuaacuugaagcuggaaaaccgaccaaaauucccuugcauugguauagcuagaaaggcuacagauaucaccucaucucaggaauaagggccagguagcuagcugagcuaauccuccugucuguuuccuccucccccagguguuucagucaccuccaguaacacgggcgugccagauaucucggguucuguguacuccaaaacccagguaggugccuggcucuggauaaaaguggaaaagagauagacauagaggagguggaguugcaaugguagaaauaacaguggacaagaagaacccuaggagagguggcaggaaacccauccuacuuuuucuaaaugaaaggucuucucuagacuucacuuccucuaagaaguuaaaauuuagcccucugagaaaaaaaacgagaaacguaauaggaagguaaagcguggcaaauuguuuaucgugucauguaauuuacugugcaacucuccuggccccuuuuccuaccuacucccaaccuuuuucauaacuuuucaagagaauaaguaugagagugacaggaaacuaguucauuccauucuuugaguaaaucuauaacagugggagugggaaaggagacgaccuaguaacuaaugaagcauuugagugauccacagguuuguuauguugcuuuuaucccccaucaccauaaauacuuaaaguuugcuauaaagcacugggggucugggggggcacuucaugcacaagaccuucagcacuucaaauaucucaguauguguuuauuucuuuugaaauauccaacgaguuuuuuuuuuuuuuuuuuuuuugagauggagucuugccuugucacccaggcuagagugcaguggugugaucucggcucacugcaaacucugccuccuggguuuaagcgguucuccugccucagccuccugaguagcugggauuacaggugcccaccaccgcgccugcuaauuuuuguauuuuuuaguagagacgggguuucaccaucuuggcuaggcuggucucgaacuccugacaucaugaucugcccaccuuggccucccaaagugcuagauuacaggcgugagccacugcacccagcggaguuacuauuuuuguaaggaauauuggaagggguagggacacuauugguuugccuuuuuuuuuuuuuuuggagacagucucaagaagucacccaggcuggagugcagugguggaaucucagccuucugaguagcuggggcuauagguguacaccaccaggccugccuaauuuuuguauuuuuguuuuuuguuuguuuuguauuuuguauuuuuguuuuuugguagauacaggguuuugccauguugcccaggcucgucucgaacuccugggcucaagcaauccacccgccuuagccucccaaaagugcugggauuacagaugugagccaucaugcccagccuggaguucuaaguucggauuucaugauguucacauaugacauucaguuuuacaaagugcuuccacauuccauccucuuauuuggucuuuuuuuuuuuuuuuuuuuuuuuuuugagacggaguuucauucuuguugcccaggcuggaguguaauggugcgaucugggcucaccauaaccuccgccucucggguucaagcgauucuccugccucagccucccaaguagcugggauuacaggcaugugccaccaugcccggguaauuuuguguuuuuaguagagacgggguuucuucauguuugucaggcuggucucaaacuccugaccucaggugauccgccugcauuggccucccaaaaugcugggauuacaggcaugggccacugcgcccagccuuuuuuuuucuuuuuuuucuugagauggagucucccucugucucccaggcuggagugcaguggcacagucuugacucacugcaaccuccaccucccagguucaagugauucuccugccucagacucccaaguagcuggauuacaggcgcccgccaccaugcccggcuaauuuuuguauuuuuaguagagacgggguuucaccauauuggccagacuggucuuaaacuccugaccuugugugauccacccaucuuggccucccaaagugcugggauuacagaugugagccaccaugcccagccuauuuggucuuuacaacagguuuguagcaucccuguuuuauaucugaggaaacugaggcuaagagauugaguaguaugcccagguucacacaguucuuaaauaagagcagagcugagacugagaccugaauaugugacuucaaguguacugugccuucugugacaccaugcugcuuucugagggucagggagcuugagcucaggaaaaaucccaagacuaguuugcugaucccuuuuacucugucuccuccuggccuccuggauagcaguccuuugagaaacaagguuuucauuccgguacuccugcugcuuccuucaacuugccuucagcccuaggaagugggggccccaucaauccggccacagcugcugccuacccaccugcccccuuuaugcacauucugaccccccaucagcagccgcauucucagauccuucaccaucaccugcagcaggauggccagguaauagcccuuccccuucucuccuuucccuuccucuuccuuccuaucccuuaaaacugccuucccuuuccuuuucuuacccuuccucaccaccaccuucacccaaucccuccccagcgccagucaugggcacacagcacauacagacacaagcgcacauaacacgagcggccggcaaaggaaaucucagagaagggccggguugaaaccuuuuuugcccaauuccuuuggugcccuucuccuccugugccacaguuguccucaucccaucagaccugggucacaccuucccucuuuccucucccagccuucccucuucccugacauuuuagcuuucccuucuaaugguggaguucuauugucaaaguuugucccuuuauuuuccauauauccugguucugccucagcuaccauauuugcagaugauucucuguugccagcgccagcaggaggagcagguaaugaaauugaaugaucauaugcuugaacccacuccuuuucaguccccauuucaccuucacagccucagggaacuugaaaagacugcgcggucacaaaucgggauacacaaacacaaacaccuugcugagcucucuggccuccccuuccucucuccuccuccccuccccaacacccucuuuaucuuuguacccuuccccagcuguggaaaacauucgguuaccagaauggaaaagauucuuggggcagcaucuggagccugaggccucagacugccucucauaccugccugaaaugggcucacagaugugaugugugguagggguggggaucuguggggcgaugcaaguggccucuugagagcuccauuauagguggcuggagcuagaauaagggcuuccuuccucaaagacagcuuuccaaauugaggcauuaauggggaucaauggaaaugaaauugccuugugaucacccaucuccaagagcaggggagagaggggguagugugagaauguagaauugaaaaugaguagaacucacucacuaccuugucucuaaagguaucuugcccucuucaucuuuucccuauuuaaaagucaaaaaugccuuccugcuuguaagaaaggggcuuuagcagcuaugcagaccaaauuuucuaugguucuaauaguagugaggggaaugggagagcaagacaguuugcacaucuccaccugaagauguuacaaauuuguaccacuaacuagacaccuuuuuccuccucaugauccucccauuccccugcagacgggcagcgggcaacguagccagaccagcuccaucccgcagaagccccagaccaacaagucugccuacaacagcuacagcuggggggccaacugaggcccugacccucuucucccggucccaucuucugagagggcuucucagccuggaaacuauggaaacagcaucaaagagaaaggaaugugggggguuuccgcugccccccacccccagcggcccaccccaugccucagcuucaugucugucccauuccuauaccauccccacccuguuguauguauuauaggauuuguauuuucuccuuuuuuuucccccuuccauuccuucuccccucuugcauucaagauuaugaaacuuugcuaugggcccugcacuuccuuugcuuccuccuguucacccuggugguguacggaugaggcggggaggugggacccccaaacauauaucagcccaacagcccuaagucuccuucuuuauuauuaggaaaacaacaacaacaacaaacaaaaaaauggcgucaugaauaugaacagcauugucagaugaauuaguugaagugguuuuuuuuuuguuuuuuuuuuuuuuuuguacuguguccucaaauuuaauggauuaaugugucuuguauauauaaaaagaaaaccucuaccuucagccucugccuauucuugcuccgucuaggacauccucaauuucgucgaugaccagcuuggugaauaaguauuacuguaccaacugggccuccucuagcaggccccugaaggcaguggaauaaaaugaaaucuucgcccuuuaagaacuccugaccuuaaugugguaguaguaucuuguccuugaggggauuuccuuccccucaccccuaagacuuucacaaccuggugacuggaaagaaccaccacaaaucuucauuuccuccagaaacugcuacaucuacagccgauuucaggcaguaaagggagagggauagaggagauuggguggaaaauggagaggaucaagaaggagcugagaccauuucaaagaaaaaaaaugcuuuauagaguuuuaaguaugacuuagauggguccaggcaaauaaacuaaaaagaagugaaggcaacauguaucgucuggcagaacuaaaucuuggaguggggugagggaugaaagacuacauauuggguacaguguacacugcucgggugaugggugcgcuaaagucgcagaaaucacuaaagaacucauccauguaaccaaacaccaccuguaccccaaaaacgaaauaaaaaaacaaaaccuuggggcccauucccccuaggaauggacuacuguaguaguggcuucuuggaugcuucucugugacauagcuauacccaauucuuugaaaaagaaucuagagcaaggucuggcuuggggaugggguacagggagaga

SEQ ID NO: 13697 - RNA, 4468 nt, Homo sapiens
aggggggagcuaugggagggggcgggaauucccgacucuaggccggaagcgcgcggagaccauguagugagacccucgcgaggugagugcgggcugucuggcagcgggguccaugucggcugcccaggccuccccgggcccgggaacaggagucccagcucacgcauucuucaucugcuucccgcgacgcuuggcggccucgcaccccgccuccuggagcccggacuuucaggcaccgcccucagugucgccucaguccgucccgggaccgcagacucuuagggccccucucuuuggccaucugccucuaggucccauccuggggccugaagcgcuuguucucugcgcugggaaaaggggaacgauggagcgauccagcacccaaacuuacccuguccagguggcccacgaagcuacccaagacaucucugcacagcccuagccuuuuuggcuucacccacuccguucgggaguuggggacccggccucuacauuccuuaggggaacuccagcuccagguccuauuuggaggcggcuccuaguuuccuaguuuucugggggcaccaggugaaagggugaugagauauccauacagccuuucucaugccucgguuucccccgugcagucucccugaauaagucacuugggaaagaaagugugagaagagaggaauguuccugguacaggaguagaugagucacccuggguaggggaaggucacaaaguggcuggggccagggagcugcacucugcugaccaagcuuccccauuccuugccccaucuuccuuugcaugauuuuucccaaccacucuggucugucuuccuaggucugagagucacuggagcuaccagaagcaucauggggcccuggggagagccagagcuccugguguggcgccccgaggcgguagcuucagagccuccagugccuguggggcuggaggugaaguugggggcccuggugcugcugcuggugcucacccuccucugcagccuggugcccaucugugugcugcgccggccaggagcuaaccaugaaggcucagguaagccucuccuuuuccccacacugcuaugaaugcuuggcuuagggagggcucuggggcuggcggggagugaccaaaggaggagggaaaggcaaggguagccauuguuuggguugggguggucggcccuggaggggguuuguuugcuuauuccccucugugcuucaccccuacccagcuucccgccagaaagcccugagccuaguaagcuguuucgcggggggcgucuuuuuggccacuugucuccuggaccugcugccugacuaccuggcugccauagaugaggcccuggcagccuugcacgugacggugagcacuggccugggcaugugacuugcgggaggggaaucacacaccucugggaguguugguuuguggagauugauucaugugccacuccaugacuguguggaagacuuuuggcaugugguaugaauugugauuuuugguuauggggcauaauucuuucuauguguucccucccccuuccccauucccugugugaccccuacauucccguugagacaguaagacacuuuuucucaggugugugacuugcucuauggguucucaguucuagcuaccagcaagugcuccaagaaucaucuucacucucucaccacuuuccuaaagggcuggagauagaggucucuguaggccugagaaggauaggaagcgauucccugggucuugguguugcuaaccuuuuuaggcuuuggcccaaggaagugggcugugaggaaugaucaaguccacggcauaggacuugguuuauuauaggaaaaacugaggccguuggauaguggggcaggaaagucauccugggcucuuuccuuuuuuccucuaaaacugaggaaguaacacuggauguaucccuuugugugucugugacugagugaccuguguuuccgugugacugcguauaagccugaauguccugugauauguggcucuauguaugaguauuuggggagaugggcaaugugugaccuuuucauguaugucuacaucagugacucucaacuaggaguguggcuuugccccucaggaaacauuugguaaugucuggggauauuuuuaguugucacaauggggagggggauggagggaacauugugccugcuauuggcaucugguaaguagagaucagaaaugcuguuaaacaaucuacagugcacaagacagcucccaugacaaagaauuaucuggcccaaaauguuuuuguuuguuuguuuuuguuuuguuuuguuuuugagaaagagucuugcucuguugcccaggcuggagugcaguggcacaaucucgacucacugcaaucucuggcuccuggguucaagugauucuccuggcucagacuccugaguagcugggauuacaggcauccaccaccacacccugccaauuuuuguauuuuuaguagagacaggguuucaccauguuggccaggcuggucucaaacuccugaccucaagugaucuucccacuuuggucuuccaaagugcugggauuauaggcaugagccacugccccuggccccaaaauguuaauaguuccaaagcugagaaacuuuggucuacacguaacacugugagugacaccauaaucuguguguacguaucauucugugucaguguuaccaauucacucuaucuuugugugacugagaguagcccugugucugugucagacccuaggucuguguaacugggcuuucaccagauuuugcaucucacucuuccuucccugaacauuuugcugcugcuucugcccacagcuccaguucccacugcaagaguucauccuggccaugggcuucuuccugguccuggugauggagcagaucacacuggcuuacaaggagcagucagggccgucaccucuggaggaaacaagggcucugcugggaacagugaauggugggccgcagcauuggcaugaugggccaggggucccacaggcgaguggagccccagcaacccccucagccuugcgugccuguguacugguguucucccuggcccuccacuccguguucgaggggcuggcgguagggcugcagcgagaccgggcucgggccauggagcugugccuggcuuugcugcuccacaagggcauccuggcugucagccugucccugcggcuguugcagagccaccuuagggcacaggugguggcuggcugugggauccucuucucaugcaugacaccucuaggcaucgggcugggugcagcucuggcagagucggcaggaccucugcaccagcuggcccagucugugcuagagggcauggcagcuggcaccuuucucuauaucaccuuucuggaaauccugccccaggagcuggccaguucugagcaaaggauccucaaggucauucugcuccuagcaggcuuugcccugcucacuggccugcucuucauccaaaucuagggggcuucaagagaggggcaggggagauugaugaucaggugccccuguucucccuucccucccccaguuguggggaauaggaaggaaaggggaagggaaauacugaggaccaaaaaguucucugggagcuaaagauagagccuuuggggcuaucugacuaaugagagggaagugggcagacaagaggcuggccccagucccaaggaacaagagauggucaagucgcuagagacauaucaggggacauuaggauuggggaagacacuugacugcuagaaucagagguuggacacuauacauaaggacaggcucacaugggaggcuggagguggguacccagcugcuguggaacggguauggacaggucauaaaccuagagucaguguccuguugguccuagcccauuucagcacccugccacuuggaguggaccccuccuacucuucuuagcgccuacccucauaccuaucucccuccucccaucuccuaggggacuggcgccaaauggucucucccugccaauuuugguaucuucucuggccucuccaguccugcuuacuccucuauuuuuaaagugccaaacaaauccccuuccucuuucucaaagcacaguaauguggcacugagcccuacccagcaccucagugaagggggccugcuugcucuuuauuuuggucccggauccugggguggggcagaaauauuuucugggcugggguaggaggaagguuguugcagccaucuacugcugcuguacccuaggaauauggggacauggacauggugucccaugcccagaugauaaacacugagcugccaaaacauuuuuuuaaauacacccgaggagcccaagggggaagggcaaugccuacccccagcguuauuuuuggggagggagggcugugcauagggacauauucuuuagaaucuauuuuauuaacugaccuguuuugggaccuguuacccaaauaaaagauguuucuagacau

SEQ ID NO: 13698 - RNA, 4468 nt, Homo sapiens
augucuagaaacaucuuuuauuuggguaacaggucccaaaacaggucaguuaauaaaauagauucuaaagaauaugucccuaugcacagcccucccuccccaaaaauaacgcuggggguaggcauugcccuucccccuugggcuccucggguguauuuaaaaaaauguuuuggcagcucaguguuuaucaucugggcaugggacaccauguccauguccccauauuccuaggguacagcagcaguagauggcugcaacaaccuuccuccuaccccagcccagaaaauauuucugccccaccccaggauccgggaccaaaauaaagagcaagcaggcccccuucacugaggugcuggguagggcucagugccacauuacugugcuuugagaaagaggaaggggauuuguuuggcacuuuaaaaauagaggaguaagcaggacuggagaggccagagaagauaccaaaauuggcagggagagaccauuuggcgccaguccccuaggagaugggaggagggagauagguaugaggguaggcgcuaagaagaguaggagggguccacuccaaguggcagggugcugaaaugggcuaggaccaacaggacacugacucuagguuuaugaccuguccauacccguuccacagcagcuggguacccaccuccagccucccaugugagccuguccuuauguauaguguccaaccucugauucuagcagucaagugucuuccccaauccuaauguccccugauaugucucuagcgacuugaccaucucuuguuccuugggacuggggccagccucuugucugcccacuucccucucauuagucagauagccccaaaggcucuaucuuuagcucccagagaacuuuuugguccucaguauuucccuuccccuuuccuuccuauuccccacaacugggggagggaagggagaacaggggcaccugaucaucaaucuccccugccccucucuugaagcccccuagauuuggaugaagagcaggccagugagcagggcaaagccugcuaggagcagaaugaccuugaggauccuuugcucagaacuggccagcuccuggggcaggauuuccagaaaggugauauagagaaaggugccagcugccaugcccucuagcacagacugggccagcuggugcagagguccugccgacucugccagagcugcacccagcccgaugccuagaggugucaugcaugagaagaggaucccacagccagccaccaccugugcccuaagguggcucugcaacagccgcagggacaggcugacagccaggaugcccuuguggagcagcaaagccaggcacagcuccauggcccgagcccggucucgcugcagcccuaccgccagccccucgaacacggaguggagggccagggagaacaccaguacacaggcacgcaaggcugaggggguugcuggggcuccacucgccugugggaccccuggcccaucaugccaaugcugcggcccaccauucacuguucccagcagagcccuuguuuccuccagaggugacggcccugacugcuccuuguaagccagugugaucugcuccaucaccaggaccaggaagaagcccauggccaggaugaacucuugcagugggaacuggagcugugggcagaagcagcagcaaaauguucagggaaggaagagugagaugcaaaaucuggugaaagcccaguuacacagaccuagggucugacacagacacagggcuacucucagucacacaaagauagagugaauugguaacacugacacagaaugauacguacacacagauuauggugucacucacaguguuacguguagaccaaaguuucucagcuuuggaacuauuaacauuuuggggccaggggcaguggcucaugccuauaaucccagcacuuuggaagaccaaagugggaagaucacuugaggucaggaguuugagaccagccuggccaacauggugaaacccugucucuacuaaaaauacaaaaauuggcaggguguggugguggaugccuguaaucccagcuacucaggagucugagccaggagaaucacuugaacccaggagccagagauugcagugagucgagauugugccacugcacuccagccugggcaacagagcaagacucuuucucaaaaacaaaacaaaacaaaaacaaacaaacaaaaacauuuugggccagauaauucuuugucaugggagcugucuugugcacuguagauuguuuaacagcauuucugaucucuacuuaccagaugccaauagcaggcacaauguucccuccaucccccuccccauugugacaacuaaaaauauccccagacauuaccaaauguuuccugaggggcaaagccacacuccuaguugagagucacugauguagacauacaugaaaaggucacacauugcccaucuccccaaauacucauacauagagccacauaucacaggacauucaggcuuauacgcagucacacggaaacacaggucacucagucacagacacacaaagggauacauccaguguuacuuccucaguuuuagaggaaaaaaggaaagagcccaggaugacuuuccugccccacuauccaacggccucaguuuuuccuauaauaaaccaaguccuaugccguggacuugaucauuccucacagcccacuuccuugggccaaagccuaaaaagguuagcaacaccaagacccagggaaucgcuuccuauccuucucaggccuacagagaccucuaucuccagcccuuuaggaaaguggugagagagugaagaugauucuuggagcacuugcugguagcuagaacugagaacccauagagcaagucacacaccugagaaaaagugucuuacugucucaacgggaauguaggggucacacagggaauggggaagggggagggaacacauagaaagaauuaugccccauaaccaaaaaucacaauucauaccacaugccaaaagucuuccacacagucauggaguggcacaugaaucaaucuccacaaaccaacacucccagaggugugugauuccccucccgcaagucacaugcccaggccagugcucaccgucacgugcaaggcugccagggccucaucuauggcagccagguagucaggcagcagguccaggagacaaguggccaaaaagacgccccccgcgaaacagcuuacuaggcucagggcuuucuggcgggaagcuggguaggggugaagcacagaggggaauaagcaaacaaacccccuccagggccgaccaccccaacccaaacaauggcuacccuugccuuucccuccuccuuuggucacuccccgccagccccagagcccucccuaagccaagcauucauagcaguguggggaaaaggagaggcuuaccugagccuucaugguuagcuccuggccggcgcagcacacagaugggcaccaggcugcagaggagggugagcaccagcagcagcaccagggcccccaacuucaccuccagccccacaggcacuggaggcucugaagcuaccgccucggggcgccacaccaggagcucuggcucuccccagggccccaugaugcuucugguagcuccagugacucucagaccuaggaagacagaccagagugguugggaaaaaucaugcaaaggaagauggggcaaggaauggggaagcuuggucagcagagugcagcucccuggccccagccacuuugugaccuuccccuacccagggugacucaucuacuccuguaccaggaacauuccucucuucucacacuuucuuucccaagugacuuauucagggagacugcacgggggaaaccgaggcaugagaaaggcuguauggauaucucaucacccuuucaccuggugcccccagaaaacuaggaaacuaggagccgccuccaaauaggaccuggagcuggaguuccccuaaggaauguagaggccggguccccaacucccgaacggagugggugaagccaaaaaggcuagggcugugcagagaugucuuggguagcuucgugggccaccuggacaggguaaguuugggugcuggaucgcuccaucguuccccuuuucccagcgcagagaacaagcgcuucaggccccaggaugggaccuagaggcagauggccaaagagaggggcccuaagagucugcggucccgggacggacugaggcgacacugagggcggugccugaaaguccgggcuccaggaggcggggugcgaggccgccaagcgucgcgggaagcagaugaagaaugcgugagcugggacuccuguucccgggcccggggaggccugggcagccgacauggaccccgcugccagacagcccgcacucaccucgcgagggucucacuacauggucuccgcgcgcuuccggccuagagucgggaauucccgcccccucccauagcuccccccu

SEQ ID NO: 13699 - RNA, 11070 nt, Homo sapiens
gggcugcugggaaguggaguccguuuccuccuagugcugcgugacuggggaugugaaggagucucguaaacaaacuacaauucccggcggcccccgcgcgcaacaggucagggcuaggcuggggccggguucgcggugcucgcugaggcggcgguggcuacggcuggaggagccgggccgaggccgcggcggaggccgcggcugguacugggaggguggcagggagggacggggaaggaagauggcgacgucgggggcgaacgggccugguucggccacggccucggcuuccaauccgcgcaaauuuagugagaagauugcgcugcagaagcagcgucaggccgaggagacggcggccuucgaggaggugaugauggacaucggcuccacccgggugaggggccgcgccggggagccggagcagagcugagcaguuacggagcggagaccggagaggcggggcgggggcgggcgccgcagcgaaggaggcggaacagagcaggggacgcgggcgccgccguuugggaggcgcagguugagggccgaggggcaggaagaaggauuuugccgggggagaccgaaacaccggagagguucgggguguagaggcgacugggggccgaguacgugaggugggagugggcggagaggggagaugaaguccggcggagguaggaggugagugguccuugugcaucccugacggaguccccucgaggacgcuacugaagcaugccugguauugggguauggccugggaggagggcugcuugucuguaaccuggcuccucugaguuugugaucuccuccaaacuggucccucugccuucugcgcuuuggugcccccgggaaagggccccuugagugguuugaacgagcggugcuguguauaguggggcaggaaguccccuccugcgucccguccuuuugcuuccuuuuucaaauacuucuugugguuuccugacgugaaugaaggugagguccauugcuugguguuuuguccuggccuccuuggaggagagguaggguuuugaauccgacaacuggguaaccguccgaccauaaguuguguggaacucuaugguuugcugagcuuucuagggaguuggcugcuuuguggguuaguguguagggugccuuggagggucuucuauguguugagaauauucauuccuaggaguucuugaaagaacuuucaggccucugccaggcugccucugaagccccccuggcuugguuucuugcuuuccaaggcuggaggucagagggaccaagggguaggaguccgccuaggugguaugcagucuuaauuuagggacacauucuucuaaaacaacaguagguaaggauauugcaaugauuccucauggcagagagcuagaaggaauuuaaggauugaugguggaacauuacuacaacaucucuagccuuuuucugcuggucugacugugguugcauuuaugacugugacucugguuguauuuuuguguguaucccccuugacucuguuacuuuuuuuuuuuucucguccuuuccccuuugagucucuagggacuaugugcccuaguuugugggagucagaaguuagguggggaggcaaaucugggagggugucugugcacgcaugugcacacuuaaaugcaugugugugcauaacccacuguaaccauugugaggauuauuaucuaacuguagacugcuccccuuuaggagcuuuuucaucauguuggggacagagacaggaagaugggaggcugaucuugauagcgugaggcccugcccucaggacugugauucuagcagaggcauggugggaucuuagggcucguaugugcaaagaaaggcugugcgaaacucaaaagcuggggcuucucuuuacggugccucgaucucuuaaaaggccccuucuacccaccuugcuccuauugguuaauuucucagcuacacagaaaagucuagugggcauacauggccaggggacccaaaagucuagagcuagggacaagagaucugggacucagccuguuaucuggccaggugggagggcucauuugagacagagauggccaugggaggcuauaccacugagauacugggguugccauauaugagaccucaaguggucuucaagugguccagaggucagcacagugcucacuaggcugaccuccuggaacagaaugucaguucugauguuggcuucuguacaagagugugacccuggaagcucuuagaacuugccccuccucagcugcccuccuccccauggccuugcccugggccuguuuauuuggcuggucgcaggggcugagccuuggaaauagaugcucaccucucacagagacaggaugucuguacacaggcuaaacccaugccaggcugucuuacgccuaugccagacauagcuccccaaagugaggaugagaccaggaagauggcccuggcccaugcuggagugggcugcugcucucuguccacccuccuucuccaggcuucccugccaauucaagagccuuaggauucaguggaagaaugucccuugguuuuggugcuguuuuuccagcuaggagagcugcuauuccuuggauguucuaguuugggaggugcaggcuuuguguagccuuccugaggcugggcaaguggcagagcccagaagccugugcucuccagagugggaaggaaagaggcuggcaguaauggcucugugacauccaccuguggccuuccucuuaaucucucaauuaguccuggacgcaucuggaaagaaagcagagguuccuaauaggcacucccccuugugaguagcccgggagcuccuggcagccccucagggacucugcuuagagugaugccaaaugagacaggcccucagcagaguaucugucucugccuggcaggaugaugucaagcaguagugauaucauugaugagggcagucugcagaugggcucugguggguuauuugcaccaaaucucgguggaccuuucaaaccccaacacuggccuuuuuuuucuggcagauaauuucuuuauuuuuuuuuuaacuuuuuuuuuuuuggagacaggaucucagucugucacccaggcggcuagaguggagugacauaaacaugucucacugcagccucuacuuccugggcugaagugauccuuuuuuuuuuuuuuuuuuuuugagacagagucucucucuguugcccaggcugcagugcaguggcacagucucggcuuacugcaaccuccaccucccagguucacgccauucuccugccucagccucccgaguaacugggacuacaggcgcccgccaccacgcccggcuaauuuuuuguauuuuuaguagagacaggguuucacgguguuagccaggauggugucgaucuccugaccuugugauccgccugccucggccucccaaagugcugggauuacaggugugagcuacugugccuggccuagauauuuuaaaagcaguggcggcagcagcauauccuggugacagagauggcaaggauggcugaaggaaauagugcucaggacccuccugacauucccacuuguuccccaugucucaguuacaggcccaaaaacugcgacuggcauacacaaggagcucucauuauggugggucucugcccaauguuaaccagauuggcucuggccuggccgaguuccaggugaguagaccccagccagggaggaguggaguuucuuaggcugcuuccucugcugacuucuguccuuuuuggcagagcccccuccacucaccuuuggauucaucucggagcacucggcaccaugggcugguggaacgggugcagcgagauccucgaagaaugguguccccacuucgccgauacacccgccacauauccuucacaggggacuugggagugucugaaagguagugggaugggguuccucagggacucauaggaagcacuugaaguguugugcgucccuuccuucucuuggagcucuucuuuacccagcuucccugaaaagcgaccauagccccugcgucagcaccugcuccugugacaaggaguuuugcuccugaggcugugcccccugucucuggcuggcucuggcugucuucacaucagcuugcugccagaggcaagccuuccuugucuccugcuaaaggagauugggucucuucucagauuucuaaguuuucagucucagagaccugcauaacugucuccuccaagcccugccugaacauucuccuggauuuuuucagccccuuuagaccugauucccuuuuucucuuccauucuuugauccuauuguugucccuuauagaagaggagaaagguaugaguuucuugaaacaacuuaucugcugccuucauuguucuuuccucauuuggccucucucaucuguccucucuacuuuuuuccuuaacuggugcuguucacauugacagcucucccuauaguccugccuacuuaucuccucccccagagucuagcuggcgaagguaaguguccagggcgggcagaagcuccugccuacucucugacguguuucuggaaggaguugccccuucuggguuggggcugggauuacugggcuaagguuucaacaguaccucuuccuauaacgccagggcugagagagguggagacaguuggaguaggugggucagaguccagccuuggccauguugacacuaguggucaagccucccaguccagccagagcagaaccaaugggaaccauagccaggcugggguguguguguaagggggaggggagaauggcagaggggcaggugaaaauggcaaccuucugucaagggugggugcaagauguaguguucuggcacuuuuagauuucuuaaacucuccccuuguccaucucacuuucaaugcucauacccaggaaugcugcugggcuccaagauucccauucagcugguccuggcagagagaaguuuccagcucucuuagauugacugggggaggggucaaucauaggcaggagaagaaccagaaagaaaaggggaugaucugggugcucagccaucuuuacuuccaccuuagcugccccacauuuuccaaccccuaugcccaccuucuuguccacugccagccuuccuccucaugacuuuguuuuucuaccccaggacgauggccuggggcaauuucccugcagagaaggggcaguuguuucgacuaccaucugcacuuaacaggugauggcuuuugccuucuuuaggccagaucucuuaucuguaguuucuggggcccugcucccucacccccacccuguuccagaccagcuaguguuuucccuugcugggcagggcuuagggaccaggaagacugucacuggugucagcucauuccugcuccccccauaggacaagcucugacucugcccuucauacaagugugaugaaccccaguccccaggauaccuacccaggccccacaccucccagcauccugcccagccgacguggggguaaguggcccugucccaggguugggaguaaccauggagcuauuuauuuauuuauuuauuuauuuauuauuucuuucuuuuuugagacggagucucacucugucgccuaggcuggagugcaguggcgugaucucggcucacugcaaccuccgcccuccgaguucaagcgauucuccugccucagccuccugaguagcugggauuacaggcaucugccacugugccuggcuaauuuuuuguguuuuuaguagagaugggguuucaccaucuuggccaggcuggucuugaacuccugaccucgugauccaccugccucggccucccaaagugcugggauuacaggcaugagccaccauacccggccuccauggagcuauuuaaagcagguaggcaagugagcacugcagccaaugccacuguaucccuugcagguauucuggauggugaaauggaccccaaagguauguguuccucacugcuguggguacugaaugccaaagaauuucugggcugguguugggauugugugcagguucagggagcaggacuccuucccaccugcuucugcuuccuguccugccuuacuggcucuuucuccaacucucccaucaccagucuuucucuuucaaguaccugcuauugaggagaacuugcuagaugacaagcauuugcugaagccaugggaugcuaagaagguaggaggaggccaccgggugucacccacuagucucucugcuauccccuugccauggggcaggccuuccaggguucucugcugagcacuguccucauuuuccauauucucccuucucuccucagcuauccucauccucuucccgaccucgguccugugaagucccuggaauuaaguaaguacucccugagguuggcugagaggugggggaaggaaguacagggagauguaggagacugaucucugcucuucccugaccacugcacccacccuccuauuuacaucuuucuuuuucucuccuuccccuagcaucuuuccaucuccugaccagccugccaaugugccuguccucccaccugccaugaacacggggggcucccuaccugaccucaccaaccugcacuuucccccaccacugcccaccccccuggacccugaagagacagccuacccuagccugagugggggcaacaguaccuccaauuugacccacaccaugacucaccugggcaucagcaggggcaugggccugggcccaggcuaugaugcaccaggugagugacuguccuggccaugugcccacugggugcugccugacuggagggaugaaggggagguagguuugagcaccugagauccugcugugaucacccacaccgccugucaccucugcaccccaggauucccucacggcaguucucagccagugauaacugguaggugugguguuuccuagaaagaagaggaagggcaguccccagaugggcagugcugucagggauagaguagggaggacguuguguugccgcuuucauagucuggucacugccacccauucuggguggaaaggggcucaguucccaucaguaauguuggcaucucugguuuuuugucugugccugcaggacuucauucaccucucagccacccaucccugcaguccucccuaagcaaucccaaccuccaggcuucccugagcaguccucagccccagcuucagggcucccacagccaccccucucugccugccuccuccuuggcccgccauguacugcccaccaccucccugggccaccccucacucagugcuccggcucucuccuccuccucuuccuccuccuccacuucaucuccuguuuugggcgcccccucuuacccugcuucuaccccuggggccuccccccaccaccgccgugugccccucagcccccugaguuugcucgcgggcccagccgacgccagaaggucccaacagcagcugcccaaacaguuuucgccaacaaugucacccaccuugucuuccaucacucagguaugcguggcugccuucccugcaugucugucucccuucccuuuucuccugccauguuguuucccucccacccuccuuuccugaaauaccuacucuauacucauccccuuccauuccucuguccuccgccugccccaucuuuuauccaucuugucuccucuugcuucacagugcaaacccaaacgcugugguuaagcuuuuuuagcuucaaacccuggcuccaccucuuacuagcagucaccuuggacaaguuauuuaauuucuauaagccucaguauuuucauuucuaaaacaaggaugguucauaaggaucaaaugaaguaacauacauaaaauacuuagcaccacacauagcccagguaugcuugacaaauaguagcuuacccuuuccuuuuauuugccuccucuguuccugucuguuuuauaucugucuuuuaucucaugccucuaucuugucccgucuccuccccuguauccccuccuaauuucauagaauucguagaaucagucaauuuccuacuguggagcccaauuccuucacuuaauagaugaggaaagugggaccuagagggaaagugacuuuuccaaguuuacccagcaaguuaggaagaguugagacuagaacucgaagcucuuaguuuagggcuuuuuccacagagaugaaauucuuagcccuugucucccuuccuguccuuuucuucuuguucucuaucucuacuccucuuuucuuucauccaaaugcucuuuucccucuccucugcccaacuuuuccuccuccauugcuaucccuggaauguguguucuguguuccaucuuuacucagguccccucuuuuguaggaaagacugaggccagauuagcaagggcucuguucccagaguguggagugagcuugacuucccuuccuuucuuucuccuuuucuuucuuucuuuucccacccccucuggccucuucaaggcuguagaacagcaguucucaaccuuaguuccuuauuuacuaacaauaaauaguucaaguaucaagauuuaagaaugguuuacuucuaaggcuaggcacaguggcuuaugccuguaaucccagcacuuugggaggccaaggcgggaguucaaaacuagccuggucaauauggugagacccagucucuacaacaaauaaaaaauuacccaggugcagucgcgcacgcuuguaguccuggcuacuggggaggcugagaugggaggaucacuugaaccaggaagguugaugcuacaguuccaacuaugauugcaccacuguacuccagccugggcaacagagugaggcccugucucaaaaaaagagaauaguuuacuucuggaguagauuuaaaauuaccccuguguuagccucacuauaucacuuucauucugauaggcacuuuuuuuuuuuuggagacggagucucgcucuguugcccaggcugaagugcaguggugugaucuuggcucacugcaaccucccacuuccuggguucaagcaauucuccugucucagccacccgaauagcugggacuacagacgccugcuaccaugcccagcuaauuuuuauauuuuuaguagagacgggguuucaccauguuggccaggcuggucucgaacuccugaccucaggugauccaccugccuugggccucccaaagugcugggauuacaggcaugagccaccacacccugccaacuaauacacaucccugggguugaguaacugcacucaaccccagggaugcccgugagaauguggaauguugucauguuuguuuugggaaugguuguagcuaaagaaggugggaagcucugacugagaguucuugggguauacacugagcaguaagcuucccucuuuuuacuucuuuucagggcgucccccuggauaccaguaaacuguccacugaccagcgguuacccccauacccauacagcuccccaagucugguucugccuacccagccccacaccccaaagucucuacagcagccagggcugcccucucagucuuguucagugcaguccucaggugggcagcccccaggcaggcagucucauuaugggacaccguacccaccugggcccagugggcaugggcaacagucuuaccaccggccaaugagugacuucaaccuggggaaugugaguacucaggcuccuugcucaaaagcaggggagugggugagggugggucaauggggccugaauggcauggcuggugcacugugaauggggagaucuagguggggugggugguggggagaucuccucuccccggagguaacauagcacugccagcuuggggcuccucucuuccugcguuugacccuacuccugccccucuauuucugcucagcuugcucuuugaugacuucugccuugacccguucucuuccuggcaugcacaugcucuggcccagcagguacggugcccauacuuacuucgggccccgugcucgcuucugucgcucugcuugcugccaccucccucugucauugccucuguuccugggguggaugaagguugcugggcaaaggggauauguuagcagggcuaggcaggacaccaguucuaaauccuacuuccuaaagauuugucuguaugucuauagcuggagcaguucagcauggagagcccaucagccagccuggugcuggaucccccuggcuuuucugaagggccuggauuuuuagggggugaggggccaauggguggcccccaggauccccacaccuucaaccaccagaacuugacccacuguucccgccauggcucagggccuaacaucauccucacaggugaauggggguggguggugaugggaaauggaaggaggaagugacacauucacuaaugaguaggagauugaggggucuuggaaaaguuuacaggacaugggguccucaccugucucuucuacccacaggggacuccucuccagguuucucuaaggagauugcagcagcccuggccggagugccuggcuuugaggugucagcagcuggauuggagcuagggcuugggcuagaagaugagcugcgcauggagccacugggccuggaagggcuaaacaugcugagugaccccugugcccugcugccugauccugcuguggaggagucauuccgcagugaccggcuccaaugagggcaccucaucaccaucccucuucuuggccccaucccccaccaccauuccuuuccucccuucccccuggcagguagagacucuacucucuguccccagauccucuuucuagcaugaaugaaggaugccaagaaugagaaaaagcaagggguuuguccagguggccccugaauucugcgcaagggaugggccugggggaacucaagggagggccuaaagcacuuguaacuuugaaccgucugucuggaggucagagccuguuggaaagcagggguagaggggagcccuggaagcagggcuuuuccggaugccuaggggugggcagugccagccccuccucaccacucuuccccuugcaguggaggagagagccagaguggauacuauuuuuuauuaaauauauuauuauauguuaauaaaaaaaucauaucaaacccuug

SEQ ID NO: 13700 - RNA, 1711 nt, Homo sapiens
uaauuaucuggugcuuccuuuacccuuagauuccccauucgucccauccgcccgcaaacacaagacugagcagggagcggcccccgcacccugagggcaccacuggggguggagagaguuaaaaaaaaaaaggggggggcgcgcuagagaggaaaggaggggagcauggcgggcaugaggcagggagugaaagcggggauggcgggggaaacggggcgugagggaggggagaaagaguacaaggagacgaaaugaagggacacgagcugggggcgcgcgaggccgaagugaaagaccgggucgcgcgcgccaaggggggagaggaugaggugaagaaggagcgcgaggcgggggcgcgccgugccgggguggggggagggggacgcaaggcgggggcgcgcgggcgggcgucggcucgcgggcgcuuccccuccccccgccccuccaccuuucccuucccccaccuccgccaccacugccuccucccagccuccuucccuuccucgcuccucaccgcccccgggcgggcgggcggccaggcuggccuaggccaaagcuccucaccuggcgguggcgguguaacucccggcuagcucgccuccucaggcggcggcggaggcgucgaaaaaggaagaggcgacggcacaggggauccagacccugcugacgggacuagggacggggguaggggaggggggcgggccggaccggggcgggcgggcggagcagacacugcgguacagacgggggcagcggcggcggcgacggcugcaccggcggcggcggcaccacacaaacaaggacgcugauugggcagcugccaagcgccucggcuccgccuuacccacacgccacgacgcccauugggcgaccuaagccggccaccccgcccucaucuucucggccaugccaguagaagacuagaugccgggacuucaccccacccuugaagaaugaguggccggagaagugaugauuggcgugcuuaaaacccaaucauaaacggaggaggggggauggucuagcgggggcgcguuaauggguaccucugccagucccagacacauccgggucuucgacagcccauuaagugucgggggucaaaaaaucgcuucaggcugcaacuuuaccuuagagacguuuugguccccaggcagccgccguaccccagucucuccaaaccgggauuccccuuuggccaucucucauucuuucaauucuaaagauggagacuggcgaacggcgauggggucugcggugggcgguguuucgucgcgacagacucuaggaaauuucacgauagaacuagcuuuaggcgcuugagccuugccgucuuuuugggguguggccugucuccgucugccaaaggcuuugagcuuccugguguucaucguaccuccgcuugguccugucgugacuaaaccacgacagcaggaaaaaaaaaaaagcagcuagccaaguugcugaggaauuacggugugcagagcccucgcagcuccuucucuugggaacuccuggucugguuagguucucagcgaggaaacagccucccaccccgcccgauuccaccuaauuaacucaagggccagcuccuuuugcuggccucccugcuuccacggagcaguuaggcccgccuaaacucagcgagcguuucuggagcaccuugaggauagggaccaaguaacagaguccggguguuaagguuaugaua

SEQ ID NO: 13701 - RNA, 4818 nt, Homo sapiens
agauacuguaggucagagacagcuggaucagcuccagccacauuuauuacaaaauagugaccgcaguucugguauagaaaagaucccugacagcccaguacaccugcaacggcccccaccccacagaguuccucucucaggugccucagguguggaaguucucagauucgaagguuuccugccaggagggcgcuguaccgggcaguugugaggggcagguaggcaccuacagccugguccagaacguacagugggucagacagggugcuggggucgaagcccucauuugccauccgaacuuucugcuguuugaaggucucugugguggccaaagacuccuggggacaggagggucagggauuuggagggaaggggacucugcccacgugguucaggggaguugccugaauuuuguuaaggagcaagucuugggaaagggagugugaggucaagguuuaggggaggaggugacagggaggagaaagagccaggccagaagaaggcagggauaaggaaagaaguggggugaagagcuugugucuccguguuuuuucucuucacggaguguauuacguugggggucccuuuguggaguuugggagccaucaaacuccuaaguugauacacgggguggauauguggggugaggauauauggggugaggggccggcgggggaaguggccgguuaccuggagccugaggaaucggggccgggcauaagguggcaaguucucagacacguggguguagagcugcauaagguccaaagcgugggggggacgcagaacuagggcugccauuccagcccugccuucaugcccuggugggugugggagacagaguaagccccuccauggcugaccaccacgaaggccucgugcucccugcgcccaaguacuaccaauucggggugguggcugggugccucccccaccuuccaugccuaggcaccuggcacagugacuccauagacguucaccuccugaagaaaaucuagggccucgaagaccucugccaccucgguuguggccacauucucccccuuccaccugucagagagcagagaucugaaacugggagucaggggucagggccuuaugggcuugguggggagaugaggucagaggucagugucacagggaugaaauggugagaucugagaaugagagauuagcuuaggacccagguugagguggcagauuagagaguugagguucagaagcuuuggaucacagagaucagauguccaggaugaaaaaccaguuauggacagauaccugaaggugucuccaguacgaucauggaagcggagaaaaccuuggucaucgcagaccagcagguccccaguguugaagaaaacauccccaggccggaagacauccuuuagcaacuuccccugggccagcucuggcccgccagcauagcccaggaauggggacugcuggcuuaccggggccaccagcagcccuggcucaccuggcagagucaccagggucaggaguggugucaccuuucccagagccuucugcccccauccaccccagucuccaauuccaguccuccugugccagcuucagcaccccgcccaccccaccagaacaccaccaaccuggagauguggccauacagugccccugggggucccgaauuggcucuccuguggugacaucauagcgaaucaaggagaaggggaagauaugcuggggaaagggagaccuggguacuggaucauugcagucacaugagcccccucuccugccagcccucugcuguuccacggguuuucaguuuccucucugccccucaccuuguaaagccaggaagcacgccccacagcgccccgcuguccuguguaguugaugguggccacguugcccucugucaguccauaugucuccagcaccugcaggggcccgaagcgccgcacaaaacgcucccagguaucugggcgcagcccgcugcccacugccagccggaccuuauggccacguucugccuugcucugagaugagugggagaggggccggagcuucagcaucaagaugcccgcucccggaagugaauuccuguuccccauuccccagaacccccuccuacugugaccuccuucagaggccguaagcaucagauggccuaggccaucucuggcuccuuaucuuacacugccauuuucuucuugcugcuucucccuccaacucccugucuccugucaacuguccugcuccccgugagcuagcccugugucagcagcucugcccaggaucugugcccacgcaccgggggcugguugacaagguaucggcacagcuccccaauguacuggaacaccgucacccugugcugcuggcaaucuucccagaacugaccagccgagaacuuggauuucagcaccacuguggccccugccagaagugggcaggggggaagaagggagguaagauuaggagcagaguggggagcccaagccccucuuuccagaccccagccaucacuguagucuuucccugggaagggcccacugugggagucacaccgucaggaagccgugcuggcccucuuuccccucccccggccccuguccccagccuuagaagaggugaaugcccuuucccuacuucccagccccaaagaucucauccuccacacucucacuuccuugucucucucucccucuucucuuacuugccuguuccuggacugacacaguccuucccugccuuugacccugcagccuggaguuauguggcuguauggccccccucaccguuccucagucuguaggucuaggcaggugacauugcccuauuguacagagcuccuggugaguagggcucugccccauccguccucuagauuaucuacccuggaggacucacaccauaguacgugcuuaauaaaugucuacuggaugaauuaaugaaggugggguuggggagacugaccaaugcccaugcagcccacgaugcccagcagggaaccggacaugugguagagugggagggcgagguagaucacaucuuccugguggacaccacacagcugauagaagcccuggcauugcaggaucuucagaugacugauccgagcagccuuggggaggccugugggguggcaguuaugggacgaucaggggaagggcaaacuccaagcucuaccuaucuguuugcacccccgcuggguuucccacagaaagaggcggaggcaggacagaagcugaggaccgagaccaggcuguccuggaaauauggguggucugggggagguggagaaaugaguaggaggugaggagacuggggagugaaaugauggggagaaaaaggaugugccaaugaaaucagcauccucucugggggcuuugaaggaguggucugggagcagaccccugccuuccucugccuugguuucggggagcuaaguauggugcccggcccucacccguggugccagaggugaagauguacaggcacgugucuguuaugcucuggggggaagagagguauccuggcacuggcccauccacuucagcggacacuucagccagcaaaucgcuaauuccagcaggguggguuccugggccugcagcccacagguggagccccauggcucucagggcgggcagguccggcuccagggacuccagaaacucuagaagggugggaaagcacaacgccggggcccuggcucuaccuagaagagccuaugacccauguccccucccuaucccagcccacacugcucuuggaugagggugaaggguauggacauuccaucuugggucugaggccuggaacucgacuccuuggggauccuuggggcaccaaagauucagccucaucccuucucaaacccggagacuccuaucuccacccacuuucgaaccccaagggauagucggcuucuucccaggcccagggaugagaccaagccuuucuguggucuccgacacgcccccuucuguggcuggccccgccuuagucaguucggagcuccagccuuaccuggcgccagcaccagcgcgcgcgcgccgcagcugcggaggcagugcagcagggggccccggcgcagggcggugggcacaaaggcagugcgcaggccggccuuggccagcccgaaccagagccacagaaacucugggccagcggggaggagcagcgccacaguugcuccaggugacagaggggcggcggcuccuccaccucuggcggcaccguccccuccggcaaacuccgcgccgcuuccggccgcugcaucuccggcucccggcgcugcccgcucgccuucuccagcgcuccccucgccgcugucgccgccgucggguccccagucccagccuagcgcacguaggaaggcgcgugcagcccuguuacucucgcgcuccgccucugaguagcuaaagcgccgcgagccgugaaugagaaaggugugcgcggcgcgcugcugggccaguuccgcgaggcgccaggccaggcugcagccccccucgggaccuuccgggucggcggcagccgcggccagggcgcgagcucgaagagcccuuuugcagcacagagcucgcaccgcaaaggccaaguccgccggaagccagcgcaacugcggccagagguguagcuucagcagcagcagcgguagcaacagcagcaggggcagcagcaggagggcagccauggagcccgcuuccucuaucggcaccgucugguuccagccgcucgcaaacaucccugauccucccuuccgaaaaccuagggccgcucguucuagcugagacuucuccuuccagggagcgcgcgugcgcuggcacacgcccauucccacccagg

SEQ ID NO: 13702 - RNA, 4818 nt, Homo sapiens
ccugggugggaaugggcgugugccagcgcacgcgcgcucccuggaaggagaagucucagcuagaacgagcggcccuagguuuucggaagggaggaucagggauguuugcgagcggcuggaaccagacggugccgauagaggaagcgggcuccauggcugcccuccugcugcugccccugcugcuguugcuaccgcugcugcugcugaagcuacaccucuggccgcaguugcgcuggcuuccggcggacuuggccuuugcggugcgagcucugugcugcaaaagggcucuucgagcucgcgcccuggccgcggcugccgccgacccggaaggucccgaggggggcugcagccuggccuggcgccucgcggaacuggcccagcagcgcgccgcgcacaccuuucucauucacggcucgcggcgcuuuagcuacucagaggcggagcgcgagaguaacagggcugcacgcgccuuccuacgugcgcuaggcugggacuggggacccgacggcggcgacagcggcgaggggagcgcuggagaaggcgagcgggcagcgccgggagccggagaugcagcggccggaagcggcgcggaguuugccggaggggacggugccgccagagguggaggagccgccgccccucugucaccuggagcaacuguggcgcugcuccuccccgcuggcccagaguuucuguggcucugguucgggcuggccaaggccggccugcgcacugccuuugugcccaccgcccugcgccggggcccccugcugcacugccuccgcagcugcggcgcgcgcgcgcuggugcuggcgccagguaaggcuggagcuccgaacugacuaaggcggggccagccacagaagggggcgugucggagaccacagaaaggcuuggucucaucccugggccugggaagaagccgacuaucccuugggguucgaaaguggguggagauaggagucuccggguuugagaagggaugaggcugaaucuuuggugccccaaggauccccaaggagucgaguuccaggccucagacccaagauggaauguccauacccuucacccucauccaagagcagugugggcugggauagggaggggacaugggucauaggcucuucuagguagagccagggccccggcguugugcuuucccacccuucuagaguuucuggagucccuggagccggaccugcccgcccugagagccauggggcuccaccugugggcugcaggcccaggaacccacccugcuggaauuagcgauuugcuggcugaaguguccgcugaaguggaugggccagugccaggauaccucucuuccccccagagcauaacagacacgugccuguacaucuucaccucuggcaccacgggugagggccgggcaccauacuuagcuccccgaaaccaaggcagaggaaggcaggggucugcucccagaccacuccuucaaagcccccagagaggaugcugauuucauuggcacauccuuuuucuccccaucauuucacuccccagucuccucaccuccuacucauuucuccaccucccccagaccacccauauuuccaggacagccuggucucgguccucagcuucuguccugccuccgccucuuucugugggaaacccagcgggggugcaaacagauagguagagcuuggaguuugcccuuccccugaucgucccauaacugccaccccacaggccuccccaaggcugcucggaucagucaucugaagauccugcaaugccagggcuucuaucagcugugugguguccaccaggaagaugugaucuaccucgcccucccacucuaccacauguccgguucccugcugggcaucgugggcugcaugggcauuggucagucuccccaaccccaccuucauuaauucauccaguagacauuuauuaagcacguacuauggugugaguccuccaggguagauaaucuagaggacggauggggcagagcccuacucaccaggagcucuguacaauagggcaaugucaccugccuagaccuacagacugaggaacggugaggggggccauacagccacauaacuccaggcugcagggucaaaggcagggaaggacugugucaguccaggaacaggcaaguaagagaagagggagagagagacaaggaagugagaguguggaggaugagaucuuuggggcugggaaguagggaaagggcauucaccucuucuaaggcuggggacaggggccgggggaggggaaagagggccagcacggcuuccugacggugugacucccacagugggcccuucccagggaaagacuacagugauggcuggggucuggaaagaggggcuugggcuccccacucugcuccuaaucuuaccucccuucuuccccccugcccacuucuggcaggggccacaguggugcugaaauccaaguucucggcuggucaguucugggaagauugccagcagcacagggugacgguguuccaguacauuggggagcugugccgauaccuugucaaccagcccccggugcgugggcacagauccugggcagagcugcugacacagggcuagcucacggggagcaggacaguugacaggagacagggaguuggagggagaagcagcaagaagaaaauggcaguguaagauaaggagccagagauggccuaggccaucugaugcuuacggccucugaaggaggucacaguaggaggggguucuggggaauggggaacaggaauucacuuccgggagcgggcaucuugaugcugaagcuccggccccucucccacucaucucagagcaaggcagaacguggccauaagguccggcuggcagugggcagcgggcugcgcccagauaccugggagcguuuugugcggcgcuucgggccccugcaggugcuggagacauauggacugacagagggcaacguggccaccaucaacuacacaggacagcggggcgcuguggggcgugcuuccuggcuuuacaaggugaggggcagagaggaaacugaaaacccguggaacagcagagggcuggcaggagagggggcucaugugacugcaaugauccaguacccaggucucccuuuccccagcauaucuuccccuucuccuugauucgcuaugaugucaccacaggagagccaauucgggacccccaggggcacuguauggccacaucuccagguuggugguguucugguggggugggcggggugcugaagcuggcacaggaggacuggaauuggagacugggguggaugggggcagaaggcucugggaaaggugacaccacuccugacccuggugacucugccaggugagccagggcugcugguggccccgguaagccagcaguccccauuccugggcuaugcuggcgggccagagcuggcccaggggaaguugcuaaaggaugucuuccggccuggggauguuuucuucaacacuggggaccugcuggucugcgaugaccaagguuuucuccgcuuccaugaucguacuggagacaccuucagguaucuguccauaacugguuuuucauccuggacaucugaucucugugauccaaagcuucugaaccucaacucucuaaucugccaccucaaccuggguccuaagcuaaucucucauucucagaucucaccauuucaucccugugacacugaccucugaccucaucuccccaccaagcccauaaggcccugaccccugacucccaguuucagaucucugcucucugacagguggaagggggagaauguggccacaaccgagguggcagaggucuucgaggcccuagauuuucuucaggaggugaacgucuauggagucacugugccaggugccuaggcauggaaggugggggaggcacccagccaccaccccgaauugguaguacuugggcgcagggagcacgaggccuucgugguggucagccauggaggggcuuacucugucucccacacccaccagggcaugaaggcagggcuggaauggcagcccuaguucugcgucccccccacgcuuuggaccuuaugcagcucuacacccacgugucugagaacuugccaccuuaugcccggccccgauuccucaggcuccagguaaccggccacuucccccgccggccccucaccccauauauccucaccccacauauccaccccguguaucaacuuaggaguuugauggcucccaaacuccacaaagggacccccaacguaauacacuccgugaagagaaaaaacacggagacacaagcucuucaccccacuucuuuccuuaucccugccuucuucuggccuggcucuuucuccucccugucaccuccuccccuaaaccuugaccucacacucccuuucccaagacuugcuccuuaacaaaauucaggcaacuccccugaaccacgugggcagaguccccuucccuccaaaucccugacccuccuguccccaggagucuuuggccaccacagagaccuucaaacagcagaaaguucggauggcaaaugagggcuucgaccccagcacccugucugacccacuguacguucuggaccaggcuguaggugccuaccugccccucacaacugcccgguacagcgcccuccuggcaggaaaccuucgaaucugagaacuuccacaccugaggcaccugagagaggaacucuguggggugggggccguugcagguguacugggcugucagggaucuuuucuauaccagaacugcggucacuauuuuguaauaaauguggcuggagcugauccagcugucucugaccuacaguaucu

SEQ ID NO: 13703 - RNA, 3268 nt, Homo sapiens
uuuguugaaaaugauaauugagucauuuaauuauaaauacucagaucacaauuugaagcugucuuugaauuaaaggacaaacuccuggaaccuuuccauauaccagaguaaacuagaauaucauuuuaaguauuuauugaauaaaaugauucuaucaacacugcuacuguauucaagccagugcaauaaaaaaguggguggacagaggucauucacuuugacuuugccugcccccuccaaauccccaguguaaacaggaaaaugagaagucacagguagaggacaugcuguccaggcccauguaaccaggcauguaacauacaaaggaagccccucugguuaacuaguccugaagaagguaagccucacguaugcagcuuaaaaaaaaaaguagaggccucagcucauuugugaaaggaagcaagagccauaauuaauguaaguccuuugggaaccucauucuggcuguguguagguuuccuggggccccuacauaaauggguaagacgaagugcuucaaacaaacuguacggcucccuuuuuaaugucugaaggucuauggggacugucuccuaggaucuuugcaugucuguugaaacaaggcagcuggggaacaguacuugugcuacugaguccauaggcucaucuguuauuugccuggggagccagggggguaaauucccgaauccagcauugcucuccugcgggcuguuuccuuggcaacacugugguuuagccgucucagucguuccuacaagacaaggaagguuuggaaucuuaaccacugugaaaggcuugagaguguaagugaacuaggugcugaaaaauaccgggcgugaucuaccucaaagucagucuucaaaaguauauauaagaauguaggccgggcaugguggcucacacuuguaaucccagcacuuugggaggcugaggcggguggauuaccugaggucaggaguucaagaccagccugaccaacaugguaaaacccgucucuacuaaaaaauacaaaaaaauuagcugggcaugguggcgggugcuuguaaucugaggcaggagaaucgcuugaaaccgggagguggagguugcaaugaaaugagaucgugccacugcacucuagccugggugacagagggagaacuccaucucaaaaaaaaaaaaaaauguaggccaggcauggugcucaugccuaucccagcaccauuuaggaggaaguggcaggaagaucacuugagcccaguuugagaacagccugggcaccauagugauagccugucuuuuuuuuuuuuuuuuuuuuuucccgagacggaguuucgcucuuguugcccaggcugaagugcaauggugcgaucucagcucaccgcaaccuccgucccccgggcucaagugauucuucugucucagccucccaaguagcugggauuacaggcaugcgcuaccacgcccagcuaauuuuguauuuuuaguagagacgggguuucucuauguuggucaggcuggucuccaacucccaaccucaggugaccuguccaccucggccucccaaacugcugggauuacaggcaagagccaccgcgcccagccgauccugucuuuuuauuuaaaaaaaaaaaaaaaaaggccaggcaggccgggugcaguggcucacgccuguaaucccagcguuuugggaggcccaggcagguggaucacucgcaugcaggaguuugggaccagccuggguaacauggugaaacccugucucuagaaaaaauacaaaaauuagcuggacaugguggugcaugccuguagucccagcuacuugggaggcugagguggauggaucgcuugagccugggagguagaggcugcagugagccuuuaucaugccacugcacuccauccugggugauagaccuuguaucauaaaaauaaauagccagguguggugguucacuccuguagucucagcacuucggguggccaaggugggaagcucacuugagcccaggaguuccagaccagccugggcaacauggagaaacccuacuucuacaaaaaaauacaaaaauuagcugggcguugugcacgcuuguaguccuaguuacucgggaggcggaggcagaauugcuugagcccagggggcggagguugcagcgagcugagauugagccaccgcacuccagccugggugacagagggagacugucacacacacacacacaagaauguaaauggcagcaacugaauagugagaaugagacgaauuuuccuagguauuuuucaaguacugggagaagugaauuucccuuuccccaaagaauuuuaaaauuacaguggcuuucacuguguugaggacuuacaaaaaagggcaaagaaucacuguugguaagauauucuuuuaccugagcauucuguagaauguuguuaaccaagacaacgcgucgccgggcauuaaguagcuucuuaacauaggggucaagauccagggccaccuucugauccucauuuaugcggcacaguucuggggauggaaguaaggugcagcuaagaucuaacggcuuaucucuuguucugagggaaagcaggcugguaaugggauggaaaacacuugcacccaaacgggccacagccauuagagauuuaagacaucccugaaaggaggaguccuuuggcagcccugaugcccuggaagcaagugacagaaacucagcccagggguuggcaaaaaccuaagguccugaaagugggcugaagaauuccggguacacagggaugcucacucaccuguggcuagguugucaauuuguucccggagcucuaccuggcucucucugcaaagagguacaaggccuacaaggucaggcaguuaccggagcucaggaaacgaacuccccuacguauuuaccaaguacugagagaagccggccuccgcugaacccuccaccugcggccuucccgccuguccuccccgccucgaaucaguuuccuaaauuuaugcccacucccagccagaacacuuucuuggccccgccccuacaaagccagagagacaggccccgcccccaacuucccucccgggcaccugacggcguguacgugagagucgagcugcugcacagcgggucgcaggaacuccagcagcccuucggcgaaaaggucgcggccugugggccccgccaccggggucccugcccccgauacagcggcggaaccagcccccgccaucacgaauuguccugaagcccgaaaccugccgcgagggccgccgggaaccggagccgcgccg

SEQ ID NO: 13704 - RNA, 3268 nt, Homo sapiens
cggcgcggcuccgguucccggcggcccucgcggcagguuucgggcuucaggacaauucgugauggcgggggcugguuccgccgcuguaucgggggcagggaccccgguggcggggcccacaggccgcgaccuuuucgccgaagggcugcuggaguuccugcgacccgcugugcagcagcucgacucucacguacacgccgucaggugcccgggagggaaguugggggcggggccugucucucuggcuuuguaggggcggggccaagaaaguguucuggcugggagugggcauaaauuuaggaaacugauucgaggcggggaggacaggcgggaaggccgcagguggaggguucagcggaggccggcuucucucaguacuugguaaauacguaggggaguucguuuccugagcuccgguaacugccugaccuuguaggccuuguaccucuuugcagagagagccagguagagcuccgggaacaaauugacaaccuagccacaggugagugagcaucccuguguacccggaauucuucagcccacuuucaggaccuuagguuuuugccaaccccugggcugaguuucugucacuugcuuccagggcaucagggcugccaaaggacuccuccuuucagggaugucuuaaaucucuaauggcuguggcccguuugggugcaaguguuuuccaucccauuaccagccugcuuucccucagaacaagagauaagccguuagaucuuagcugcaccuuacuuccauccccagaacugugccgcauaaaugaggaucagaagguggcccuggaucuugaccccuauguuaagaagcuacuuaaugcccggcgacgcguugucuugguuaacaacauucuacagaaugcucagguaaaagaauaucuuaccaacagugauucuuugcccuuuuuuguaaguccucaacacagugaaagccacuguaauuuuaaaauucuuuggggaaagggaaauucacuucucccaguacuugaaaaauaccuaggaaaauucgucucauucucacuauucaguugcugccauuuacauucuugugugugugugugugacagucucccucugucacccaggcuggagugcgguggcucaaucucagcucgcugcaaccuccgcccccugggcucaagcaauucugccuccgccucccgaguaacuaggacuacaagcgugcacaacgcccagcuaauuuuuguauuuuuuuguagaaguaggguuucuccauguugcccaggcuggucuggaacuccugggcucaagugagcuucccaccuuggccacccgaagugcugagacuacaggagugaaccaccacaccuggcuauuuauuuuuaugauacaaggucuaucacccaggauggagugcaguggcaugauaaaggcucacugcagccucuaccucccaggcucaagcgauccauccaccucagccucccaaguagcugggacuacaggcaugcaccaccauguccagcuaauuuuuguauuuuuucuagagacaggguuucaccauguuacccaggcuggucccaaacuccugcaugcgagugauccaccugccugggccucccaaaacgcugggauuacaggcgugagccacugcacccggccugccuggccuuuuuuuuuuuuuuuuuaaauaaaaagacaggaucggcugggcgcgguggcucuugccuguaaucccagcaguuugggaggccgagguggacaggucaccugagguugggaguuggagaccagccugaccaacauagagaaaccccgucucuacuaaaaauacaaaauuagcugggcgugguagcgcaugccuguaaucccagcuacuugggaggcugagacagaagaaucacuugagcccgggggacggagguugcggugagcugagaucgcaccauugcacuucagccugggcaacaagagcgaaacuccgucucgggaaaaaaaaaaaaaaaaaaaaaagacaggcuaucacuauggugcccaggcuguucucaaacugggcucaagugaucuuccugccacuuccuccuaaauggugcugggauaggcaugagcaccaugccuggccuacauuuuuuuuuuuuuuugagauggaguucucccucugucacccaggcuagagugcaguggcacgaucucauuucauugcaaccuccaccucccgguuucaagcgauucuccugccucagauuacaagcacccgccaccaugcccagcuaauuuuuuuguauuuuuuaguagagacggguuuuaccauguuggucaggcuggucuugaacuccugaccucagguaauccacccgccucagccucccaaagugcugggauuacaagugugagccaccaugcccggccuacauucuuauauauacuuuugaagacugacuuugagguagaucacgcccgguauuuuucagcaccuaguucacuuacacucucaagccuuucacagugguuaagauuccaaaccuuccuugucuuguaggaacgacugagacggcuaaaccacaguguugccaaggaaacagcccgcaggagagcaaugcuggauucgggaauuuaccccccuggcuccccaggcaaauaacagaugagccuauggacucaguagcacaaguacuguuccccagcugccuuguuucaacagacaugcaaagauccuaggagacaguccccauagaccuucagacauuaaaaagggagccguacaguuuguuugaagcacuucgucuuacccauuuauguaggggccccaggaaaccuacacacagccagaaugagguucccaaaggacuuacauuaauuauggcucuugcuuccuuucacaaaugagcugaggccucuacuuuuuuuuuuaagcugcauacgugaggcuuaccuucuucaggacuaguuaaccagaggggcuuccuuuguauguuacaugccugguuacaugggccuggacagcauguccucuaccugugacuucucauuuuccuguuuacacuggggauuuggagggggcaggcaaagucaaagugaaugaccucuguccacccacuuuuuuauugcacuggcuugaauacaguagcaguguugauagaaucauuuuauucaauaaauacuuaaaaugauauucuaguuuacucugguauauggaaagguuccaggaguuuguccuuuaauucaaagacagcuucaaauugugaucugaguauuuauaauuaaaugacucaauuaucauuuucaacaaa

SEQ ID NO: 13705 - RNA, 6184 nt, Homo sapiens
cuccccaccgagccagcucagcgggcagggcugggagggagugggacagauucugggagugcagcggggaggagucccggcugggcugagcgcagggagcugcuuggcagugccagagcccaggccccagagcccugcuggagaggaggcagacugaggcagcaggugagcacccugggcccggccugggaggucuucggcugccggagggccccacaguauugggaggccaggagaaggggcagugaagggggccuggggagaggggccugccagagagcaggcaggaagauuuugguaauuauuaacuuucucccacaggccaguuuaggaauggggaguccugggggguugggggcugggugaggccuuuagagggauggaugggauggugagacccccucccugccgcagcagcugacggagcuccucuccaggggcagaguauuuggaagcuuugaccacagcuacucgauccuccccaaaaggagaggacaaaugcguguuggucuggguuggggguggucagagcuuggacacaggccuugcugggcucugggagcuguguccuaggggaggugaugggguccagaaggaaccaggcaguuuccagggagccugagauuccgagaagaggaggcgggggcugagguggcguccccucuaccucacgacccaagcagaccccacuguguuccaggagcuguuccuugagagggaugaugagaucugggaggaacccgagugaggcuguggggagccugcaagcucccugggagagggaaagauagagagaggggggcugaaccucggcagcuccuccaccucaggacccaggcaggccccggcuugagcugcuuuucuuggcagagccaccugcacuaugggagccuuccccugcccagcccaguggggaugguggugagggcaggggugcuggggagcuggcucugccuuuccccacauucuaguaaguguuguugaggcugggguagcuguguguguguugggggaggcgggggcaagauccacacugaacuccuccaacuucacuugccuggaaaaauuucagaggcuggcuucuugcuccaagaacugaagugaguggaagggugaugggucacccaagcagaggggaucaggaauggccgagguccuugcucggugugugugugugugugugugugugugugugugugagagagagacaaagagaguuagacgcagaauccugugaggaugguaaggggugaggcagggccaagcaggccccacuaugcuccgggagcuguuccuggagagggccuuguggaauuggagaaagaacacaggaaggagcagagaauggaacagcugaggcuggagaaauuucauuugaaacagccuugcugauagagguggcauugucagcccaguucggauggcaccuucccuauauauugaaguuagagaggacaaaugaguaaaugaaaaagggaaugaaugaaugaaugugcaagagagugaaugcauuauugaaugagcaagugaaugaaugagagugaaugaaugagccaauaaaugaaugaguaagcaaacucauggugccuaagugagcaaaugaauuccagguagauggaagggacacagagaauccauacuuaggcuugacagugggcuaggcucuggagagaacagugaccaggagggacaggagucuagggacacaucccaacacuuggaaaaaacuuaagacuccagaggugucuguggggugagaagagaagguggacuuaggacggugugguggauguuuggagcuccagacggaaggagccuggggaugcuaggggugguuaggaggcauuuggagggcguggagcccagaaccugggggugggaggguggggcuggaguggcugggauccaggggcauggagucagggcaauuugggcuuuuggagaagucagcaagcugggcugagguggguggggugggggugggagacugcuuguugcucaaugaugaaucagccaaggggaagacaaugagaacauugggguagggcuggaggccugaggugagagggcccauuggaggacacgugguccucccauucccacauuucuggaaggcuccuguguacacuguccacucaggccaggaucuaccuguggcagggccaaugcaggaacgaccuccugcuugaccuuucuaggaagcggcugaugggauagaacaucugcccgaccccugaaccaggagacccggggccuggcuggugggggaauggggcaggcgggaggagcagguggcuuguggggugggugggguggcagauccugucuccuggccuccaggggagggaggcagaggaggauaacgaucccugccugccugcuacccuauccuuccuucagaaaaagcuccagaaaagcacuugucagaugguuaucuccagcacuguccauuuuaccgaagguggggagcggguggauuccugggaggaggggcugggagcugaagcccugaggcacuggagcucccgcucugggucucccaguacuccugggagcagguggcagagucaucucuggggcucaucugugucuuggccacuuggcugcugccagaggccaagcagggguugagucaugguauugaggaaggccaggaggagacagcucagagaaaugacuccaaggaggcagguggugggagaggugggcuagcuuguggggagaguggcagagggaggugcaccacccauuuccuucccucuuccucucccugaccguuucccacaagaucccucauuuagggaacaaggauugggaugguuaaguguggggaguuucucugaauuaucuucccacuuccaagucuugguugggaguggacuuggcacaguccuuccagaaaugggcacgguuuucagaaucaccuggaacacuggucaugaaccugagccaccuccaacccaagggcagcacagcagacagaccacagguugaacaauggucuuccucuucaacuguaaauguuaaaguguuuguaugaaagucuugcagcgguauagacagggaaccacgcaguuacacacuuaaauaaaagaauauggaaaagcguguggcuuccugccauccugguacucugcuccauccucccagccaaggaccagaggguuugggcaggcggaggagggaagacaagggcaggauuucccuucagagaagccgcagccugacucuuccucucaacucuccuuccuucuugcuuccuggccuguucccuccuggucccacccuuccuucagaagaggcuucaugaaagaaaaagcuuaaaagguggucaaggacgugcaauacccguuaucagggcuggaaggagguggaauauuuauagaacguguaccuugagcaaggcacuggaccaggcaaugugggcuggagagaugcagagauuaaaagcagggggugguguauauccaggauugaaaaaacuguccuaaagucugagucccgccgcuugguucagaaaauacauuggccauguguaagaaaaacuaugcuugucucaaggaacaagacaggacccagaaagacaccguggccucaccaguuagugggccccagccagugcuagcugaguggugaugacagacacgucugugggagucagggaggauggcacccagugcaggggucaaggcaggcuuccuucggaggcguggcuugggcggggcgagagugauuggcaggcuggcuggagagggcagggcagccggcaugggaguaggaauggccacaaguggccaacggaaagcagguggcaggacaggaggcugugguggggccugaccgagcagccuuuccuuccaaaucugacuguggcuugcucaggccccuaugguggcugugacccuguuuuguccaucuccuuucaccaggacccgccgggugagggugacuggagcacauuccugggcuugggggugggaagggagucugauuugccugggguugauguggggggguuuugggcaugggccgugacucacagaguagauccagauccgccugcuccccucauauccuguuauucagaaggcuguauccgcuuagaaagugucuuuuguccuggggugagagggugacgcaugugcccucuggcagucugcugcuguguccagaguccgacuccagcugggcuguaacugggcuuggcccccgccuuagguaacgauguguggguggggguguucuuggguccugcuguguauuuagggaugggaauaagggaggagaggcuagcaggguguggcgggguguguugggagagcugcacaaaaucugauccaauugaucuggaccuuguccuuucccauaaggggcagccagguucugagacccgggacucacuguccuggagcccggcaagggauuggggaaggccuacaucuuccuuucugcuuuguugccuggggcuggggucucagccaguccugggagugggaggcaguagccucugccccuaaccuccauggcucaucccagcugucccagccaugcuuggccccgggagaggugggccagcuguggagcagggugggagaacagguggacucuucucuucccaugagagccucuugccccguagggcucugacacuagggaucuugcucccuagggcuggaaccuggugccuggggcuggggcagggccuggagaaccuguugaggcgguugagcuggggagcaccuggauuagaggagccgcauaguucucauuccagggcucacucucccccacccacucuguuccccuuuuccugccaccuucuucuccagggaccagaaacaaggcaggaggagggacccagggccuaggguggguguggaggaggaggagguauggccugugggugucucuucucaucuccccuccuccugguguccaggccccgccagcaggcgaagcagggagaugucagacugcuacacggagcuggagaaggcagucauuguccugguggaaaacuucuacaaauaugugucuaaguacagccuggucaagaacaagaucagcaagagcagcuuccgcgagaugcuccagaaagagcugaaccacaugcugucgguaaggccucucacccaagggccuugccucccucuccccuucccuccccugcaagccucuggccucugagggugucuuucccugcugaggccucuauccuuccaguguccccgcuaacuccagggucuucuacacccccaggccucugucuucucaggaugcuuaggccuagccagugagggcuauauuugcauuucccaagggaagcagcugugcaggccagauccugggucucugccuaggguccugccuggagucucucuggggcuuccaccaucagcauugcugacccugcuuccuccccaggacacagggaaccggaaggcugcggauaagcucauccagaaccuggaugccaaucaugaugggcgcaucagcuucgaugaguacuggaccuugauaggcggcaucaccggccccaucgccaaacucauccaugagcaggagcagcagagcagcagcuagagaccccuuuggccacaccuuccaggcacuggccugaugccccgcccuggugcucuccccaggcucccuccucagccuccugcccacccagggcccuuuacucucuucucccuccagaccuuccucugacccuugcugaacuggggucccuuugugagugucucagucuagagguaccucccucccuggggggucucagcuccuggagucgcaggcccuuggggccccucugugagaucucaaugcugucuggggacccuaagaguuuucucaccuguucagucucaucuaaccuuccaaugucugauguuccugccaaauuccugccugauucuggguccguccugaccuccaaaggucagcuuggugcuugaggucucccugcucuugguggcagugguagcagcaacagcagcagcagcagcagcagcagcagcagagaccucuccacuuucccuuagccccucugcuggguagagaggcacuuucagggacuucccuccagcugccucuucaucugggaaugagcuaagcaaggcugagccuccuccuguugcuugaaauaaugaugauauaaaggcuggauuuggaguuuguaucc

SEQ ID NO: 13706 - RNA, 1143 nt, Homo sapiens
cucuggcagggagaagcugucucugauggccugaagcugugggcagcuggccaagccuaaccgcuauaaaaaggagcugccucucagcccugcaugucucuugucagcugucuuucagaagaccugguaagugggacugucuggguuggccccgcacuuugggcuucucuuggggagggucagggaaguggagcagccuuccugagagaggagagagaaagcucagggaggucuggagcaaagauacuccuggagguggggagugaggcagggauaaggaaggagaguauccuccagcaccuuccaguggguaagggcacauugucuccuaggcuggacuuuucuugagcagaggguggggugguaaggaaagucuacgggccccgugugugugcacaugucucugugugaauggacccuuccccuucccacacguguaucccuaucaucccacccuucccaccagagccauagccaucugcugguuugguuauuuggagagugcaggccaggacaaggccaucgcuuggggcaugaauccucugcguacugcccuggccagaugcaaauucccugccaugggauuccccagaagguucuguuuuucagguggggcaaguccgugggcaucauguugaccgagcuggagaaagccuugaacucuaucaucgacgucuaccacaaguacucccugauaaaggggaauuuccaugccgucuacagggaugaccugaagaaauugcuagagaccgaguguccucaguauaucagggugaggaggggcuggguguggcgggggcucucugccugguccuggggcugcccugggccagcgguccucccugccacccuucauagauggcuaugccucggcucucucugagaucuuuaaacucuggcuucuuccuccucaaucuugacagaaaaagggugcagacgucugguucaaagaguuggauaucaacacugauggugcaguuaacuuccaggaguuccucauucuggugauaaagaugggcguggcagcccacaaaaaaagccaugaagaaagccacaaagaguagcugaguuacugggcccagaggcugggccccuggacauguaccugcagaauaauaaagucaucaauaccucaugccucuc

SEQ ID NO: 13707 - RNA, 1143 nt, Homo sapiens
gagaggcaugagguauugaugacuuuauuauucugcagguacauguccaggggcccagccucugggcccaguaacucagcuacucuuuguggcuuucuucauggcuuuuuuugugggcugccacgcccaucuuuaucaccagaaugaggaacuccuggaaguuaacugcaccaucaguguugauauccaacucuuugaaccagacgucugcacccuuuuucugucaagauugaggaggaagaagccagaguuuaaagaucucagagagagccgaggcauagccaucuaugaaggguggcagggaggaccgcuggcccagggcagccccaggaccaggcagagagcccccgccacacccagccccuccucacccugauauacugaggacacucggucucuagcaauuucuucaggucaucccuguagacggcauggaaauuccccuuuaucagggaguacuugugguagacgucgaugauagaguucaaggcuuucuccagcucggucaacaugaugcccacggacuugccccaccugaaaaacagaaccuucuggggaaucccauggcagggaauuugcaucuggccagggcaguacgcagaggauucaugccccaagcgauggccuuguccuggccugcacucuccaaauaaccaaaccagcagauggcuauggcucuggugggaagggugggaugauagggauacacgugugggaaggggaaggguccauucacacagagacaugugcacacacacggggcccguagacuuuccuuaccaccccacccucugcucaagaaaaguccagccuaggagacaaugugcccuuacccacuggaaggugcuggaggauacucuccuuccuuaucccugccucacuccccaccuccaggaguaucuuugcuccagaccucccugagcuuucucucuccucucucaggaaggcugcuccacuucccugacccuccccaagagaagcccaaagugcggggccaacccagacagucccacuuaccaggucuucugaaagacagcugacaagagacaugcagggcugagaggcagcuccuuuuuauagcgguuaggcuuggccagcugcccacagcuucaggccaucagagacagcuucucccugccagag

SEQ ID NO: 13708 - RNA, 257 nt, Homo sapiens
ugggcuugucacucacugugccgaacguagaggagcuuuaccgcaauuauggcauccuggccgaugccauggagcaagugguccagcauaaaaaugccuaugaagugauaccggguggugugaaaggugguacuaaggaaaaacgauuaguagcccaauuuauuccgaaauucuuuaagcaguuuccagaauugguugagucugcuaucaaugcacuguuagaccucugugaggaugaagauguaucuauucgacgu

SEQ ID NO: 13709 - RNA, 1366 nt, Homo sapiens
cuaaacuccugguacuugagcaccgaucugcuuuggagaaccuggugagucugcuuacuugaauuucucuguucuuugggcccucaaaaguugaauuuaaucugaagacagaaaguaugguugauccaaaccucugaugacaguuuugacacuacuuaguggauggaaccuuaggauuagaucauaaugacacauuguuuuagcuuuuuuuuguaaguagcuugguguucauaugaacagcgaaguuaauaggaaggcuuugauuugaggaagagguaaaagcaaaguguuuuuccuuuuuucuauaucuuucugguguccuuuucaaacauuuguguuuuagcaggugugagagccugcaauucuucccaaacagcccuuugcucuuugcccaucagcccacuggggcuuuacaacagauaaugaugauaggaauagcuucugagauugcccagaguaucugaacuugugacugccuuucaugaagugguuauuuucaugcuugauucuuuauaacagagauauuuucuuuagaaaaauugcaugagaaaacacaggauuucccaggguugauaaagcaauuugcuaaaguggaaaggagaaaccagagagucaugaaaagggaauuaggaguuuaaauaauuuuuuggagacuggagaaauagcccaugguauuacauaaacguuggcuuuucuuuguaggagucccuuccugugaacccuguuauauaauuucuuucagauucugagacuccagcaggaugucuuaucaacaguagcaauguaagcagcccugccagccaccuccugugugccgccugccaaagcguccagagccauguccaccccugaagugcccugagcccugcccaccaccaaaguguccacagcccugcccaccucagcagugccagcagaaauauccucuggugacaccuuccccacccugccagccaaaguguccacccaagagcaaguaacagcuucggaauucaucaggaccacgaaaggauagggauaauuggcucaccucguuccacagcuccaccugcaucuucucaucaaagccauccagggauacacagggagcuucuuuccccuuagccugugaucugcccaugaugauccccgacagcaaaauguuuccuuucugaggcugccaugcugccacuguccagguggagacugagcaaaggaaguccucagcuguaccggccuuucagagcuucucuuugggugccaucaaagaauuauuuugaugucuucugucucugucugucaccuggcaugagcuucuacuaucugugcaauugucacuuuucuuucacucccugaauaaaguagcuaugccuauauuuuugugaau

SEQ ID NO: 13710 - RNA, 1366 nt, Homo sapiens
auucacaaaaauauaggcauagcuacuuuauucagggagugaaagaaaagugacaauugcacagauaguagaagcucaugccaggugacagacagagacagaagacaucaaaauaauucuuugauggcacccaaagagaagcucugaaaggccgguacagcugaggacuuccuuugcucagucuccaccuggacaguggcagcauggcagccucagaaaggaaacauuuugcugucggggaucaucaugggcagaucacaggcuaaggggaaagaagcucccuguguaucccuggauggcuuugaugagaagaugcagguggagcuguggaacgaggugagccaauuaucccuauccuuucgugguccugaugaauuccgaagcuguuacuugcucuuggguggacacuuuggcuggcaggguggggaaggugucaccagaggauauuucugcuggcacugcugaggugggcagggcuguggacacuuugguggugggcagggcucagggcacuucagggguggacauggcucuggacgcuuuggcaggcggcacacaggagguggcuggcagggcugcuuacauugcuacuguugauaagacauccugcuggagucucagaaucugaaagaaauuauauaacaggguucacaggaagggacuccuacaaagaaaagccaacguuuauguaauaccaugggcuauuucuccagucuccaaaaaauuauuuaaacuccuaauucccuuuucaugacucucugguuucuccuuuccacuuuagcaaauugcuuuaucaacccugggaaauccuguguuuucucaugcaauuuuucuaaagaaaauaucucuguuauaaagaaucaagcaugaaaauaaccacuucaugaaaggcagucacaaguucagauacucugggcaaucucagaagcuauuccuaucaucauuaucuguuguaaagccccagugggcugaugggcaaagagcaaagggcuguuugggaagaauugcaggcucucacaccugcuaaaacacaaauguuugaaaaggacaccagaaagauauagaaaaaaggaaaaacacuuugcuuuuaccucuuccucaaaucaaagccuuccuauuaacuucgcuguucauaugaacaccaagcuacuuacaaaaaaaagcuaaaacaaugugucauuaugaucuaauccuaagguuccauccacuaaguagugucaaaacugucaucagagguuuggaucaaccauacuuucugucuucagauuaaauucaacuuuugagggcccaaagaacagagaaauucaaguaagcagacucaccagguucuccaaagcagaucggugcucaaguaccaggaguuuag

SEQ ID NO: 13711 - RNA, 5305 nt, Homo sapiens
uuggcagguaaaagaaaagacuuuauuaauaaucagugggugggaggugagggugugcaacgcacugcaagcgcccaguuccucggaggacggcgcguggcucaguccaggcucauguccuccucuucguccuucuuguccuucgugucgcccucuuucugcucgggcuuggcguuguucugcauggcuuuggcaaacgcuuccacaucuagaacacguuaaagacacaagguggugucuaacccuugcccagaacuggggaucaaagcgaugggaucaagggcagaagggcugugaccuuuacccccucagccccacuucugcagauccagggggacaggaauggacccugccccuggcucuggccuggaggugcaggcgcagccacuuaccgcccuuguuggcggccuccacagccucugcaggcagaccgaacuggcacaugagggggcccagcugccccgaggccaaggcugcgcugaacaugcccagggccugcaagaagagccaggcgagggcugagcuccaacccgggcugcaccccagagccacacugcucagcugccagcucugcgggucaggcacaugaagcacuggccauggugaagguggggcagggccuccuccuccccccugcccacucccugagcacacaguggaggacacccugggcccggccucuaccugcuggaacuggggcgaggucaggguauucuggaucucauccgcggucugcggcagcgacuccccagauggcaaguagggaagcaggcgcuccuggacauccgcguuggcgaggaugggagccauuaucuccggcgucagcacacuggccagguccacuggggcacaagaacacggccaucagcucgaugacagccuaagugcccacauggaaggcaugcaagcagggacucagcccauggccccagcaccccaggcgcgcacacuaggcagaugccuuggaaggugagcgugcgagggucagcaggccccaugccccccacccagcuccaggcgacagcacacguuaccuugcuggccgccugcuggcccggcugguacguucaucguggccaggaugcucuggaggucgcucagcuggaugggcugggucgggcuggcugcugugcuggcuccauucccggaacugggcgcggggcucgggcuaguugcugaggcagcugcuggagcagaaggggcugggguggcacggguggaagaggugguggaugacggggugaccgcugccgacuggcuccgggagcugcgaagagagagggcaccgcuggagcggacacgccccacacggcagggccuacucgcaggguccagggugcugggccaggauuccccacugccccucccuuaacaccguggcaccugcguggcaggagcgaugaggcucaccuggaggaggagcugcucccuggaggcccacugcuccccaguaagcuggccaggccagguccagucagggcccccagcccaccugcgaggggcaaggaaaugcgagcucaggaugcccucuagcccaccagaaagagccuggccccuccccaggccagaggagcaggaauucccaacaccaaagccaggaagaagcggggcgguggggacccacaggccuggaggagcggcguggggcggguggacacuugcggcuguguucuggaagcaaggucauuucuguuccaucccauuacacaauucaugugcuuagauuagaagauucaguccagaucccacccaaagggacaagcauuucugaagggccaagcacacgggucugcacuccaugagcuggcagcaggcaggcagccauguagggccaggggacccagggcgcaggaaccccagcucccuccaguccuccagccccaccgcucggccagccacccuccucugaaguacccagcugggguccucaccaggggcccagaagcccucgccuacccagcucuagccacaggcaaacaagcgcauucccaaaggggaaccagcuugcggacacacaggcuccccgacacuacgcagacagagccagcagaaguuuaaaggaaacagagaccgggccucaaagcauucccagcagaagcugcccgagagcccggguggcgcacguuacccaguccuccaaggccggcugguccgaugagcugcaugagcuggcuguggcucauguuucccagcaggcucugcaggccacccucaccuggaaaacacugcagcucaggcgggccugccccagccagauccacgcgggccccaccgcacugccugcgccucugcugagcaccgcacucggcugccccugaacccuacagggggcaccacuugaagugaggcgacggugggaugcagacccguccuaccccgugaaggugggaguggggagugacccagggagcucacagggucucuaacuuuuagaaucuucuauuuccacuuccaaacaaccugugcugagggggcgagucauccacaguagacucuggccucccaggaaacccugagcucacgugacacaugugacaguuaccgccuagcgcagagaguucguggccgcugcuuccgcuggcccccagcgccccaggcaucgggggguuguucagauacucguugacuuuccggcaaugcuccucauccuggucugucuuggguuccugcaagaggaagggcauguaagggcaggagcuggcgccagcucacccagggccaccacagccauccucugaccuggcuuccaggugagggaccugagacgcagaggcgcgugugccuggccacacaaugcugaggagacaggacccggcccagcaggugaggggacggcaguggcgccuccugagcacgaugcucugcgcccuguccccauccgccgcaaucccgggugugcccugucccccuccgcccauuucacaaauggggagccuagagcuccgaaggcacuuagcugcugccagaccaagcccucucacccuccugcccucuggggugcgguucuuuacacacccgucuccuuccuucaaccaguggaaggcagcgaacuggcccgcucagcacaccgcggcccagggccacggcaggcgcucacaaucgagcacacgcgugugcacacacaugugcacagaucagugucagaagcaucgaccugcgagcucacagagcugggagcagagcacccacgcacaccccgaauggcuauggaagcugcagggcgccagggacacugggagucccugcucucauggcaaagcagggacgggggacuuaaaagccaccaacaggaaaaucggggaaaaaagggagauggugguaacaguuggacacuauuucuuggcaaaaccguggaaaaacacguucuacaccagcagguggcaaauuguggccgccaucuguguuugcaaauaaaguuuaacuggaguuuggcuaugccuguucauuuucucaggccgcugcacacuacuugcacaggugaccagcaacacagaccaugugcuccacagagaccucagccagggccaccccugcucuugaaagugccaaggggggugggguggggacagcagcuccaccucuggcagagagcauggccuucucucuccacacugcaaacgcaugcacacgcuuccugaccacaggcccgccaccaguuuucaccuacagaugauacuggcuuauggaaaaugaucuguguaccgggaaauucuuugcaacacugccuguaacagcacaaaaaacggcaacaagcucaauggucacugacagauggcagaaugagcagcggccucuagacccaaaagacgcucugcagcuguggguaagagaaacccugggcacugacaccccuggccuccaggacacacugccagggaaggggcaggacuguggaaagugugagcaggaugcuucguuucugugagcaccagcagggaagccacacaggggccucugccucugcugugggggccucagugacccacggcaaggggcagagagagggcacugggcaucguuagaaccagggccagcaugucugucugccuggaaauuucacaccgcaaucgguugcccgcagcccagccuggagccuccguacucugggagaggaccucggccccagguagcaugcaccgcagcccugagguggcaucucaggccguguggccggguguggccggcgccugcugguuuauaaaagccaauugcaccacacuguaagcaaguuccuaaccgaaucgcagggcaacaaaaaggcacaaccccaaggccugccccauaccugcauccagaagaaaagccgcuuggacccugccuugaacuucagcacguagacccucccgcuggggcacugcggcacccgcuugaacucacagucgucagggaagaugaucaaguccuggcaagccaggggaagagagagucaguggcgcagauggcaucacugugcccagucucaggagagcguacugagcccugggucuaaccggguggggugcgcaaggggcagcuaagccgccagaccccucgcuggcagggucuccacaaggcagagaagccagggucagagacagcccaugaaaggcaaggccgggggagagagcagggaaaggggccuuucagauggcaacgggguuucugagacgugcuggaaacaacauucccagaguaguuaaaaagucaacgcugaacugcucucaaauguaacaaagaacaacuaagaguuugaaaaacaaagaagacugagugaagccgccaggcacagagcuccaggcucuccagggccacaccuccaaccccaggcaccucacacggacaguucaaggccaggcacagagcuccgggcucuccagggccacaccuccaacccaggcaccucacacggacaguucaagauacacaguggccgagaugccccugucaccgcggaaaccaggacgacccaucagcagggcagucgaugacggccccacgagcgguccccagaugcggccaagcccccaccgcgaacuccaaagcgaggacuccgagggcccgagaagucgccuguccugcugcugcggcucagggacacucacgucuuccacguucccggacguccuguccuuccagcagaagugaauaagcgagucguccgucugcugaauguacaccagcccuuuccgcuuauccggagucacggugguccccuucagggacaucuuucccgcccgaaacuccaccaaguacuuguuggaggcgccccgagagccuggcaccaggcuuggaaagagcgcgccugaggucgucauccugaaagcgc

SEQ ID NO: 13712 - RNA, 1397 nt, Homo sapiens
cuaaacuccugguaccuaagcaccgaucugccuuggagaaccuggugagucggcuuccuggaguuccucuguucuuugugcccugaaauguugaauuuaaucugaauacagcaaguuugguugauccaauccuaugaauguugauuugaugcuacuuaguggauggaaauuuaggauuagagcacaaugauaugcuauuuuagcuuucuuuuaguacagaguuagguguucauauggacagagaaguuaguuaaggggaaagcuuugauuugaagaagaaaaaauaacaaaguauuuuucuuuuuuucucugcuuuucugguguccuuuucaaagguuuaugucguagcaggugugagagcaugcaauucuucccaaacagucguuuucugugugccuaugucaacccacugggauuuuacaacagauaaugauaacaggaauagcuugugagauagcccuggguaucugaacuugugacugccuuucuugaagauguuauuuucauagaaauaacaugcuugguuguuuacuacagagauauuuucuuuggaaaaauuauaugagaaaacacaagaguucccagggacaaugaaguaauucgcugaaguggaagugagaagccagggacucuugaaaagggaauuaagaguuuaaauaauuucuuggagauuggagaaauaauaugccaugguauuacauaagcuuuggcuucucucucuggaggauucccuucccgugaacacugucauauaauuucuuucagauucugagacuccagcaggaugucuuaucaacagcagcagugcaagcagcccugccagccaccuccugugugccccgcgccaaagugcccagagccauguccacccccgaagugcccugagcccugcccaccaucaaaguguccacaguccugcccaccucagcagugccagcagaaauguccuccugugacaccuuccccacccugccagccaaaguguccacccaagagcaaguaacagcuucaggauucaucaggagcaugaaaggauaaggauaauuggcucaccucguuccacagcuccaccugcaucuucucaucaaagccauccagggauacacagggagcuucuuuccucuuagccugugaucggccugugaugaucucugauagcaaaagguuuucuuuuugaggcugccauacugccacuguccagguggagacugagcaaaggaaguccugggcugugccagcucccagagcuucagaagaaagagcagcucucucccugggaaccauuagagaauucuguugauguuuucugugucugucuguccccugggcaugagcuuccaccaccugugcaguugucacuuuccuuucacucccugaauaaagaaucuaugcauaua

SEQ ID NO: 13713 - RNA, 2107 nt, Homo sapiens
ugccagaggaauucuguuuuaauuguuugaaaacaggagcugaggggaagcgugguaggagaagaugccugugcaugccgcucauguuuccagcagggcaauguagaugcaugucaggaaagaugauuagauaguuuagaaccagauccuugucugagauggaaacugcagcugcuaauuaagaagaguagagcucgaggaagccgccagcugccagccuggugcugccucuccugcaagugugaaguguggcugcauccagaagcacuggugagcagggcuuugcuuggccuguggaguguaagaugcuggcccagaaggaacuucaugcucuguuuuuccuggggguucgccucugaucacaugcccagggcuuacuucugcuuggacgucuggcacugcugagggggugggcacuugggggcacagggcuccuggcacuugggugggggcuggcaaggcugcuuggucuguugggguggggggcaguacugcugagguggagggcagcacugcuggggugggggacagcacugcuggggaggggggcagcauuguugaggcggcgggcagcacugcugggguggggggcagcacuguugaggcggggggcagcacugcugggguggggggcagcgcugcugggguggggggcagcacugcugcgggggagcacacugcuucugcuucugcugagacauucugggcuggacuugcaacuggaaacagaaagacacagaaaugaggaacacuugagccauagagagacccuaagcccaggugaacccccugccacauuccuguccugcucugcuuuuaccuugcccugaucccuucacagauuuaagaggagugugugugugugugugcgcgcgcgcauguguaaacuuuaaguguuuacaaguuauuucaacucuuuucaagacaaagaaacauggaaggaaggaaagauaggaaaggaggaagggagggaaaacagaaauguuaggagggguugaaaagaaagaaaaacauaaaaaaagaaaagggagagagaggaaaaaaaagaggaagaaugaaagagcagacuguuguauccuauuauagcaaaaccuguggcaucuggaauaaauugccugggaucugaguucuggcuaaaucauuuauuaacuauaugauuuugagcaacuaagguuuuccauacuuaccucucuuagaguuggugcaaaaauuaaaugaguauauaaaauacauacuuaaaauaugcaugcauacguagguauguauguaccgacacacacaugcagaguaguagcacaaaaugaacacuauauaagaguuguaauuuguuaaguaaauucauaaacaauuuaaaaggcgcaucuuaaccacucucuaaaggaguuuauaaagagaaaacucuagagauagaugaaauggacuaucuagcuugccucucucaauuacaguugaggaaagcaaaccucagagggaaggaauggcuucaaagccacucggcauagauggugggaaaagaggucuccugauucccagagcagagccuuccauggugccacaucgucuugucccugcagcccuuugcuccauggacauccacaacucugcugucccaagggagucuguucucuuuccuuccugccuucucuuuucuuugaaaggacaguccuuccaguugcucugcccagaacuggucucuccucuccuacuaauucccucuuagcaccugacaagaugcaacacccacaccaugccagcagcaucgcugagauacugacccucuuguagauaccccccuccuucucccugcucagcccagccucccacacuacucugcuggauaacuugcuggacccaagauagguuugucacaaaugauauggaaaaaagagguaccccaaaagacccauccuuucugaccaccacccagagaaucagcccaguccauaguugguuagggaugcaggcaaggcaaggcugcuauaagagguacuaccuuuccagacuuaccaagguucaccagcgacuggagcagauagguguggagggguuugggaugcucugagccuaucuaccuuuuauauaccucucaucccugccugaggccaug

SEQ ID NO: 13714 - RNA, 6806 nt, Homo sapiens
cauagagucuuguggagagaauuauggugucauagaggcuuagaaucuuggcauuagcagggaagggaacccaucugguucagaaggcuuuggcuucugauagucauggacucacuaggcugcugaggaagaucaauaauaccuacuggaaucagucaugagaagucaagcauggaaauugugaauuguguguguggccagaccagguaacacagagaaacauugucuuuuggguccucucuccauggcuuuuucauguguucauuaguucauuacguauuuaccuacugagacccaugcaaugccauucaguguguuggaugagaggauuccaggauucauccuaucuuucaggaaaaagcuccugcuucuauuuaagaggaagacaugggagccacuggggguggggauagugagaaugccuguguuuauggaacuaacagaccacaaaagugagacaauugggaaaauaauaaccacuauaaaaauguaaugggaaguacaggggauccaagaaagccuuucagggagauggagguuuuggguuaaggaaguuuuccucgaggagugauguguaagcagagacuucagguuugaacgauauucagugagcauguggggacagagacccaggaagggugguuuaagcugggaaagagcacauucaaagaccuggaaagaggugagaaaauucagcaggugucugcucugagccagucuggugccugagggaacaguguuuggacaugaggcugggccugugggcagagggagaaggugccuugccagagcccuccuggugguuugggcucuguaucaauccucucugaauagagcaauaagagcuaggaagauggcccuggccuugcaccacaaguguuugacaugauuaggcagauuuccugaggcaggcugugcacagcaugguugggaaggaagggaaauggagcuuggagagaauauuuauuuauuuguuuguuucuuuuuauuuauuuauugagauggagucucacucugucacccaggcuggagugcaguggugaggucucggcucacuguaacuucuaccucccggauucaagugauucuccugccucagcuucccaaguagcugguauuacaggugcacgccaccacacccagcuaauuuuuguauuuucaguagagauggaguuuugccauguuggccaggcuggucucaaacuccugaccucaagugauucacccgucccagccucccaaagcgcugggacaacaggugugagccauugugcccggccaaggagagaaucuuaagaagaaacucuugcaggaggcagagggguccaggaggcagguuuguuggacaggagccaggguucugaaaguggaggauauagauacuauucaccaggcagaaggaagacaguggagacagcacuggcucagaggggcaggaccugcauccaugggggugagguugcagaaggacuugauguugcccucccuaugcuacagucaacaagacugguuuccaaccugcuguccuucucugauauugcacaaccuccacauucaggaccuauucccaggaucucacuaugggggacaugcuuggaguggggacauuggugggacuggugaggcaagccccuggaccugggcuccaggugccucugaugccucugcaccucugaucacuggaaugagaauugcuucuguagaaacagcucagucuggacuuguaaagauggacacuaacaaacuggacuuccaaguggugaugagacucugcacuuuggucaauucagggcacugaccuucagaguagagaaagguaaaccagagacaaaagacagaaagguagagacagaaugaagaccagagaaugauagagaggcagagaggaaaaaaaaauagcaaaaggcaaaaauaaacacagagaggaacaacagaaaauaaaaacagaaggggcucacuccucccucgucccucucaaaaccuagucuuaggucugaccucuaagggagcagauucaaacaacaaggagauacggacagauacugggcucccugcauaccccggcacacccaaauucaccacuguacagcugcaggggcacccaagugugugcuugugugugcguguggacacacacacacacuuccugucaaacagcuuugaacacugcaaaggugguagagaacauggcccuguacucucucaccucuucccuauuuuuauacuggucugucuccgucuuauuuccauuuuuggugugccucuccauugcucaccucucuccuuccuguucucucucgggcaagucaaggcaucgcagggccuguaucugccaccucagccucuuugcagcuuccucugaccuagaaggagcaauagggugacuuguccccacccccauccuuuaggagucuuugcucuagugucuuccucuuaaauggaagcaggggccuuuuccugaaagauaggaugaauccaggaauaacuggcagagauagagucaugacugaauuaaagccaacauccuaacccaagucacucuccccuuuuuaggugggaacugcccuugacccaguucaggcugcagccauauagccagggacuuaggaucaugaaagguuuauaccagguggcagggccuuaagagauaacucuucccucccaaucuucucucacccuaaugcuguaguucaggagauucaaacauagggguccuuauaagagguagcacugugcuccccuccuucccacagagaaacccugagaugaggcuccaaugguucagaaagugaaagugaagagagucugcgcuggggcuggguccaacgugugagucugaaaguuacuguuucuaguggguggcgcugucggccacaccuggcucaaugggacccaguuuguacacuaugaacuggauuuaggugaauccccagauaaaaaaggguugagucuaagagcaugucacccaucauucaggauagccacagcccugggucuucuauaaagucacaagggugauucagauagcaaaguaggucaucuaacaggcguccuuuagcaaccaccugacuggagaauccugcacaccuucaggagaggaugauacagauuuuuguccuacugggguggauuaguccauuuccacacugcuauaaagauacuacccggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgugguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaagauacuacccaagacuggauaauuuauaaaggaaagaaguuuaaucgauucacaguuccacaugucugagaaggccucaggaaacacaaucauggcagaaggcaaaggggaaggaccuucuucacauaguggugggagagagaaguaagaacaggggaaaugucagaugcuuauaaaaccaucagauuuugugagguacauacacagagccaaaccauaucaugggguaacccccagaaauuauuuuauuuuauuuuauuuuacuuuauuuuauuuuuugagauggaguuuugcucuucuugccaaggcuggagugcaauggcacgaucucagcucacuguaaccuccaccuccuggguucaagcgauucuccugccucagucucccaaguaucugggauuacaggcaccugccaccaugcccauuuuucuauuuuuuguagagacaggguuucaccauguuggccaggcugguucugaacccccgaccucaggugauccaccugccucgaccucccaaagugcugggauuacagacgugagccacuguguccggcccucccccagaaagacuuuaaugugaggagagauuuguagcuacuguccccaggagucccuuuaucuacaggacacaaaagaagaggacaagacaagagauguggcuuucuaaacaucagggagaguguuuggagcagggcuguggggaagcagccugacagcaggucaggauaggauagagggcaaguagggagcacccagcaggagagagaaggccaggacagaggcuggccccuacuaggagcuauucacacuggcucuaacuguaaagacucaugagaaaguucaagcaaucucaauuuguuaaacagccaucaucacaaaccucaaguucuucucuccauguaccuauaauuaugcauggacacaugccuacaugcacuuaggugcacacacacacacacacacacacucucacagagauaugggcaugugugugcuuaguggaaagcccacagcaguaacuggcucaguuuaaaaaacaaguuugggggcugggacauuggcucacgccuguaaucccagcacuuugagaggcugagguggucagaucaccagaggucaggaguucgagaccagccuggcuaacauggcaaaaccccaucucuacuaaaaauacaaaaauuugcugggcguggugguaggcaucuguaaucucagguacuccggaggccgaggcaggagaaucgcuugaaccugggaggcagagguugcagugagcugagaucgcaccauugcacuccagccugggugacaagagcgaagcuccaucucaaaaaaacaaaaacaaaaacaaagaaccacuaauuugggccagaggcuuuucucacaaucccaaggaugccagaggcuggaaggugguugccaccucaccucagcaguugucacuccaaaucccacacccauccuacccuaccagugacagggcucugacaggccuggcaccucccugacauggguuuguggcuuugugagcugaguccacagaggggguacaggcucauuucccgugcuucuacauuuccuugaggaggcuagauaacaaccugcucacugucugcuguuuccuggccacuucuagacccucuauucugcucugggaccacaacaguggcguucauccucucaucaugugccauaggagggaccagggcggaaaccauuaggggcuucuccaggggcugcauaccugggcugaggcccagggacguucccagaagagcuuggacuuccugggaggaggaagauggguagauagaaguaaagcaagaguuguuuggauuuucucuauaccuggaagaaucaggaaaugauaaaacugcugagugguugaguuugaggacaccuaccagguccaguucccccuuccucacccccaccacugccccuuuauagaggaagagguacaagcccagagagaugaagagaacugcacaaucccuuaggcuugggaguugcagaaccaggccuggaacucaaguccugccaugccaagagcacuguacuuuucauuucaucuugcuguaaccaccacagugcuccgugcaugggacaaaaugaugcauucaggaagcgugugacaguuggucacucuaagugcaagaguuucauugcaccuggguccaugggugccacauuagagacaagaacaagcacaugcucuggagugggauagagcuuggcuugaaucacuuacaagcaacugagguggauuuuugaacuucagugguccucauaugaagugaaguggacuaaaaaugucuaccucaggcugguagccguuauaacauuagcugauguuugugaagugccugacacuugacucaggaucuggagacugagggucaaacuguuugcucauuagcuaagggaccuuauucacauugcuuacauauucuggucuuuugauucuuuaucugacaaaugacuaccuaguaaggaacaaacacacuggcauaugcaaagguagaauuauggggcuggcuggccucucugagggauccagcucugcuuucucaacccuggucugagucauuauccugaagauggauguauuugggugucaagaaaggaggaaaugaaagcaggcacccagauuuccuucugaugagaauauuauuuucuuuuucuaguaccuccaaguguucagaagaugugugaccagacaaaacacaguaaaugcugcccagcaaaaggcaaucaaugcugcccaccacagcagaaccagugcugccagucaaaaggcaaucaaugcugcccaccaaaacagaaccagugcugccagccaaaaggcagucaaugcugcccaccaaaacacaaucacugcugccagccaaaacccccaugcugcauucaggccaggugcugugguuuggagaccaagccugaagucucaccccuuaacauggagucugagcccaacucaccgcaaacucaggacaagggcugucaaacccagcagcagccccauagcccacaaaaugaguccaggccaagcaaaugagagcagaagaagucaaacaaagaagaagucccuggggccaugccuuucacuuuguagggugggggauuacugagagucaggcuagaccuguguuuagagaagcaguuuucacagugacuaccauuuccacccaaugagaggcuccuauuucccaucauagcucccuacccuagggaggccuccaucuggaaaugggaggaugaagaggcuagaaucaucuuuccuagugauccugacauuuagacagcacagaaauaaagagcaauaaaaaga

SEQ ID NO: 13715 - RNA, 1460 nt, Homo sapiens
caaccacucaccuccugugcugcuugugaccucaguaaguguucccuggguacugaagcaggggcuuccacaaagggaugccuagaucagggcaggaggggagggcaggcagagccuccagggcugggguggugcugguauccauaugagugaaggagggagccucaagaaaacugagcaaaggcaauggggacagaccagggacaugagaaugaggaguccugugauggugacuugguguucuggagaaaugagauggaucuagaguucuugggucucuagucugaaggcauugcaacauugccugccauguucaccuguaacugcuuucagaaagggagauuuaccuugaaaaauauaauuguccuuuccugaaaagaugagauggaaacagugguucccagccaguguagaggauaucacagcuaaccgacucucuuaaacucacauuuaaugguauuuaacuuggugagacaaguacgguagacaaacaaaauauaagugcugagcauucaguacagguguuugucugcugaaaaaugucagagcacuggacuaagucagaaaccuguauacaauucucacuuaauucaaugauauuuuuccuccaacuuccuuugcaguucugaacuucuauguccuuacaacaagguaaucuagaaaauucuuccaagagagaaugacuguuuccccuugagaaacaauuuuauuuccaaaccccuuucuagauuguuuucaugauucagguguguaguugaagcagaaugucuccucuacauacuacaugcuugauuuugagaauacuuucuuaauaucuuuuggcuucgguuuucuaauuauaaaauaguugaaaaugcuuuaugauuuuauaaguauauaaaaagcauuagguucaaaacagaggcuauaaguguguuuagccaacuauuagacacaaugaaacuucccgugauuaauuagcuacaacuacacuaagcaguucaucaaaauguagggauuagaaaugaugcugaaagggcaagaauaggccgggguggccucuaccugggucuaacuugcugucugacucucucucagcuccugaacacccgcaccaagauguccugccagcagaaccagcagcagugccagcccccucccaagugcauccccaagugcccucccaagugccucaccccuagaugccccccaaagugucccccuaaguguccuccagucucuuccugcugcagugucagcuccggaggcugcuguggcuccagcucugggggaagcuguggcuccagcucuggggguugcugcaguucugggggagguggcugcugccugagccaccacaggcgccguaggucccacugccacagaccccagagcucuggcugcugcagccagcccuccgggggcuccagcugcuguggaggagggaguggccagcacucuggaggcugcugcuaaagugg

SEQ ID NO: 13716 - RNA, 1516 nt, Homo sapiens
ccuaaaacauuuaaauacaaauaaaaugaguguagcaaaaauaaugaaagcuaacagcagguaacuuuacaaauaauggaaugugaacuguuucugcccuuauccagaguaaaaugggucacaacuuuaucuaaaggaaaacuucugcagcuguagucaaaggugugcacaaugagacugaguauuccacagauauacaugguuuaacaugugguauccaugggguauguuucuaccacagccuuguaaagugcuccaaaccuuaaaaguacccacaauuacuacaccucugacuggaaucaaugaucccuuuuauucuccaccaggacaaaccaauauguaggcaguuuucuuugcuuagacauggaagcaguuuuacacuggcccuugugaagccacaauguaccaaaaguacuaugccaaacauuuauaacuuguauaaaaauuccacaucccaauauuggccaccucaagaugaaaacagauaccucccuaaauguugacuggcucuacucccuuaauauuaaacauaaaaaccacaugggaaauauagaaauccaaauagaaguaacauaaaccugucauaaaucauaaacaaaaaacuauuugugggacagcauggaugacaaauggucuacuguguaaauuuuagaaugaggcagacaaaaguuggaaggccgguuaauuuuccccuccuucuccugcuucagcuucgucuccuuggguauccgauguccacaaugucaaguugucucucaguaauugcauuauuagcaugcugucuuuguaugacucuucacuuaauguaucaaguucagcaauggcuucaucaaaagcggucuuugcaagacagcaggcuuucucuggggaguucagaaucucauaauagaacacagaaguuaagggccagacccaaucugacaggauguguugguugcauuucuuuuuugcugauuucaaaagcuucuugguaugcuuguugugacugauccacaaucccuaucuugucaucaccagcaguaaccucagucaaguaacgguaguaaucuccuuucauuuucaaauagaagacuuugcucucugcuugugaagcauuggggaucaagaacuuuuccaaaagagacaauacaucauuacagauaucucuuagcuccgucucaauuuucucucuguguucucgagccaucugcuguuuuuucucagcaccuuccguuuuuuguucaauacuugagacgacccuccaagaugacuuacgggcuccuacaacauuuuuauaagcaacugagagaagauuccucuccucauuggauaauucagcuccuugcuuaguuacagacuucaugcaggcugccaugucaucauauugcucagccugcucggccaguuuggccuucugaaccagcucauuuuuauccgugacuggauguucuguguccggagugggugguggcuguggacgaacaggggcucagcagucucugggcggcggcggcagcagcggcgaggcugagacucu

SEQ ID NO: 13717 - RNA, 14114 nt, Homo sapiens
cauccacagcauccuuaggagcagccuucuucuccuaccuccucugcaucuggugaguggccagcaggggacagauccucagcugggaguguuugggaaagagaggcccagaacugaaauggaaccaucagaaagaagcccacagugggcagcagugggggaggugauggagaauaaggagccucuaaagcacaugucagggacccgugagcugcaaaacccgcaggaccuuaggauuccuucacauucuuguuuggagcauguugucaggaaugcacauagauccauuuuauauuuuuaagguugcuuuauccaaaugcauguguaggguucccucuacuacauucccauuucucuccuacagaucuuggcuuagaaaguggcuucaucaagggggucagugugugacaaacccaaaaauaaggagauggucugaggguucugugcucaaauguuucuauuauucuguucaagguaaaauuccugcauuccugcaaagauguccugccagcaaaaccagcagcagugccagcccccucccaguugucccucacccaagugucccccaaagagcccagcacagugucugccuccacccucuucugacugugcucuaagcuccgggggcuguggccccaguucugaaaguggcugcugccugagccaccacaggcacuucaggucccaucaaugccggcgccagagauccaacuccugugacaggggcaguggucagcaaggcgggggcuccugccguggccauggcucugggggcugcugcugaccuggauccugaugaugagacaagugaucuuuggaggaaacaaggaucccaaaggcccaggaaaagcuccauccugaugcaugcuuuuccagauaccuuguucuggcuuucacaagcugagcuggggguguuccuguugaguauccaagcuguccccagaaggugcuuccugucugguguauaggaucucacaguucccucaucccugccccugccaaggauuggcaguucccugugccuaacccugccaaaaaauaaagcuucuuguucucauuaccacggugucucacuuguuaggaaacuauccaggauuuauccauccaggccagguucuccugucacccgaacucgcaggaccuuagaaagccagagauuuaaguguguuaccccugguagaggugaccccagagagcugaccucaugcucgggcaaguaacugggcuguguucucccagccaacccucugucaucacaggacaccugcucagccucagaccuguguaguuuuugcucugaugacaaacagaggagcgaggaauugggagccccucauggaggggaggaaagguugaugggcaccaucaccaggauggguauggagccucccaagccaggcaucaggguuggggcuguggagaaacucauuuguggacaucugcugcauuccauaggaacagaaagggccccccauuacaguucugggguguucugaaacuucagaacuuacuccucuguuguuguaucccaaugacuacagauuuuacuccuaagaagcaaaaguggucacucagcuauauucagccccacaaucuggcuaccaugagaaagugcuuggucuaucucuuuuaaaugucucuuugcaggacagaggccacugaagggacccuuaacauuaagaguaaaguggccacccaagaguaguucaagggauaauuccugaaaauacuuccaagacagagacaggggucaugugcuggaggcaggaaaaugcugcugagaauaucaauaccuaaaccuacccucuccccaguccacauucagagccacccucuuuccuacggcccagugccuuuaugcucccacaggcaucacuauuucaguuugcuagggugggcugucaggcagaauaagaagacaaaaauuauaaccccaauagugaacauaauuuaauuuuuguugacaauuauaauuuaauuuaaauauguauaaaguuugauuacagccugacugauuuaucuugaaaaauaucuagaaaaagguacuuauuuuaauauuagagauuaauugaaugagaaauuuaucuacaauuaaaaugaaauucgcagagaaaauagcauucaguuugcaucaauucuccguacccaaaauauagacaugaucaggucagcuccauuacaugagaugcacccagcacuaccaucaaccucaaaagcagcaacacauaccaaagucaucuucaucaagcccauccauuaucaugcaugcuugcagaacuucauuucgaguccaagcagaugaacgacuccucccucuguguuuucauggucuucaaauaaagagcacacauucccuggauuuugauggaaggucaugccuuuuguaaugugcuuacugugacucuuggcacuccaauuguuguacuuuccuucuccauauuugccccucaaucagguauucauuuggcuccccuccucuccugcccaggggccuauguuaccuccuggguaccagugaggcucuuucaagaguccucaucuccgcugacuuuacccuuccaucuguuuuacacacagcccauucugaauguccagcauccuuaccucagucaccaccccaacagcaagugcugaucacaucugaugcuugauuuuccuaagggaacauuacagaaaaaaguagaugggcaaagaaccauggacuucguggguagucauuuacauugcaguacuuaucucauggaagcagucucccuauuuacuugacugccugugcaguuagacaguuaauuucuauaggucaggugaugugucauauugaacucuaccuuccaccacaaugcauggagcaugacauauuuuaagcacacauguaggccuggguggaagguguacaagugaggaccagggcuuccugugucaaacaugccacccuguuccugggaagacggugaaggccuggaccugggcuggguuguuuggugcugucaccuccccgagcaacccauucaugcugccccucacaaucuagcagcucugucuugggcuucccagaccauggacuucuuucgaauaagcuuucucuugcugccaugaaaccagauggaugucuagcuggagacaggaccugagcuggaagaccuaggaagacaagcccggguuucuuccaucaggggagaaggaagcagaggguaugggauggaggaagcaggaagagugugggguuaaugggcacccucccgggauguaucagguguccugugacugcgaaggucaugggucuucagcacacccucaucuucuuccuauauauguucugagagaugcacugaucucaccagacaucaucaaggaagcuuuacccaaacagguuuauucuccucugugauuacaugaagauaggacaccucagcugcucaauuagaaaagacccaguaucauuuuguagcaggugaccaaagagaaaagaacaucuuuccaggauaaacuaacuccaaauuuauuuucauuuccucccuauauuucuuuucuuuucuuuucuuuuuuuuugagacggagucucgcucugucacccaggcuggagugcaguggcgugaucucggcucacugccagcucugccucccagguucacgccauucuccugccucagccucccgaguagcugggacuacaggugcccgccaccacgcuguacuaauuuuuuguauuuuuaguagagacgggguuucaccauauuagccaggauggacucgaucuccugaccuggugauccgccugccucggccucccaaagugcugggauuacaggcgugagccauggccccugguccuccucccuauauuucuuagugcagaaguacacccaucagagaagagauauuacaaagauucauuugcauuauugcauucucucuagagucauugaugcuuucugagauuuugugucagcaaaacgcgcagcagggauagccuccaaaggcucccagaguuccccacccagucugagccccaugucuagucuaccuucagucuucuccugcuauggcuccagcuccagggguugcuuuaacucuuagggggcagcugcagccugggcuaccacaggugcuaucucuuccacuggcacaggcacuagagacaugacugcugugaguuuacccacuggcagcugcagcuguugccagagcuuugggcacugcugcugaccugggcagugcauugagauaagcaguuuuagaggaaucagagacccaaagugcccaggauuaaccucagucugauguaccugcuccuaaccuccugcccauggucggagcuccugaguucauccugacaaggguugucagugaucuccaguggucucccuggugucccucaugguugucuccacauccauguucuggucagugcuuagcagcacuuaugucucacucuguaaaaaauaaagcuuuccuuucucaccuacguuucuauauugccccuccgaaggcugcuccauugcucucccaugccuuaucucccagacugaaugcuucacaggaugagaggaaugagagacaacacuucucucuacucauagggagaccaugaguugcugcuaggaagaggcuacagaaggccacauggcugcagggaggaaaguucaccuuauuucuauauggaagaucuggguguugaggagguaggaagggauccuugaaagcugaauaguugaugggugcaaggagagaaauguagaugguugcagagguauacacugagaggaacuuagaagaaguaagaaaauaaaaaccugaucauugcaggaguuguaaacuggauauauucauagggucaaugauuuguauacuacucaugaugugccaguggcuugacauacaguaaauaauuuaauccucacugcaguccuucaaguuacguacaacccuugucccauuuuacagaugggaaucaucauggaaugaguguccagggucucccaacagcugccaugcaaaccuuggcaguuuugcugagaagccuaugcuccugaugacugugguguucuaaguucuucuaaaauguuuuaagagaugugaguaaacaauggauuuguuuuguaauuauuuuaguccacaguauuuuguuguuugaauuauacaucacuaaaccaccaaaccauaugaaucacacuuuuaaggaguucgccucccagaguuuggacccagaguguaguauucagcugcaccacaggauuaaaaucauuauuuuugaugugcauuaaaacaacaauucacuuucacuaccaauuuugagaauguuaaugaacuggagaaagacucaguaaaaauucaagccuuggugcucaucaguaaaauacuagcaauccaaggaggucucauaaacucugagccaaagugaaagagcagaucuuaagaguaguuuagggcuagauacaacagagaaauuaauguauccaguaauaggugaauauauuaaauuuuagaagcuuuuuuuccaagcucuugggaaauagggaaaagaaaauuacuccccucuucuguguucauagacauucauuuucuuaacucauugggaugaaaaagguacccaaagggauccuaugaggaaguugaugucagaacugcucugaugaguuuagaucgacugcccagcucaauuccucuuaguugccaugccuggguuuauugcccuuggauggauacaggcuccacaucuuacucaucccaucaaccaucccaggugacagcaggugacaccaucuggauucaucauuuacucuggcuggauucaucauuuacugauucaacuagcuaagaaagauuuguuuaagaaguuaccacagcuguaggacuuauaaaagccuaugauacagacuuuugauucacuacgacaaccacuugcuacucaaaaauugagaaacucuugaauaaaaucagcccaggcgacauaaagaauguuguguuaugacuucuagaccaaguccaacacccaaucauucauaauuuaucugcucaacacguaguuuuguggcacuggucuagguguuuagaucagugugaaacaagaugaaguccccuuucaggcagcuuauguuccagugggcccauuggagacaucuucugguuuccuggcuugucagcagauuuagacaaagaugguucuauauucaguuggauucccacucuggggcacuugacagaugccgguaaaggguggcuaaacccagugaaggcacccaucaugggcaaacuuuugaaaacuggauaucauuuuuugggugaauacaaaaaggacauccaaugucugguuguuuccacaucaaagguaggagcuuagugagucaagggguaggugggugauuccaauggugaaauguuuguuuaaaaguugaaaaguccuugucccuucccagugccuuucucacuucccaguucucagugaacaaccccauucacccaaguaucuugaaagugcuucuguuugguacuuagcuauaauguauggagcaaauaaaaaaaauggccacaccuauacccuucccuguaucaggauacucagacacauuuaaugcaauaauaauguuuuauuaaaaccuugucguuuuaggauauguuugaaacuuacauguguauuccauuuuuacauacuuuuaauauaucaugauucaggauaaaauauauaucuauuauuauaauaaaugcauuggaaaaauacuauagaguuuagugcucucucuacaaccuugguccauguugugucaggugcucacggugaucauauuaaccucauuauaaucauacccaucaauuaucauuucuauuuggacaaaucucuuuuagucaucccauccaauuugaaucacucucuucccugggucucuuagaaucaauaguacagucgcuaagauccugacacaagguuccuuaaauguauguuaauccaugaugcauauuaccaaagccauuguggauuucuuauacuugucucugaauuuaccugugauaucccugggucauuuugccuccauguaaacagauuuguuuugccucagacaucuuuaccuuaauacagcuauuaggagaagcagggaaagauuaaaaccuagaaguuccugucuccaaaauggaugcucuuaaugagcaaauuauucugcauucaagacuguacauguccccaguauuccccucagcccuguucuaccucgaccucagcauugucucuuucuccugggcaccuccuugauguuucuuggguccacaaauuucucuuaguugccaugccucgguuuacugcccuuggauggauacaggcuccacuucucauucaucccaucaacaaucccaagugacagcaggugacaccuuuuggauucaucauuuauucagagucgcuacagaaccaaaagggacuaaugccccaaaacccugacuucaggccuggggacucccacacacuguaucccagcacccucuccuggcucaggcuuaguuuccuacuuaucugucagucucacuacaccaucagccuaaggguagggaugguaucuucuucagucuugaaucugcuuugcccagcacagugagugucaccaucucaauauaacuuguuuaaagaaggaaugauguuaaugaaugaaaaaugaagaauugcagaccuacagaaagacugaggcacagguaugugaauagucacgggguuucuugaauccccacucuccucaaaacucuugacaccugccauggagauacagaggucuuggggcuacagaggcaaagaagcugacuccuaaacgagacucacauucucaccccucccaaucccaacacccauuucuugccugcaaaagaaaauagaaaaagagcucuaagguuugcucaguccucacuggaaucaggaugccucaacccaaguuacuuucuauuuccugcacuccucugcucgggaauuuuuccuaaguuguggauucaaagccacauaugcuuugaaauaaacauaaaaagauccaauuuuugauccuguuugagccaucacaggcuuuacacaucccacaaggcacagcaucagcccucuggaugcugucacucaugcagugaccagggcacugaaaaccacaguggagcagggcuggaugauccagugaagcaaagagagaagccucuucccaguguggugauuuuccuccucccucaccucugcuccuccuugguggagaagucccguggaacauuagugaagauaauaagggugggaaugcccuuguagaaauuacuguuaauagucugagaauugggcagguacuauaaauccuaaucuuuuguguuucaaagccauuugcaucaacaaguguuugguuucgaacucagcguauccuugucuuaguaaucccuucuuaggucuuauuaccagaaagauccucacucaacagaaugcccaggugcaguuccagucagaacacucuuguggugcccacucccaauuuucucugucaaacgucauugagcucuuucaaugcuuccuuucacuuuucccccaaccacucugcugcaguuuugcaucccacagugaacaagcuuguguccauuccaagcccccuggagaugagaccucccucagagccaaaguauauucauugagcagaguaucugucacuaaagugaugcagcugccugggaccuagcacagacccuucaugccccuaauauguccauuccucucccuacauucaggauaggcagaauguugaaagaaaacaugguaaaagauaacuguagcaaagaauuggcaaaagagauggcagguguugaagaaacggaauuugucaagggucauauuggucagggucuucuauugccucccagagaguuuuccuuuuuccccauggacuacagguaaguagcacaugaauauucucaccauccaacacccaacucccuguccucccucuugaucuucuaagauacuccuguucaugaaagacuuccucccugaccuuccaaacuccaucaugucuccaguaacuacccaguuucuacuuccaguugccuuuacaguaccuguguguggucauuaugaagcuuccaccaacauuccugaacuugcuucucguuuguccuuggggaccugaaaucugggcauuuauugauuugauugaugcuagaaagggugggagaauccaaaacugccccuuucuuauaaaaaccuaagagccuacuaaguuguguauugaacagucuaaagucaguacaauaaaaacaugaagcauugucuuuuucggucauuguuuuuuccuaugcucuguugaaucucucuugaaaauaccucagggaaauuccacauuucgucagucacuucuauggauacuaaaguccagaccagcuaaauuuaauucugaacaaaauuugaaacucaaauucucccuugcacacaagcauuguccagguaucucccaggagacuggaguuggaaggggaauaugaugggcucuuucucucauucacuaccaccccuccaccuucuuccucaguagcccuuccuccuccauuguauugggagauggaaaaggggagggagaaucauuacacaugugacuguaccacuagccuccucuguuggcagguucugcggcagggcugucucugcuucuucuguguggcagguucugcaggagggcugucuuauagggugcuuuugugaguccuggaguaucuucaagcauuuuccuaacagcaugauuuccagacaugggaugagcagucggauuuaacccuucacguacucccuaagcuccuaccuucguuggcaccagccauggcuucucgauaaugaggucugucugcccaacagaaaaccauccuaagcacaacacuagcaagacuguggaagcuggucuuccuucuuagaugucaucugcuguuaugucucaauguccuguucuaucucuucaguuccuuuucuuuauucaacaauaggcucagagguuagaacaucaagucuacuacuacagcagacauucugcugggggauaaaaaugcugucuuucuuucuugaaggaaucucuaacaucuacaggcugucauugugaauccugcccuuucaauugaccucuguuguaggagaacaaccaguuucccucccauguacaagauuagggggagacuacaucauugucuuuuaggauaauaacuuuccuaucuaaaaaauucucaccaaaguucaaccuuccaaauauauagcugaaccagagaaauagaguucuauuuuuuuuucuuagcaagucuugcagagauuuucagcagcuuauccuaaguuuacuuuaguauauggggauaagaggcaucuacuauuuucaucuuuugacuucagccaacaucguaauacaagaagaaaauuugaguccaacaucuucuuacacacuggguccuaccagagcuuucucaggagaauagagcgguguaaauaucucaaaauacuauuuaaucugagggaaaaauucaaauccauauaagaaacuuaggcacguuggagguauauggcacuuucuggccacugcuucccauuuuccuuaagaauaacuuagcugcuugccauggaauuugauugucgcagacauggcaggaacagaauggagaaggaacugugaguuuuaagcaaagggagaagaauucuguuuguugacucauccuugauugcugauguggaauguccaaaaugcacuccaaggggcuaaaucugagguccugcagugccuguuccuauaguaccaauuggaaugacuaagucaugaaauuuuuccuggauucauccagccagagcagucucuguauuuccuugaugucuuugggccacaggaagccaaggcuccucaggaugggacucucaggacuagugauucucagggaggugcccuugugcuguaggggaagugacaagaucaugaucuuauagcuacuguuugucaucacgggacaaauccugugcgugugagaacuguggacaccugauuucaggaagaggagaguggugacaggagcaaucacuaagguagaagggagauuaaugagcucuccaggucuuguggggaggcuuucaagacaggcagucaagaauggggcuggaggaaagccuaacagucaucuauuguguuuuauaaaacagcgguaacacgauauauugaaugucauaggcaaggauuuuuuuuccuuugaaacuugcccaaaaugugugauuuauguuucuuucucaauuaacgcuuccaucuccuaccucccucagcugccaaugacucaggguugcaacccaugcaggaaaauggcuaucaugcuugcucuguugggaggacaagacuugcuuaugauaaauacaagauacagagaaauaaacguucagauuugcagcaaagucuaaaccccaguaauuuuuuaacugaauuuuucaacagauugugucccucuucaacuucaccaguauggaaugagaaaguacccauuucaaccaucaugaguaauuccuuccaaugcacuagcaauuuguguguucuaaagaaugcaaaagaaauggacaccuaguguagucccggggcuaagcccaaaaauaucccuucagcaagaggcuucugcaggcagaagaauaucagagaggggagucaaugacaggucugauccuuuuccucuuccuccauucccaagccacauuccuagagacaauucacuuucucuuaaauaucucaaaauaaaucauggaauucugccccccaccucccaccauguuuuaaagaggguaaguuguaaagugcauacucugauaaggaguuuguugucuaaaagccauaaacuaucaaguacagggagcaauaacaggcauuuaccauaaacauguguuauuuaaaauuaccauuuaacuuaaauuuaauguucuguuauaguucugacuuuaacuuuuuagaaacaaauagcaaaguucagguauuauaauaauagagaugaauucagugaaaaauucaugucuaaaacuauuauacaaucaaaugggaaaaauacaaaucagacuuuauaugucauccuacagaaaccuuagaauuuauaagguuuguuccauuaaauuugaugcacaugauguuacuaccaucacuaaccucaucaucaacaauacauugaacgaaucauguucaugacucacaccaacuaucuuacauauuuuaugcucauggaccauuuuauuugcuuauaaucaguaucauauaucccaugggaagcuaaauaugggcaaauugaccuuuuucauauuaaguaugagucuugugaucucaacuauuguauauuccuuaaugauuuugucugcuuauucauauaauccuaccuuaauucucuuaagggccccaacagccccagacagggcuugugucccauucuccauucauuaccuaauacaucucacucccaggguccaauagucucagaucacccaacauccccaagagucaggagccaauuacaucucaacaaaccaugccccuggggaauaugcagaggaauagggaagugauguccaaaaaaagacauccugggauacccaggacgaaucacaugauaucauaucagacacauaaguuuacaucucugauguuaguccaguuaacuuugaaaggcucaaggucaggaaaugugucauaugcaucuuuacauucucccucaaagugcaagaggcagagcucaaacuaaagcauccaaacugaaugagugaaaggagaagaaaugacagguccccaacacacguggagaucugucaucaagacuuccugguucccucuugccaggcaucuuggcaagcaugaagcaagaugcuggaggccugggaugggaguguuuggcucugccaccuccccuuguugugaaagcagcaugccuggucugugcaucucuaacccugcacaagauaaaaagccucuuaucuugggcuccucauccacagccuccuagagaacagccuucuccucuucagcaucuucuguaucuggcaaguaucuagcaggggacccucagcugggggugucuggggaagauaagcccagauuuuacuagggaagggggaagcagaggugucagauguacagacagcaggaagaggacuucagagggcagcugaggguaggggaaggggcagugagcaaggaaccucuuuggggugcaugggagucugugacucaccagagcccuggcucucagcauucucuccacucuuuuccugggagaugcauacaugcccagugauauucucugagaaucauuacucaauuaggugcuuuugcaucaguguuuuugugaagacaggaggacuugggacccaguuagaagacaccagcauucuuuucuggaagagggaaaaauggaaggaaaugucuuaccaggccaguuuuacuugagaucaguuucuguuuuuauuccugaagugcauaucucaggaagcaacugguauuaggaguaagggcuucauaaaaccauuuguagaggagacauuagccuggagcuuuugcguugaccuuuuccuuuuaucuauccaggcugucaccuccugccaagauguccugccagcagaaccagcagcagugccagccucugcccaagugccccucacccaagugccccccaaagagcucagcacagugucugccuccagccuccuccugcugugcuccaagaccugggugcugugguggccccagcucugagggcggcugcugccugagccaccacaggugcugcaggucccaccgaugccggcgccagagcuccaacuccugugacagaggcaguggucagcaagauggugccuccgacuguggcuauggcucuggaggcugcugcugaccuaauuccugaugcugagacaagcgacuuuagaggaaacaaguaucucaaggaaaaaggaaaagccccaacuuguuagauccuuucuuagacaugcuaauuaaccauucauucauggggaagaauugugcuuuuuccaaaaggcuccacccauguguuuuccaagaucguggaagccuccuuuccuccugacaauguuaucacuugugucugauuauacagagaaauaaagcuucugaacagcaccu

SEQ ID NO: 13718 - RNA, 4484 nt, Homo sapiens
gccgcgcgcacagagcucucagcgccgcucccagccacagccucccgcgccucgcucagcuccaacaugguaagccucacuuuucuucuucuucuucuuacaugaaaagaaaaagaaaagaaaaaaaacccacauacuucccagcagacuuuaucuuugacuuauguguggacguggcaggaaacagcaggaaaaaucagccucgugggagggaacuggggaagaagggauggaaggaugaagcccuaaaaucauccuugggguggccgccuaggguagcagcggagguucuuuagccuucccagucacgacaaggcccagggcuggggaagaggaagugcuggccgcucaccgcgcgggggggggacccgucgugggucacugccuccagccccucgcccgcggucucccgggagcccagagacgccuaggagcaaguuuaaggcagggggcuggaaagcugcgaggggucacuaguuauuucuguacaccagaaaagggacauuuuagaacuuggucgucuagccccagggaaaaucaaaguuucaguaagcacccggcagacggccaagacccaacgggacugaaacuuuagcccgucgccgcccgcagcgccgcggccaagaaugugggaggaacccggucccagcugagcccucuccuccuuccucuuccuuuuaccccaccaucuauuuaggcacucacuccguaacuuauuuuucucuucuuaucuccuuucaucucccaguugaacucauauuuuccauaauuccaccuccaaaaucucuuucuuuaccucuccuuaguggagagucagcaaacuggcccgcgggccaagucggguuuucuguucugcccacaagcuaagaauaaaguuuacauuuguaaaugauugaaagaaaucaaaagaagaaaaauacuuucugacaugugaaaauuauguggaaaucaaacuucagcguccauaaaugaaguauuggaacagagccacgcccauucccuuccauacugucugggguugcaguccugcuacagcagggacagaaagcuccggaggguguugguuaagaaugagaagacaauaguugagguuuuuaaaauugcuacgucuuuuucaucguauuuuuuucuuuccucaaauguugagcgcuuagcaugcauuuuuaaaaauuauuucacaguauccguuuaucauaauguuugcuccuugcuaucgccauccccaccaaguaagacuccaagagugccaugagguguggagagcgccgguucuccucuccuucagccacugcgccacccugggcagagcuuuccgguuucugggcguccucaggacccaucuccaaagugcccuggagcucuacaaauuaugccguuccauuuuaguaauuugauaauugugucucuuucuuucacuuuggagaauuaccucugggaggaaaugcaaagagguuuuaauuuucuccuuguggcugauagcaacagcaacaguuuucaaaagaaaauaaucucuaaauuacaccaagacugauguuaaggagagaaaaaugugaagcagaaaggcacugugaaacuggaaaagcaaaacugucugcauucuggaaggaaaaggggcagggggagaaucuguaguuccagagaaaggugacaaagcccaugcuccucagccugguguggccucccagccagucuccuuccugucaucugauaccuuaguaagacagggagauuuuaggccugauaugaagggcauguuguaacagaacaaacacaucuguuucuaggcugugguauuuuguuucuccccuaaaggccccugaaccuaccaacacuuuucuuaaugaaaaguucaauuuagagcaaaacaaaaacaaucauccuccaacaaugugauucuugggaaaaaguccaccucucuuaggguucagggguucuaacgcuguaagaugcaaugggaggcaagacucagcuaggaucucugcagcauaaaggcuguacaggaaggaggaaucaaucugcagcuguguagcuaagggcucagaucaguucuuagcacguguuaauuacggagugagaaagccucuagcucuggccuccaggaaguccauccuaagaacaaacgaaaggcuaaaugcuaaguugcaaaugucaccauccaaacauaaaucauuguuaacgcuaguagguaaagucucagaggaaggguguggccaggccgguuucccagaaagucuguaauugcggcuucuacccaccagagggaggccaacagcuccucacuuuugggacccuaaguccccuuggggaaccggaugacugggcccuauagaauuuccuugaaaaauucugcugugaggaaagagcccaguacaggauuuaaaucucuuacauuguagaugcuguguaagcagcaaccugagagcuuccugguuuggagugaccuccagagaagcuccaccuucucugucacuauuucccaccaggaaguggaagccugcaaggcuaaggacugcagaaagggacugggaggcccagauuccagggcuggcucugccauauccauucccuucuccuguccguuuccucacaucuaagauuaaugguuccuaacucuuaaauaugaaagccauuuucaaacaucuaaaaaguucuaucucccacugcauacacaaugauagcuaugcuuuuaguuuucucuaaggaaaugugugagucccaggaauucgguauugcuuuaaaaagaacugacauuucauuaaucacaaaagccuccauacacucuuggaaaauaagaaauuauuaaccuauagacaauguuuggugugcauauggauuuguggauauagaguuacacauguauuuauccacacauuuuaaaaauaugaguaaaccuugucaccgucacucucaucuaggcagucuacugcuuuuaaacgugccagcaaugcuccacauuuaccuuccauauauuucaccuggaauaaacauguggcgagggguaggacggaaggucacagagugugacuuuuugugguugucuugaaccccucagccccuugaaaaaaugacucagucuuuuaggaaacugcuuugaccugaaauaagagucccuggaguuuucuccaguauccagccuugacaucuucccuugucugagcccugcaauuuuuuuucuccaaaggcaaaaaucuccagcccuacagagacugagcggugcaucgagucccugauugcugucuuccagaaguaugcuggaaaggaugguuauaacuacacucucuccaagacagaguuccuaagcuucaugaauacagaacuagcugccuucacaaagguacuggucccugucucccccacuuccccaaacuacccacaacaugaaacaagacccuggcagaauggccaggaaugaaggagcagcaacugacaccccacacucuugcuucauuuuaacucacucuaagccaggaguuuuuccauuuaggaagagagauauaugaaaugguauaugacguaauggaauuauuuucaaauuucauuauucuaccccagagguucuauggcagcccuguccaguagaacuuucugcagugguggaaauacauucuauaucugcucuauccaacaugguagccaccagccacaugugucugcugagugcuugaaauguggcuagugugacuaacagacugacuuucuaaauuaguuaauguaaauguaaauguaaauagccauuuguaaccaguggcucuaagucuguaucuguguuggcagcuugggcaaguggaggaugagacugauuaggcagggccuguggccuuuuuccaccugaacccgcuguacuuuuauauaguuuaucuauuggaguugcaugcaacacuugaaagaaguguuccacuggcuuuacaaaacugaauagccccuaauaucauagaaagagcccuggacuaggagugggaaaaccuuugguucaaggcccaggucugccccuuaggcaggucacuucaccucuuuuagucuguuucugcaucuggcaaaugggaauauuaauaaucccuauccuguaccuuauacuccugugagaauaaaauguggcagcauauuugaaagcacauuagaagaugcgauauaaagguguaauuauuauuuucucugcagaaccagaaggacccugguguccuugaccgcaugaugaagaaacuggacaccaacagugauggucagcuagauuucucagaauuucuuaaucugauugguggccuagcuauggcuugccaugacuccuuccucaaggcugucccuucccagaagcggaccugaggaccccuuggcccuggccuucaaacccacccccuuuccuuccagccuuucugucaucaucuccacagcccacccauccccugagcacacuaaccaccucaugcaggccccaccugccaauaguaauaaagcaaugucacuuuuuuaaaacaugaacuagagag

SEQ ID NO: 13719 - RNA, 4484 nt, Homo sapiens
cucucuaguucauguuuuaaaaaagugacauugcuuuauuacuauuggcagguggggccugcaugaggugguuagugugcucaggggaugggugggcuguggagaugaugacagaaaggcuggaaggaaaggggguggguuugaaggccagggccaagggguccucagguccgcuucugggaagggacagccuugaggaaggagucauggcaagccauagcuaggccaccaaucagauuaagaaauucugagaaaucuagcugaccaucacuguugguguccaguuucuucaucaugcggucaaggacaccaggguccuucugguucugcagagaaaauaauaauuacaccuuuauaucgcaucuucuaaugugcuuucaaauaugcugccacauuuuauucucacaggaguauaagguacaggauagggauuauuaauauucccauuugccagaugcagaaacagacuaaaagaggugaagugaccugccuaaggggcagaccugggccuugaaccaaagguuuucccacuccuaguccagggcucuuucuaugauauuaggggcuauucaguuuuguaaagccaguggaacacuucuuucaaguguugcaugcaacuccaauagauaaacuauauaaaaguacagcggguucagguggaaaaaggccacaggcccugccuaaucagucucauccuccacuugcccaagcugccaacacagauacagacuuagagccacugguuacaaauggcuauuuacauuuacauuuacauuaacuaauuuagaaagucagucuguuagucacacuagccacauuucaagcacucagcagacacauguggcugguggcuaccauguuggauagagcagauauagaauguauuuccaccacugcagaaaguucuacuggacagggcugccauagaaccucugggguagaauaaugaaauuugaaaauaauuccauuacgucauauaccauuucauauaucucucuuccuaaauggaaaaacuccuggcuuagagugaguuaaaaugaagcaagaguguggggugucaguugcugcuccuucauuccuggccauucugccagggucuuguuucauguuguggguaguuuggggaagugggggagacagggaccaguaccuuugugaaggcagcuaguucuguauucaugaagcuuaggaacucugucuuggagagaguguaguuauaaccauccuuuccagcauacuucuggaagacagcaaucagggacucgaugcaccgcucagucucuguagggcuggagauuuuugccuuuggagaaaaaaaauugcagggcucagacaagggaagaugucaaggcuggauacuggagaaaacuccagggacucuuauuucaggucaaagcaguuuccuaaaagacugagucauuuuuucaaggggcugagggguucaagacaaccacaaaaagucacacucugugaccuuccguccuaccccucgccacauguuuauuccaggugaaauauauggaagguaaauguggagcauugcuggcacguuuaaaagcaguagacugccuagaugagagugacggugacaagguuuacucauauuuuuaaaauguguggauaaauacauguguaacucuauauccacaaauccauaugcacaccaaacauugucuauagguuaauaauuucuuauuuuccaagaguguauggaggcuuuugugauuaaugaaaugucaguucuuuuuaaagcaauaccgaauuccugggacucacacauuuccuuagagaaaacuaaaagcauagcuaucauuguguaugcagugggagauagaacuuuuuagauguuugaaaauggcuuucauauuuaagaguuaggaaccauuaaucuuagaugugaggaaacggacaggagaagggaauggauauggcagagccagcccuggaaucugggccucccagucccuuucugcaguccuuagccuugcaggcuuccacuuccuggugggaaauagugacagagaagguggagcuucucuggaggucacuccaaaccaggaagcucucagguugcugcuuacacagcaucuacaauguaagagauuuaaauccuguacugggcucuuuccucacagcagaauuuuucaaggaaauucuauagggcccagucauccgguuccccaaggggacuuagggucccaaaagugaggagcuguuggccucccucugguggguagaagccgcaauuacagacuuucugggaaaccggccuggccacacccuuccucugagacuuuaccuacuagcguuaacaaugauuuauguuuggauggugacauuugcaacuuagcauuuagccuuucguuuguucuuaggauggacuuccuggaggccagagcuagaggcuuucucacuccguaauuaacacgugcuaagaacugaucugagcccuuagcuacacagcugcagauugauuccuccuuccuguacagccuuuaugcugcagagauccuagcugagucuugccucccauugcaucuuacagcguuagaaccccugaacccuaagagagguggacuuuuucccaagaaucacauuguuggaggaugauuguuuuuguuuugcucuaaauugaacuuuucauuaagaaaaguguugguagguucaggggccuuuaggggagaaacaaaauaccacagccuagaaacagauguguuuguucuguuacaacaugcccuucauaucaggccuaaaaucucccugucuuacuaagguaucagaugacaggaaggagacuggcugggaggccacaccaggcugaggagcaugggcuuugucaccuuucucuggaacuacagauucucccccugccccuuuuccuuccagaaugcagacaguuuugcuuuuccaguuucacagugccuuucugcuucacauuuuucucuccuuaacaucagucuugguguaauuuagagauuauuuucuuuugaaaacuguugcuguugcuaucagccacaaggagaaaauuaaaaccucuuugcauuuccucccagagguaauucuccaaagugaaagaaagagacacaauuaucaaauuacuaaaauggaacggcauaauuuguagagcuccagggcacuuuggagauggguccugaggacgcccagaaaccggaaagcucugcccaggguggcgcaguggcugaaggagaggagaaccggcgcucuccacaccucauggcacucuuggagucuuacuugguggggauggcgauagcaaggagcaaacauuaugauaaacggauacugugaaauaauuuuuaaaaaugcaugcuaagcgcucaacauuugaggaaagaaaaaaauacgaugaaaaagacguagcaauuuuaaaaaccucaacuauugucuucucauucuuaaccaacacccuccggagcuuucugucccugcuguagcaggacugcaaccccagacaguauggaagggaaugggcguggcucuguuccaauacuucauuuauggacgcugaaguuugauuuccacauaauuuucacaugucagaaaguauuuuucuucuuuugauuucuuucaaucauuuacaaauguaaacuuuauucuuagcuugugggcagaacagaaaacccgacuuggcccgcgggccaguuugcugacucuccacuaaggagagguaaagaaagagauuuuggagguggaauuauggaaaauaugaguucaacugggagaugaaaggagauaagaagagaaaaauaaguuacggagugagugccuaaauagauggugggguaaaaggaagaggaaggaggagagggcucagcugggaccggguuccucccacauucuuggccgcggcgcugcgggcggcgacgggcuaaaguuucagucccguugggucuuggccgucugccgggugcuuacugaaacuuugauuuucccuggggcuagacgaccaaguucuaaaaugucccuuuucugguguacagaaauaacuagugaccccucgcagcuuuccagcccccugccuuaaacuugcuccuaggcgucucugggcucccgggagaccgcgggcgaggggcuggaggcagugacccacgacgggucccccccccgcgcggugagcggccagcacuuccucuuccccagcccugggccuugucgugacugggaaggcuaaagaaccuccgcugcuacccuaggcggccaccccaaggaugauuuuagggcuucauccuuccaucccuucuuccccaguucccucccacgaggcugauuuuuccugcuguuuccugccacguccacacauaagucaaagauaaagucugcugggaaguauguggguuuuuuuucuuuucuuuuucuuuucauguaagaagaagaagaagaaaagugaggcuuaccauguuggagcugagcgaggcgcgggaggcuguggcugggagcggcgcugagagcucugugcgcgcggc

SEQ ID NO: 13720 - RNA, 11352 nt, Homo sapiens
cgccaggcuccucccgcucccgcgccgccucccucuacccacccgccgcacguacuaaggaaggcgcacagcccgccgcgcucgccucuccgccccgcguccagcucgcccagcucgcccagcguccgccgcgccucggccaaggugagcuccgcccggcccacgcgccccuccuggguaguccccaggcccggaccugcugcccggggaaaacccugcacccggcuucgcggggcguccggagcaccgcggggcugggcggggagcggcugguggggaauccgcugcucagugcuccgggccacacccaaacgaggccagcagcgccccuccccggcccgggcgcggccgcccccagacccacgcggaccagaggagggggcacuuguucuuuaggaggggaccgugguauuggugcgccugaaccucuucccuccucccuuuauguuugcguugcuuuacucccaccuuuccuacuuucccacucgucucucggguuaccgaaucccuccuacacgccccugcccuggcuggcguguuucuugguggguuccgcucgcaggccgggucugcauguucguagccugcucccggcuguaccgcccaaguaggcgcggguaggacgaguaggcagcuggggcgucccuuccguaacccuuaguccgucggccaaacaggcguuucuggucggggcuuccuguugucugcucgacggaaagggucuuccugcugagggagggagguccacuuguuuucuuucuacagcaguuuggcugggguuugugggagagggcccugugugacgugguuucucuacugaaaggguucccuugcugucuuaauaaguggaaccagaaagagauggaggaagagcaggcuugaugaaggaucuuccaaucauagauuaauuuggcccggugcagugaaacagacagacgugccuuugguacuugguucaccaccugugcuuuggccgaaggaauggcgcugccccuagccguggacacugcugccuguccagccucaguccagcucugccuaagugaaaccaggagcucugccuuguuggcugggguggaaugcagagcgcuccaagccaggccagcacaggggagcccuaagccagauucugggaugcauuaagcccaccccguuuucugcccccacccaguuccgucucugcgggagcuucugcagggcgugguuagcacaaagggcuccaggauucucccaguggucugaggccugugacucagcugugagaccauguggguguggccgguugcagauacucucgguggaugguuuggacagaacacucccugaaggaaaaggagaacugugccaucucagagggcauuuuccaagaggaagugagucacaccuggucuggcugccagucugcaggagagguuucucgacugaacugccggugagggcaguaauuagaucugcagggccuuggcgagaccgcuuuucguuaucggccaguaugcgccuggcagccugccucagccuuacuugggagguagcuuuucccgcuaagagguuugcaguuguugcggauauuuuuccccagaagcuugaguuucagucuccaggaauggaguuuuauguugugcguuuuaggugaggccaggcucauggaaacacccagucggugaucuuugccuccaacauguuucagcaaauugcaaaagauaaugccagggguuggagugggaaugaguucauauaacuuauuggaaguuucuucaucggcccugcccccacagauuccuauccaguuucucuuuaaucaucccuuccaaaugguguauuuguuccuucacagccagaggauaguuucuucacuguggcccuugauccaccauuuggaguuucuuaucuagguucuuacaauuuuuuuggucuacugggcaugaagcaauuuuugggucuuacccugcuuucugggugaugcucuuccuagcuuuucuccgacacaucauauaggccccuuuccucccgugugcuggccagccuccuaagcagccacuccagugaggucaggguggagcugagacugugugccucccugcuuucuacugacaguucaaaaaaugugacuuuuguagagcacaacccacuugguauacccuuggacacaguccagucuuuuaaagcguaaaguugagagaaacaauggaauucuuucaggauuauaauguauaaauuagcacucaaagugcugagaaagcuggacuaaaauuuuaacaucuuaaguuucucauuuuucuggggacucaacaaauuuaggaauccacaucaaaagcaaaaagaaagaauguacuucuuuuaaacaauuuucagcacuuucuaucccuuuacuaaauaaauaccacccauccuaccaaaggauuuaacuaaaagcaguuuugacaguagcuauguuggcugauuaggcugaugccuaagcauucuuuaaggaaaaauugauguaguugguuagauugaaggagguuucuuccaaguucuuucuuccuauugaauugcaucugaaacguuccuuugcugcccaguucuuuagugggcaaguuuuaguuggugagaggugagagagacagccuggauccagauccauugcuucaacucauuuuuucugaauucccuucagagaucaaauuuaagaaugccuucuggguucaauuuuaaaaacuccaaaauuucuaaagcaaaaggaaggaaaccucaaacauauuuuaaauaacagauguuuguuuuuacugacacccugccguuuauuuucugggugggcuguaagaaaacuaggguauggacaagacacagaggagcaaagcaaguccgacucacucugcagaaguguccucuuugaaacugcagccgggaucugggcauagguccaaagcaaacauuugagauuuuucaggagcagacacuuuucugaggaggacuccugcuugucugcuacucgcaggacaaccaaaauacaucauuaucaauuucuuaacaauucaucgagcaggcucuaugagggcuggggcacuggcuauugggacccugcucaaaaaaccugcaaccuagugaggaaagaaacagaaacacaaauaacuagaauucaggccaaaugcuuuaauaguauuccauuagcuggugaacuccucaaaggcaagcaccauggagagcuuugugugugugugcauguguguaugugugugugaacacccucaugccuaacaccaugucugggacauucaaaguaggugcucagggagggagaaccaaaaauggaaaauugaauuccuccuaagguaacuaaauuuguggaguccagaauuguuuuccauagagaaaacuaugcagagaaagaugucuccgccucccuucuuaagaccuguugcucagacaaacauguagagggcauguauaggcaucagauuagaauacuucaauaaaaggugaguggacagcaaggcuguuauuauccuguggagcucagcagugagauagcagcacuagaaaagcaaaaaguagaagaugggaugaaugaaacacgagaaaauagcaaguguuagaagagaaggagcacagucaugucauucugacuagaccuguuuagcaggacacauauuuuuccuuuugcguauggaaugugcacuccuguguacucuaucuacuguuccguucauaguugaacacuuuuggggccccuuuccuggcccuucccagcucucacaucguccuccugagcucugagcuacaaggcuuucagccuaguccuggguaaucacaccugcaccucagcuacugcccaagggauugugugguucauuuaugcacauaacaguuauauagugcuccaugaauaaaagcagaauaauuuguaguucuuaaucaagagaagcuuaaaucucaggcagacaaguaaacaauuaaaugaaauugaauguuucaggugcaagaguacguuauuggggauagagaggacacugcagccccucagccccagccccaaggcccuccugucaaaaugugucuaaccaggaugcaggaagcccacaucuguccaggaauagagcuugcagaguggcuacgugaggguggaaaugccagauugaagucccugaagaacuucaguuuuggcagcuagcagugcugcagacagcccugcccaggcaagccccacccaagaacggagggccaggcagggcugacucaguugggcaaccauuggcugcacucagacaagaguuacaugauucauccucuagccaagagaacagaguuuuaaucacaacauuucccccuuuccuuugucuuauuuuaaagccagugugcaacuccuuccccaaaacagaguuccuugcuguggcccuggucagugcccuuugggguacugguugcugaggagacaagggcuucuccacugauuuucaaugcuauuuucaccuccuggcuacucccuccucugcauccuuauugcagaaggccuacuggacacacagggagucagcuggcugcaauauucacaauccauccacugaauaaaaccgcugggggaggaggggaggggaagaccaagugggagaaggauguaacuucagagaaggaagcuccgucacuucguaauggcugugggcaagagaggcaugcgacugagugacuucagaccuaagcacucacacagugugagguagacucaccuugcucuccugaagaagauacucaaggguggccaggauuuccucagcugacaacuuguauuucuuagaaccuccuaaaauuagccuuuuuaaaauuuagagguccuuacccugcugcauucccuuucuuaauucugcacuuuccuucuguccugucaucugaaaaaaguaaacuagguaccccacccaguuccaauuucugggaucuuugggaauugauccugaagugcucugcugcucugaacuugagcacagguauuuuuaaaccucuguggugucugacuccuuuccugaguuauuuaagaacuggggugggaucccacguccuucucccagaggugacucgcccaguucaguucucuuaaauugcuggacuuggaguaccaguccaggcaaggcagacucucuguaagcccacugccaucugaaacccauaugagggaugggggaugagccagaucugagcugugucagaagagaaggaaaagggugugguuccccuggaauucaucucacagcagaccuugaagcauuaauuugcagcucucuccaagauaacuaacugccuuucagaugacucaugccagauucugauuuauagcauucuuuggccugcugguucccauacuuuucuggagauuaagggguagaauuuacaauucuuaaguguuaauugcucaauccucauguuuacccacuccaccuucuccucuguaaaagauagcauuugagaaucaguguugaacaggcaucucucagagauaggaaccagaccaaagcaugucucagguucccauuagagcucuucagcagaggaauuugccagcccuucaaucuaagcucaaagccuauucuugugauuauuuauuuuuauuuuuuagugcuauauuacagucuccauucacguucaccuguuuccuauccaguagugauuuuaggugauauuagccaaagcuuaucuguucucgccaaaugauuccuuccaauuaagccaaaauucacugagguucuauuaaguaccacguacugggucuugugagacauauaccccuaguucauuauacccaaauguaaugaucugacauguuuccuuuccuuucuuauaaacgcuucaugaugaaagcucuugcuuucccacuguaccccagacugugagagcagcucaucugucuaaugucacuaaaaacauaggaggcccucaaaugaguuagguuauaguauuacuuguugcuucucaagugaacuagacaauggacuuugaguaguuuucuguuuggguagagcaacuguauuuuacugccagagaugcaacugucuuuauugcaguaaauaacaaguucagagcuuuaguaaagaauacauauaggccgggcauaguggcucacgccuguaaucccagcacuuugggaggccgaggugggcggaucacgaggucaggagaucgagaccacggugaaaccccaucucuacuaaaaauacaaaaaaauuagucgggcgcgguggcgggcaccuguagucccagcuacucgggaggcugaggcaggagaaugccgugaauccaggaagcggagcuugcagcgagccgagauggcgccacugcacuccagccugggcaacagagcaagacuccgucucaaaaaaaaaaaaaaaaaaagaauacauauauacccagcagauaaauucauuuguaagcagauuucuaaacccuagaaucacacugaaccaaguuaccacuuuaagcuuagaagggugaaguuuucguauuuaccagacuugacuguguggauuguuaguaucagccauaucuaagaaucccauuuacuagugccaagagaaauuaugaacuaucuguucuuucaguaggugcuuugucaguuaaaaagaggaacacugggccgggcgcaguggccuguaaucccagcacuuugggaggccgaggugggcggaucaccugaagucaggaguuugagaccagccugcucaacauggcaaaacuccgccucuacuaaaaauacaaaaaauuagccggacaugguggcggacgccuguaaucccagcuaccugggaggcggagguugcagugagccaagaucacaacacugcacuccagccugggcaacaagagcaaagcuccgucucaaaaaaaaaaaaaaaaaaaaaaaaaagaggaacacugauguugcuuuucuaaauuauuaguuucuauucuucauuagauuauucaugcaaauuagcuggaguuagcuaaaccccuuuauuuacagcaccaguaucugaggugucuauuucuaccaacaagggacccaaacugggguggacugguucuuagauucauucacugaauuuuaaagcuggagaagaucagauggaugaucuaaucuccaucuuuccaauuauccuaaaaaggcuggcaauacauauggcuuaaaaguuaauguaaaucuacaaagaugaaccuggaggacguuacgcuuagugaaauaagccaagcacagaaagacaauuaccagaugaucucacucauguggaaucuuaaacacugaauuucauagaacuaaagaauagaaugggcuggggugauugcauuugagugauguugaggagcuauuggucaaaagauugaaaauuucaguuaggaggaauaaguuuaagagaucuacuguacaacaacgugacuauaguuaauuacaauguauuguauucuugacaaauaguuaagaguggcuaaguguucucaccacagaagugcuaacuaugggagguaaugcauauguuaauuagcuagauucagucaucccacaauguauauauaccugaaaacaucauguuguacacauuaaauacauacaauuuuaucuuucaauuuaaaaaaaauaaauucaugcauaaagucugccaaaaaaaguuaauguagacccuguuacuuuacauccuuuaauaggcuucaacggaccacaccaaaaugccaucucaaauggaacacgccauggaaaccaugauguuuacauuucacaaauucgcuggggauaaaggcuacuuaacaaaggaggaccugagaguacucauggaaaaggaguucccuggauuuuuggaaguaaguguugaaaagcuuacaaagaaccagacauaaaagucaaugcuucuaggccuugguuccuuuuccuucuuguuuccaucccuucccuguggaggucaccacuagugaauaaaugaauguagucaccugaaggaaugaaugaaugaccucauucauucauuuauuaaauaguauugaguaccugcuauuuguaagauacuguugaggaaacaaaguaaugaagacacagccccaaccuucaaggagcuuacagucugcaggugaaauaagacugcauacaaauaaccacaauaugagcuguuuguuggaaaauuccaucggguuaucugugucuguugugacgauguuggggacagaguugggagaaagaaagcuuuucacaaaagaguagucaaccagaaaauggcuaccuucagguccaaaaaccuggugguggagaugccacauccuggucacauuccauuuugagcaacucgaaucucccuucuuaaaucucuucagauaaagggauuguuuuuucuuuuucuaauacuacaaaggagcagugucagucaucuacugaauaaaagccacauaucacuccagaaauaacugcuuuucacauaauaaugcucugacagcacaggagcaguuugaauuuaugucucaccuuugacagacugagagaugcaugaagaccuauaagaggacucugccaucagcucagauacaucacucaggacauggggccacaaggcacaguuguccuuuuauauuccagguucucgagagguggcuguugaauucaacugaaggugcaacauugcaugacaaaauaguagacugaaaugcaagcccuucuuucccuaccacaauuguagucaccugaaaagauuguuucugugcuugguguugaauaaugcauuaaccuguaaagggugagaggagauacgguaaaacguuggguccugccucuugucaucugacugguaaacggcacauuaguccagccccugacuccugcaaucaauaaacaugaggcuuuuuaguauacuauaauucguaugucaucaauaucaguuaaauaaacagauauaaauagccuaacugcucucucagagcugcaguuauuaccuaaugcuaucccagaaugaguuagaauaugcagguccucugcuuuuguagaguccugugauauagccccagaccaggaguuagaagaucuggcucugccuuaacuaacaaugggcagguugcuucagcucucuagucuucaguuuccuccccuguaaaauuagagagggcuggacauaauuaucugcaaggucacuuucacuuucuaugaucauucaagacaagcauuaagaugcaaggacaaaaugugcucauuguaagccugccuguccuauagacaaaggcauucucaguacacuaaacacuuguuaagaguguuguuaagagccagagugaguaucauguaagacacagacccuuucuuccuaaaggcuuuguggcaucagacacauaaaggguauauguaguguggagcacuaaccauggcaggguaauuuauuccaggcacagagucauaauucuggaaacaucuagacucacugcauuaacagagcauuuuguuucuaaaguagaccucuuaugucauccagauuucacucauucugaccacagccaggaagcugagggugaagccagaauuagcugaaacccaccaagagcugcauagagcacguuuagcuagaguaggaguuugcagugcucaugugggaaaugcugcugcuauacuuuuaggaauuucugagugcaauuuagaaacaucuagcacacuugaaacacugcguaucauuuuccucacucaugaauauagucaucagaauucauaaauaguuuaccugagcccuuuaacaaccucaaauaggccauauuucucucucugguugauggcauggacccuacaggaaaaaccacaccuuaccgcuucugaccagcaucacuacaaaaaggagugcugaagccaaucaccauguaagcaagauaaaagcaaagggggucuugccugcccaucucuguuccauacauucuuaccaggcacugagagucauggggaguuuaagacuccaucccacauacuccuuuugaaacugguccaguguacaacauccagugaagaguauaggauggcauagacuuaccaacucaaagaaugaaaggauucuagaaacauuauaguccaaccuccucaauucaucguugauacacaaaggcccacuaagcugugugguucacucagcaucacguggcuaauaugauaugaagccacacuagcuuguccucagcugugccaagaaugagagcugccuucuccaaaccuaaaaccaacccauggcaucauuaacaccucuuuaaaauccauaggacagugauccaaaacuuauucccuaaaucauaaauaucuuuucauaaggaguuuccuuuguaagggauuugaccaugccauuaggaauaaaauuuuaauaagagaauguaaguuuaaaccauaaaaugaggagcuuagggugguucuuaggcagaaucuaaauaugaaauuacugaaaugcucccacaaggcaaaaaaaaaaaaaaauacauuuagaugaacuccaaagguugcuuaugaccuaaaacaagagcucaaguaauugggagauauauacacaguucucagcaguacaaaucaaauaagcuccucauugcaaccuuugacuucuauuucuugccuuuguucuuuuuuuuuucagaaucaaaaagacccucuggcuguggacaaaauaaugaaggaccuggaccaguguagagauggcaaagugggcuuccagagcuucuuuucccuaauugcgggccucaccauugcaugcaaugacuauuuuguaguacacaugaagcagaagggaaagaaguaggcagaaaugagcaguucgcuccucccugauaagaguugucccaaagggucgcuuaaggaaucugccccacagcuucccccauagaaggauuucaugagcagaucaggacacuuagcaaauguaaaaauaaaaucuaacucucauuugacaagcagagaaagaaaaguuaaauaccagauaagcuuuugauuuuuguauuguuugcauccccuugcccucaauaaauaaaguucuuuuuuaguuccaaauuugagacagaauguuuguuguucccucagaaauucuuguuccccaagaggcagcuugcccuugggcagccagcacacagcagagcuuuucuuacacagcagagcuuuucucacagaacuggcaaaaugagaaaacacucuucauucaggcuuggagucugacuucucuaauuguucugcccuuguagcugugucuauaugaaggacucaaacuugaaggauuaggagaaggcucuacaggaauagaugguaaguuuauaauuacugggcacaguuuugcccaguuaaaucagugcuuuucuagccagcacuuugcaugccugcaaugucugaauccaauuuucauagcaaagugucagcaaaccuaaggc

SEQ ID NO: 13721 - RNA, 11100 nt, Homo sapiens
aggugaguguugugcaagauucugucaacauuucuggccagaauaccaugaacaugguaaagguuccugagugccggcuggcagaugaguuaggaggacugugggagaauucccgguucacagacugcugcuuguguguugccggccaggaauuccaggcucacaaggcuaucuuagcagguugguauuuauucaugaggaauuuuauaguuuuggugaaauaaggaaaaacaagugauugcauaaucaccuuuugaacaacuucaacuuuuugaacucaacuacaaaacaaacugcagcuaaauauaucuuuguauuccgguaacaaugcucagaaccaaaaaagcugcucucuaaaaugacauuucuguuuuuccucucuguaguggaccuaggccaucauuuucaaggcauggaugaugauguacaaagguauugaaugccuuugccccuagagaguagaugucagagcaccaguuaagagcagguaucaaccccuagauaaggguuuaggauguaauggagaggauucuauacucaggacuaaaugccaucuagcuaguccucagcccuggagggguuagcccucuuuucaauuuaaacauacuagaagaaugaaacucuugccccugacauggaggaucaggucuugcuuuaauaggcccaugguuuucaagaccagggagauugacaccaaggaggaacugaugaggaaggacugacuucaccgcccagggaaggguaacaaucaccguauacuucucuuaagaccauaagaccuaacaggaaauugugugaaccuucaaguaacacacuucuuacuaagacccuccgcuccgucauucuaaaguacacaccugguaaaaccucagacugccucagucuaaacauuuuccuguucccucucacaacuggcuguuacuguguaauacucaaggaagucacgggcgcgguggcucaugccugucaucccagcacuuugggaggcugaggcggguggaucaccugaagucaggaguucgagaccagccuggucaacauggugaaaccccaugucuacuaaaaauacaaaaauuagcugggcaucguggcaugcgccuguaauaccagcugcuccagaggcugagacaggagaaucgcuugaacccuggaggcggagguugcagugagccgagaucaugccacugcacuccagccugggcaacagagcaagacucugucucgggggaaaaaaaaacaaaacucaaggaagucuauaacucuuugguuagugucuccacacuuagcuaggcccucaacacugccaauaguuuuucuacagauguuuaggcaacucccuuucuuaacgauagcugucucaaaccuuaaccacucuuuaacuccuuccaaacuccuaaaagauuaccuugccuacuuccuccaagagaaaaggaggcccuuuuguaggaacuuccucaacucuugcuucuuaccucaccugcauucucaguggagguguucuuccucguggacaaagcagacuuuuuuucuaccucugcucuguuuuauaucccaucuugccuucucagaaaccuuacucuaccgguuauacccuugcuaucuaucuaguaucuucacuaucucucuguuauugccucuucaccuucagccuguacaggcuccaagcuucucccucuaguuauucucucucucuuuuccccagaacugaguuucuugaguuagcauauucacuuucuacuuccuuuccucccacuuauccucaguucaccuccaugcuaugaaagcaguuuuucaaaauuacaugaucuacugguuccuaaauuugaaggacuuuaguucauauacuaggacuccucucuccugauucucugguugcuucugauguguggucuccuuacuucuuccucaccaaucccuuuauacauuggugagcccugaggaucugcuucaguuccguuuucauuccacuucuucucccugagugauuucauuuauucccguugcaucagcugcugccuauuuaccgaggacccucaagaccuggcugcuuuggacccuuccuucuuuaugaaaagcaccgggccuuuagucuuuaauuucugaaauauauuuauuuaguucucuauggucuguaacccuucugaaauaagaacaaugagaauugauauccuuucgguagaaauuaaaauacugaaguucagaggguuaagugauuugcccaagaauaugugguuagaaaauggcagagcuaggccgggugcaguggcucaugccuauaaucccagcacuuugggaggcauaggugugcagaugacuugaggucaggaguucgacaccagccuggccaacaugguaaaaccccaucucuacuaaaaauacaaaaauuagccaggcguggugguggguaccuguaauuccagcuacuugggaggcugaggcaggagaauugcuugaacucaggaggcagacguugcaaugagccaagaucaugccacugcacuccacucuagccuaggcaacagagcaagacuuuugucucagaaagaaaaaaaaaaaaauggcagagcuaaaauuagugcuuucugacauaaacuauaggccaaaauuuccaguucucuguuagcucaaaaccuuucuacuauauauuuuguccauucuuucacucuuagguaaucguuggaucucagcuuucaccagaaccccugauuuauuugacaacaugaacaaauuugaguucuuagccauucuauuacuuuucgugguugagauuauuauuuuucaugguguucauuggacuagaaugagcaugaguuggagcacuguuucucaaccuuccaaccuucauuaucccugccucuaaggagaaaaacuaaauuuaaauucucccugaugagagaaauaaaauacuaaggaagaagauuuuaucagguaggguugugcuuuaaagggacacaaaucauuauaauaucuaaaguuucuuuccccccccaccucuuuggggcaauaucaucucuguuaggaaugcauagcuuagaaaaacagacaguuugccauaggugagcaugcgcuucaucugguuaguggaugccauugagcccaguucuugaccuucuuccugugcagucccuggaggugcagaaaguauggugucaguuccaacaaaaacauagguauuagaacacccugcuugaucauaagggaccuuccauuugaaccccaaaucuauacagagaacauagcauuaucauccaacauagauaaguaauuuucuugaaaugugaaugguuggaguagagccgauaaguuauuuuggaaguagugguuucuuauuuuccuuuauguauuauaauuaguuacuuauuguuauaauauaugaagaaaggaauuuuguaauucugauguaaauugagguagagaccuuuccuauagcaguaggauagguuagaaaaugaucucucccucaugacuggcaacaaccaagagauuucacugugauagccuuaucugcuuguuucucuuugacuuuguagcucguucuccgguuuuuagugccauguuugaacaugaaauggaggagagcaaaaagguauguaacaagaugaagacaugucuguuuagccagguaucuagagucagaugauuucccacuuuagcugcagauucauuuuccuaauuacuuuuuucuuacuaaaauggaguaugagucccuaaacuccuucugagagcagagagaagugguguagaaguauuauggguaaagcagauugacuuauuaaaugaggcugaucauccacacaguuuugggugaggguauuuagacauauauguuuuuacucagaaaacugaggaaaagaaaggugaaaaaaucgaagaguuguuuugcuguuauguuuaagaaaacaaagauggaacaugugauggacgaaaaggcuauuauaaucaagccgggcaaagaaauuuuccauuaauguuagguuuuaaaugauacaaaguucucuccucacuagagcuuaaaaucaugaaaauaguuuaguuuagggauuuuguucuguuggaauguuucucauauucaguuuuucuggcauagaaucgaguugaaaucaaugauguggagccugaaguuuuuaaggaaaugaugugcuucauuuacacggggaaggcuccaaaccucgacaaaauggcugaugauuugcuggcagcugcugacaagguaagauaagaauagaaaaauaaucaggacuaggaguuauugugacuucuuguguuucaugaacaggauucuauguugcauuguggguaaaaugagcauauaucuugguuuggccaagacgguccugguuuacacauauuauuccaacacaauuauuaauagcacacuuuuuauucucaaaaguguccuguuuugaauaguaaacuauaugaucaccuaacuaugggaaagaaggauaaguuugacuucuaccucuccucuuuuuuccaucucaaauuuaaccacagugauaguaaagauucaaauaauacuaacauuuggauugugcuuuauaauuuacaaaauguuuuugaguuuauuaauguauuuaaacuuuaucaguaaaacagcccuuuguauccauguggacucaaccaaucucagaucacaaauauuugagaaaaaagaaacaagaggccaggcacaguggcucaugccuguaaucccagcacuuaucggaggccgaggcagguggaucaccugagcucaggaguuugagaccagccugggcaacguggcgaaaccccaucucuacuaaaaaauacaagaauuagcuaggcaugauggugcacacuuguagucccagcuacucaggaggcugaggcaagaggaucgcuugaacccaggaggcagaguuugcagugagcugagaucgugccacuccagccugggcaacagagcaagacucugucuccaaaaaaaaaaaaaaaaaaaagaaaaaagaaacaagaaaaaacaggcugggcacaguggugcugggugugcagugccuccagccuauaaucccagcacuuggggaggccaaggaggaaggaucgcuugagcccaggaguucaaggccagccugggcaacauagacuccaucccuacaaaaauaaaaauaaaaaaauuuagccaagugugauggugcacgcccauagucccagcuacuugagaagcugaggugggaggaucacuugagcccaggagguugaggccacagugagccaugauugcaccauugcauuccagccugggugacagaacgagaccuuguuucaaaaaaauaaauuaaaaaaauacaaauaaaaaaccaaaauaguauaacaacuauuuacauagcauuuauauuguauuaauuaguauagauaauauagggcuaauuuaaaguauacaggaggauauacauaaagauacagggaaauacugccuauuuauuuguuuguuuauuuuuuuuuuuuugagaagggagucuugcuuuugucacccaggcuggagugcaauggcacgaucucggcucacugcaaccuccaccucccagguucaagugauucuccugccucagccuccugaauagcugggauuacaggcgcccgccaccaucccuggcuaauuuuuguauuuuaaguagagaugggguuucgccauguuggucaggcuggucucaaacuccugaccucaagugauccgcccaccucugccucccaaagugcugggauuacaggugugagccacugcaccuggucuauuuauuuacuuuuugagacagagucucauucuguugcccaggcuggagugcaguggcacaaucucggcucacugcaaccuccgccucccagguucaagcaguucuccugccucagccucccgaguagcugagauuacaggcaugcaccaccacacccagcuaauuguuguauauguaguagagacaggguuucaccauguuggccaggcugcucucgaacuccugaccucaagugguccgcccaccucagccucccaaagugcugaaauuaugggugugagccaccauggcuggccaauacugucaauuuauauaagugacuugagcauucacagauuuugguauuugcggggcccuggacccagucccccaaggauagugaggcauggccguaaucuuuuaccuaguguccugguuagcauuuucaacuuuuaccuuaguaguuauugaaauaaacaguauuucuucaaaauuaugagagaauuaauagcuuaauaguagaauaaauuguacuucaugacacauuucaauuugagaaguguucaaguguggaaauaaaaaugcagaucuuagaaucaaagacauaugaugauuaccuaaaauaauucggucagugauucccaaaauaaggugaaauaucaacagauauuagguuggugggaaagucuuaugaaaaauacugaguuuaaccaagacaaauaguugcuaucuuacugcaggauuucucagaacauguagcauauuaauguuacugugaauuuucuaacaggaauuaugauagacagcauuucuccaauuuaguuaacccuggaauccuuuuucucaaggaucaccugcaagauuagugguccccaaaacgcacauugggaaacggacuuucauuguuuagguacaucagagagagaacucaauggucugcccuucuaggcccugcggucuguggaaacaugaccuguggggaagggugaaagaauugguguuuacccugugggagcuuuuccuguguuggcggacaaguagaguuggcgugaggaugggagaagggcguagauccugccagcaguagacccugugagaaagaggguuaucugccaaaagcaccuccuuuuccugcugugaugcugcaauacccauuggagggaaaagugggcucuggucuaaggacacaagagccuuccaggguuugcucaugggauagucuccuaccucccuuugugccugaggacagaggaaagugccuguguuuauaguggagguuuuaucuuuauugaucagcuuuuggaguguauguggaggauggggcagguaaaugccaucagugcuccugaugaagaagauuggaauaauaaccguaucuuucuugucacuuuucaagacuuuaugaguacaaugaagcaaugugaaaauuccauacccuuccagucuaccucaauucugaccaggggaaacuugcuuuuaauggagacaguaagaaaauauucacugcaagcucugggaaaguagaagacacaauccaauaacugccuuuuauaaaguuaauuaugauucugccugaucugugcucugauuuuuaaggaaguggucacuuguacuuauacacaucauguguuuauccucucaucuucuagauuccauaaggauaaguauugcaaggcccacuuuuuagacagaaauacuaaggcucagaguuguauauccgcagagccaagauuaaacuucugccaugucccuuaguuuucauucuugcucccuagccagaaaaccuacugguaaccuacuguaaguacacagggcauggugaucagccugaacugccauuucaaggauagcauuucagcacaauguguuaacuugugguuuuaaaagauaaagcuguugaaucacggcagugcuuuaaauuuaugaaugagaaguaauugaaggguguauuuucaaauuccauucagaauuuccaacuagacaguuuuugcuucaagccuauuugaaaacguuuuuaccuuuacaccucuucgugaguuuuaggaaaacagaauaagaaaucuuucauggaaugaucuaaacaucuagaauuuacccaagaggcugaaacagcuucucuuaagcuuuuccagucuccuggggacauguguaauuagaccaaaaacaacaaaacucguugggcuaggccugggagacacaauuuccaucucuuggguaaguacugccauuaggcagguuuuucagaagcauaauuaagaaaaaacuuuguccccaagggacaagaauggcuacuuuugucuaauuaugcaauagggaucagagcuauucacaguaaaaguccuuuuaaaagaauguauugagaaaggauaagaggaaucgucugggcagcacuguauaaaaaacugaacauuucagccuuuuaaaacaaaaacggcaacuucauuucuugcuuaucuaauguuauuccuguuuuccauggaaacuguuuuccaguuacucaaauguaaaaaauuaaagcugcaccaaaaccaauaaaaccucucuuuuuugcugcaggagaucacagugccagcagauaugccuccucacccagaauucauaacaauuaaauuguccugauuugauugccaugauucacccugaaggggcauugugucauugaguucuggggccuucaagcuggggccuauaaggagacugugcauagccucaaagcaaacuguuuuccugugaacugaucaaugacauuuuauuuugugccuccuuguauuuccuuccucuuuccuaucccucaaguuccuaguaaguucauaaucucauauuagagaacaagugguagagcuguaucugaaccaaucaaguagaucagaugugcccagcauuaaccuaggcuuuccauuucaagaacauuuaugcccuuuucuuagaaaauacaaguuuuuaaacugaaguuuuuaaacugaaacugcauuuaggcucucugccacuuuguccuuuuacccugagaagcuuaaccucaaccccaguaaaauaagacucuauuuauccuucucuauuuaaaaggaggccuuuaguugacccucauucagaaacaacuaguggcagagguguugguaaaagucaccacagggcuccuuuucacaaccugaugggccaguugggauaucuugcugggcuagugacagugcuuaagucaaaaggacugugcuucacccucuucuggcucuaaggggauugcaguaaauaagggauuucacaggguagacaccaauucuuucacccuuccccacagaucauguuuccacagaccgcagggccuagaagggcagaccauugaguugcccuguugacgugaagcagacugaugccucacuguaauuguaaguggugaagguuuaagaacaacuuucaucacagucaggaggagaguaaacuucaggaugcagaucuacccuguaauugccauuuuucuaauagguagacuuuagaacucuaauggcagcuuuccaaguuacuuuagcuguuuacauuucaagcuuaaacaucuaaccuucagaaaugguuauguuuuaucauugcaguaguagcuuuucauggucugugcaguucuauucaaguaucuaguuaauaugaugguacagcuaaagaaaacagcuucaguaguggucagcccagaacuauugcugcucugaugacagcagugcuuguguuuuacaguaugcccuggagcgcuuaaaggucaugugugaggaugcccucugcaguaaccuguccguggagaacgcugcagaaauucucauccuggccgaccuccacagugcagaucaguugaaaacucaggcaguggauuucaucaacuagugaguuggcaucuucaaaguucuucuuucaaaauaguuggauagcugaagaaaugagaaaggcuuugaauuaguggguaaagcaggcaaguagcuucauuaaccuuuuggcaguaagaauagaguuuucaucuuuuccuucaguugaccguauggaauugacuucauggguugaauccuauuggugaguaaaguguuuuacuuccucauagugaaucgaagugaugaaaauaacuugcuggccugaaaaagcuguaugccccaaaugauaguaucuuuacuucacacugagugacuuaauaaaagacauguagauuucuaggaggauagacauauguuuaugaguuaguaaaauguaccucauguuugguuguagaauaaggaaaaaagaagggaucaucaguagcugguuucacuguuuugagaaagaaauguucauuccacuaggucuguuccuucaucuuaagugacaaaugaccuggaaauacuacuuucugaaauaauaauauggaauaauaauaauaugaaauaauaagaauaauaauaugaaagaugaguuguaacuacaacccaucuucucagugggacauguucuacucccuugccccauggagagagcaaaagcuggaaaaaacccaaagaagaaaaucccucacaacagcaguucuggggcaggacaggucugagacauuccagguggaugagugaacaauauucaacauagaaaauucccaaagacaggaaauaacauccucuaggucuaguuguagaauuauuuucuaaggagugaucaagugaggcagaagagggaggggagagacccaucagugugaguuccuuugagugcuuacugugugcuggacacuugcuuggugcuuuugagauauuaaccauugaaugaaguaugguuauccuccccucuuuuuugauaaucaaguaggccccaggcucugaucugcccugugguuaaaggcuggugaguggcaaagccaggcagaagcucagggcuucuggccgagggagcccaugcuccuuuuuaugacuagcaucaccggugaauauaaggaacauaggcaguguugggggccuggggaacauucugcuuuuuguuuuugagaauauaguggcucaaagucuugguuuucagaugacgacagccacaggcaagucaccagucugcucauugucuaacaagcaaauucuuaugcauauuaaggguucuucuguuucuugcauugacacccuuuauaccuaacaguggaaaauuaggcuaucuagguggcuguugaauucaucccuugcucacucccuuugguaacccauuucuccacauuucuccuagucaugcuucggaugucuuggagaccucuggguggaagucaaugguggugucacauccccacuugguggcugaggcauaccgcucucuggcuucagcacagugcccuuuucugggacccccacgcaaacgccugaagcaauccuaagauccugcuuguuguaag

SEQ ID NO: 13722 - RNA, 1983 nt, Homo sapiens
cuaaggacaaggggacauuuuauuagcaaaaauaaauacaagccgggcaggguggaaagaauguggacugcagacacaguggagacguccugaggaagccaggggcucaggcuacaggcugagaugggugggcgccagggaugacccgggaccuagucccccacccagcgggggcagcagcgcaaugaggggcgucucgcacucccccagcagcacaucccugcgaagucccgcgccccugucuagcaccuuggcucucaggcugcgggcggccagguccggggggccgagcccgucgaaaaagaaauccucguugaagaugggguuggcgcugcacuugaccacgcggcucugcugcucccgcggccggacgcggggccgcagccucagcaccacacagcagccgccgccgccgcucccggggcgggaccgcggccggggcaggcccucggcgcucacuaggcgcagccgcagccgcccgggcccggccugauauucgguggagagccgcagcugcccgccgcggggccccaggcgcagcacgcucucgcgcgugggccgcagcuggcagcacaggaaguccagguggaagagcggcggcgugggcggcccggcgcggcgcggcgagugcgggcugguaucggccgagcucgcuuuuucuggggacagagagugaggccuggacacccggcgccggcccaggccuggccgcggggagccgaagggcgacgaguccggcgacgaggccgugucgcugucgggggcccggcagaggcgcagguccggggcggagacgugcagccgggacugcgccgcggggagucccccggccggggcagguggcggcccguggaacagggauucccgccggcgcgugugcgggcucucgggcaggaaggcccagccuucgcggcccgccaggugaggcagcgagcaggucgcggggaggccgcgccccgccacgugccgccgggccgcgggcacugcgccgcccggguccgggagccgaggcgggaugaagaacugcgggaugcgauccggggugaggacguuggggcaggcgcuugugggcgggcccggggcgcgacgcuuggagaacaggccggaaggcgcccaacgggccgcaggcuccgcggcccccaccuuauagccagcuuuuuccaagagccacaugcggugggugggguaauggaauuccgaauuccgcagggccgagaggguccaaaucccgucucagaugggagugcucggcggagcggggcugggcgaggagcgcagaggagucagaggugagugaugcuggcguacaccgggcggucagccaccgcgccccggucuccggacccacugggagcgcggaccccuauuugagcagaaaaagaaagggcggcgcagucuggggggcuggggagaaauggagggagcaaagggccagucagucacauuuucauauacgggccuccgucaccaaguacacagauucucccacugguacuaaagaugccccauucaccuuacaguuagagggcccauauaguauccaccagaacccuaggguacuauuaggacaaauaggauaauaaccgcauuauagcaaaaggacucagaucccaaccccccugggacacugcgcccuaggcgggcucacgcccuccucccccgcccauuucgaagacuuggguuuuccucugggauccagucuggcgccccuugggacuuccucccuuugccaggcugccccggcucaagcuucucuggccugagccaucccucaguccuagccccaccugccuccucuggcuccuccuuccccuccucgagucgcuccaagccagaagaggacucacuucugcuccuggcagccaggggacacaccuggcugcugaccucaggacacccugggcugguccaaggagacgcaccucccggggacacagaaucccacccccaguagcccugaccguccagcucccgcgccuccca

SEQ ID NO: 13723 - RNA, 15325 nt, Homo sapiens
cuuuggaaucugacaaacuggguucaacuccuacagccaugccuuacuggcuuugugacuccagggaaguuaguuaaccuuccaagccuccuuuucccaucuauaaaauuauauccuaccuaggcugggcgugguggcucaugccuguaaucugagcacuucgggaggccaaggcaggagguuugcuugagcccagggguucgagaccagccugggcaacauagcaagacccugucuacaaaaaaaaacaccauuuuuaaaaaugagcugggcgugguggugcagccgcuuauaguccuaacuacuugggaggcugagacaggaggauccccugaaccaggaguucaagguugcagugagcuaugaucucaccaucacacuccagcuugagugacagagugagacccuguuucaaaguaaauaaguaaaauaaauaaacuauagccugccucacaagguuguuaggagguaaaaugaggaaaugcacaauaaggacuuggaacagaaucacauauggagcagugguuaguaaaugguggugucacaacuggcucccaguauccacacuggccucugugcagaaauggagguccagaugugagacugcaaguccucagccuucagagggacagagcuggauacaggggagagcccccgacaggggagaucuccuugugccgaacucugcaggacauuccagaauuaagccccaaagaagggcugaaggacaggaucaugaagccaugaacaaggccuggaugcugcucaaaagcaagggcccggccuucccugaugggauuuucucucucaaaccucauucucuaccucccucccccuucccaguguggguagggaacaauccccuacccucaaccuuccaagacucuuauuugaugcuuuuaaacuuuuuucuuuauuuagacagaaaagaccaacucuuuaaaaguaaaaugcaauaaauaaauaaguuaagcauagagaacugucugaaacugacuccccggucuccccuuaccacccccacccccaccccauuuucuuuucccuaaaaccucuuccuaaagaaaaugaucagguaauaaaccccuugaccccuccccacaccccuccucccaauacccaauuaccccccaaagcaaagggagaaauuaagagagagaaaaaaauccaagggcaacauugucuaaacucccagaaagagagauggcagcguccgggccaggccgggcgggcuggauaacgcacgggugguagugguauuuacacagagggaaccagcagagacuguaaacauuuuuagggguucaggggaaggucuuuuccucgugaaaggaggagggucucuguggcugacuggcagagaggcagcccucagggcucccccacacccuccuuagagggggcccuugggggaggcagugaguuuuaaggcugggagcccaggaaucagggauauccuaccucuagcugaggguggaggggagugagagccagcuuccaagaaaccccuaauguggggaagaggcuggggugagggugagcugggaguguguggcaggccccugcggcucuccuggggccugcacggguagaacaggcccacuguugggggaggcaaguacaaacgcuggguacagaaggccugucacaggagcccagcagaaggcagauaccccggagccuucgagccuguuccucgcucccucacaaaggccaaaagggcaucuaggaggaaaugggcccuuggagccagggaagcauagccauggcccuucagagaggcaggggggugggaggggccggugucuugugcccccgggggccacgaagcagcguuugccccagaacccagucaaggcccagggcaggugugcggagagggccggggccagucgugggaagagggugugaggcgccccuuccucugggaucuccagaccugugaaggaagaaacaugggugaagcauggggaagagacccccgaugcggaucacgggcucugggggaggggagggggcuggggugagugacagcaucuaggauggggcugccugaggaaggcagaucaucaggccucaguccaaacggacccaucugcccccacccccagccaugagagcagggauagaggagacaggagggagggggcaaaccauacaggaaaccaaacgguauuaggaaggaaauagauagcccaugagaaaaauaaagacuggagggggagagaggcaaagagaugacaacagacaggcaggcagagaaaucgagagagagacagagaagggggugcguguaagagacagacaccuggaaaaagaaagggaacacccgcagagaaggccagggcagagcccaggucacggcucagggauggagucucauggggugagaccacccccggcccccaguuagugcucucauuccuuuuuggaaaggaacacagaaagcaagagaaaugcacagaacacagaccacagucaccaaccacuguagaccaagcacgucccgcgagcugcccccggcccugaccuugggcuugggggugcuucccuccgcggccccuccccaaagaacaaacaaucggcuccaaagacaacacgcucguuccaugcaacuuacaggggcccggagcagggguccggggaugggggcuucggccgacaauggacacgggcccugggcugggggggcccccaggguugggggaguuaagcagccaggauuggggggaaaggggagaaacagaaaauguggguauuuuucuuggguuguguuuucucaaggguuugguccaaaggagauuaaacagugcgaaaguaaccaaggcucacagcucuguggccaugagguugaggugguggccagcaaugggguggaggagaccuaaguaaacuucacaggcggcgcgacauuucaaccucuuccaccuaaaccagagcaacucccaagaggccugaaaaugggcucccccagucuguccugugcacucugcugccccaugggucugcugcuacaugggaaaaaucaccugaaguccagggaaaccagggcugauguccucacuucucaggacaacagagauucuaggagccaaggauucuagggcccucuggcacccucagccaaccccuuaauccuccaguccuguuccccuaauuccacucuaacccgaaggaaaaccagaaagagacacacacagacauggacacugaccagacaaacgagaccagauauuguggaagguccagggaguggacacauauauacaaagacuuggcucuuucuggggucacggagggugugugugugugagagagagagagagagagagagugacucagauuauugaaaaacagcugagggagcugccccagcccccugcuucaagugcccagggucaaggguggggugggcaucccugagggugguggaggacagggguuggggguguaguccaaucgagggcccuggcugcagugugugaagcuggggagggaggccacaacggagcgggacccaccugggggcccucaguagggccgguuggcauccuuaggccgcuuuagcuggacuuugaggcgcuucaugccgaucuggaagccauucauggccuggauggcagccugggcacuggccggauugucgaaacucacaaagccuggggugagaggggcauaaggcccggcccagccccaccucgcucuuccgugcuuaggagaccucuggcacuacccugugucucccaagugucccaaaugccuagaaagcugccugccacauagcagcauuccuuaggaauuuguugauugauggguugaauggaugaauccaguccagccacuccaacuaccacauucuucccagcauucugugccagugaccccuuccucugccuggauagcucugagccugcccuuugaaaacggccacuuccagacccuaaauggcuucugaagcagagaagaacauucccuuucuccccugaggaagacuuucaaagaugugaaggcagcuaaaaccgacuccccaagcccaccuuuugcaaaccaaacauccccagaccauaagccuauuucagaccucaugggacaugaauuuggccaguuuuuaagagaaacgcugaaggaagaagagaugggccgaggcagcagcuggguguggcauguugggugugucaaaauggcucuuuuguacucuuggauaaucaguauuucaaauacuggguccacugugaccauaaaugccuucaaauauauuagaccuuguccugauuuggaguauggcaaaaaaugugccauaucauauucuuaccaaaacauuugcuuugauugguggcucggucaacaaagacuuuggcugagaugacguggccaaaggggacaaacaucuggaggaucucugagucagugaacuccuggggcaggugguagaugaagauguugcagccaucagggccuggguggcgacagagacagaagaaagagcucagugacugggaggcacacaccccagaagcaaaugucccagggaaagcagauccugggagugcccuccagucccaguccuugacagugugggccaagucuccggccacucccuccccacuugcuuucauccugacacgugggcaagagcugggcucagcgcggggugacagggaguccccaagcccauaacgagggcauuccugucucccaaggccccagccagcaccuucucuuugcugcugcugcuguugcugcugcugcugcugcugcugcuguugaggugguggugggggcugcugggcgaccagggcuggaggcugcgggaacgcaggugcaaccaggcuguaggcugcuggguaggcugcugggguggggagaagagagaggcugauggggcuucccugacuucuugagcccucccagccaacccugucucccuuccccuagcccaggccaguggcaccugcagggcugagagguggucagggaaggagcugccucagaccccugggugugcugcccuuaaagaccccuccccacaguugggcuugucaguaaagccugaagagggugauuggcagggagccaagaagcccagacccaguuacugggccucuuuuccuccugccaccucucccaccugagcaggggcccuggcuagggcgccucaccuguguagugcugcauccccgcguaggccugcugcaggggguccacgggggccgcggggcucugggcuggggagagcagcacagacuaugagcguggaccuggcacacagugggggcccucagugccucucugggccucugggccgaggccaggcagguggggagcagagcuucucugggcauggggugugaagugagaaggcagaaaugcacaaagcagugggaagaggggaaagagcccagcguuaggaagacuugggucugacugucuugcaacccuggacaggucgcuucacugcucuacaccucagcuuccuggccgagcccaacaggaaggaucauccccgcccaggauggcagggcaggaggaagcaccuguacccccaaagcugggagggaagguguguccugccucccuaaugggaguggugguuuagaugguugcugggacggagugggcaggcagagagucccaccuggguaggggugaaccccguugggauacagagcaucaggggcaggcugcccagugggcugggugggcaccgggcuguagccguugacgcccagggcagccggaauggcagagacaggcguggcagcgauggcaggaggggugcugguuccuggggaggagaaagcgacagggagagagcagaggagcagacacacacacaggcagagaaccagucagcaagucugugggcagaggggaggaagcaggccucucugaccccugagucccucccagaccccgaggcuucccugagcaaugcccugugccccucccuaccccuaccaugcuuagcucccuugcccggccuugcccaggccauaccugaggauggggugauggggguggcgaugaggccauuggcauugauggcagccaugugcugcaucugcacggcagccaugguggccauggggcugagguaggcacugugagccgcuaccagggccgccugcugcugcaucagcuggggggaggggagaggagaguggggcaggcccccugugcccaagccuggcucccucccagcccggggccuuggcaucgggagggugggggcaagauacagggggucaggagggcuggcccggcaucaggggcagugcucacggccuggguguaggcgcuguaggcuccaaacuggagggcgauggggcugaacaugcccaacuggguggccaccugcugcaugcggcggagaccucgcuccuucucagugucagcaaacuucaccaccaggcuggacgaggcacccugggcacgggcccacacacaggucagaggugcagggucagggucucuccuccccaaagcccucaggaccuggucuccauuccacccccauggcauggcuuggccucucugagagggcggccaccauuuugcguaugaaagauggggagauauuaaucccacucucucccuaugcuaggaugugcaagaggcuagaagaaaaaaugaggaaugugaaggcacaugcuuggaaagugaaaagccuacuggaaugaaaagggcaucauuggcuacucugugaggacucugaacuggaaaucauccccacccuggguugccacagcaaauguuuaaucucaggcuagucuucccuuguagcugcccugcgugccuuaccacgacuccugcccccacaccccaguccucauggugugccucaaaucuuaauacuagucugagcugaauaaaaaccaaauuggagcauuugcaaggaugaugguagaauccuagaaucucaaagcuggaaggggcauagggucauuggacacaguucucuacccaaugcuguguccccuccaccaaggccccgugaaaugucugcccagccuuugcuggagagcugugaguuaugggaagugcacagccuucugagucagccaguuccaauuuagaggugggcucuagacuggucacugaccuaacgcugcugugcaggggcagggaagaggggugcacguggggccucuaagcaaguguccuggcgccccagcaaaugaggguagggggauaugggaaggcuggagaagagacgggggugaagggagggcuggggaauggagggagaaggagagggaugugagggaauuuggcugaagguggauggggaauaggggaggaguggggagguggggaagugccauuugaaaugugagggugucccuaagcaguuugguucuucugccaggacauuccuuuccaauaaauucaaauagcccauccugaguggacugcuucucugggccagggccuggcaggugggcagggugggaaggagaggcccgggggcaggggaguggggcucacuggcaggguccggcugcugugaaggguguugauggccgccugggccucagcgugggucuggaacuucacgaaggcgcagccuggagagguugagauggaggaggagagggguaagcacccaucccugcgggaccccgcgguggaacccgaugccuagggagucuuggggguggaacaggaaggggaagggcccgguggggaagggggaaguggguggacuaccuuugcuggugccaucuggcccccggagcacagugcacucgucgauggucccgaagggcucaaacaucuuccggacguccucaucugucugcugcuucccuagcauccccacaaagagcuuccggucuucugggugguagggcacaggaggagggcauguucagggccuccuggcugccuucccagcccuucuuccgcccuucccuggagcuccuaacacuacuucugcuacccuuaggguccaauggcuguaggggcugaugguuggggaaugggguauaguugcagagggugcucaucccagcucugagggacucgcacuccacccugggccucaguuuugccaucuguacccgccccagaucucacccgcucuggccacacugacuccuaucucaccgcagcugggaacucuucagaaucaucaggcuuucucccucaagaaaggcuaccccucgacaacuccaggcccugggccugggggugggaggagagggacagaguccaaaggcacagaaccuaccuccucggcucucgcugucggcuggcuugaccuggaucggccuguucaucugaaggagagaagagaaggcagcugcuggggaccuccucugaacacccaagagcccucccaggccaggcccugcagagagacuagaggggcaagccccaggcccucuaaguuucugaugggaaggaagggacagggccuaauacuguucaggaugaaggccugaggggaucagaggcacagagagagaggauguagagggagaggcucaugggcacagcuccaggcucagguugggcuccugaugacuuggccagggaugggugcugcuguccugagugggagaagggggccugcacauaggacccggggccugagagagagcccgaccaaggaguuauuuaauaagaauugccucaauucuacaaagugggcgcaacagaggccacucugaagaagccccaaggaggacucuagacugagggagaccccacaaaggcccagacuuccuucugaccucuagaggugugucugccucucuuucugccccccuauaccccuugaccccagggggaaggcacucgggcagcacaaagggagcagaugcccagucuccguggcaacgggagaaugcgcaccauggcaaccgcccacucagccugauuuauccguccccgucgcccuggcgaccguggugacgucaucacuucugcugcuccacacacccagagaaggagugggguggggggugguuaacaggguaugcuggggguggaggauuuggugggggcugggaggugggggaggggcccagaaaaccuuccugauucuggagggaggcuugcagagcaggcccugcaggggccaucccaucccuucuccugccucccuccuccagagcaaauccuuggugccuggagggcucuaaaggaggaguugcugucccgugcuccuucgcaauuuacccugugcacggaaguccuccagagcucuaaccucuccccgaccccugcaguaucucccuuuguucagucuucaguggaaauggagaaauuccuaguuccacucuccauguucuugucuggugagaggacuuggaaauuacuccugcagguugauuuucuuaaccaggguggggaguauuauaggaacuggagaaagaggagaaggacuuaguauuuagugucugaaaauauuuugcucuugaggacucugacagcuggaaccacaccugguugccccacucaucugaugguggggcaguaguuccagugaccagaaaaauuaaaccucaauuuacauucugagggugaggcuagagguacccucaggaaagguacuggacugggagucaggagaccuggauuugaggacuagcccugcccugccacuuacuagcugggcgaccuuggacaagccacuaguccccucuggaccucaacuuccuuaucuguaaaacaagggggugggccaggcgaugucuaaucagguuccggucagcuccaggcuccagcauguggagauccuguguguggcaucacuuagcgccgagaagugcagaagucacaguugccccugccccuucucacccuggauccucacccaggugucgcaucaugccagucagucuggccgacuccaccaguuagguauucccggccucggaccaaaccuaagccccaccucaacugauacuccuuucccagggccccacccccgccccccaaaucucuggaucugagagcagcuggugaggagggaggguaacagucauacaaauccuccagccaaucugcccccagcuuuaucacccgccaaucugggauuaucccaucggaggcucaaucuccuuaggcaugugugugcgggugcgcaugcgcaagcaaagcgugucgugggggcagaugcucagggugcaugggcuuucaccuccuucucuccugugcucuagccaaagcacucaggaaauucccucacaggcaccuccgcagccaggcacccaccccuacacccacgccaaaagaagcagaaucagaaccaggguugggggauucuuacgcuuggcgcuagcccccuucccagcaggccuggggauuugcuguucuagauggagaugggaaccugggacccagagagaaaggaugcaguucccuccuggcauaggcucccaggcacaaaaauagcaucucgagaaauacccacggcugauguggauucgcacaaagagacacacaaguguacagaccacagcaaggaccgugcugacgguaggcucccccuacacccucacagacaggacccuuggcgcuccaguguccccuucccagccuccuucuucguggccuggcacuuccuguggggagcucaggcuucguuagcucagcucagacacaccugcccccuccccugaguccagcugugcccuguuuaccuggcaaccaggcgcagcaccuuuccucccuaguuacuacccaccaggugacaagcccucccucgggccucccaaagaaggaguggcuauuuauaccccaacccaguauagccgagccccuccaccacggucacuuuuaaggccuucaucuuucucgccaauagcaaaaacuccacuuccaagaagaccucacaguucucacaaaaucuaauucuuuugaggguacagccugggguccugccacuccuggcuccacacuuguucccggcgucccagaccacucacagguucucuccguggggccagaauccaccuuccugacugcagaccgacagggaaggcccaugucccccaagugggauuuugguucagggugaagggggaagagcuggacagagggcaacccccacuccaccaccuccaugaugccacacccugcucagaggacaaauucagggaccuguggcagagccacuccugggaacucuuaggggagagaaaaggaaauggggcucaacagcuauaggcccagcccccauucuuucucuuucccucugcagcccaaaauaucacccuaguaugguagcaccuucuagauuuuuggggugacagagauggggagcaaggagagggggcuaaaugucugauuuuuuuaaaaaaaccugcaguaggaaggcauggagauuaaacaguaggaagaacaguuaugcaggagcugacacacugcacacacaugcgugugcaugcacacacacucaugcaugcacacacacacugcaugcacacacacgugcaaacacacacugaggggagaaugcagguagcaggagaagacuuagggaagacaaagggucacagacaucugcuccccacaacugcccugggucuguuccuucaaaccccuuggaugggggucccucuuggaggauggaacccucauuuccuacuggaagcugugucaggucccucuggauucuguccccugggacaagggcuaaaguggagaauucagcgucaccuagaagcucuggagaagggcuagacaaucauuaaccaggcgcccuucuuccucacccccacccugggcuggacuuccucaagaagggcagguggugccucuccacacccaggauggagcucugccugagcugccaggcagcuggaggggcacagaccuaggguggacaccugcagcugguacacaugaccuuuggggcucaugcccauccccaggcugucucucauccaugucuccacuccaguccucuuuaucuaccuuuuccucugacccccucucauuucugcaggggcucugagauagggagacaacagaaaaagacaaacagcgauggagaugaaaacuguugauuugugaggggccuccacagagaaaaacagggaaggcaaguugggacuggauggggaccaagcuucccagggauacgugugcccaaaccccacacaucuggccugucaagagcucacaugccugugugcacaaacacacgcucgccuuggguccugcagcucacacacgugcauggcccuuaacucuggcugugacaggcaaugccuauucuugacacugacugggauaagaucuuuggugggcguggggguuuggguggauuugccgcaguuggcuuugcuuuccuagcaguacucaaagguugaggccauggaagggcuugggacaaucagcaaggcuggcugggaagaagacacaaagagauaggaccuugcaggagaggggccaccucugaggccaccccugccucccugggcauaccugguggcaucaggccugauccucuacaaugucugucccugcccuugccugcuacuuccaggccuaccuccagcccagaccugcccaggccugcccaggcccugcucuacccugaugcucuguggcucuguuccugggacucuuccugggagacagaagggagaugagagcucaagaaccagcaccgagaugccaaucuagccggcaccagcugccuguucucugggcacuccucccucaucucacagccacccagccugccuuuccagagugacaaaagagugccugggugcccccugcucacccugauccacacuugguguccagagacuuuuccccacaccuuccaaccagcgaguccucccucuaguguugccccaugggcagcuugggaaguggggaaggggcugcaucugcuccugguaaaagucauguuuacgccacuaaucgcugcuuuccuucucuccagguaacaagaaaugcaugcaucuacagcaagaaagauggaugcuacagagagagagggggacuuccuggugaugagaggagguggaaauuaugcucagugucaggaggguggugagccuccugccacuucuauggcccuucucaguccccuggcccugcaaagggcaggacucaccccuggaagcgucuucuguucgugcagggcgcucugggccuucagggcugaaucccgggcacaguaugucaggaaggcacauccugaggaggggcaggggcagagaaacacggcggggggugaguccuccaucuccccucucugaaaggcucccuuccaaagacugacgacugggaagcuuucccuucuugucaucuucugccugcugggguagagaggugucuccaagggguagacucucugccccagaaguggggcagacaccuggaggccuaaauacugguggugaugggagagggaggacacuugggcugucaggagaugggcuuuguguagggagagaaggaccaugugaccgccagacaaguaagaguaguguggcuuucucuccugcugagcuguucuccuuuccccucucucccucaccuccaccucccuccaucuugaucaccaucaucccucucuucucccauuuucccuauuuccucaucucuccccaccuccaccauaggcagguggaggacggagagugaaauagagaagggaagggaagaacaguuaguuagccggaagugccucuucccugugccagguggagggggagcugguguggccccugggauccccgguguguggagcucuccaagugcugacccugaccgcccccacuuagccgcacagcccuuggauaggccugaggagcacccucccuucucccccacucucuuaacuuucuaagccucccacacuuuccagaucuuuaccaaucuccagccuucaugcccugcuuccuagucccucucuuuaguccuggagcugcccugcccaguccagcuccacgcuuuccacauugaacaccugacccuguguccugacccccaucccaauauuaucugaggcugcucagauucucagucuugcugcacacgcacacacacacacaccccuacccagcugcuuaucucccaaaccagcucucuugucccuccauucuuucuugaguucaucccaugacaucaacacacccauaugucugggauccacaucuuugcagccgucuugacaacucuucagccaaaagaggcccuccuuaguccuucaccgggguuuccugaucacucuagcugaguucuuuuucagcuccuccauccacuuuccucaggccugaacucuucuccuuccacaucagcccuucccagccgcuccaccccuccagccuggcuuaacuucccccagccucccagcccaccccgaagccucuucagccugcccgaccccucacccuugugcagcccgguguacuuguccuugaugacagucagcucaaagauccgaccaaacuguucgaagaugggcuucagguccuucuccuccagaugccucgggaucugccccacaaacagcuugauggcauccggcuccuucauugaggcggcccaggaggaggggccgaggggagcagggagaggcccaaaggccaaggggagcugcccagcaaggagauaagugguggggcccgggggcccagcuggggcuggcuuucccuuuggcccccaaccacgcugcuaagcagaggggcggcucuucacacaaaggaggcccagggaguugagugcuaggggucaggggucuaggcagacgcugucaugccaccagggggcaucgccuaaacaaacgaucucccucccagagaucuggcaaaugucccaggaugggggugaguauggccaagaccuggaggguuaggugguagccgggggugcuagggcuuagagggcugggaacugggaguugagaugagagcuggaggcggggaaagggccugaggagggugauggggaggagacugagggguuaaggggccugcuaugguugccagcagcgucaguaaggggggcccacuccugauguggggcaggugaaucucucguuggcuucccugggaggacaccuccccuguggcggauccuucugcuggguccgaagaucccugaugccagaugcuugaucucugauggcggcagggcuccaggggucccuuuugcccugccgccccccuucagguccuccccucagccccccucccacccccaccccaguccccgggccugggcugcugccggcugcucccgccgcuggggcugccugcuuucccggucaccugggucccggagcucugcucuccggccgcgcucuccucaacaaaaaccuccccccuccacaccccccuccccacuccca

SEQ ID NO: 13724 - RNA, 306 nt, Homo sapiens
cagggucugcggaaggggcggcaggugccauguccggccacgaagguggcaagaagaagccaccgaaacagcccaagaagcaggccaaggagauggacgaggaagacaaggcuuucaagcagaaacaaaaagaggagcagaagaaacucgaggagcuaaaagcgaaggccgcggggaaggggcccuuggccacagguggaauuaagaaaucuggcgaaaagcaagcuguuccuugugccugaggagauggugacccuuuauuucauccguauuuaaacuucucuauucccugccauaacaucuuuu

SEQ ID NO: 13725 - RNA, 502 nt, Homo sapiens
gucuuuuuuuuuuugaaggcaauuuuauaacuuuauuugauguauuugacgaucagcgauuaguucucauccacauugacuguagauuuucaaaaguggcaacagguacauagguaaccaaaguauagagcuuauuuggugaaucuucauccucauuacguuuucgggacagccgcacacggauucgguaugggacauucuuauuccuuuggcccagacagcuuuguugagccugauaucaaugcgcgcaucuggaguucccaucuccuucaugccaaauuuccgaagcucuuugagugcccgaggggcacacuucuugaagcccacuccauggaugugcuugugaauguugaugguguauucucgggucaccaccucguugauggcagaacggcccuuuuauucuugccacccuucuuugcgggagccauucugccggguccaaguuggaaaggaagagcgcgagggauugagggagaaggaaagccgagaaucuauguca

SEQ ID NO: 13726 - RNA, 502 nt, Homo sapiens
ugacauagauucucggcuuuccuucucccucaaucccucgcgcucuuccuuuccaacuuggacccggcagaauggcucccgcaaagaaggguggcaagaauaaaagggccguucugccaucaacgagguggugacccgagaauacaccaucaacauucacaagcacauccauggagugggcuucaagaagugugccccucgggcacucaaagagcuucggaaauuuggcaugaaggagaugggaacuccagaugcgcgcauugauaucaggcucaacaaagcugucugggccaaaggaauaagaaugucccauaccgaauccgugugcggcugucccgaaaacguaaugaggaugaagauucaccaaauaagcucuauacuuugguuaccuauguaccuguugccacuuuugaaaaucuacagucaauguggaugagaacuaaucgcugaucgucaaauacaucaaauaaaguuauaaaauugccuucaaaaaaaaaaagac

SEQ ID NO: 13727 - RNA, 23992 nt, Homo sapiens
cagugcccucaccucgagacccuucagcugccgggcccugucguccugggaacgcuucuuguucucugccucuugcuccagccccugcagucgcugggccaguagcucuuuguccagccgggcugugucccgcucagccugggaugccugcagggccugccgcagccucuggaucugggcaggggguaaaaaugccacagcucaguguagugagaaggugaggguugaggggcaggagcaguccagcccagugggcagaaacauuucaucacugucacucuuuagaauuaccaguggcaugaugacaauaaaaagcaaacugacuuuucauccauuuucuuuuuuuuucauuuuuuagauggagucucgcucugucgcccaggcuggaguacaguggugcgaucucagcuuacagcaaucuccaccucccagguucaagugauucuccugccucggccucccgaguagcugggacuacaggcaugugccaccacgcuuggcuaauuuuuuguauuuuuaguagagacgggguuucaccguguuagccaagauggucucaaucuccugaccucgugaucugcccgccacagccucccaaagugcugggauuacaggcaagagccacugcaccugcccucauuaauuuccuuuauuguuuuuguuuuuguuuuuugagauggagucuugcucugucgcccaggcuggaaugcaguggcacaaucgcggcucacugcaaccuccaccucccagguucaagcaauucuccugccucagccuccugaguagcugggacuacaggcaugcaccaccacgcucagcuaauuuuuguauuuuuaguaaagacaagguuucaccauguuggccaggcuggucuugaacaccugaccucaugaucugcccgccucagccucccaacgugcugggauuacaggcgugagccaccguccucagcuucuuuauuguuuuuaaagucucuacacaacuuggaaucaccugaggaguuuuuuuaaauucugauccuggaucccauccccagagaugaugacugaagugguaugggauacagccuggguguggggauuuuuaaaaaucuccucagguggcucuaagcuacagaauuugaaaaucacugcucuacagacaauauauuccuccacccugcaagucauuagaccuaaaccugggccccagggacccuuggccacagguucaguuaagaggcaaggaccgggcugggcgcaguggcucaugccuguuauccuagcauuuugggaggccgaggagggcggaucacgaggucaggagauugagaccauccuggcuaacacggugaaaccccgucucuacugaaaauauaaaaaauuagccaggcgugguggcaggcaccuguagucccagcuacuugugaggcugaggcaggagaauggugugaaccccggaggcagagcuugcagugagccaagaucgcgccacugaacuccagccugggcgacagagugagacucugucucggacaaaaaaaaaaaaaaaaaaaaagaggcaaggaccuucaaacccaaggauauuagacuucuaccucauccugaagucggcucaguccuccagaggucuucucagccucacuggcccaauccuuggccuggcgcugggcaucugccaccucccgccgggccuuuuccuuauaauccuccagcugggccuggagcugcugcagggcuugcuuagaguccuccccgaucuucuccaacugaaacacagagaaaagggucuucagcacuguacauaaaugacccucuccaggcccagacucccaagacucuccccuaagggucuccuuccugacaaggcagcccucucuugcucuuuccugggccuagguuccuaguauagcuaauaguuauauacagaugucuggguucaaauccuggcucuaccacuuacuggugaccaugugcaaguuacuuaucucucugggucucagucccccaucuguaaaaugggauuaaaaauaguaacuauaucacaagguguugugagaauuacauuaguuaauuaugugaaguucuguacuuacaacagugccugauacaaaguaagccuuaaaugaccauuucagcaaacccaaggugccaaugauuauacggcguaccacuaagaaaaauaugccaauuaaacuauaacauaccauaagguauaagacacaacucuauuucagaaaugauaaaaugugcauuuuucauugacaaaugauaagaugugcauuuuucauugacaaaugauaagaugugcauuuuucauugacaaaugauaagaugugcauuuuucauugacaaaugauaaaaugugcacuuuagaauugauguaacauauuacguguuugcucuugcuuuacaaaaagauugggaggagaaccuuagcagcaaaagcaauuuauuuccuuuucuuuuuucuuucuuuucuccuuccccucacccaaauuuaaaauucuaccaaugaagauuuuuuuuuuugacaggcucuugcuguagcgcaguggggcagucacagcucacugcagccucaaccuccugggcucaagcaauccuacgucagccuuccgaguagcugggaauacagaugucuggguucaaauccuggcucuaccacuaauuagcaaccauaggcaaguuacuuaucuucucugggucucaauuccccaucuauaaagagaaacugaggaacaagccaccacagcaggcuaauuuuauuuuuaaguagagacagagucuuauuauguugcccaagcuggccauugaagauucuuguauuuagguuuuguagacucccaagggagaaucccaggagauguucuccaagaaugaagaccauaaaggaauaggauguaagggaaagagcaaaaacauggaggggagguaggaaggaugccccuuccagaagauuuggucuuggucuuccuaacaaugaacuugaggaaagcaaacaucacacauucuuuuuuuuuuuuucuuaagacagagucuugcucugucacccaggcugaagugcaguggcaugaucucgccucacugcaaccuccaccuuccgggugcaagugacucuccugcaucacccuccugaguagcugggacuacaggcaugagccaccaagcccggcuaauuuuuuguauuuuuaguagagacagaguuuugcuauguuggccaggcuggucucaaacuccugaccucggguaucugccuaccucagccucucaaagugcuggaauuacaggagugagucaccgcaccuggccauaaucaucacacauucugacuaaccccucucccccaagccccuguccucucaggccagcuucuggaugagcugggccucuuccuaaaggcccagaauaccccaugccccaccuccuuguucagucgguccacaguccuguccagcaaacgcuucugcuccuccagcucagccuugccucgccggagcaccucccgcugcuucccuuccuccuccagggcccgguucagugucugcugcuccugccccaggcgggccagcccccgcugagccuccucuaggcgugccuccagugcccgcuuggcugcugccagacuccccuccucuuccugggacgcauucagggccuccuccagcugcuguuucucugccugggagguagggaagcaggguuggacugagaaaagguaaaacuuggguucaagucauuuggagguggguagcugggcaggagaaaggagguauuuaugaaaaugaugugcaaugaaaacaggcuccuagcaaagaaaucaggacacauagagcaagcaaagggugagaaauaagaaacaaaacuaccagugcaaagacugaacauuggcgccaaaguauacaccaggaaauaaacccaagguuaacagagcagguuuggggaggcaaaacagaugcacacuaagggcaaagugaaacugauggcuaacuacuuagcauaggaguauuucaccagggcugagcagagagggcugggagggcagaaccacugaccuccagccgcugcagcuugucccguagucgugccuccaccgcuuccccaccauccaccagaccucgagucuccuucagcugcugcuccaaacccaggaugcgccggcggaauucgucauuuuccuccugggucucccgaagcgucgucuccacugcggcccgccgcugccccagcacuguugccucugccucggccaccaucuuagccuaaggacgguucaggggguggcagcucagaccccagggcguggcagcucagaccccagggcuuggggccauugaccacacccaggaaagccaucccaaagacagcccauaagaaugaggcuuaaagagagcagcugccaccagccagacgcuucucugagaaucccaccccuacacagauacagguauccucccccugccaaauccuggcuucuuugaaccacaugccuaggacccaggagcuggucaguacauacccaugacagguaacuuuccacacccucuggcuccucagcccuccagacacccucagccuccaccuccuaagcccugugcccacuccccuugccuuggaagccucuucacaguccugucgcaguugcuggagggucuuuuguagcuggagguucuguucuuccagcucccgaccucgaucagccucgacccucaggaccgccagcugcuucuccaacucccggucccggugucgcccagccaccuccuggcucugccguucugccugcaguuccuuaagcuccuccuguguccggagcagcuccuggaaggaaacgggaauggugauggggcacccagagccagacuaagauaccugaauguggagaagcugaaacucucauacacugccaagggaauaaaaacugauguggccacuuuggaaaguaguuuggcaguuucucaaaaaguuaaacacagauuuaccauuuauaucaccagcaauuccacucuuagguaacccaagagaaccgaaaauauguguucacaaaaaaacuuauacgcgaauguucauaguagcauuauucauuauagcccagauggauacacaacccagauguccacgaauugaugacuggacuaaacacgguauacccacagaguggaauguuauucagccauaaaaaggaaugaaguacucauacuugcuaccacauggacaaaccuugaaaacacuaugcuaggugaaagaagccagacccuuaaggcccauauauuauaggauucaauuauauuaaauauccagaauagguaaauccagagacaaaaaguagauuagugguugccauuggguggggggaauuauugcuaauggguuuggcgccuuugaggggguaaugaaaauguucuguaauuaaauagugaugaugguuguacaacuuuguuaauauaauaaaaaccacugggggccaggcgccaguggcucaugccugcaguuugggaggcugaggcggguggaucaccugaggucaggaguucaaaaccagccuggacaacauggugaaacccugucucuaccaaaaauacaaaaauuagccgggcgugguggugugugccuguaaucccagcugcuugggaagcugaggcaggagaauggcuugaaccagaaggcagagguugcagugagccgagauugugccacugcacuccagcuuggguagcagaguaagacuccaucucaaaaagaaaaaaaaaacccauuggauuguacacaaagaugacuuuuauagcauguaaaauauaacuccauaaaaaaaaaaauaccaugaagggagaguacaugaagguauggcuaguaaggcugguuguuuaaaaaaaauacagugugaggcugggugcgguggcucacgccuguaaucccggcacuuugggaggccaaggagggcggaucacaaggucaggagaucaagaccaaccugguuaacacggugaaaccauguuucacggugaaacacugaguacguguauuuuuuuuguaaaaauacaaaaaaaauuagccgggcgugguggugggcgccuguagucccagcaacucgggaggcugaggcaggagaacggcgugaacccaggaggcggagcuugcagugagccgagaucacgccacugcauuccacccugggugacagagugagacuccgucucaaaaaaaaaaaaaaaaaaaaaaauauauauauauauauaguguggccaugggaucuccaacugcaugcaagagcaaccuggagagacuuugacagaacaggucagcacaaucccugcagcugccacuugucuuucguguguguguguguguguguguguguguguauaaaaccaaaaugugugacacaauaaaugcuggcacagcucugauuucuuuuaaaaagaaaauuaaaauaggaguucugguucuaauuauuagcuauuagcuacuucugaaauucagaaaguaccauaauuaggcuaaaggguuauauaauauguagugaaucuucaauguaauaccauauacucugcuauuuuucuuuugcuaauuaguuuuguuacauuaguaaccaggccaugccaacacaaguauuccaguccaugugaugauauuucucaauguaaauuaauaaacugaaauucuaaugguaaacauuuuuucauaaauguaguuagagaccccucugaaagacaaagcagcuuuugccaugcugaccaaauuagauuucugagccugcaaaaaucauccuggaguuucacaaauccaccuaaaugcugcuacccaugacgucucuugggagucggccagcagccucuggcuauaccccaaccuggguucugagagcacuuuccauuagaaaccucuaugcucaaugaggagacuggugcugcugugcuggaaagagaucaagcugagcaggcaggaugaggccuggaaaccaagcacacaggagauagccccacuagcaagaaggcccucauggagagguaaggcagguguucaucaccccuaccuaccauucugccccccaauucccaaauaccuucuugagcaccucaaccuggcgaguaucuccagcacuagcucgggccugcucuaauucccucugcaagaccucuaucuucucuccaagcuccucuuccaucuccuccuucuccauucgcagcugcaggagucugagccaggcaaggugaaauaaaggggaaagggaacagaguaaggccacaugccugggggagguuagcaugacaauaaaagccaccucucuggaggccaacacgcugggcaccaacucucaagaggaaggaaggugaacguggaaaagagcaguuugagaaaugggagaguaagagcauaccauagauagaaaggaagugggccaggcaugguggcucaugccuguaaucccagcaauuugggaggccaaggcagauggaucacuugagcccaggaguucaagaccagccugggcaacauaaugaaaccccgucucuacaaaaaauacaaaaauuagccaagugugguggugcaugccuauagucccaccuauucgggaggcugaggugggaggauggcuugagcccaggagguggagguugcagugagcccagacugugccacugcacuccagccugggcaacagagcaagacccugucucaaaaaaaagaagaaagggacugggugcaguggcucacgccuguaaucccagcguuuuggggggccgaggugggaggaucacgaagucaggaguucaagaccagccuggccaauauggugaaaccccgucucuacuaaaaauacaaaaaacccaggccuaguggcaggcgccuauaaucccagcuacucgggaggcugaggcaggagaaucgcuugaacccaggaggcggaggcugcagugagccaagacugcaccacugcacucuagccugggcaacagagugugacuccaucucaaaaaaaaaaaaaaaggagaaagggggccaggcgcagcggcucacacccguaaucccagugcuuugggaggcaagguggacagaucaccugaggucaggaguucgagacuggccuggccaacaugguaaaaccucaucucuacuaaaaauacaaaaauuagcugggcguaguggcaugcgccuguaaucccagcuacuugggaggcugaggcaggagaaucuguucaacucaggaggcagagguugcagugagccaagaucgugccaugacacuccagccugggaaacaagagcgaaacucugucccaaaaaauaaauuaaaauuaaaauuaaaauuaaaaauuaaaaaaaagaaaggaaguggcauaugaaucauggguauuucugagagggccaauguccuuacuccugcuugguggcucuaagauccuccuuguucuucuggaacauacucugccaaugcccugucuccucugaagucuccuccagcucccucugcagcccucgcacaagggcugacaucuucugccucucggccuccagcacugcaugguccuagagaaggggagaguuggacaccagaaggcucagagggaagaggucacuucaaaucaaagugugaguguguacaaggaaaggcuuagacccagagggcaccaugccaggugcacccccugacacucuugugguaccugguacaaugcuagcagagauucucuccucaagucacaguccaccccucuaucaucuacaggaaaccuccccaguuauuuccccuugggacuuuuuauuuuuagggggacagagucucgcuguguugcccagggugaagugcaauggcaugaucucggcucacugcaaccuccgcuuccuugguucaagcgauucuccugccuuagccucccaaguagcuaggacuacaaguacgcaucacuacacccagcuaaguuuuuguauuuuuggcagagaugggguuucuccauguuacccaggcuggucucuaacuuccugagcucaagcaguccacccgccucagccucccaaagugcugggauuacaugcaugagcuaccgcacccagucccccuugggacuuuugucacacaaccucaagguacuucuggccuguacucccucccucugccccuauaguuuuccugcccaagguuuucagcagaucucacuguguccuuuaggaggagagggggaguucccaguugcaaccaugaaaaguccaaaaguccaagaucccaaggcagccuuguucuccagcagugcccuccucucucagacccugcucuugucacaugccuggguugcaucuugcaugcuccugcggagcugcucugugucucgcugguacugcugccggacauguuccaccuccuggucacgggaggcuaccuccucuuucagggcccccuucagggcugucaacucccgcucccgcagccucagcugcuccucuacucgcuguuuccccuccaagaccucuuccagaaguucccgggucucuaacagguccuggagaaaauaaaggaagaaguacaggggugaccauauuagaauccaucuguuuaucaauucacugagucaaaaaauauuuaucguauuaggcacaguaccaggugcucuaguaccaguacuggagcccagaaugauagguuuccuuuauccuaacucuagucccaacacaccauugaaucuaccugaaagcacacugaguaccuguaaucagccacccacuccucauacuuuggggaaaccauggaugagcagacuugaggaugcuccaacugagaaaaagcagaggcuggggcauaugaccccagacccuaccuucaguaacaccuccuuagcaggcucaggacccuggacauguuucagcuuguucugcagcuccaucaccugggucuccagcccaugucguaaaucuucacccugguccaagaggcgcuucauguucuggagccuaauaauagauaacauuauugcacacuaugugucaggcaguucucuaaacgcaucauauauuuuaauucauauuuauuaaugcauuuaaacuuccuuccuucaaaucuugaugaggccuccccugauuuuugcaaccugccccgcuacaaccuggcccuccugaucugccuuacccuguuguauuuacugccuucucguguguuacaaauuuacuugcaaaauauguuuguuuacugucuguucccucucaguagaaacuaagcuucuggagagcgagcccuucaucuauaggguucacugaugugucuugggaaccuagauuaaugccugucacagcauucuugaugaaacaucugcugaauggaugacugaauccuuacaaugauccugugagguagguacuauuauuaagucuauuuuauagcuuaagaaucugagacagaggcaaacccagguagcuuaacuccaaaucaugcacuaccaccauuauugauaaagaagguagagagaaaggcccuauccuguccuuaaaccaacacugccccuuucagcuucuggagauuuccuucugucuccuucaacccuaggggcaaagagggaguggccucuaaaccuggccuaggcccccaagcagcccgaggugcgccaccagcugcacucacuccuuguugcucugcugggccucccccuuccuccucuccagcagcuccugcagucggcugcacucuucuguuuucuccuccagcugccgcuccagcccaacuugggauggcucuagcuucugccgcuucuguaaaagggaaugagaguacagcagguagaggguagggaaagccucucagaaagacucagaauaaugggaaugucuaacacucauuggacacuugcuguaugauagacacuauacuuaggaccuuauguguauuauccacaucuaauccucauaacuagccuugguacuugugaugauguaaaauauguucacaaauuaucugacauuucuuucaaaagauaaagccuaauucuguuugccucgagcacgggcuugacuuaggggcuuccuucuaacaaacagaaaaaggaggacgugaugaguaaauucugauguuaggucauaaaaaggcauugcagcuuuucucuuggaucccucacucugggaaaaaaauagcuguuauauugugaggauacucaaaaguagcucugugaggaaggccaaacagccaggaacugagguuuacaaccaacagccauuugauuaagcuggguuuuuauuauuuuuauugauuuuuuuuuuuucuugguguuuuguuuugagauggaguuuugcucuugccuaggcuggagugcaauggcgagaucucagcucaccgcaaccuccaccucccggguucaagcaauucucgugccucagccuccuaaguagcugggauuacaggcaugcaucaccucaccuggcuaauuuuuguauuauuaguagagacaggguuucuccauguuggucaggcuggucucaaacucccgaccucagguaaucuguccaccucagccucccacagcgcccggccugguuuuuuguuuuuuuuguuuguuuguuuuuugagauggagucucgcucuguugcccaagcuggagugcaguggcgcaaucucggcucauggcaaccucugccucccagguucaagcaagucucccugccucagccucccaagcagcagggauuacagaugccugccaccaugcccaacuaauuuuuguauuuucaguagagacaggguuucaccauguuggccaggcuggucucaaacuccugaccucaggugauccacccaccucagccucccaaagggcugggauuaugggugugagccauugcacccagccaauuaagcugguuuugucuaucuuauucauuaaacugguuuuguuugcuucauucacuuauuuauauuuuuuugagacagggucuugcucuggcacccaggcuggagugcagcagugcaaucacagcucacugcagucuuaaccuccugggcucaaaaaauccucccacuucagucuccuaaguagcuggaacuacaggcacaugccaucacaucuggcuaauuuuuuguagaggcggguucucacuauguugcccaggcuggucucaaacuccuggguucaagugguccucccaccuugcccucccaaagugcugggauuauaggcguaagccaccaugccuggcccugaguaagccauuuuagaagcagauccuccaauuuacuucuuuuggccacagccagaagcuggacuggaaccuuauaacaggcucagagccacaauuacccuguuaagcugaucccagguucuucauccucagacucugggaaaugcuuuuuuuuugagaaagaguuucacucuuguugcccaggcuggagugcaauggcaggaucucagcucaccacaaccuccaccucccgggugcaaguaauucuccugccucagccucccaaguagcugggauuacaggcaugugccaccauaccaggcuaauuuuguauuuuuaguagagacaggauuucuccauguuggucaggcuggucucaaacucccaaccucaggugaucugccugccucagccucccaaaggauuacaggugugagccacugcgcccggcugggaaauguuuguuuaaagcuauugaguuuuggguaauuuguuacacagcaauaguuaauuaauauaguacuaucauaauccccacuuuacaauuuaggaaacagaggcuuagaacauuuaaagaacuugcccaaggucaguuacacagccaacaaguaacagaaccaggauuugaacccaguuaguuuggcuccacagccaaucacuuaaucauuacacuacagugauuuccaaaagacaagggaaguuacaauccaacauuuauugagcaccaacuacacacaaaccaauaugaugaaaggcagaagacauguuuuuaaaaaggguacacuggcuuuagaauaagacugacccggauuuuuucauuccucucugcaacuuacuaccauaggcaauuuacuuagccucucugaucuucaguuuucucaucagaaaaggguccagaauagguauucacaggguaacuauaaugauuacaguacccaggacaguacauacuaccaaaauuauacucaauaaaugauagcuacuacuauugccauuauuaugauaaugauaaaaaaaaauugaggcacagagaauguaaguaauuuucuuaaguuuuauauagcuaguaaggggcagagccaggaugggaacucccaaagggaguggaauggaagguagguagauuccuaaugugcucugccucccuaacccccacagaaccccagaaguccuuccuggaauuaguacacauucuugucucuugucucauaagacacaaacaugcuuguuccauugcuuagaagggucagcucagcccaucuccaggccaaggcuuuuucccuguuuuccuucaugccuccggcaccucuaaccuuuccuuaccuucaccucuucauccagcuuucgcuguagcuccuccacuuuucggguaagcucacccugcccugccacggccuuaguagaaccagaagaaaccaucugccagagauauggggggugugggggaagggagugaguccaagucuggauccccugaggcccucaaagcucuaaccuugacccuugcucccauccagagaaggccacucaccacuagaggcugcaucuucuccagcaccaaacuaaccuuccuccucacagagguuucacuuucugagcuucuagaggauaaaaggauagaagcaaggguuaggggaggaaagagguagcagagaucaggaaaggguaaaaucagggaagaugggaaacaaagcuagaagaaaaagaaggagggguaugccucuguuguugggggggcccccacucaccccucccucaggaugccauagaugguggccuucauaugguccacacugccugguggggcugccuccugcuggucucgaaggaggucuggaguugauuugaacuguuaaaaaaaaagaaaaagaaaaaaaaaagaaagaaagaaagaaauaggaagauuaggccagaagcaugcgugggguucagauggaggagaaguggcagucucaggucaagucccuucaagcaugaugaacaauccugaaaugcagcaaggaaaacaugcuguggaggccugagcaacaggccagggagaggccaacacaggaugcaccucugcacuguugcuguaaaccagauuuuccucaacaaacaucucaaccagcugcaaacugugccacaagugauuugucacuaaugguaguuaacaugcuagaguuuauaaauaauuuacuuuuaaaacagacuuacguuucucucaaaguaaagucacucccucacuuacuuacauuccugaguaggagagaaagguguggaauuuuggcaagagcaccaaggaaacugcucuuauccuccaagcccgccuuacauauucugcagaccuugcaaaugcuggugacugagccauaguuaaugguuguggcaaugacaacuagguccaaacuugugaauagugauuuuauagcuugcuccauuuucuuuagaauuuuacccauggaaauauccugugcaugugaauaucaccuauuuuguggacagauacaguagagaacaaaaggcagagaguuucugccuaggcuauuugaauuagcaaggaggcucauggcugguggguaaaagcugaugagaagggagaaggggcugacauuuagaagucagggaggggcugggucugaccugcagcauggugggguccugugcacuccuccgcggcuccucaaaacucugaaggacccaguccugagucugacgagaacggcuaaagccacugagaggacucagguucuggcucugggcuggcugcuucgaagugcccacaugguugucauauuuugugcuagagguccagugguugguggacuggcgcucccguuccucaaaggugucccgugggaggcggcuguccaggcucuugcuccguuugcgcuguucaggggguagcauccguguucggcggccaguccgaccccgggccuggccuccaaguugacugucaaacuuguugaugagugaguccacugaagacaggggagcagugucaauggugcuaccuggggaagccacuuucggggcuagcuccagcaugcuguugcuucuguuacuaggauccacugggccagggccugccagugaggccugggagugggaacggaguagcuuuccauuccaguaggccccaggcuccucaucagaugugcugcucugcgagggggcaggaaaucccuugaccugagaguagggguucucagggaguuccaaaucugagcucagagcuccugaggccccuuggucauuggcccccuugauuuggaccccaaaggagucaccgccuuucuccccacuguugagcaccacaaagggcugcccagcgauucccugcacacgcacagcaaccccguagguacuggcucuugcauccuuagcugggcgucguccaccucgacguagagugcccaucucugcaccacucacuggcucugugaugaagcgaaucuggacuccauggucuacggggccccggggcucagccauguugggugccugcuccauaaauaggaggaguccuagaagaugaagaaaugaguuuaggcugagagacuucacuagaaacuaugaaacuucuaccugcgggcugacuucccugucaguuccuacuagauaaaccacugauucucagacuaacagaaggccccuggagagccuuuuaacauaccgguugcuggaccuaaccuccagagcuucugauucaguaggucuggguuaggacuugagaauuugcauuucuaaccaaguuccccaggugauacugaugcuacugguccagguaccacacuuugagacucacuaaccuaaaagaauccacuuccucugauacagcccuggggagcuaggcuuuguuaaaaguuuaaagauuuugcuugauggccaggagcaguggcucacaccuguaaucccaccacuuuggaaggccaaggcggguggacugcuugagcucaggaguucaagaccaguccgggcaacauggugaaaccccaucucuacaaaaaauacaaaaauaaacugggccugguggugcacaccuguaaucccagcuacuugggaggcugaggugggaggaucacuugagcuugagagaggcugcagugagcagugauuaugccacuguucuccagccugggugacagagugagacccugucucaaaaaaaaaaaaaaagauuuuacuugaucuucauacauacauauaauaccaccauguggccagguacaguggcucaugccuauaaucccagcacuuugggaggcugaggcagguggaucaccugaggucaggaguucaagaccagccugaccaacacggugaaaccuugucucuacuaauaauacaaaaacuuagcuaggcgugguggcgcaugccuguaaucccagcuacucaggaggcugaagcagaagaauugcuugaacccgggagguggagguugcagugagccgagauugcgccacugcacuccagcuugggugacaaaagcaaaacucuaucuccaaaaaaaaaaaaaaaaaacacugugugccuucuucccuuccucccaccaagggaaggcagaacccacacccugcugagcagauaccuccaucucacuggagaaaagggggccuucucucccagagcucauuuaaaauauagaagaccucaaaguauaucaucccacuucuggaaagaaacuuaaaaacacugauagcagugaugccuuugagguggaggaacugaggacuaggaacagggaugggagaguuucuauucucuggaagagcagaaaggaguggacauucuacuguauaucucuuaugucccuuuugaauuuggaaccacguagauguauuaucuauucaagaaaagguuguguuuuuuuugagacagaguuuugcucuuguugcccaggcugaagugcaauggcgugaucuugguucacugcaaccucugccucccgaguuuaagcaauucuccugccucagccucccgaguagcugggauuacaggcaccugccaccaugcccggcuaauuuuuguuuuuaguagagaugggguuucaccauauuggccaggcuggucucaaacuccugaccucaggugaucugcccgccucagccucccaaagugcugggauuacaggcaugagccacgcacccagccaaaaauauuuaaaugugguuuaaaaacugugccacucggccgggcaugguggcucacgccuguaaucccagcauuuucagaggccaaggcguguggaucaccugaggucaggaguuugagaccagccugaccaacauggugaaacccugucucuacuaaaaauacaaaaucagccgggcgugguagcgggggccuguaaucccagcugcucgggaggcugaggcaggagaaucgcuugaaccugggagacggagguuacagugacccaagaucacgccauugcacuccagccugggcaacaagagugaaacucuaucucaaaaaaaaaaaaaaaaagugccacuuuaaggggccccaggucagguaaacuugucucagcugagagccagagccaacaccauccauaggccagcuucccagguccacauugcuaaagcucagagucagcaaauggaauguauuccagguaugcucuggcuccaggaacuugggggagagauugucuuccaagcaaauaaaaaaauucagcuuccccaccccuucugcuagucuccaccagagccuagcaccaaacuggaggaugagccucuaacgugccagacagaaacacaaacauacccaacucaaccuccccauggaguucugggccaaggaaacuuggcaaggccccuuucagggacuguaaagugcuagcaagccagggugagaugagaagggaggggaagggaugggagaggcagagcuacaggugacaaagggcuugguggggaaggucuaucugaagaagagcauucuuagaauucccagcaauucucaagagaaaggaacagggagagaagagcccuuuauuaggaauuguucuucaucuuuuuggcccugggacuccaugagaaaaugaugaaagcaauacacucucccugaggagacagcacauccaaacuuuuaucaccccaucuuaaaaggcuugugaaggcagacagguaaaguaguucuccaaaccacucauccaguagaagaaaaugcacugggcuagagucaggaucuggucuggaauccugucucugcucuucaccugauguaugcaaccugaggcaaaucacaacuuuucuggugugguggcucacgccuguaaucccagcauuuugggaggccaagguguguggaucacuugaacucgggaguuugagaccagccugagcaauauggcaaaaccccaucucuacaaaaaauacaaaaaacuagccgaguauggugguacacaccuguagucccagcgacuuaggaggcugaggcaggaggaucaccugagcccaggagguugaagcugcagugagcuguaauugcaccacugcacuccagcuugggcaauagaguaagacucugucucaaaaacaacaacgacaacaaaaaacccacaacuuuucugugccucaguuuccucaucuguaaaauggguauaaugauaauaccccacaagguuauuaucugugagaaugagauaauaaauaauuauaugggcauauacaaugauaaaaaaguaccaaguuauacccuuaagaucuuuguacuuuauuuaggccaggcgcaguggcucaugccuguaaucccaacacuuugggaggcugagauaggcagaucaccugaagucagaaguucaauaacagcccggccaacauggugaaaccccacgucuacuaaaaauacaaaaauuagcugugcgugguggugcacgccuggaaucccagcuacuggggaggccgaggcaggagaauugcuuaaaccugagaggcacaggcugcagugagccgagauccgccagccugggucacagagcaggacuccaucucaaaaaaaaaaaaaaagauguuuguacuuuauugaacuuggguucuaauuuaauaaaaaggagagaaaaacaagauauuaaacaugaaaacauuuagcaugugacuaucacaaagcugacaacaaauaucauccuucacacaugcuacuuuguccaacaggcacuuuuggcuucaccugguucauagaaagaugucacuucuucagagaagccuucccugaccaccacucccacaaacaaggucaguucucacaaaucagccucccacaaaccaggucagauccacguuauacgcucuauaguuguccuucagcagguuuacuccaguuuauauuuauacauuuauuggaguaauuauuuccugucugucuccccuacgagauaauaagcuccuggagggcaaagaccauggcuagcagcuaaccacuguguccccagguguuuggacacgugguagaugucaacaaauauuuguuaaaggcuguauccugaacuaaagcccacuugcacagcaguggggagauuugcccaggacaaaucuacuuugccucaguaacaggaccucuuagcaacaggaccuccuccugguccagacuugcugcccuauguagucaugaucuuagaaccagaagugccuagauugccagcucucagaagccauaugauuuauucaugaugcagucuacccugucaguacaucuacugaucuuccagauccaggucaaggaguucccagccuaggcccagcagagggcacagacccuugagcaacagcacuaaauuauucagaggcaguguugaacacucccccaggucccagguuagguuaacucccuaaccucaaucaccuucaguccaaggacauguggaucaggggccaggagggcugaagggaucuuuggggugggucagaaagcagggcucuaaaugauucaacauggaaaacccgaaaccuacccgccuuugguuacagaggacaguggggcgggaccaaggcagcagggcagcucugaggccuugcguaagccccagagacaggcagguaaacagugaucaagggccaggcaacauggaguccagggccugcgcccucaccaaugccugacccuacuuuucucuccccuaucacauguccagggcucuccucaccaacuguacuccaggaagagaccagaccacaaguugauucaggugcaucugucugcuucugccuuuccugccugcaaggagugggagaacacucuacaccuguaccagacagccacuucucccugaguuacucauuagccugcccugccccaauuccaucaccucuggcccagccauaugcaucugguuuccaacuaggagugacaggguaucuggacuucuggcaggaaguggggguggggugguuucggguguguggaggaaggacugauucacauagggccaggcaauaugcuugaugcuaaauaauuggcagauuuagaaaacgggagaacuugagguauagagauuagaauccccucagaggaaacaaggaaagcaaauggucgaaauagaaaaggacagcucagugaccuugaugauuuggcacccuuuuucucauaguuagagauaagaagguuccccguggauccaaaaagaaucccccaaguggacuccugcccagguccgcugaaagagcagaaaccugagagccaggcuacagcugcuuggccaguagggaaaaaaacacaaugaggaacugggccccugcaaacuggcuggacugguuugagaggcaaggggaaggggagggccggggaaacuacacuggcagcuuguaaagcagaccagagaaauuccacaccacggaggaggcagaggggcaagaccacaggcaggggcucuccagccuugauggcaaagccaaagcucugaaggagaggacagagggcagggagggaacaggcaggaggagcagaugaacaggaaccuggugacaggccaguaugugacagggagacuuugucucccuccaccccucccuuugagguucccaaaguugcauuccugaucccacacuugcuuuggccaccucccugguccucaguccgccccucccuggcacaaagagaagagcccuacacccccaucaccucccacaaggggaauggcaugcaggccagccugggaaacacaggaaggguucuaggaagccagaauccucuuagagucgggcaaaucucuggauuagcagucccccagagccagcccccagacucccaaacauccaggaugaaagaagagaugcauaggcauguguaggcagcccaucuacaaacauagcgguugcuaauuauuucccaauuacaacaaccuuccucaggcagggcuucaaaggggccaagcuaagguugacucuaguuccuuuaccugccuaaggcaaagaaauuugccuccagucuugucugggccccaaggugcaccuuucaucuguccuggggauuuggaguuguaauuucccuagucucguggucuccugaugaguccugccuauuuccugccccaauagugccugcugccauucugacagccaccgcaguucaggagucagggaugccuggagggcguucagggaguaauggggauuccuccagacaucaaggaaauugguugggcucccaaaccucauccaaugguccccaucuagaaccacagaaaaaauauguggguacuuggagaaaggguuugacauccgcccccagaaaggggccuccugagaaauaaguauuaauauuuaucaauauuuugcaggaccaggcagggcucuuugcuuccucauaucccucucuuggggaguacucucucucucucucaagaggaagaaggaacgauucucccuggcacgaaagcaaaggacacaaagugaaagccuaaugguuguacaccuggugaagagaugagggugcccucucaucugccccucagugucucugauucgcaacugccuucggccggaggugaagggcuggggaaaaaaucccacaccucagagucaucucaaagccaccagggugcugacaacggccagcugagaccgcaggacgcaggaaagacccucaggcgagcagcaccugcagaugcccuccccuggcgagucugcaccucaggcagcagcaguucccgacucagcuggaacuaacuccuuccccgcgccaccgcugucuccaagagaaauucugccccuagggcuggcgucugaccuccagagacaucuggcgcugaaacgcuuucaugcgcugggaacagccuucgccccaggugccccucgccuggcaccuuccuagccaccugcaucuggcaccucaggguaggggucggcucuuaaucaguaccccaccccgccccaaucuccccuccucccgucucccacucggcaccggugcccuggagaggggcaucucacaccgccucgaugccugccccucaaagguaccccugaaggcucgcuuuccucucgggugcccuggcccgcaccggguccacucacccuagccgggcuccgcgcucccaggcuugcguucgggcucgggcucgggcucgggcucgggcucgggcucgggcucgggcaaagcagcacgcgcagcuccggcccucccccucguccucggagcucccuccuuucucucccucccaccaaccuguuacuccgcugcggagcuccacccccgcgggccgucagugcccgccccgccuuuccccgcuccgguugguccgcuucccguagggggcggggccuccggugcggggaccgggacccggggucuccagccgcgaagggcgggccaggucacguggacccacgggcugcggagcgucggggcggggcggcgaggggcgcggaggccauuuugggggcgucgcggauggucgcgagugaccgccggccaagaucccgggagccgucggccagagcaucuucugggcucugcuagaaaacagccuccugccucccguuuacuccaagggaaucgccggccagggcccuuucuguccuucaccuaccucugcaggaaccagaaugcucuuucgucacuuucugcagaaaauaucuccguugucccccgacgucagagccuccugcaccucagcucgucucccuuuucccugacccgaaccagaacccugaucuuggauucucuuuuaucuuguggccuccgcaaucauuuugcagccugacaucuuuuucuauguaauauuuaucaccuucuaguuaauaacauaauuuuaaaaaucauuuucaucauuuugccucccguccuacgauaagcuucaccagagcaaggaucucuuguucugugccuugcuucaccccaaacgccuacaacagggacugguacauacuacaugcuuaauaaauauuuguugacugaaugaauggaaaccggggacgcaaauuuaccaaaauaggaaugaccuucguucuaaacugaaagggacucaguuguaaauuuaccucagaguuagccucucaaaaaguagggaugcugaucccaguuccuagaaaagaguaaaaacuaggggcucugcaaacugcaggaccgcucauaccagcugcaguuaaaacaacauuaaagcuggcauccuagcuguuaaccguugagauauguaaaaaagagauugacuucguuuacguugcugggcuccggauuuuguucucauuuaguuacaacaaauauuuacccuguaucuauuggaguagaagaggaaucuucgaugcagcacagauuccgguguauucucgggagcugguuuccgccccuccccaagccuucaaaagcuagguguggguccuacagaguaaaguccacuuaccagcuccucagcugggaugcaaagucucugcauu

SEQ ID NO: 13728 - RNA, 2504 nt, Homo sapiens
cuuccgcuuccguuggcgcaagcgcuuucauuuuuucugcuaccgugacuaagauggaagcguuuuuggggucgcgguccggacuuugggcgggggguccggccccaggacaguuuuaccgcauuccguccacucccgauuccuucauggauccggcgucugcacuuuacagagguccaaucacgcggacccaguaaguucucggcgcuuucguuugcguagcgggagggaccguggggccuggugcugccggcugguuuugagagcccgggaaggugaggcggggaccccgggggcgcgcgaacggcaggggagcucagggcgcggaguccuggagaaugcagaauaauuggaaggaauuauagaaaaucagaagcgcagcucagugcgcggaaagagggcgcaguccauccccccucucagcucccaccguucucacucuuuaggaaccccauggugaccgggaccucaguccucggcguuaaguucgagggcggaguggugauugccgcagacaugcugggauccuacggcuccuuggcucguuuccgcaacaucucucgcauuaugcgagucaacaacaguaccaugcugggugccucuggcgacuacgcugauuuccaguauuugaagcaaguucucggccagaugguguaagucauccagagaacaggagagugguucccaaguagagaggggaguccccuguuuuuuauucccuucgaugggauggggggacuuguugcagcgggggacuggaagaguuguuggaggugggcgaucuguguuugcaauaaaguuuuuggcauuagguguaaaaugggggaaggugugguaacuucuuuuggggauggguggagaccccgacuuaauucucucccuuuucucacaaccaauuccuuuuaaggauugaugaggagcuucugggagauggacacagcuauaguccuagagcuauucauucauggcugaccagggccauguacagccggcgcucgaagaugaacccuuuguggaacaccauggucaucggaggcuaugcugauggagagagguucauaugaauacaaauaacuuauuuccuuuaccacccaaccuaguaccuguguaguaucucuucugucucuucuccccaagugaaucccacuuuaacucagaccccaugguccccuucuucagcuaagaugaaucuaaggugaaaugaguuuugacccauuguguccuguuagcuuccucgguuauguggacaugcuugguguagccuaugaagccccuucgcuggccacugguuauggugcauacuuggcucagguaaguaguaagucuagaggugggggaaagggaagacaaaaggaaauggauuagugguugucugcuuuucuccugaaauucugauaugagggaugggcugggaucgcuauuacugggcagaugguuuucuuuguagucugggggcuguagguguugacacugauuccagugacaagaugacaugacugggagucaguagacaugcaaagagaggacacccuagaacuucuuccugaaguggcucuuagcuuauuuucuaagcagaguucauucuggugaggcaagaaguagaaugucaucuuucacucuaaugcuuuuuauaccauagauuugagacaacuagccuguuauucagcccaauauccccccaugguuuucccccaaucucccuagccucugcugcgagaaguucuggagaagcagccagugcuaagccagaccgaggcccgcgacuuaguagaacgcugcaugcgagugcuguacuaccgagaugcccguucuuacaaccgggugagggaugugcugggaaccuaauuggcgggcucuggcuacuugcaaucccugggucucuaugcuuugaagaacagauugccuuacuugugugacuccuauuuucacauuggggaagaccuccaccugaccuuucauuuaaggacuuaaggcgugggcauuauugaaugcucugcuuucuuccaguuucaaaucgccacugucaccgaaaaagguguugaaauagagggaccauugucuacagagaccaacugggauauugcccacaugaucaggugaguaauagggaaaaaauuggugacagacuugggaggucuuuggcuuacacuaagcugggcuuuucugggaggcucacccaggaaaauuuucuggguggaaaguuuugguuggacaguacagcuauuuuuaggaauugaucccuuuaugcuucacaauuuuauuauucugucuuccuuuuuuaguggcuuugaaugaaauacagaugcauuauccagaacugaaguugcccuacuuuuaacuuugaacuuggcuaguucaaagauagacucuucuuuuguaaaguaaauaaauucuucaaaaugcuugcugagugguuuuugucugacugggucacaccaagugcaaaacugcugaguacugccaugugccaucucccucccuggucggagaacccuuguggucuu

SEQ ID NO: 13729 - RNA, 3786 nt, Homo sapiens
ggaacauaaaauuaaaccuaaagaaagcauaaaaaagauagcuauagauaagauccauaauuaaugaaauggaaaacaaauacauaagggagaggaucaacaaagcucaaaguagcaucugaagauauauagguaaaauaaauugcuggugcaacugaucaagaccaaaaaaggaggcacaaguaaacaacagaaaugaaaaggaagauaugccuauccacagagcagagauaaaaaagaaacaaggccaggagcaguggcucacgccuguaauccaagcacuuugagaggcaaaggcaggcugaucacuugagaucaggaguuugagaccagccugaccaacauggugaaaccaccucucuacugaaaauacaagaauuagcuggccgugguagcacacaccuguaaucccagcuacuccggaggcugaggcaggagaaucgcuugaacccggaaggcagagguuacagugagccaagacugcgccacugcccuccagccugggcgacagagcgggacucugucucaaaaaaaaaaaaaaaaaaaaaagaagagccgggcacgguggcucacgccuguaaucccagcacuuuggaaggcugaggcgggcggaucacaaggucaggaguucgagaccauccuggcugacacggugaaaccccaucucuacuaaaaauacaaaaaaaaauuagccagguguacguggugcaugccuguagucccagcuacucgggaggcugaggcaggagaauggcguaaaacccaggaggcagagcuugcagugagccgagaucacgccacugcacuccagccugggagacagagcgagacucugucucaaagaaaaaaaaaaaaaaagaaacuagaagaaauauaugcauuuuguguuaaaaaaaauacaugaaaugcacaaaacccuagaauaauacuuuaccuaagcugacucaagaagaauagaaagcccagucuauaauuauuaaagaaauggaaucaauaguuaaaauuauucccacaaagaaacaucaaucucagauagcuuuacaggugaguuuuaccaaacuuucaaggaacaguuuguuucaaucugauauaaacucuuccagagaauaagacaagagggaacaguucccaacuuagagguuauauaaaccaaaggaccaugguagaagccucuuuagaaaucuuacugaaaacaaaggcacuaacauguacaagaauguucauagcagcaguuugaaauagcaaaauacugaaaauauccaaagauccauugauaggugaauggauaaauaacuugugguuuaugaacuugauaaaauauuaugcagaugaaaaugaaugaaucauagcuaucuacaacagcauggaugaaucuuagaaacaaugguaagugagaaaaagcaaacugcaggggacuauuagaguauaacauagcugggcacagguggcucaugccuguaaucccagcgcuuugggagcccaaggugggcagauggcuugagcccaggaguucaagaccagccugggcaacauggugaaaccccaucucuacuaaaaauacaaaacuucaggcaugguggcaggcaccuguagucccagcuacuagggagggugaggugggaggauugcuugagcccaggaaguggagguugcagugagcugagaucacaccacugcacuacagccuucacaauagagugagacugugucucaaaaaaaaaaaaaaaaaguauaacauuuucuguaaagcuaaaaaacaagcaaaauuaaacacauuuuuaaaauuauauauacauauaugguuaaaaaauaucuauagcagauaauagacacgaaaauuaaggacagugguuaccgcuaagaagaggcgggggacaggcuagggaggaacacaaacacaaugguauuuaaaauguuuuaauguauauguguuaugggucauagguacucauuaguaugcuucauaauuuauucacguuagauauacucuuuauagauaucaaauauuacauauuauaauuucuuaaaaucugcugugguggaaauaaaugaacacaugaagucucccugaaagaaaaucaguguuucuugggaagaaccaagauucccugacagaagcuacccuauguagaggacaaaguaggucuucaauaaauauuaguugguuuacugcuuuucccaaggauacaucuggagggucugcauuccuuucucauuggugccgccugaccacagaacuagcuuuuuccgugacaucuaaccuaaaccccgcaguccuaaguccugacacguaugacaagaugcugccaccugguggauacagaauagauuuaaugaaauggcuaggaagucuuucacucuaguugguggaacuggcaauagggugagagggaagcaggaaugagaagacaaaaauuaagaaacaggaaaaggaaggagcuccaucucuaauauggagguagaaaaaaagggacuaucaucuaaaugagacugaagagucccuagaggagaauggcuucccucuccuuccuucugagacuagaaacgaggaaagaggcuacagcuuguauugagggaaaugcaagacugaggagaaaagaaagcaggucuagcugaucucaacuuagcaagcuaaaauaagaguagccugguguuagcggccacccaagcaacucccugcuccuaguuuccacuuggggaauccaugugauuuuggggaggcugacccccacccuuuuccccaaagguguuguccaugauauagaauaagcaaauuagcauguaucauccuccuggccacagugauuggucaggguggacaugugacccaggccuaaucagugugaauauuagggcuuuugcugagauuucugguacaaagaugccuucuuuuucugauuggacauaaauggggaaaaguguaaucuuaggaaugcuggcagccauuaaguggcccagacuuaaaugguccuacagaagaugcaacagugagaaaaaagucaguccgguauuuagagacauacugaacuacugggucaagucuucaccuggagccagcacuaccuauggacuuucuaguuacaugaaccaauaaauccuuuuuauuuuaagccaguuugaauuagguuuucugugauuuaaaaccaaaagaucccuaaccuauauauucaucauacuuagcccauuccuaccuucccacaggauagcacagggaauacagguaaggucacuacagauuuauugguuacacuaaagcccaggguaucaagcugaaaaggucagaggcagcaaccagguacuaaguagacugggugacucagcugucuguacagaggagaauggacuuccuuaggaaaagaauagccaaaugagaagcaagugcaaagaagggccucuacuaggcaaaguuaacguagggauauaaacacucuuccccacagaccuguaucauggggguguugcuuuugggucuuuaugcuccugggauaaggaacuuugaagcacaugcuccuuuaagucuuuauuacccuguggugcagugucuaccucucccuuugccaaaggaaaagccuccuuuuggcuucugcugcccuugaugacacucacuuuugaggggaccaagggaauuuuaucuucugcuucuuugguaugcugggaaccggggccccuuccuccuuuggaaacaguaccaucucccugacccugggcaaguacugcccccuuuucagccucucccauuggcccuggccucucugccccuccagcugaguugccuuccccuccuga

SEQ ID NO: 13730 - RNA, 6897 nt, Homo sapiens
cuuuuugacagucuuauuaauagggcaccaggcugaugcagcugacgcuuggcauggcuuugguaggaggugggggagggguuagaaguauggauagccguggcugggugcgguggcucaugccuguaaucccagcacuuugggaggccgaggugggcggaucacgaggucaggagaucgagaccauccuggcuaacacagugaaaccccgucucuacuaaaaauacaaaaaauuagcugggcaugguggcgggcgccuguagucccagcuacucaggaggcugaggcaggagaaaggcgugaaccugggaggcagagcuugcagugagccgagaucgugccacugcacuccagccugggcgauagagcgagacucugccucaaaaaaaaaaaaaaaaaaaaaaggaguguggagagcuguguaccuugcaggcaaggaguaguuggaaugagaaugaacagaucugaaauccugagauccaacaaggaaccagacuuaaggaaaguuaaguucucagcacccauuguaauuuauuugugaaugaaugggaaaaggguaucaguccaaggggagaucaggugguuccuccucaucagagucaaacucaacauuuucaucuuuuacccaucgaccucguccaucugggauccauccagagcuggaaacaucagagaaaauagcaucgaucaggaaagaggcuuauuaagaaguuaguggugagcucacaccaguaaucccagcacucugggaggccgaggcagguggaucacuugaggucaggaguucgagaccagccugaccaacauagugaaacccugucucuaccaaaaaaaaaaaaaaaaaaaaaaaaaaaguuagcagugagaaaaaauugagagccauguaaguuggguggcuaaaacaaaacgaaaccaaagauggaaaacaacaaugggaguccgggugcgguggcucacaccuguaaucccaacacuuuaggaaacugaggcagguggaucaccugaggucaggaguucgaggccagccugaccaacauggagaaaccccgucucuacuaaaaauacaaaauuagccgggcgugauggcacaugccuguaaucccagcuacucgggagccugaggcaggagaaucgcuugaacccaggagguggagguuacagugagccgagagcgugccauugcacuccagcuggggcaacaagagugaaacuccaucucaaaaaaaaaaaaaggaaaaacaauagcuuugaaacaagggugucagagagaaaagaaaaucugaggaaacugauuaggcauacucaccuucgaagggugagauaaugguccagggcucgucuucuuguggggcucaugggugcaggggcugagacaguugcugacuccucggccugugggccagccgcagguucagguucccuacugaucuucccacuuuggaguuugaccucugaggguggcauaggggaaagggagacagagggaccaggggcuucuggucuagguagagaagaauagucuguaaaagcaguaagggaaagggccaacucuccuaugacucccaaccucuuaaaacagugcuucuuaaacuauauuucucaagauauuaauaaguucugcauacaaaggauuucagaaucaugaauuugggaaaggcuagcuuaaaauuuuacaaguuuuuuuuaaucuuaagacuuuguauaguuuuuaaaacuguuauucuucaaguagaauuacaaagugccauuucccaaacuuuauuuaaaaaucacaaaauucuccuuuucuuuuucuuucuuuucuuuuuuuuuugagauggagucucacucugucacccaggcuggagugaaguggugugaccguggcucacugcaaccucugucucccggauucaagcaauucuccugccucagccucuugaguagcugggauuacaggcacacaccacacacccagcuaauuuuuuacauuuuugguagagacaggauuucaccauguuggccaggcuggucuugaacuccugaccucaagugauccacccaccucagccuccaaaagugcugggauuacaggcgugagucaccgcgcccagccaaaauucuccuuuucuugaaacacuaaguaacaucuccagaacacuaguauuccucagaauacacacuggaaaacucuuuuagagccaucugucuccuucugagccuuccuaccucuggcuuucccgucccauaccuguacuuccggcggcagcaacuguuauaguggggagcucugugcagagcacucugggugauaagucgugucugaguuagcagaggagccugguaaggagaugggagacagagucagagccuucagcccuccgcccuuccagccuggugugugcagcagggucuugccuagaacacacucuccacucucugauuaccucagcuuugguuucuucccuucucaauucauucugauguuuuggauucugcuuucuuuccuuucccggcugcuucuugccauagaaaagcugcaagccugaggagaaagggaaacagaauuaaaagcauagcaccaagaguggugugcagagauuucgaggguuuauuccccaucccgucuucccccuaacuuacuggacagauguuucuugccugcacggugggcagucagcauggccaggguguccaguaccggucgaugggggcagauggcacaagcaaagcugagcagggguagagaagaggauaagugguccaggggaagaggguugggcccgucccugccauaggucccacccuguccuagcagucuuugcaaaacccaacucccuggugacccaaucuccacuucuuccaguccucacuggccgccaaagaauccuagguacuccugcuguccuaauuaauaacaaaaguuuguugaagccaggcgugguggcaugcgcuuguaaacccagcuaaucgcgacgcugaggaggcaggaucacuugagcccuagaguucgagggcagccugggcagcaccgcgagaccuccgucucaaaggaaaaaaaaaaaaaagucuauugagccucuaaccgcagaacccucaggcuugagccacuccuugcucuuaccguccaucccgaagcaucagcgccucauccucuggaauguaacuggcuaggagguccccgacucuucuuuucugcagggaguaggggaagaaauccggacgggaucagcgggauaggagagagggguggaagugaaauuauagaaaugaggagugaaauggaauaaggacccuggggagaacagcgaucauagaccgaaaaaggagucacuacacagcucuaagucgccugguucucuccugcacccccgaguuguugccagagcaaugaaacaaagcuccuucccaaccuucagggagcgacugaagcggcuccagauccucuccgcucacgcuuacuuugagcacauugaguugacuccaaucgucuccuucccucuugaaagacaucacgacugugagucccagaagugauaaauucucuguuccgguuucgccacuccuccaggccaccguagcaagagcgggacagcgccuucucuuuuuuccuucucuuccugucggccuccguacuuccggggacgcacuuccacgcaugcauugcgcgauccggaaauccacucucuggugcucggagggaacugcauuuccuauggugcccugcgacuccgcagacgcggagccuuuugggaaaugaagucuuuucucaaagaccuugccgcucaacuggauccaggcccuugcaucuuggcggaucugaggcguuuggagggacaacaaccuagauguggagccgaaauuugagggugugaccuaucuuaugcggagcggaccuuugaggaucucugaguggaagguguacuacaaauucuugcaauccucacgcucuucgucugcggcgacaguucaccuggggugggccugauuuguuccugacucuagcaaacaaaccccgggaccggggagagcugggauguuggagcgcccugaggccaggcuacuugggggcaaacugaggaaagaguguugaggauuauuucuagaguucaaaggucagaggucaauguagcgaggaguugugggggaguccaaagucggaggggugcuuaggggagaauuagggagggacugaauacucaagggacagauuuguggauaaguagcuuggagggaggagaaaccgggagggggcagauggcguagugcuggggaggcggggacacaggggaagagagagggggaaaggaauccccugaauauucauucccagacuucaggccugucagucgcagucucggucguaccuccccuaguugcaaccuuagcuguuggcagggugaagagauggcuuccccgucuagacagcccccgccaggggggucaggacugcuucaagggagccgggcucguucauauggaagccuggugcaaucggccugcuccccagugagggaaagacgccuggagcaucaguuggagcccggagacacccuggcuggacuagcacucaaauauggggugacggugaguuuuccaggauuggggugaagacaacagucaggagggauuuaguccugagaagaauguaguggcccuucuagguaaccuccccugaaauguuccuaauguguugcacucuguucugccuuuaucuuuguuuucccaucacaguguugcacaaguccugcccuacuauuccaacggagaggaacagcuccuauuuuauuaugccagacacugugcugagggcuucacauacguuagcucauuucacccucacaucuguaucaaguauacauuuaucguucccuuuuggcagaugaagaaacugagacuuggauugguuaaccaguuuggcuaaggucaaauaaugagcgucagauuugggauucaaacaggucugucugacucuauuaaccacacagaaaauuuuauguugagagugauuaaacguuuacagcaacuaauggagagcugauuuuuaguucucaguuccuaaagugcccaccucuccuugcucuugguuccuccucaaugcucugccuucuuuccaguaagguggccuccuuugugcaaaacagguacucuacaccaaguauuucaggucaugcaugggggaaauuggauagauguaaaaauguacagcauugaaguugaugggguuacucccccuaucccugccccuguuuucuuguuccaucucacucaaacaaauguugaauuuagccaacauuuuuaugcuugcuguauuuaaagcacugugauaacuuuucugggagauagaaacuuaaacuauaugguugcuguccucauguaauuuauggccuaaugagaaaugaacagggacacaaauaaugauuacaagugacagaauguggugaguuuguaaagguauuaacaacgaauaggggucaggcaugguggcucaccccuguaaucccagcacuuugggaggcagaggcaaguggaucaccuaagguuacgaguacgagaccagucuggccaacauggugaaacccugucucuacuaaaaauacaaaaauuagccgggcgugguggugcucaccuguaaucccagcuacucaggaggcugaggcgggagaaucgcuugaacccaggagggggagguugcgaugagcugagaucgcaccacugcacuccagcacuccagccugggcaacagagugagacacacacacacacacacacacacacacacacacaaagauaggaaaucagaaaagauuaaauuucaguuggaaaggggcuguggugggccaggcgugguggcucaugccuguaaucccagcacuuugggaggcugagguggguggauugcuugagcucgggaguacaggaccauucugggcaauguggugaaaccccaucucuacaacaaauacaaaaauuagccgggcaugguggcaugugccuguaaucccaccuacuggggaggcugaggcagaggaucacuugagcuggggaagcggagguuucagugagccgagaucgcgccacuacacuccaggcugggcgacagagugagaccuugucuccaaaaaaagaaagaaagaaagaaagaaaauacgaauacacuauaucuguaguuucuauauuucauuaucuaauuaugauaauaauuacauaauuauaaguaauaguuuuuaaauaaagcauuaaugagccccugcuaugugucaaggucuguaggaugcuaaugacuuccuggggauacagagacagcaagucacaauccuugcccuuaaaggacuuauaggguuuaggcaaagcagauauuuaaagaggugaauaauauuauaguaggguuauguauuauuauagcaauauuuacaguaugcauugggagcccugaagaagguagcacaaagggagugauaguugaugaauacaaguuuuccaagcagagaaugggauaguaggggggugggagcauuucaggcagaaguaacagcaugaauaaagugugaaaaagaucauggaauguucaaagaaaaauaaaaaguucaggauagcaaaauguagagguggcagagggagauuaaucuagacauuuccuuugggagcuggauugagaaagcccuugaaugcuaauuugguuuuuaucuuuuagccagugcggagccauagguggguaguggguuaaucagauuuauuuuuuuagaaagauagaugccaagaggaggaugaguagaaauagagcgaggaaggccaguuaaacuguugcaauaaccccagaugagaaauacugagggucuauuuuaaaucuuuggcaguaggaaggugagaccagaugugagagagauuuuugaagcaguuuuguugaccacuugguau

SEQ ID NO: 13731 - RNA, 6897 nt, Homo sapiens
auaccaaguggucaacaaaacugcuucaaaaaucucucucacaucuggucucaccuuccuacugccaaagauuuaaaauagacccucaguauuucucaucugggguuauugcaacaguuuaacuggccuuccucgcucuauuucuacucauccuccucuuggcaucuaucuuucuaaaaaaauaaaucugauuaacccacuacccaccuauggcuccgcacuggcuaaaagauaaaaaccaaauuagcauucaagggcuuucucaauccagcucccaaaggaaaugucuagauuaaucucccucugccaccucuacauuuugcuauccugaacuuuuuauuuuucuuugaacauuccaugaucuuuuucacacuuuauucaugcuguuacuucugccugaaaugcucccaccccccuacuaucccauucucugcuuggaaaacuuguauucaucaacuaucacucccuuugugcuaccuucuucagggcucccaaugcauacuguaaauauugcuauaauaauacauaacccuacuauaauauuauucaccucuuuaaauaucugcuuugccuaaacccuauaaguccuuuaagggcaaggauugugacuugcugucucuguauccccaggaagucauuagcauccuacagaccuugacacauagcaggggcucauuaaugcuuuauuuaaaaacuauuacuuauaauuauguaauuauuaucauaauuagauaaugaaauauagaaacuacagauauaguguauucguauuuucuuucuuucuuucuuucuuuuuuuggagacaaggucucacucugucgcccagccuggaguguaguggcgcgaucucggcucacugaaaccuccgcuuccccagcucaagugauccucugccucagccuccccaguaggugggauuacaggcacaugccaccaugcccggcuaauuuuuguauuuguuguagagaugggguuucaccacauugcccagaaugguccuguacucccgagcucaagcaauccacccaccucagccucccaaagugcugggauuacaggcaugagccaccacgccuggcccaccacagccccuuuccaacugaaauuuaaucuuuucugauuuccuaucuuugugugugugugugugugugugugugugugugugucucacucuguugcccaggcuggagugcuggagugcaguggugcgaucucagcucaucgcaaccucccccuccuggguucaagcgauucucccgccucagccuccugaguagcugggauuacaggugagcaccaccacgcccggcuaauuuuuguauuuuuaguagagacaggguuucaccauguuggccagacuggucucguacucguaaccuuaggugauccacuugccucugccucccaaagugcugggauuacaggggugagccaccaugccugaccccuauucguuguuaauaccuuuacaaacucaccacauucugucacuuguaaucauuauuugugucccuguucauuucucauuaggccauaaauuacaugaggacagcaaccauauaguuuaaguuucuaucucccagaaaaguuaucacagugcuuuaaauacagcaagcauaaaaauguuggcuaaauucaacauuuguuugagugagauggaacaagaaaacaggggcagggauagggggaguaaccccaucaacuucaaugcuguacauuuuuacaucuauccaauuucccccaugcaugaccugaaauacuugguguagaguaccuguuuugcacaaaggaggccaccuuacuggaaagaaggcagagcauugaggaggaaccaagagcaaggagaggugggcacuuuaggaacugagaacuaaaaaucagcucuccauuaguugcuguaaacguuuaaucacucucaacauaaaauuuucugugugguuaauagagucagacagaccuguuugaaucccaaaucugacgcucauuauuugaccuuagccaaacugguuaaccaauccaagucucaguuucuucaucugccaaaagggaacgauaaauguauacuugauacagaugugagggugaaaugagcuaacguaugugaagcccucagcacagugucuggcauaauaaaauaggagcuguuccucuccguuggaauaguagggcaggacuugugcaacacugugaugggaaaacaaagauaaaggcagaacagagugcaacacauuaggaacauuucaggggagguuaccuagaagggccacuacauucuucucaggacuaaaucccuccugacuguugucuucaccccaauccuggaaaacucaccgucaccccauauuugagugcuaguccagccagggugucuccgggcuccaacugaugcuccaggcgucuuucccucacuggggagcaggccgauugcaccaggcuuccauaugaacgagcccggcucccuugaagcaguccugaccccccuggcgggggcugucuagacggggaagccaucucuucacccugccaacagcuaagguugcaacuaggggagguacgaccgagacugcgacugacaggccugaagucugggaaugaauauucaggggauuccuuucccccucucucuuccccuguguccccgccuccccagcacuacgccaucugcccccucccgguuucuccucccuccaagcuacuuauccacaaaucugucccuugaguauucagucccucccuaauucuccccuaagcaccccuccgacuuuggacucccccacaacuccucgcuacauugaccucugaccuuugaacucuagaaauaauccucaacacucuuuccucaguuugcccccaaguagccuggccucagggcgcuccaacaucccagcucuccccggucccgggguuuguuugcuagagucaggaacaaaucaggcccaccccaggugaacugucgccgcagacgaagagcgugaggauugcaagaauuuguaguacaccuuccacucagagauccucaaagguccgcuccgcauaagauaggucacacccucaaauuucggcuccacaucuagguuguugucccuccaaacgccucagauccgccaagaugcaagggccuggauccaguugagcggcaaggucuuugagaaaagacuucauuucccaaaaggcuccgcgucugcggagucgcagggcaccauaggaaaugcaguucccuccgagcaccagagaguggauuuccggaucgcgcaaugcaugcguggaagugcguccccggaaguacggaggccgacaggaagagaaggaaaaaagagaaggcgcugucccgcucuugcuacgguggccuggaggaguggcgaaaccggaacagagaauuuaucacuucugggacucacagucgugaugucuuucaagagggaaggagacgauuggagucaacucaaugugcucaaaguaagcgugagcggagaggaucuggagccgcuucagucgcucccugaagguugggaaggagcuuuguuucauugcucuggcaacaacucgggggugcaggagagaaccaggcgacuuagagcuguguagugacuccuuuuucggucuaugaucgcuguucuccccaggguccuuauuccauuucacuccucauuucuauaauuucacuuccaccccucucuccuaucccgcugaucccguccggauuucuuccccuacucccugcagaaaagaagagucggggaccuccuagccaguuacauuccagaggaugaggcgcugaugcuucgggauggacgguaagagcaaggaguggcucaagccugaggguucugcgguuagaggcucaauagacuuuuuuuuuuuuuuccuuugagacggaggucucgcggugcugcccaggcugcccucgaacucuagggcucaagugauccugccuccucagcgucgcgauuagcuggguuuacaagcgcaugccaccacgccuggcuucaacaaacuuuuguuauuaauuaggacagcaggaguaccuaggauucuuuggcggccagugaggacuggaagaaguggagauugggucaccagggaguuggguuuugcaaagacugcuaggacagggugggaccuauggcagggacgggcccaacccucuuccccuggaccacuuauccucuucucuaccccugcucagcuuugcuugugccaucugcccccaucgaccgguacuggacacccuggccaugcugacugcccaccgugcaggcaagaaacaucuguccaguaaguuagggggaagacgggauggggaauaaacccucgaaaucucugcacaccacucuuggugcuaugcuuuuaauucuguuucccuuucuccucaggcuugcagcuuuucuauggcaagaagcagccgggaaaggaaagaaagcagaauccaaaacaucagaaugaauugagaagggaagaaaccaaagcugagguaaucagagaguggagaguguguucuaggcaagacccugcugcacacaccaggcuggaagggcggagggcugaaggcucugacucugucucccaucuccuuaccaggcuccucugcuaacucagacacgacuuaucacccagagugcucugcacagagcuccccacuauaacaguugcugccgccggaaguacagguaugggacgggaaagccagagguaggaaggcucagaaggagacagauggcucuaaaagaguuuuccaguguguauucugaggaauacuaguguucuggagauguuacuuaguguuucaagaaaaggagaauuuuggcugggcgcggugacucacgccuguaaucccagcacuuuuggaggcugagguggguggaucacuugaggucaggaguucaagaccagccuggccaacauggugaaauccugucucuaccaaaaauguaaaaaauuagcuggguguguggugugugccuguaaucccagcuacucaagaggcugaggcaggagaauugcuugaauccgggagacagagguugcagugagccacggucacaccacuucacuccagccugggugacagagugagacuccaucucaaaaaaaaaagaaaagaaagaaaaagaaaaggagaauuuugugauuuuuaaauaaaguuugggaaauggcacuuuguaauucuacuugaagaauaacaguuuuaaaaacuauacaaagucuuaagauuaaaaaaaacuuguaaaauuuuaagcuagccuuucccaaauucaugauucugaaauccuuuguaugcagaacuuauuaauaucuugagaaauauaguuuaagaagcacuguuuuaagagguugggagucauaggagaguuggcccuuucccuuacugcuuuuacagacuauucuucucuaccuagaccagaagccccuggucccucugucucccuuuccccuaugccacccucagaggucaaacuccaaagugggaagaucaguagggaaccugaaccugcggcuggcccacaggccgaggagucagcaacugucucagccccugcacccaugagccccacaagaagacgagcccuggaccauuaucucacccuucgaaggugaguaugccuaaucaguuuccucagauuuucuuuucucucugacacccuuguuucaaagcuauuguuuuuccuuuuuuuuuuuuugagauggaguuucacucuuguugccccagcuggagugcaauggcacgcucucggcucacuguaaccuccaccuccuggguucaagcgauucuccugccucaggcucccgaguagcugggauuacaggcaugugccaucacgcccggcuaauuuuguauuuuuaguagagacgggguuucuccauguuggucaggcuggccucgaacuccugaccucaggugauccaccugccucaguuuccuaaaguguugggauuacaggugugagccaccgcacccggacucccauuguuguuuuccaucuuugguuucguuuuguuuuagccacccaacuuacauggcucucaauuuuuucucacugcuaacuuuuuuuuuuuuuuuuuuuuuuuuuuugguagagacaggguuucacuauguuggucaggcuggucucgaacuccugaccucaagugauccaccugccucggccucccagagugcugggauuacuggugugagcucaccacuaacuucuuaauaagccucuuuccugaucgaugcuauuuucucugauguuuccagcucuggauggaucccagauggacgaggucgauggguaaaagaugaaaauguugaguuugacucugaugaggaggaaccaccugaucuccccuuggacugauacccuuuucccauucauucacaaauaaauuacaaugggugcugagaacuuaacuuuccuuaagucugguuccuuguuggaucucaggauuucagaucuguucauucucauuccaacuacuccuugccugcaagguacacagcucuccacacuccuuuuuuuuuuuuuuuuuuuuuugaggcagagucucgcucuaucgcccaggcuggagugcaguggcacgaucucggcucacugcaagcucugccucccagguucacgccuuucuccugccucagccuccugaguagcugggacuacaggcgcccgccaccaugcccagcuaauuuuuuguauuuuuaguagagacgggguuucacuguguuagccaggauggucucgaucuccugaccucgugauccgcccaccucggccucccaaagugcugggauuacaggcaugagccaccgcacccagccacggcuauccauacuucuaaccccucccccaccuccuaccaaagccaugccaagcgucagcugcaucagccuggugcccuauuaauaagacugucaaaaag

SEQ ID NO: 13732 - RNA, 9276 nt, Homo sapiens
caaguagaauuacaaagugccauuucccaaacuuuauuuaaaaaucacaaaauucuccuuuucuuuuucuuucuuuucuuuuuuuuuugagauggagucucacucugucacccaggcuggagugaaguggugugaccguggcucacugcaaccucugucucccggauucaagcaauucuccugccucagccucuugaguagcugggauuacaggcacacaccacacacccagcuaauuuuuuacauuuuugguagagacaggauuucaccauguuggccaggcuggucuugaacuccugaccucaagugauccacccaccucagccuccaaaagugcugggauuacaggcgugagucaccgcgcccagccaaaauucuccuuuucuugaaacacuaaguaacaucuccagaacacuaguauuccucagaauacacacuggaaaacucuuuuagagccaucugucuccuucugagccuuccuaccucuggcuuucccgucccauaccuguacuuccggcggcagcaacuguuauaguggggagcucugugcagagcacucugggugauaagucgugucugaguuagcagaggagccugguaaggagaugggagacagagucagagccuucagcccuccgcccuuccagccuggugugugcagcagggucuugccuagaacacacucuccacucucugauuaccucagcuuugguuucuucccuucucaauucauucugauguuuuggauucugcuuucuuuccuuucccggcugcuucuugccauagaaaagcugcaagccugaggagaaagggaaacagaauuaaaagcauagcaccaagaguggugugcagagauuucgaggguuuauuccccaucccgucuucccccuaacuuacuggacagauguuucuugccugcacggugggcagucagcauggccaggguguccaguaccggucgaugggggcagauggcacaagcaaagcugagcagggguagagaagaggauaagugguccaggggaagaggguugggcccgucccugccauaggucccacccuguccuagcagucuuugcaaaacccaacucccuggugacccaaucuccacuucuuccaguccucacuggccgccaaagaauccuagguacuccugcuguccuaauuaauaacaaaaguuuguugaagccaggcgugguggcaugcgcuuguaaacccagcuaaucgcgacgcugaggaggcaggaucacuugagcccuagaguucgagggcagccugggcagcaccgcgagaccuccgucucaaaggaaaaaaaaaaaaaagucuauugagccucuaaccgcagaacccucaggcuugagccacuccuugcucuuaccguccaucccgaagcaucagcgccucauccucuggaauguaacuggcuaggagguccccgacucuucuuuucugcagggaguaggggaagaaauccggacgggaucagcgggauaggagagagggguggaagugaaauuauagaaaugaggagugaaauggaauaaggacccuggggagaacagcgaucauagaccgaaaaaggagucacuacacagcucuaagucgccugguucucuccugcacccccgaguuguugccagagcaaugaaacaaagcuccuucccaaccuucagggagcgacugaagcggcuccagauccucuccgcucacgcuuacuuugagcacauugaguugacuccaaucgucuccuucccucuugaaagacaucacgacugugagucccagaagugauaaauucucuguuccgguuucgccacuccuccaggccaccguagcaagagcgggacagcgccuucucuuuuuuccuucucuuccugucggccuccguacuuccggggacgcacuuccacgcaugcauugcgcgauccggaaauccacucucuggugcucggagggaacugcauuuccuauggugcccugcgacuccgcagacgcggagccuuuugggaaaugaagucuuuucucaaagaccuugccgcucaacuggauccaggcccuugcaucuuggcggaucugaggcguuuggagggacaacaaccuagauguggagccgaaauuugagggugugaccuaucuuaugcggagcggaccuuugaggaucucugaguggaagguguacuacaaauucuugcaauccucacgcucuucgucugcggcgacaguucaccuggggugggccugauuuguuccugacucuagcaaacaaaccccgggaccggggagagcugggauguuggagcgcccugaggccaggcuacuugggggcaaacugaggaaagaguguugaggauuauuucuagaguucaaaggucagaggucaauguagcgaggaguugugggggaguccaaagucggaggggugcuuaggggagaauuagggagggacugaauacucaagggacagauuuguggauaaguagcuuggagggaggagaaaccgggagggggcagauggcguagugcuggggaggcggggacacaggggaagagagagggggaaaggaauccccugaauauucauucccagacuucaggccugucagucgcagucucggucguaccuccccuaguugcaaccuuagcuguuggcagggugaagagauggcuuccccgucuagacagcccccgccaggggggucaggacugcuucaagggagccgggcucguucauauggaagccuggugcaaucggccugcuccccagugagggaaagacgccuggagcaucaguuggagcccggagacacccuggcuggacuagcacucaaauauggggugacggugaguuuuccaggauuggggugaagacaacagucaggagggauuuaguccugagaagaauguaguggcccuucuagguaaccuccccugaaauguuccuaauguguugcacucuguucugccuuuaucuuuguuuucccaucacaguguugcacaaguccugcccuacuauuccaacggagaggaacagcuccuauuuuauuaugccagacacugugcugagggcuucacauacguuagcucauuucacccucacaucuguaucaaguauacauuuaucguucccuuuuggcagaugaagaaacugagacuuggauugguuaaccaguuuggcuaaggucaaauaaugagcgucagauuugggauucaaacaggucugucugacucuauuaaccacacagaaaauuuuauguugagagugauuaaacguuuacagcaacuaauggagagcugauuuuuaguucucaguuccuaaagugcccaccucuccuugcucuugguuccuccucaaugcucugccuucuuuccaguaagguggccuccuuugugcaaaacagguacucuacaccaaguauuucaggucaugcaugggggaaauuggauagauguaaaaauguacagcauugaaguugaugggguuacucccccuaucccugccccuguuuucuuguuccaucucacucaaacaaauguugaauuuagccaacauuuuuaugcuugcuguauuuaaagcacugugauaacuuuucugggagauagaaacuuaaacuauaugguugcuguccucauguaauuuauggccuaaugagaaaugaacagggacacaaauaaugauuacaagugacagaauguggugaguuuguaaagguauuaacaacgaauaggggucaggcaugguggcucaccccuguaaucccagcacuuugggaggcagaggcaaguggaucaccuaagguuacgaguacgagaccagucuggccaacauggugaaacccugucucuacuaaaaauacaaaaauuagccgggcgugguggugcucaccuguaaucccagcuacucaggaggcugaggcgggagaaucgcuugaacccaggagggggagguugcgaugagcugagaucgcaccacugcacuccagcacuccagccugggcaacagagugagacacacacacacacacacacacacacacacacacaaagauaggaaaucagaaaagauuaaauuucaguuggaaaggggcuguggugggccaggcgugguggcucaugccuguaaucccagcacuuugggaggcugagguggguggauugcuugagcucgggaguacaggaccauucugggcaauguggugaaaccccaucucuacaacaaauacaaaaauuagccgggcaugguggcaugugccuguaaucccaccuacuggggaggcugaggcagaggaucacuugagcuggggaagcggagguuucagugagccgagaucgcgccacuacacuccaggcugggcgacagagugagaccuugucuccaaaaaaagaaagaaagaaagaaagaaaauacgaauacacuauaucuguaguuucuauauuucauuaucuaauuaugauaauaauuacauaauuauaaguaauaguuuuuaaauaaagcauuaaugagccccugcuaugugucaaggucuguaggaugcuaaugacuuccuggggauacagagacagcaagucacaauccuugcccuuaaaggacuuauaggguuuaggcaaagcagauauuuaaagaggugaauaauauuauaguaggguuauguauuauuauagcaauauuuacaguaugcauugggagcccugaagaagguagcacaaagggagugauaguugaugaauacaaguuuuccaagcagagaaugggauaguaggggggugggagcauuucaggcagaaguaacagcaugaauaaagugugaaaaagaucauggaauguucaaagaaaaauaaaaaguucaggauagcaaaauguagagguggcagagggagauuaaucuagacauuuccuuugggagcuggauugagaaagcccuugaaugcuaauuugguuuuuaucuuuuagccagugcggagccauagguggguaguggguuaaucagauuuauuuuuuuagaaagauagaugccaagaggaggaugaguagaaauagagcgaggaaggccaguuaaacuguugcaauaaccccagaugagaaauacugagggucuauuuuaaaucuuuggcaguaggaaggugagaccagaugugagagagauuuuugaagcaguuuuguugaccacuugguauggugaugaaaggcaaguauuaguuaaggaugacauugauguuucuaccuugggaggccaggcagauagauggugaugccagucacuauguccagugaugaauaaauaggucaaaauaaauauuuauuaaugacauuguuaauaguauagugugaaaagcauucucagaagcagugaaaagacccaggauugucauucuagcucugucauuaacuugauagauaauuuuaggaaaguagcuuaaccucucugagccucaguuccuucauuuuuauuuauucauuaauuuauuuauucauuuauuuuuaauuuuuuaauuuuuagaaauggcgucucacuauauuacucaggcuggacucuaauucccgggcucaagcuauccucccuccucagccuccugaguagcuggaauuauaggcaucagacauugcgccuggcuugcacaauaauuuuuuaaaauguaagggggcccuaagaccaaaaagugugaaaaccacucaucuauagaauagaaauaaugucagcccuuuguacuuuagcuugguuguuauggaaucaaagaagacucuguacagucacuuuaaaaagcucaagauguaagauugaucauuauuacuguccuuaauuuuggugacuuuuuuuuuuaagauggaacagauuaaacgugcaaaccgccuuuauacuaaugacuccaucuuccugaagaaaacccucuacauccccauccugacagagcccagagaccuguucaaugguuuggacucugaggaagagaaagauggagaggaaaaaguacacccaaguaacagugaaguuuggccacacucaacugagaggaagaaacaagagacaggagcaggacgugccaauggugaaguccuccccacaccuggccaggaaacccccacgcccauccaugaccucucugccucugauuuccuuaagaagcuugauucacagaucagccuguccaagaaggcugcugcucagaagcugaaaaaaggggaaaaugggugagucuugaaugguuccuuauaaguuccucccuagacuccuccaucauuccugucuuaccuaaccacaaacacaaguaaguaaggacagugccaacagaggcaaggugauaccuuucccccauguggccccaagauaaugagcagaggugauggcugcuggccuggguagaggcaguggaaaacuggguucuguguucuuauuggagucagacaguuaacuauuuuuuuuuuuuuuugagacggggucuugcucuguugcccaggcuggagugcaguggcgcgaucuuggcucacugcaagcuccgccucccagguucacgccauucuccugccucagccucccgaguagcugggacuacaggcgcccgccaccacgcccggcuaauauuuuguauuuuuaguagaggcgggguuucaccauguuagccaggaugaucucaaucuccugaccucgugauccgccagccucggccucccaaagugcuggaauuacaggcgugagccacagcggccagcugacaguuaacuguuuuuacugcucugaucauccaugaaggagcauuaggguuaggauuuaucuagaggguacugagacugucuugaagcaaccagcuuauguauuagaagauagcuuuccauguaccucucacuuggcccauugucagguucuucccuugaucugucacucuuuccccccuuuccucaauugcaggguaccuggggaggaugcaggucuccaccugagcuccccuuggaugcagcaacgagcaguccuagguccugugccgcugacccguaccucucggacccggacacuacgggaccaggaggaugaaaucuucaaacucugauguccccagaacugacugagagaagcaagauguugaaagagaaacuucagggggagaggagccugaggugaggcucaagaacauggcuuaugagccugccucccuccacuccagccauccuccccagccuccuugucugccaaaaauuccuuggccuggggcaguuuuauuggcaagauuagggaaugggaacuggaccuuucccaguucuugggcugaaucuagaguugaguccuuuagacucaaaaggcucuuuuuauauccuuguugccuuuccuauccuuuuuaccuuucccuggccuuagaacagggaagcagagacucccccucagcuucuuccucaucuccaacuaugugacauaauuuauuuggugcuaauauugaaguaauauuuauuugcuauauuuuauuucuucccacucuuagcugaaaaauggaauuucuauagcccuggggugaggagaacccgggaacagugagccagugacugcugguucuccacuuuccccaccuuguuagccaaacauguuauugaggaugaggcaaucggugauauagcccaccacagagaauggaugacuguuggccuuuucuccaaucucaaagugacagauuugggcugauucuuuuuuuuuuuuuuuuugguaccccauuccuguugaaugggcucagucuugacaaaccaauucccuguaacuuuuucacaauucuugacucugagaaaaagcagcacuguagggaccugaacucuccauucuaccaguucacccuucugaccuguucugcucagccuguggugaggggaacagauggaagaaggcuuuccuugggguuugaagaggaagccaguugugggagucucuuuguuacacccccuccccuccagacccucucucucuaugccuuccuccucacugcauauuuauuugcgauuuguagcacugaucuaugguacaguuguuuuguuucuuaaacagaaguagguaagggaaccucaguaauaauggaaaucugccucagucuccuguuuggaaaugaugagaggugagauaaguaauguuuauauaccuccuuucuucugugaugauuauaagguauacgaagcuggacagauuaaacauugagcccugugcauauuuuaguaguuuuauuuccccuaugagaaucuccccugcccuagccccuucuuccugcacucuggaacagagccucuggcaucuguccaagcucugucucuaagggccaccuuccccucuucugucuuuaguauccccaaagggguucucugggcugugccuccuuuccuugguucacaugggagggggcuucccuguuucagaagucccuuaugggagaaauagagauccaaguuucacuucaccuuuuucaggcaguucuguuuccuguccuggggcuggagugggagagaggccucaccccucagcauugcuccuucuccacuagcuguuugggggugggcuggucucagagucaaaagcacucuugggaaggaaugaagccugaagauugaaaaguguuagugccaggugagcaggguuaggaagcccauuaucuguguuuucucagucaaccauuuugucaagguggaaugugcuaggcucagggcucucagagcuucccuucgucuagcagcuuccugaguccgucacagaucuugccaaggugcugagugaagucaggcccauagagggccgugagcagaccugggucagagaagugaucaaacacguggcggaugcggccaugugacuugggcgugaggugguguuccaccaacucuagcagcacaucccggcacucggucagcaggccagccagaacagcagccucgaaggugaagucuaccucaccaaagcuaagugccgucauggcacccugccgcagcuucuggcgaaagcggguagccagggccagcucacuggggccaaaggagccauugcggugcagcacagccaccuugauggccacuuugaucagguccuugaucacgcgcugggccuggggccggcugugcguguacuccuuggacacacgguagagcucaucuagcaccucacugcuugucucaucuaugaagagaugagccacagagcgacccgccaucuuacucaguagcuucuucucugcuugcagugccaggcucuuugagcugaaggacuccauggguccuggagagugggguauguggucagucacuagaagaaaggccacaggcuu

SEQ ID NO: 13733 - RNA, 10137 nt, Homo sapiens
gggucgcccgagugaucgcaggcuccgacugggucucgagggucggcugcuucggucugcccuggagagguuuucagcuucggcgcgaggcacuugggcaggauccccgggcugcacccuccuccgcccgcgccccguggggcuggaagugggaaugugcccacccuggcggggaccgggggccgcacagcaguuggggguggguggggguggguaggaguaaggggacagggacaccgccgcucggagcccgggaccccgcggcauccagugcgucugugucggucccagugggagaccucccaccccgaaaagagaccgaaguggcggaaggagcccgcacccgccuccccaggucggcgguuucucuagcgcaaggugacgggcguggacgcggcuguggggccgggagcggaggguuggggucuggccucccgcgccggggcgaaggggcagccgcagcgcagaggcccgccccgcccuccccucccgucacgcccagccucccggcccuugggcugcucgcggccuuuuuuucccggcugggcucgggcucagcucgacugggcucggcgggcggcggcggcggcgccggcggcuggcggaggagggagggcgagggcgggcgcgggccggcgggcgggcggaagagggaggagaggcgcggggagccaggccucggggccucggagcaaccacccgagcagacggaguacacggagcagcggccccggccccgccaacgcugccgccgggugagucggggcccccgcccggcgcccgagccccgcgcgggggugggaaggggcugcggaaaaguugggagccccgggugccgcuuugucgcggggccgcggaggggucgggcugggaaggccgcggggccggggcgaggagggaggcggcgcuggcggggggcgcugcgggcgcucauggcggcggccgccggguaaggcgggcgcagcgccucaagggagcggccggggccggcgggccuggcgccgcgguguccgcggcagcgccgcccugagccggagaagcuuucccgggcaacagguagggcggaagguggggacgcgggggcugcgggcgacggggccgagccgugggcuucccuuuguuggggaguggaggagcuuggugaccauuggcgcgagagccuccacccuggcagcggcccgcgggguugcccuggccuggacgcguccuguggcuugggugggaggagaggggagggcccugccccguuuucuuccuaccggcccaccgugcccaccucgcaggcgaggucagagcuuccaugugcuuaacgggaaacaggaaggagcggcccggagcgccugccccggcccgguagggcuaaggcauaccguuaugagguguggauggcuggcaagggagcuccugguggaacuggcuuucugggccguagcuuguuaaucacuagaggcccguggcaaguggguugacugcagguguagagcacucaucuuuagccugcaguuggagucucucccucccuaagccuagcuccuggcaucaaaaccugguuucagucaccugaguugccaggcccagguucaggggguucugaggaucguggcgaaugcagugagccccuguuccuggagaagugaguccgagcaggccuccagcaggcagucacccccauaucugugcuggggcagggguggguggcgguugcugccgcauaccggagucgggaugaccgcaccggggugugaguggcugcacauguaaaggggcuccuaaggguaaggacuugccugcaguccugucccugaggaccuggcgcugaccauaccgugaucugcacagucuguuccagagagggauccuuuucuccccuggucccccacuucccucacuggggccucuggccagauuuuccccugggaggaagggccuccuuuuaccccugucacuggccauaggcuggcugaucccucacuguguccuucaacaccgccccagcugucucucaaacccaccggcgucucccugccccuggggccauagucucaugcaguguuuugguccguggaggccuuuggugggacuuugcagacaagcuguaggccagaugaggcugaggacuacuguucugacugccucucacccaccucuuuuuuacaaucuggcuuauuuugaggcccauccugcagccuggagggauaacacaccucucauuggcuccauccauggcuuguagacuucuaguacaugaccugcuucuguugccugaaaguuuucaacaaggaagacuauucaggacuucuucaguggaagcagggagccggugggaccuuugucacuccucccuugucaacaacuccuuucuauuuuccucaguuauucuuccaaacuaugagagccagucagacugaccaccuggagucugagagaauuccuuccucucaggccgaaacuucugccuucucagccguuuggaucuacaaacucccauggggauccucugcuccuuucauccaccuagaggggucuugugggggugucagucagaguuggggcaaagguuggggcuggacagaguccugcucaaguuccugcuaaucuaaugccaguuaaaucccugcucuucuggccccucuccagccugugccucagaaaguggcaucugugccuccaaggcaggugugugugagagagagcguagacagauaccaugucucuucauguguaugggggagugaagucuggguggaaaaguguuucuagaugugauuuucuccauaagaagucaaguaacugcccugaaggcccagggggccuggaaaaacaggguugucuccuuaccguguguacacuucagcuuuucuugccccagccucuuguuuauggggucuugcuuggaucugugugcuggugcuaagaggccuccccaguacugccacagggacccaacucuuugguucuguggggauguguaagugaggccggccaggccccagcuguccuccccucucuucauguugagucagagguccugacccugcugaaucuggggccucccugcuggggagauggggguagugccucucugcuaauggaggugcaggaccaccagggagggcuguggucaugggaagccugcaaccucaguguaaaagcccccauuaaucugcauuucccaagucuuccacucucccugcuuggaguggaagaggacaggcgcuaucucaucuuggggaugaggaaguugcacugcccaggugucuguccuugaccaugcucuagugccuacuuugccugccccccacccccuguuuugcaggcaugagacauuccugggccccaggaguccagcaggggcuccacccucccucugcgacuccagccugccgccugacuagagaaacaucccugccaguuuucacagaccugguuggggaugggaucugaagucuaggacugccagggcaacaugguaccuuuggcuuuacauuucccuggagaaguugggcuccaagagacagcagucaggugacugggucaggcugauuucucgcuuccaaucaggcugagcaaaaaagugggaagagggggccaugugcacacaucaaaguguuccgcauugucccuucucugugcauuuucuacccuugucccuucuuuauucaauuuucuacaacuuuucucuaggaaaaaaguguguguuuguguggggaaaguuccacuguggauaauuacauuuaauuuuguucaguucagaaggcuuccaucuguuuaauuaaauauuuauucuggcugagguggagggggcaggggcagugucuggaaugugugugugugauuugggggaggaggaggggagaagguggagcugaagcuccuuuacuggcagugcugaccucugauuucauccgagagagcagugaccaggaguggggacaaggggguaaaguccuugagcuggaauacugacccgugacaggcugagggauuucgcaagggcuacagugguggguggggguggagcgggagcugucagagcagcagcaggaccagcccagcccagcuguggucucaggcucugucuucagucaguggcaccaacuagucuccaggucacuguggauaacaauuucaccacucucuuuucuuccugucucugcuuucacuuucugggccagccuaaaucccaccgccucaucuccuucccaggagaacaagggguggggagccuggaaaagacugucauggucauccugcugcggcuucuugcugaguccuaggauugccagguguuugcuggacccagcaucccuggcucuccuggaccaucuugccauuccucucagcuucaagcagcugcucuucccucaugagccacacacgucugaccguucccucccuccucuggguauccaaguggucacucccaccauguuguucgucuuucaguugggggaggagguuuacauagcggcucuuuccuagacugagaggguauggguguuccccugcagacuaggauucuguuuucuggaugagcauuuauacgaaauagcucugaccaggcaccguggcucaugccuguaaucccagcacuuugggaggccaaggcuggcagguugcuugagcccaggaguucaagaccagucugggcaacauggcaaaacccuguuucuaccaaaaaaaaaauucaaaaauuagccagauguggugugugcuacuugguagugcaugcuacucauagccccaggcacucgggaggcugaggcaggaggggaggauggcuugaaccugggagguggagguugcagugagcugugauuguaccacugcacuccagcuugggugacagaggaagacccugucucaaaagaaaauaaaagaauagcucuuaauuccaucagauguauugguccgcucucuugguucccugccccacaaucccugacucuuugcagcccuaccuucacuuuucuuucugaagaguuauacauaggguccuucugccuuguguguagggacuagauggcuuggcauggagugucaaccuugugugcaguaguucgauguccagugauuguggagcucagugucauuuggggacauaauuuugcuuuaccuuggcuuuuuuuuuuuuuuuuuuuuuuuugagacagagucucacuguguuacccaggcuggagugcaguggcaagagcauggcucacugcaaccuucaccucccaggcucaagugauccucccaccucagccuccugaguagcugggauuacaggcaugugccaccacauccagcuaauuuuuguauuuuuuguagagaugggguuucaccguguugcccaggcuggucucaaacuccugagcucaagugaucagccugccuuggucucccaaagugcugggauuucaggcgugagcuacugcccagccuacccugucucuuaauuuuucuuuagggacuugcuacucagauggguuguagguuguagggaaggggaagaaggguuugccucagcccugcaauguuuuggggcacccccuggaagcuuucagcugaguuggcuuggaggcucgaggaaguggccagaguguagggggauaagggagggacuuuacucagauuguuggcuacagcuucuagggccagguccugccugucuugcagguuaagauagcaaaaugacaagacccccaagguucuucccccacuccccgaaaucagagguuguaaggaccccaaguuucuuaauuccagggaaucacgucugcagguugcuguagacaauaaaugcuuuuuuuuuuuuuuugagacagucucgcugucaccuaggcuagagugcaauggcgugauuccggcucacugcaaccucugccuccuggguucaagcgauucuccugccucagccuccugaguagcugggacuauaggcgcccgccaccacacccagcuaguuuuuuguauuuuuaguagagaugagguuucgccauguuggccaggcuggucucgaacuccugaccucgugaucugccagccucggccucccaaagugcugggaccacaggcaugagccaucacggccggccuaacaguaaauguuaaaacuggaaagccaccguauuacagaugaggaaacugauuugcccaaggcuacauagccaggauagggaucuagaguucgacucucugcccccuucuccuuuugauacauccugaaaacuuuuauucaucuaucucuuccuccauagcuacucccucuugaugcccuccccuuugccccucacucaggaugcuccagaccuuguaugauuacuucuggugggaacgucuguggcugccugugaacuugaccugggccgaucuagaagaccgagauggacgugucuacgccaaagccucagaucucuauaucacgcugccccuggccuugcucuuccucaucguucgauacuucuuugagcuguaagcaugccagccuacccucaugccuuccccuguugccaguugcaguuucuuggacuucaaguuuguuccuugcuguuuaauuagcccuugacccugauguucuggcuacucagguuccugcccacugugcacccccuccccugaaggcaccauugucuuccugaaggcucagcacccccaggcccuuuccaucaaugguuauuuguucucacccucuacccgccgcccgccuggccacuagugaacacacaggcagcuuugucagcugugggcagcccuggaggcuagagaaaaggggguugccaggaagcuggggaaacugaggccaggguaaaguugccuuagcuugcagcccuuucccuucccagcaagcuagauaccuuacucauaucccuuccccagguacguggcuacaccacuggcugcccucuugaacauaaaggagaaaacucggcugcgggcaccucccaacgccaccuuggaacauuucuaccugaccaguggcaagcagcccaagcagguaugagccgcaugcugcucuggcucugggaaucacugaguuuggugguggggggacaggguuugaauguuagcucuggcaggugaagagauggggaagcaguggugcugacugagguuguuacugggagaggcuggggaugcugcugaguuccgaagguaaacauaacaaugggcuucuucacugugcccagguggaaguagagcuuuugucccggcagagcgggcucucuggccgccagguagagcguugguuccgucgccgccgcaaccaggaccggcccagucuccucaagaaguuccgagaagccaggugggggaggcuggggcagaagcugggugacaaggaauauccugaugugucuugcugggagggauaggcgguggcuauacgcagggagaugugaggaggugaauucaguuauuaaugguaucuugugaggguaucugcagguauuugggggcugcugggggacugugcuauccucugaccuagccauuucugcuuccucugccagcuggagauucacauuuuaccugauugccuucauugccggcauggccgucauuguggaugugaguggggauuacugggaggugggaguagguucucuggcaaggucaggugaggccauggaauuuggguuccuccucuuuuaacuucucaccaucucucugcagaaacccugguucuaugacaugaagaaaguuugggagggauaucccauacagguaugaguucugcuuccucauguggggguggacuaagacacacccuagugaagagacgguuuguggaauccauggcagagggauuagagugauggaaugaagaaccucaggggcuaggggguuuguggaguggggacacccuugcggcugguugcucuuaccucucucuccucucccagagcacuaucccuucccaguauugguacuacaugauugaacuuuccuucuacuggucccugcucuucagcauugccucugaugucaagcgaaaggugggugaagggguugugcaauuaagccucagagccaaaaugaggcccugggaugaacacccucuccuuugacuucuggguacucugaauggagcuguugguauauggggaaccaaaggcaagggguaagaaggcauagugagagcuggggaauaaaaaaaggcccuggggccugcaucaucucugcaggauuucaaggaacagaucauccaccauguggccaccaucauucucaucagcuuuuccugguuugccaauuacauccgagcugggacucuaaucauggcucugcaugacucuuccgauuaccugcuggaggucaggcuuccucaaaucuagagacccuggugcagguucuucugucccuuugguuuucuuugggagggaggugcggggugggaauuuggaggaugacauuccugggaccaaggaggagggcacagagucagugcuccuaacuggaguguacauaugaauguacucgagggagucaggagcccaugaugauggaugggggcucucuaugcagucagccaagauguuuaacuacgcgggauggaagaacaccugcaacaacaucuucaucgucuucgccauuguuuuuaucaucacccgacuggucauccugcccuucuggugaguaggcagcuaggcuacacuccuguucugaagaaaucaggagccuugccuuucuuccccuccuguaucuccccggugucugaccugcucuuguccacguucucucucuccuugaauccucaggauccugcauugcacccugguguacccacuggagcucuauccugccuucuuuggcuauuacuucuucaauuccaugaugggaguucuacagcugcugcauaucuucugggccuaccucauuuugcgcauggcccacaaguucauaacuggaaaggugaagcccuguucccauuguguaggccuuacuacucucuacaacuuccugaacucccaucuugccaguaacucucuaaaaaacuaguguggagcccuggguauaacaggaacaagcccucagagagaagcaguacuuagggguuugaggaucucauguaauaacccuucuugucccuuuuccacagcugguagaagaugaacgcagugaccgggaagaaacagagagcucagagggggaggaggcugcagcugggggaggagcaaagagccggccccuagccaauggccaccccauccucaauaacaaccaucguaagaaugacugaaccauuacuccagcugccucccagauuaaugcauaaagccaaggaacuaccccgcucccugcgcuauagggucacuuuaagcucuggggaaaaaggagaaagugagaggagaguucucugcauccucccuccuugcuugucacccaguugccuuuaaaccaaauucuaaccagccuauccccagguagggggacguugguuauauucuguuagagggggacggucguauuuuccucccuacccgccaagucauccuuucuacugcuuuugaggcccucccucagcucucuguggguagggguuacaauucacauuccuuauucugagaauuuggccccagcuguuugccuuugacucccugaccuccagagccaggguugugccuuauugucccaucugugggccucauucugccaaagcuggaccaaggcuaaccuuucuaagcucccuaacuugggccagaaaccaaagcugagcuuuuaacuuucucccucuaugacacaaaugaauugaggguaggaggagggugcacauaacccuuacccuaccucugccaaaaagugggggcuguacuggggacugcucggaugaucuuucuuagugcuacuucuuucagcugucccuguagcgacaggucuaagaucugacugccuccuccuuucucuggccucuucccccuucccucuucucuucagcuaggcuagcugguuuggaguagaauggcaacuaauucuaauuuuuauuuauuaaauauuugggguuuugguuuuaaagccagaauuacggcuagcaccuagcauuucagcagagggaccauuuuagaccaaaauguacuguuaauggguuuuuuuuaaaaauuaaaagauuaaauaaaaaauauuaaauaaaacauggcaauaagugucagacua

SEQ ID NO: 13734 - RNA, 10137 nt, Homo sapiens
uagucugacacuuauugccauguuuuauuuaauauuuuuuauuuaaucuuuuaauuuuuaaaaaaaacccauuaacaguacauuuuggucuaaaauggucccucugcugaaaugcuaggugcuagccguaauucuggcuuuaaaaccaaaaccccaaauauuuaauaaauaaaaauuagaauuaguugccauucuacuccaaaccagcuagccuagcugaagagaagagggaagggggaagaggccagagaaaggaggaggcagucagaucuuagaccugucgcuacagggacagcugaaagaaguagcacuaagaaagaucauccgagcaguccccaguacagcccccacuuuuuggcagagguaggguaaggguuaugugcacccuccuccuacccucaauucauuugugucauagagggagaaaguuaaaagcucagcuuugguuucuggcccaaguuagggagcuuagaaagguuagccuugguccagcuuuggcagaaugaggcccacagaugggacaauaaggcacaacccuggcucuggaggucagggagucaaaggcaaacagcuggggccaaauucucagaauaaggaaugugaauuguaaccccuacccacagagagcugagggagggccucaaaagcaguagaaaggaugacuuggcggguagggaggaaaauacgaccgucccccucuaacagaauauaaccaacgucccccuaccuggggauaggcugguuagaauuugguuuaaaggcaacugggugacaagcaaggagggaggaugcagagaacucuccucucacuuucuccuuuuuccccagagcuuaaagugacccuauagcgcagggagcgggguaguuccuuggcuuuaugcauuaaucugggaggcagcuggaguaaugguucagucauucuuacgaugguuguuauugaggaugggguggccauuggcuaggggccggcucuuugcuccucccccagcugcagccuccucccccucugagcucucuguuucuucccggucacugcguucaucuucuaccagcuguggaaaagggacaagaaggguuauuacaugagauccucaaaccccuaaguacugcuucucucugagggcuuguuccuguuauacccagggcuccacacuaguuuuuuagagaguuacuggcaagaugggaguucaggaaguuguagagaguaguaaggccuacacaaugggaacagggcuucaccuuuccaguuaugaacuugugggccaugcgcaaaaugagguaggcccagaagauaugcagcagcuguagaacucccaucauggaauugaagaaguaauagccaaagaaggcaggauagagcuccaguggguacaccagggugcaaugcaggauccugaggauucaaggagagagagaacguggacaagagcaggucagacaccggggagauacaggaggggaagaaaggcaaggcuccugauuucuucagaacaggaguguagccuagcugccuacucaccagaagggcaggaugaccagucgggugaugauaaaaacaauggcgaagacgaugaagauguuguugcagguguucuuccaucccgcguaguuaaacaucuuggcugacugcauagagagcccccauccaucaucaugggcuccugacucccucgaguacauucauauguacacuccaguuaggagcacugacucugugcccuccuccuuggucccaggaaugucauccuccaaauucccaccccgcaccucccucccaaagaaaaccaaagggacagaagaaccugcaccagggucucuagauuugaggaagccugaccuccagcagguaaucggaagagucaugcagagccaugauuagagucccagcucggauguaauuggcaaaccaggaaaagcugaugagaaugaugguggccacaugguggaugaucuguuccuugaaauccugcagagaugaugcaggccccagggccuuuuuuuauuccccagcucucacuaugccuucuuaccccuugccuuugguuccccauauaccaacagcuccauucagaguacccagaagucaaaggagaggguguucaucccagggccucauuuuggcucugaggcuuaauugcacaaccccuucacccaccuuucgcuugacaucagaggcaaugcugaagagcagggaccaguagaaggaaaguucaaucauguaguaccaauacugggaagggauagugcucugggagaggagagagagguaagagcaaccagccgcaaggguguccccacuccacaaacccccuagccccugagguucuucauuccaucacucuaaucccucugccauggauuccacaaaccgucucuucacuagggugugucuuaguccacccccacaugaggaagcagaacucauaccuguaugggauaucccucccaaacuuucuucaugucauagaaccaggguuucugcagagagauggugagaaguuaaaagaggaggaacccaaauuccauggccucaccugaccuugccagagaaccuacucccaccucccaguaauccccacucacauccacaaugacggccaugccggcaaugaaggcaaucagguaaaaugugaaucuccagcuggcagaggaagcagaaauggcuaggucagaggauagcacagucccccagcagcccccaaauaccugcagauacccucacaagauaccauuaauaacugaauucaccuccucacaucucccugcguauagccaccgccuaucccucccagcaagacacaucaggauauuccuugucacccagcuucugccccagccucccccaccuggcuucucggaacuucuugaggagacugggccgguccugguugcggcggcgacggaaccaacgcucuaccuggcggccagagagcccgcucugccgggacaaaagcucuacuuccaccugggcacagugaagaagcccauuguuauguuuaccuucggaacucagcagcauccccagccucucccaguaacaaccucagucagcaccacugcuuccccaucucuucaccugccagagcuaacauucaaacccuguccccccaccaccaaacucagugauucccagagccagagcagcaugcggcucauaccugcuugggcugcuugccacuggucagguagaaauguuccaagguggcguugggaggugcccgcagccgaguuuucuccuuuauguucaagagggcagccagugguguagccacguaccuggggaagggauaugaguaagguaucuagcuugcugggaagggaaagggcugcaagcuaaggcaacuuuacccuggccucaguuuccccagcuuccuggcaacccccuuuucucuagccuccagggcugcccacagcugacaaagcugccuguguguucacuaguggccaggcgggcggcggguagagggugagaacaaauaaccauugauggaaagggccugggggugcugagccuucaggaagacaauggugccuucaggggagggggugcacagugggcaggaaccugaguagccagaacaucagggucaagggcuaauuaaacagcaaggaacaaacuugaaguccaagaaacugcaacuggcaacaggggaaggcaugaggguaggcuggcaugcuuacagcucaaagaaguaucgaacgaugaggaagagcaaggccaggggcagcgugauauagagaucugaggcuuuggcguagacacguccaucucggucuucuagaucggcccaggucaaguucacaggcagccacagacguucccaccagaaguaaucauacaaggucuggagcauccugagugaggggcaaaggggagggcaucaagagggaguagcuauggaggaagagauagaugaauaaaaguuuucaggauguaucaaaaggagaagggggcagagagucgaacucuagaucccuauccuggcuauguagccuugggcaaaucaguuuccucaucuguaauacgguggcuuuccaguuuuaacauuuacuguuaggccggccgugauggcucaugccuguggucccagcacuuugggaggccgaggcuggcagaucacgaggucaggaguucgagaccagccuggccaacauggcgaaaccucaucucuacuaaaaauacaaaaaacuagcugggugugguggcgggcgccuauagucccagcuacucaggaggcugaggcaggagaaucgcuugaacccaggaggcagagguugcagugagccggaaucacgccauugcacucuagccuaggugacagcgagacugucucaaaaaaaaaaaaaaagcauuuauugucuacagcaaccugcagacgugauucccuggaauuaagaaacuugggguccuuacaaccucugauuucggggagugggggaagaaccuugggggucuugucauuuugcuaucuuaaccugcaagacaggcaggaccuggcccuagaagcuguagccaacaaucugaguaaagucccucccuuaucccccuacacucuggccacuuccucgagccuccaagccaacucagcugaaagcuuccagggggugccccaaaacauugcagggcugaggcaaacccuucuuccccuucccuacaaccuacaacccaucugaguagcaagucccuaaagaaaaauuaagagacaggguaggcugggcaguagcucacgccugaaaucccagcacuuugggagaccaaggcaggcugaucacuugagcucaggaguuugagaccagccugggcaacacggugaaaccccaucucuacaaaaaauacaaaaauuagcuggaugugguggcacaugccuguaaucccagcuacucaggaggcugaggugggaggaucacuugagccugggaggugaagguugcagugagccaugcucuugccacugcacuccagccuggguaacacagugagacucugucucaaaaaaaaaaaaaaaaaaaaaaaagccaagguaaagcaaaauuauguccccaaaugacacugagcuccacaaucacuggacaucgaacuacugcacacaagguugacacuccaugccaagccaucuagucccuacacacaaggcagaaggacccuauguauaacucuucagaaagaaaagugaagguagggcugcaaagagucagggauuguggggcagggaaccaagagagcggaccaauacaucugauggaauuaagagcuauucuuuuauuuucuuuugagacagggucuuccucugucacccaagcuggagugcagugguacaaucacagcucacugcaaccuccaccucccagguucaagccauccuccccuccugccucagccucccgagugccuggggcuaugaguagcaugcacuaccaaguagcacacaccacaucuggcuaauuuuugaauuuuuuuuuugguagaaacaggguuuugccauguugcccagacuggucuugaacuccugggcucaagcaaccugccagccuuggccucccaaagugcugggauuacaggcaugagccacggugccuggucagagcuauuucguauaaaugcucauccagaaaacagaauccuagucugcaggggaacacccauacccucucagucuaggaaagagccgcuauguaaaccuccucccccaacugaaagacgaacaacauggugggagugaccacuuggauacccagaggagggagggaacggucagacguguguggcucaugagggaagagcagcugcuugaagcugagaggaauggcaagaugguccaggagagccagggaugcuggguccagcaaacaccuggcaauccuaggacucagcaagaagccgcagcaggaugaccaugacagucuuuuccaggcuccccaccccuuguucuccugggaaggagaugaggcggugggauuuaggcuggcccagaaagugaaagcagagacaggaagaaaagagaguggugaaauuguuauccacagugaccuggagacuaguuggugccacugacugaagacagagccugagaccacagcugggcugggcugguccugcugcugcucugacagcucccgcuccacccccacccaccacuguagcccuugcgaaaucccucagccugucacgggucaguauuccagcucaaggacuuuacccccuuguccccacuccuggucacugcucucucggaugaaaucagaggucagcacugccaguaaaggagcuucagcuccaccuucuccccuccuccucccccaaaucacacacacacauuccagacacugccccugcccccuccaccucagccagaauaaauauuuaauuaaacagauggaagccuucugaacugaacaaaauuaaauguaauuauccacaguggaacuuuccccacacaaacacacacuuuuuuccuagagaaaaguuguagaaaauugaauaaagaagggacaaggguagaaaaugcacagagaagggacaaugcggaacacuuugaugugugcacauggcccccucuucccacuuuuuugcucagccugauuggaagcgagaaaucagccugacccagucaccugacugcugucucuuggagcccaacuucuccagggaaauguaaagccaaagguaccauguugcccuggcaguccuagacuucagaucccauccccaaccaggucugugaaaacuggcagggauguuucucuagucaggcggcaggcuggagucgcagagggaggguggagccccugcuggacuccuggggcccaggaaugucucaugccugcaaaacaggggguggggggcaggcaaaguaggcacuagagcauggucaaggacagacaccugggcagugcaacuuccucauccccaagaugagauagcgccuguccucuuccacuccaagcagggagaguggaagacuugggaaaugcagauuaaugggggcuuuuacacugagguugcaggcuucccaugaccacagcccucccuggugguccugcaccuccauuagcagagaggcacuacccccaucuccccagcagggaggccccagauucagcagggucaggaccucugacucaacaugaagagaggggaggacagcuggggccuggccggccucacuuacacauccccacagaaccaaagaguugggucccuguggcaguacuggggaggccucuuagcaccagcacacagauccaagcaagaccccauaaacaagaggcuggggcaagaaaagcugaaguguacacacgguaaggagacaacccuguuuuuccaggcccccugggccuucagggcaguuacuugacuucuuauggagaaaaucacaucuagaaacacuuuuccacccagacuucacucccccauacacaugaagagacaugguaucugucuacgcucucucucacacacaccugccuuggaggcacagaugccacuuucugaggcacaggcuggagaggggccagaagagcagggauuuaacuggcauuagauuagcaggaacuugagcaggacucuguccagccccaaccuuugccccaacucugacugacacccccacaagaccccucuagguggaugaaaggagcagaggauccccaugggaguuuguagauccaaacggcugagaaggcagaaguuucggccugagaggaaggaauucucucagacuccagguggucagucugacuggcucucauaguuuggaagaauaacugaggaaaauagaaaggaguuguugacaagggaggagugacaaaggucccaccggcucccugcuuccacugaagaaguccugaauagucuuccuuguugaaaacuuucaggcaacagaagcaggucauguacuagaagucuacaagccauggauggagccaaugagagguguguuaucccuccaggcugcaggaugggccucaaaauaagccagauuguaaaaaagaggugggugagaggcagucagaacaguaguccucagccucaucuggccuacagcuugucugcaaagucccaccaaaggccuccacggaccaaaacacugcaugagacuauggccccaggggcagggagacgccgguggguuugagagacagcuggggcgguguugaaggacacagugagggaucagccagccuauggccagugacagggguaaaaggaggcccuuccucccaggggaaaaucuggccagaggccccagugagggaagugggggaccaggggagaaaaggaucccucucuggaacagacugugcagaucacgguauggucagcgccagguccucagggacaggacugcaggcaaguccuuacccuuaggagccccuuuacaugugcagccacucacaccccggugcggucaucccgacuccgguaugcggcagcaaccgccacccaccccugccccagcacagauaugggggugacugccugcuggaggccugcucggacucacuucuccaggaacaggggcucacugcauucgccacgauccucagaacccccugaaccugggccuggcaacucaggugacugaaaccagguuuugaugccaggagcuaggcuuagggagggagagacuccaacugcaggcuaaagaugagugcucuacaccugcagucaacccacuugccacgggccucuagugauuaacaagcuacggcccagaaagccaguuccaccaggagcucccuugccagccauccacaccucauaacgguaugccuuagcccuaccgggccggggcaggcgcuccgggccgcuccuuccuguuucccguuaagcacauggaagcucugaccucgccugcgaggugggcacggugggccgguaggaagaaaacggggcagggcccuccccucuccucccacccaagccacaggacgcguccaggccagggcaaccccgcgggccgcugccaggguggaggcucucgcgccaauggucaccaagcuccuccacuccccaacaaagggaagcccacggcucggccccgucgcccgcagcccccgcguccccaccuuccgcccuaccuguugcccgggaaagcuucuccggcucagggcggcgcugccgcggacaccgcggcgccaggcccgccggccccggccgcucccuugaggcgcugcgcccgccuuacccggcggccgccgccaugagcgcccgcagcgccccccgccagcgccgccucccuccucgccccggccccgcggccuucccagcccgaccccuccgcggccccgcgacaaagcggcacccggggcucccaacuuuuccgcagccccuucccacccccgcgcggggcucgggcgccgggcgggggccccgacucacccggcggcagcguuggcggggccggggccgcugcuccguguacuccgucugcucgggugguugcuccgaggccccgaggccuggcuccccgcgccucuccucccucuuccgcccgcccgccggcccgcgcccgcccucgcccucccuccuccgccagccgccggcgccgccgccgccgcccgccgagcccagucgagcugagcccgagcccagccgggaaaaaaaggccgcgagcagcccaagggccgggaggcugggcgugacgggaggggagggcggggcgggccucugcgcugcggcugccccuucgccccggcgcgggaggccagaccccaacccuccgcucccggccccacagccgcguccacgcccgucaccuugcgcuagagaaaccgccgaccuggggaggcgggugcgggcuccuuccgccacuucggucucuuuucggggugggaggucucccacugggaccgacacagacgcacuggaugccgcggggucccgggcuccgagcggcggugucccuguccccuuacuccuacccacccccacccacccccaacugcugugcggcccccgguccccgccagggugggcacauucccacuuccagccccacggggcgcgggcggaggagggugcagcccggggauccugcccaagugccucgcgccgaagcugaaaaccucuccagggcagaccgaagcagccgacccucgagacccagucggagccugcgaucacucgggcgaccc

SEQ ID NO: 13735 - RNA, 609 nt, Homo sapiens
acccucauuaaaccugacuuuuuuuuuucuuuuugguuguaaguuuauucaacgcaaaagaauccucuccaauuuuacugagguagcugacuauguccacaaccaaauccgccucuaaacuggaauucaguugcugacccagccccagacucggcuuucuugucggcaccagguggcacagcacucugucuguagguaucucugucagcuucccaucuugugagucucgcagguugcucacccuccagaccuuuaggccgaggccugccagucucuggaugccuacggcguaggguggcaggcacaaucuccgggggcagaugaagguaaucauggagauacuggauacccucauugguaagguaccaguagaaaugucuccaggcaaacuguuccuucacguagccucgggacuagagagacugcauggcuuucaugacaugaagguugggcacauucuugucugccagcuccgggugcuuaggcauguggacauccuucuuggccaccaugacucccuucuuaaaaaggaguucauaaauggcaauccgguucuucuuaggcaucaacaucucugcggcugcaggggccggggccggggcuggaaaa

SEQ ID NO: 13736 - RNA, 7489 nt, Homo sapiens
cuggguuggguuuuuucauggguuuuuguuuuguuuauuucgaauacugaaaaaguccuuugggcucugugggguuccccacgcucacggcuccuuucucccacacucacugcccuucuucccacagcaaaucuauuucaaggacaguacuuuuuaaaaugauuaauguugaguucucaacuagcucugcagaacuagaggagcuguuugcaucugucugugcggauggaguuucuuuuaucugacaccaggucuccaaccacacugaaacaaggcauuuaucuacagagcucaacuagaaccccuuuucauuaggcuacuccacuuccuuccccucauaccuaccccacaucagccacgugguuaagaaggauagucaggaauguuuuuaccaacuccaagcccuaauucauacuccuccauaucucccaccccacccuuucaaccccacccccacccccagaauuucauugauauuucucccaacuguuauuuggaaaaaagguaaaacaaaaaagguucaaggucuuggugcucagcccaaggggcuccaugugcugggacaccaacaggaaagggcuucugccucuccagcccacacccgagccaccuccugaccccuggcugcaaaagcaggaaggggcaggagccagcacaggacccggguggggcagggaggggaagcgucucaggaucuggcagagccccgggcagcaucauucaacuuggccacugcggacgaacacagaagaaaaaaaaaaaaaacaacacugucaaguaauaggggaaaaaaacccugaacuccaacccagucucuaccccaugauuccuccacauuuaacaaccauuaggcuaccuggcaugucucaauccuauccauaagggaguugcaaaaaaaaucaaaaaauagaauuucagucuuuuccuauccacgaaacaacguuaucugccuuucugggauauccauggauaacaaacauagaaaaauaauucuuuagauaagaucaaaauaacuggagguuuccagguggguaagcugccuggcucagagcaggcuguuucagaggcauggccacagcuacuugcaaagacugagguagcacagagaugagguggugacuguguggaggccagaaccagaccacacacaugcuguucugaauggauuuaauaaucuagguuuaaucaaagcaauuugcauuuggauuuuggaaugaccacuccuugcuaaggaagcuauguacuucaugcuguggaaacuggcaaauacagaauguagcuuguuuguuuucuuagccuugaagaugaccagguagagagacagagugagaccaacaguuuuucugauuucccugcuccuccuauuccuuccuaaaaaucagacucauugugaccaguagucuugaggacucaagcugaaugauagagaaggcagcucagacagaaaagaaaaaaaguacagaauuugagaagaucggagaugaagaaaacguacaaaauuauauauauauuuauauauauaauaacaugacauaucuauguacaacauggcugggacaguugaagaaacuauacaaugguguucagcauuuuccccuucccagauggacuuuaaggaugacagcaugaggaaauggagcaagaaacacaaaaauuauauacaauuacaagugacagucaaggaguuuggggaccagggaguccagggauccugcucucuccauuccuuccucaccaacuuucuccuauccaauuugaaugacagccugaacacugaauggccagucaggagaaaggcauauacacaccucauccccccacaugcacaucagcaagucuaucagucauucucauugggccaaauguuuggcauaucagaauuugugaugugagagggcaagaggauuacagaaucuugcucucuugagcauuaguucucacccugguccucucugucauaacuagcaaguugcguucaauaaaauucuagccaagcuggugguaacuagauugaagaugcuggucaccugcaaccccuuuccuccaccuguucaugagucagcauggcuaccucuccucaugauaaaagagcuggguugcugaguucuggggaugcagagauuucucagucuuccuccucucccucccuaaccacuuuccccagcuuccuccaaggugaaucaucuucuaagaaccuguuccuccagcccugcaggaguacucagccccaggggcuagcucaguuuacccuucuuccucuuucccuaacaauauaccuggcaucagacugcaucugaaacaugggucaacacaugugcaugacugagcauguuuccucaggccugcagcuccgcugccagagaagcuuuuuagcagcuaaggcccagagguaggcugggaaagugggcugggucagaggcaagaagcuuccauggcuagcuuccuaaguauuuuuuuuugacccucaagacugugauaucuauaagguucucuugccugaauuuauaauccccaaaccucaauuuacucucuccucauguaucccucaaaugguuccccucuguaguacuuucccaguauuacagagcagagguucaccacccacgagccuuccucacuuuuaguuuuacaaugaacaguauggaguuuuucugcuggcaguuaagacuucagaaucagaaucaaucuuacauacauuuaacucuauuuuacagaugaggaaauagaaauccagagaggcuaaaugacuuaaucaagguuauacaacagcucugcugggacugaguagagugagaacccagauaucuugacuccuaaaccagugcucgucccacuaucccaugauacuuucaaaagcaacaugcuggaagagagagagaaggugcccauuuucugugaauaauguucaucaaucuuuauauuauuugagagccagagcaaacuguaagagauacuaaguaauggaggcuaagggggcacuguaguuuuaggcaagcaagucaauuuuucuuuuuaaggauucucuaaaccugccauaauggaaacaugaagcaauagcagccuaagggacagaacacuuagaagcacagaaaacaugucucauucaaucuaccuuucccaacuacguuagguuagccuugggauguuaaaccugccaaacuauucccaaggcucagccuaaucaauuuugggacauucucucccaaaaggagaaaucacaucucuccaguuucucacacaaaaaaagcauuugcagcauuauccaauccuagccuuuccuauuucugggcccuaccuggacuacagggaguguguggaagugucaaucuaacgaaauaaauaaacuuagagccccuuuucaaccuacauuaccuucucagcagcccccagcagaaucacagucauuucuggcuagcaagcugagaagaucugacuaggugcccauuucaucccugccuauaauauauaaacguccagugguugaggaaggggaggagaggggggcucagguuaccccgcaagcuugcuggugacgagcgaggacuuucucuggggcagauccugugggguggggaugugaucaccagucaccagguucuugucugguccugcacuuggcagcugcuuauucuucaucuuggcuuuggccauguuguagucuccugagucaaaguacuuuugcuaagagauaagagggagguuuaggugagugaggacucuggccuuccucaaaaacaaggagacucacaucucacauccauuauaaacccucaugcacacucggaucuuucaagaagucuuccuugauuaaccucaugcauacacaguuuaacauuaauuacauguacuuaugucuucuccccaguguguucugacuuuuucagguacauaagcaauuucccagcuagaguauauaguuuuggagucaagggauagccccugccauccuuuguacuccacucaguagaggaucguuccaccaaaaucacuuauucauaaaggguaacugaggaccuuacuggguacagggcaauagccuggaacuggagaaacagaaaugaauaagauauagagaaggauaaauauggggcuauccuagccaccaggagaucaaccacaagccaacaaccucaaaaugauuauucucccagaccaggaauagaaacugggccuguucaugaggauaauguauuuuccuucugacucucacagcucccacacauguuccaugacugugacagccugcccacgccugccuugccuccagcaagguaaaugcaaaucagcaucacauuaucaucugugacuaagacucaauaacugggauccuccacagggauguuucacccaccauuucauccgcacagagaagcacacuccaauguaaugauuuauaauccuacagucauugcagaggagaguaaggaaaauaaaaaaauuuuuuuuugagauggagccucgcuauguugcccaggcuggagugcaguggcacgaucucggcucacugcaagcuccgccucccggguucacgccauucuccugcuucagccucccgaguagcugggacuacaggcgcccgccaccacacccggcuaaguguuuguauuauuaauagagacgggguuucacuauggucucgaucuccugaccucgugcuccgcccgccucggccucccaaagugcugggauuacaggcgugagccacugcgccuggccaaauuuuuuuuuuaaaaaacgauaauauaaucccucagucagcuuuagguaccuuugggaacuaaaaaucugaucaggagcuacauggcuaugaaaguagacucucucuugguaaggaggaccacucugaacaagaaaaauacauuugcugcaggaguauaauuaauggcuggugcucacuucaaggguaugaagaaacugauucauuucaaguugaggauuuauuucuguaggagagaugguuugaucuucuucugaaaugaugcaucccaaaauuuaucucuaaugcuuaaaaagugcacaauccuaaaaccuccaacauucaaacaggcaaaugccugggggcagucugcauuucaguuucuaacaucuuucccucauuuccccacacacccaaaugcuccaauuuaggccuuaauuuccuacaugggaaaucaggagggaauugauaccacaucagggauuuacauuaauuugacuugcucuuuucaaauuucaaauucgccucuacuucuguucaacaacaaaaccuccagaaaaggauccaguagaaccucuacagacuucauucgaagaaccuccuuuagcuccaaagaaagaggguaagagacuaugccccauaccccuuucuggagucucuucaugaggaagucggagccuccaggcuuuuguccuaggcuuggguauuuggccuuuagcuuugccucuucagcucucucaggcagaauaccuucuuucuccugcguguccuggagaaaacaaaugagccaaauaaaauuaaagacugagaaacaacagcuucucacaucugauaacaacuauacuaucaacuucuccuggaaauccacccacuuguaaauacgcuaucucuacucugcuguuaaagcuagaccuuuguuaaaaucccuaaagcucaagaugacuauugugagagaaaaagacaagcugcuucucacacuucacccaaggaaccagccagggaccugugcguauugggcuaaagguaauacuaaacacaauacuuuaaucacagagugggccauaucacucagcacaaaugcuaagaaagacaaagagaaaaaagcagggcuucuggugauagaggaugaguagcaggguucccuaggcuauccuacaugucacaugagaaauuaaaaaaaaaauaguuuggggcugggagcagugacucaugccuguaaucccagcacuuugggaggcugaggcaggugcaucacuugagcucaugaauucacuacccgccugggcaauauguugaaaccccgucucuacaacaacaaaaaauaguuugcuaaauguuuccuccuuauuuuuuucuuucuuuuuuaaaauugcuacacgacaaagcaguuccuucuuuauucaaggucuaagccaccuguuaggucucccuguggaggcggcuagcuauguggccuucuccaaagaucuccaccugaguaauggcacagccuugcuucaacauuuccacaaauauuaugguagcaagcugauaaacagagaggaaaaugauacuguuuuuaaccucaggaaaacaaagauacaguaggcucacuaguauuuacccaccaguuuucaucaaaaaaaucaauaccuacccugguggugcagggacucucacuacuguagucaaucucuuuuuuuuuuuuuuguggucccugcugcccuuuagugacuuuuugaaaagauaugaagucaacguaugacucuuuuuaguggaauuauauuccuuucucuuggaaauuacgcauagauauaacaccaaguguauuuaaugaguaccugaacccaguacuaaauuuuaaaagucaaauacaaaccccaauaagggguuuauuuggcguuaguguuuccaucacggaaucgcaggugcacuaagucccugccuuggaagucuaggggaagagagaagugucuuucucacgacccugucggcgucuuuuccaaguuuaauuaccaugauucuguuuggaacucuagcccucuucaauauugcuggguccucacugaaggugagcaauagaccauccuuagcuacuaaaauaggucucuugagaaaguugccgccuuaaacuagccauuauaauaacuacacuucuccccucccccaauacugguuuuuuuuuaaacgucuuuaccucgaccccuaucuuugcggauugaggcugcgggccccagcccgguugcugggucacuuaccucuacaaaccaauaacacacaucacacccaagaccaccagccauccccuuuccauucaccgucuuuccaaccacccgccccacguccaugcucggccaauuauagcacagcguccaagguuugagcgguaggccuauuggccaaucaggaagaguacaguacugagugacaaacgacccaacuaaccagcgccaaagcagcaugucguguugaagcucacccagcgugacgcaaaaaguggccaaccccugcggagccugagaccauggcgaccaauccgcacuggugggagaccgucucccgccccaucacggucuccccagcucgcccgcccgcaccccuuccacuucaccugcuucuccucgccggucuccuccgcaggguucucuucuucuuguuucugggacauggcgggaccgggacuguggaguguaaggggcccgggaaggcaaccggagaagggaagggggaggggaaacggggacaaccugcgcugcugcuucggcuccugucacuaggguugcucagucaaaauggcggcccuugcccgugacg

SEQ ID NO: 13737 - RNA, 11767 nt, Homo sapiens
uggcccaugaccagccugcagggccuggggcuggcggggauucucugacccaaacucuccugggcucuaaugcuguuccccugcccacccuaccuucugccuucacacugcugagggguccauagccgacaaggaagagcucauuucucauuugucaugaccaucuuuaauaaaaaauaaauuaguucugggugggaaccauuucaggaggcagggaguggggcuaggggcugggcgggguggugggggagcggaugcucacauuucucuuuuucacccucugcccagcugggccuugcucuggagaggcagucucuuuccuccugccuuccugaguaaggcaggauuggcaguggcugaccccagcccuagcuaauuagggaggcaggggcagagauacuaggcaaaugagaaggggucagagacacagggcggcuuagaagaugugaggucugaacaugagaaaugaggcuuagggcacaaaacuggaguugguggggagaccacacucuaaguagcucagauuagcaaggaacugcagacuugcuuuccuuuccaccuaggaaagucucaaggaaacaggucuuguccuucucagucuguguaaccucuuuuugaaaagugauacacguuugagcacacacauauccaugcagucccaaaagcacaccugaggcauaugugcacacacccaucacaccaccacaugggccugaccacagcccugaaagucacuuugugucagucaccuugccacccucugucaccuggaggacaucccugcugagacugggacaggcuggagagccaggggguucagagugggccgaucaaugggugaccgaugguggcacagaaaaccgugaaggugccccggaccccuuucaggagggauccuggggagaccgcuccaggacaugugcgcaagagcggcaacagguggcuguguaguagggguagacgcagagccgggccuguaccaccagggggcaauguggagagcuguccuugcauugaucaucuggggacagaggaggccagugggcacaagagagucaccaggacccacccgucugggaaugggugugcugcccauucccacugguccuuucucaucuccucccauacuucagcuaauccacuguauuggggauuggggagagggggcucuuuaccagggcgcuggcugcaggguuggcuguuacaggggcgcuuccuggagggccgcaguugaggagggcaucgggugcugagggucugguuggugcucaggcacuggaccucccgugucugcguucccccuuggcaggagcgagaacacuggggcgaccccagccaucauaucagaccuuugccaggcccgggauucuccuuaaccccuggcugccaccucucuccccaaaagguggugguggggacccuccuaggacauugugaaaucccaaauggagagggcccaucuuuccuccaagucuauaagaaguaggacagugguaacgcuuggcugggcuuauucuggggcacagagagaccuggaggggguacagcgagaggagcuccccuccccuaggggcccaggcugagcagggcaggacagcgcagccagacacucacugggcuccagggcguggaaaaccaucgguccuggcaggccugcccuugacagggcugcagggcagggggccuggggaggugagaacaguugcucggagaagucacguugaacuccguccccaguuuggauacacagaugaugucucuacgcugugugccagagccacauucggaggagcacuaguguagggggagggcagggugaugaggggaggggaggacagagagcaccccaagugcccacaaggaaucccacugggacuggcacccccuuccugcucucagcaggcgcucagcuuaccucaccccagggcccuguguaccagcgccaaguucucucacagggccccaggcugcaggcgcgcaugucagggggccggcuuccuguuggacagcucugcccaguuccugcuccugcuucccccuggccuggcccgagggcugccccacucccaaggcagaccacagagcgccgcuggauucccgucccacacucggcugagcacugcggaggaggagagcggccugugugaggggccugcuggugacuggcacaagggacaguaggggggcagggagggacgcauccuggguccgaauccugggugguugggaauguccccggguaccaggcccggacgaggaauccuagccgggccccucauggaaguuguucucacuuaucucugaguucccagggucaggcauauagcaggcgcuugaucaauacaaguuuauugagcuaugcuggaaaggcugagguguccugggcgugguuacccaggaugcaggauauggcuggggguuccgggcucaccuuggagcuccagucgcuguggaaccaggcaguaguacagggccccaugucacaggccucucugcuggggggcugcggggggccugacgcacacuccugcucgcucacuucaucaccauuguucccaacacagcgaaccugccggcuucucuggccccggccgcaccgcacggagcacugagggggcgaggggaauccagggagcugggcuucccagaccuucucagccagcuuccagcucuaggcuucagaaccaggcucugccuucgauccccagcccagcagucacauggcuucgugggcugaggaggaggcugagcccuagggcccugggcccccagucccugguucagucccuuaucugacuucuauauuggggguccauaugaaacccuguuuguaaauaguuucugcugaugaaaaagaaguugaaaaaccacugcuguuguucaccugugcccauuccccuccccagcaccuccuugccugggcaaacucaccuggcuccaaggagagccaacuucccaauggccacagaggcgcagcuggcaagacugggugauguugggccgggggagauguccacagcgcuccgggggcaccgaggagccaccccccccaaauuccugccggcacugcagcuggcggugcugggugccggggccacaggagcggcugcaggauguccacucgccagccucccagcugcaggcaccagcagggcagggaagaggcggagacauagaugagauguguggggcugccguggcagcagagauggaagacacacuggacgugggggccucagaggagagugggcacguuuggcguuuggagucuggguuccuggggggcucagccugccauggcuuucuugcugccuaccgaaugucugccuuucuaaucuaauguugucucucugcagccaggagauguugcguugagugcagaguucagguaagauucugggggcaacugcuguguuuccaguacccuaacccuccccgugggcucccccauacucacuauggggggcauggggugccguggcaggguucaggggaggcugggggccuggcacccgcggcacagcugcguucauccaguuccucucccgacucacgggagaugcagaggaaaauggggcgccagacaccugagugggugagaaggcagccagggaggcaggaggcuagagcccaagcucaguggugucccagacgcagggucgggcguggccccacaauccaggaugcgggagugucaguugggggguuuggaccgagaugcggggaacgcacugugaugucucaccuuucccgcaggacgcugagcaugcagagugucccacucguuuccaguacgcagcuggagaccccagggguguccugggauggggcggggcgggcaucugggggauccgcaccugacgcuggagggugccugggguccgggcugggcggggugccggagcaagugggggcuccacccucagaaucucugugcaggggagcaggcgaaucagaugccaccccacugccccgagccagcccugcagccucucccuccuccuuccaagugcaggggucagagucuuacccggcugaagcugggggacagggggcucuggggugggguucucaaggauuggaggaggugaagagaugacauacugauaaaaaacgccuggguuuuccuccugaaagaucaucuggggagaagagaagauaaugaauauguggggguggccagaagaggaugccaccagcucucucucccaucuugacaaccacagcucugcccagagggaacagccucccuccccagcauucagcugccccuggccccaggcucacauagacauccacaggcugggugguggggccuucagccgacagacucuccccuuugcccuccucccugggaggacgguuauaucgaaagacggucccgccggcccuguaggacccagggggauccacagcccaguucccauugaugauggaccggcccccagggccacgaagugcugcgggucagaggugagagaucgggaaauuccagggugauaauaccuuccuccucccacaccguguccuuagccuauagaagcucccaccagaaccuaagauccccccaagcccucucagcuuccucacuccuuccacgaggggaggggcuaggcccuggacuucccccuguuuggcuugcucacugcucugaguagggguauggagggccgaacagagacggaaguggaaggggaggcagcugggugcucacccagguaguuggagcuaggccggagcugggcaaucuggagccgcaaggcucccgcuggaauccacaagaucuucugauagcccagggggcccccucggucagugagguuccccgaaacaaggcgacagguagaaucaucacccccacagacuccacagccaucaggacgccugccagagccaaggaucccaucacagccggggcucuggagagagugaggugaggcaguggccacagaacgccagacaccaccucaaccccaccccgguccccucgggagccucagcucacuacccugcuuuuugugccacaagugagagcacaaaaacagccccaccauccccagccagacccagggacauggacaggugcccgaucagauccuucaggcucugcucagcgcagcuuggcaggugagaauucucccucagugaucucaguaugguguuuuguuguugaauugagacugugcaaauacgugugugugcaugugugcauguguucaugcaugugugucuacaugugugugcaugugucugcauacgugugugugcauguguucaugcacgugugcacaugugcaugcaugugucugcauaugcaugugcaugugugugcauaugcgugugugugcgugugugugugugcgugugugcaugugucugugcgcauaugcguguguguaugugcuugcaugugugcauguguucauacauauguguguacauguguaugcauaugggggcaugugucugugugcauaugcaugugugugugcacacacacacugucuucccucaccagacagcguccagccacacagaugucaggggcuccaggcugacacagggucccauccuggaccuuuucagugugacggacauagaagcggaagccacggggccggcaguucaguucacagcgcugggagcccuggacuaagggacaggguagaagggugguuagugggcucccuggugggagguuagcugagagaggccccagagggggcaccuugagguugcccaggucacuguggaugaaggaaaugugacaacagcacaagcugagguggucagggccgggcgcaguggcucaugccuguaaucccagcacucugggaggccgaggugggugcaucauucggucaggaguucaagaccagccuggccaacguggugaaaccccaucuccacuacaaauacaaaaauuagccaggcgugguggcacaugccuguagucccagcuacucgggaggcugaggcaggagaauugcuugaacccaggaagcagagguugcagugagcugagaucgugccacuguacuccagccugggugacagagugagacucugucucagaaaaaaaaaaaaaaagguggucaggucaguugaggucaccgagaccaucaaggggacucugaacugagagaggagcaaucccugaugcccaugauucuguguguucagagcucuugagugcuuaucccggugucaaguuaacacaggccuaaaaugaagcggaugguaaccugggagcaaccgauacgacagugcccaggaugcguggcacacccccaccuggcugucacggcuggacaggaucucucccaccauggcccucuugugucacagccaccugacccccagugauggccuucccaggggaguccggacaaagcgugucucccacaccuccuccucccaccccgacccuucugcagaccacucaccaccugugcugucuccugacccagccccagggagaagaaagaaggcauggcgcaggggaagcagaggggcuggaagucauucagggcugggaguaagcagguaucuccucuccccuucauccccaauuccaagccaccacugcccaggggugagcaagaaaccucaccuucagugaagggcucccacugauacagcuggcccaugaauuccugggaguuaaaggcugcgcacugcagggcccgggggucuggcugcucaggggggcagggcugcggugagggguacaaaggagucagagcuggggagcaaaaugaggguaggggcagggcugaaccuggggagcaggugggaggcucaggucagcggaagagcuccaagaccccugcccugagguggucagaugccaaggcccuucucccucaggugccaagcggaagcugaagacccagcuucagggcagggaagccacacuggaggucgggguugggaggggaggcccgaggagacucaccgcuuggcugcaggcucuuagcuguucacucuccccagaacaucuuggaauagggcuacugggagcaaagaggcuccagagggagcuggcaugggggccguugcucagcaggggcagccaggcgcccgggugcugagggucaggcuccaggcggggcccgugaggagucccccccguuccccaaggcccuuggcccugcuggccucggccccgagggaccgaaggaaaaggaucagggcgucucccugcuaccuggggacuggcccaacccugggaacuuggccuucguggcugaggggaugcacggaagaagccaccuucuccuaaggagugcgugggugaggggggcucugugccagaggccugggcucuggggugaugccguaggggggcaggccugguucugggggccaccucugucugagcaguuucagggcuuagagguucugcuuggggggaugggguguggacagacaguucugugggagggagcucaguuugggggcugccguuugcggagaauggcucugcucuuggaguaggggacggaauagccucuuccccucuagaagagaucagggacagcucagaucugggugggcuccgagggugccugcgguuccggugcaguggcaaugcaaagggcacucucccauaaccgaacauuccuggcuugauggggucucgaagccgggaccugagaagguguuucagaugugggggcacagcucugaccaccucugacccuguuuccccaguuuacuuccuggcaccaaagacaagcccucugaagccacccgugcuccccuuuccuucaugcuaagcccccaccuugcccaaggcccaccucuuccacccaggccucucaccuccuggccgcucgaaucuccugggucuccucucucccuaggugggaagcgggaccucgaagugggccaccccuuccccgagacuguguccuguacaaggggaggguuucuggagaagucuggggucugggacccuggccccgggggaggagggcuucuggaugucuugggggccggggagggaggggcagacucggguggagcugcacuguagggagcugacauguccggcuccugcgcugcacccccaccccgcagggcugggagcaagaggcccacuggacccaagguccccagacaccuucggggcccuggcccuccucuguaggugucugaagagaguguccggacaacaccuauauagagaaaaaggucagacagaauuggaaggauuagagggaacuguccagaguguccauguagaccaacacugaggcucacggagucgcuaccaguccaaggucacauucagcagcagagggagaacuacaccucggccucuugguguuaugaggcaaggaacuggggaguuggcaggggaggugggugggcuguggggaauggaggcguggccuggagagauggggugggagccuagggggagaugaaaggguggcaggcaggcugcagcugcucacuuguccagaacucaccuccugauccaagcagagcugagggagggacagaagcagcagcagauacagccagggccugcaaaccaaaggccaggggagggacgucagacuggagccagaggggguguugcaacacugcccuccgcccccagccggcucccauauccugacuaccaacuucucagaaagcagaaguuacucaucacuuccccugccccucccagugguccccuuucccucacuuccagacacagagccaucccagcaccuccccuuuuccucccccccaacccguggccccuucucucaccugccaguccaguucuccaucgcucccccucuacugccccagggggaggcaggagcggacuggucacaaaaacuacgcaggcaucugggcguggagggugcucucugcagggacagaagccuggugguuaccucuccaguguccagagagcuuggggcugggaggacagcucagagaauauggaggagggggugaaacugguccaucccuuuaggauccucagggugggagcagggaggaucacugccuuguccaucuguagaggcuacauggucaggggcugaccucagcccuccaacuaaggcucaguccccaccucugggcccuguaggggcuucuuagcuccuccccaaauccuaccuagggacuguuucuaagccggcucaggcacacacaaaaggcuuuuuuuuuuuuuuugagauggagaucucacucugucauccaggcuggagggcaguggugccaccaaagcucauugcagccucaaacucacaggcucuccuuccucagccuccugaguaggugggacuacaugcgugcaccaccacacccagcuaauuuugguauuuuuugguggagaugggauccagcuaaauugcacaggcuggucuugaacuccaggccucaagcgcuucuccugccuuggccucccaaagugcugggaugacaggugugagccaccgcacccagccagagggcuccuucuaaaaugguugucaucugcucccacuccugcccucccagaggugccuagaaaguagaggaggaaggcuccacugaggaugcgccagacacucucucugaggacccaccagaagccccuuccuugggucuuccagacacaagaccuuccccagucaucucucuguccuacuugccucccggcuuucucuucccuucuuagauaagcucuuuagggaacauccaggcacaucucauacacuuuuuggccaagggauaagcuaaauggguugacgguuuaaucucuagagaagaagccggcaauguaacacccacucugggugccagcaucuggaguugguucagugagggcuuguuuccugugcgucucuaccagcuggggaagcgggaaggagaggugcagccggggcugccucaugccccagccacaggccucucauucugaagagccgggaaguccaucugaaguucagcuuugaacacuggagaagugaggcuuggaagccaccccagccaccaagccugacucucuuugcccccuucuucucacuuugaguccuucccaccccugcuccucaucccacucuuaguucugcuuuccaggaaaaaaaaaaucuguuucuguuggaucugaaaggcacccgggagaggaauccagggagcccucgcauugcugaggugggccagcucuggggcagaaaaugaccaagagaaggguaggaaugugccugggggcagacacucagccccacugcccucccugagaccuaggguucggaauuugagggaggggucagaguggcugagccagagcgggcgccucagggauugggguugggguggggguugccgauggccacuccuuccccuggcugggccggccacuaaggucagcaacuccacccugacugaacgggggaggccaggaucuccagagaagggcccauguuccacccaagucuucaggcucugccugacucuuguuacuccagcugagggaagaagaaauggggugauagucacugccugccccuucucugaugccgaccccucuucaugcccucucugccucugcuucucucugccaccgagaucucuucucgcagccccucuccacgggucuacccaguacacauaaucccaucccgagcuggguuuggcuuuggcaguucccuggagaagugaggggugggggugacgugagcucccggggcccgggccaggccuggcucccucucuggaaaagucccaccccacccuccccugcgcagcccggcaggggcccaugcccccuccucugcagaaacacacgcacauuuaugcuucucaccccuuuccaugucccucauuuggugucguucccggcccaggacgaggaaaggagaggucagagguggucacucuggugccagaguagacccuggucuggacaaacgcgggcuccuccuggccacaccucuccacacugcccagugaagaccaaggaacagagaccugcgcagggcucaccccuucacccccaggucucccugcuggagagugguuggacccuguguuucugggccuagccauggagaaucccuguccugaguccgaauucccgggcccucagagcccuccacuccugggucuggcaggccaccccaacaggugucuuucuuuuuugucaaccucuucugccaucgggcugagcuggaucaagggcacccaccugcgucccucgcggcgacccuguccuccaaguucaggagugcagugggggacacaccguccgagagcacccuccuagagagagggcaggaggcaccggccgcgcggggaggucaugggucuguuuuccaacuuuacuaugugacuuaggaggaauuuugguucacuccccgcccgggugauggggccagaguuccacgggaucagacucccuccccaggaauucgaccccaggggcuggaagauuguccgaggccaccggagcuggguccggggucguggcggggucgcgaccgcacagcgcagggagaggggacgacgcgggcgcgcggggcgggcggucuaacgggacccgggagaggggcggccggggccggggucccggggaggucucuaccugcucugcgagcccccgguggcccguuaacccuucugcgcccaggcgcucucuccaggcaaccucgcuccgcggcggccacuggggccccugagccgcgcuccggucacggccgccucggccgcaacuccgcccucgcgcccgcccccgcccagccccgcccgccacgcgccccagcccgcgccc

SEQ ID NO: 13738 - RNA, 11767 nt, Homo sapiens
gggcgcgggcuggggcgcguggcgggcggggcugggcgggggcgggcgcgagggcggaguugcggccgaggcggccgugaccggagcgcggcucaggggccccaguggccgccgcggagcgagguugccuggagagagcgccugggcgcagaaggguuaacgggccaccgggggcucgcagagcagguagagaccuccccgggaccccggccccggccgccccucucccgggucccguuagaccgcccgccccgcgcgcccgcgucguccccucucccugcgcugugcggucgcgaccccgccacgaccccggacccagcuccgguggccucggacaaucuuccagccccuggggucgaauuccuggggagggagucugaucccguggaacucuggccccaucacccgggcggggagugaaccaaaauuccuccuaagucacauaguaaaguuggaaaacagacccaugaccuccccgcgcggccggugccuccugcccucucucuaggagggugcucucggacggugugucccccacugcacuccugaacuuggaggacagggucgccgcgagggacgcaggugggugcccuugauccagcucagcccgauggcagaagagguugacaaaaaagaaagacaccuguugggguggccugccagacccaggaguggagggcucugagggcccgggaauucggacucaggacagggauucuccauggcuaggcccagaaacacaggguccaaccacucuccagcagggagaccugggggugaaggggugagcccugcgcaggucucuguuccuuggucuucacugggcaguguggagagguguggccaggaggagcccgcguuuguccagaccagggucuacucuggcaccagagugaccaccucugaccucuccuuuccucguccugggccgggaacgacaccaaaugagggacauggaaaggggugagaagcauaaaugugcguguguuucugcagaggagggggcaugggccccugccgggcugcgcaggggaggguggggugggacuuuuccagagagggagccaggccuggcccgggccccgggagcucacgucacccccaccccucacuucuccagggaacugccaaagccaaacccagcucgggaugggauuauguguacuggguagacccguggagaggggcugcgagaagagaucucgguggcagagagaagcagaggcagagagggcaugaagaggggucggcaucagagaaggggcaggcagugacuaucaccccauuucuucuucccucagcuggaguaacaagagucaggcagagccugaagacuuggguggaacaugggcccuucucuggagauccuggccucccccguucagucaggguggaguugcugaccuuaguggccggcccagccaggggaaggaguggccaucggcaacccccaccccaaccccaaucccugaggcgcccgcucuggcucagccacucugaccccucccucaaauuccgaacccuaggucucagggagggcaguggggcugagugucugcccccaggcacauuccuacccuucucuuggucauuuucugccccagagcuggcccaccucagcaaugcgagggcucccuggauuccucucccgggugccuuucagauccaacagaaacagauuuuuuuuuuccuggaaagcagaacuaagagugggaugaggagcaggggugggaaggacucaaagugagaagaagggggcaaagagagucaggcuugguggcugggguggcuuccaagccucacuucuccaguguucaaagcugaacuucagauggacuucccggcucuucagaaugagaggccuguggcuggggcaugaggcagccccggcugcaccucuccuucccgcuuccccagcugguagagacgcacaggaaacaagcccucacugaaccaacuccagaugcuggcacccagaguggguguuacauugccggcuucuucucuagagauuaaaccgucaacccauuuagcuuaucccuuggccaaaaaguguaugagaugugccuggauguucccuaaagagcuuaucuaagaagggaagagaaagccgggaggcaaguaggacagagagaugacuggggaaggucuugugucuggaagacccaaggaaggggcuucugguggguccucagagagagugucuggcgcauccucaguggagccuuccuccucuacuuucuaggcaccucugggagggcaggagugggagcagaugacaaccauuuuagaaggagcccucuggcugggugcgguggcucacaccugucaucccagcacuuugggaggccaaggcaggagaagcgcuugaggccuggaguucaagaccagccugugcaauuuagcuggaucccaucuccaccaaaaaauaccaaaauuagcugggugugguggugcacgcauguagucccaccuacucaggaggcugaggaaggagagccugugaguuugaggcugcaaugagcuuugguggcaccacugcccuccagccuggaugacagagugagaucuccaucucaaaaaaaaaaaaaaagccuuuugugugugccugagccggcuuagaaacagucccuagguaggauuuggggaggagcuaagaagccccuacagggcccagagguggggacugagccuuaguuggagggcugaggucagccccugaccauguagccucuacagauggacaaggcagugauccucccugcucccacccugaggauccuaaagggauggaccaguuucacccccuccuccauauucucugagcuguccucccagccccaagcucucuggacacuggagagguaaccaccaggcuucugucccugcagagagcacccuccacgcccagaugccugcguaguuuuugugaccaguccgcuccugccucccccuggggcaguagagggggagcgauggagaacuggacuggcaggugagagaaggggccacggguugggggggaggaaaaggggaggugcugggauggcucugugucuggaagugagggaaaggggaccacugggaggggcaggggaagugaugaguaacuucugcuuucugagaaguugguagucaggauaugggagccggcugggggcggagggcaguguugcaacacccccucuggcuccagucugacgucccuccccuggccuuugguuugcaggcccuggcuguaucugcugcugcuucugucccucccucagcucugcuuggaucaggaggugaguucuggacaagugagcagcugcagccugccugccacccuuucaucucccccuaggcucccaccccaucucuccaggccacgccuccauuccccacagcccacccaccuccccugccaacuccccaguuccuugccucauaacaccaagaggccgagguguaguucucccucugcugcugaaugugaccuuggacugguagcgacuccgugagccucaguguuggucuacauggacacucuggacaguucccucuaauccuuccaauucugucugaccuuuuucucuauauagguguuguccggacacucucuucagacaccuacagaggagggccagggccccgaaggugucuggggaccuuggguccagugggccucuugcucccagcccugcggggugggggugcagcgcaggagccggacaugucagcucccuacagugcagcuccacccgagucugccccucccuccccggcccccaagacauccagaagcccuccucccccggggccagggucccagaccccagacuucuccagaaacccuccccuuguacaggacacagucucggggaagggguggcccacuucgaggucccgcuucccaccuagggagagaggagacccaggagauucgagcggccaggaggugagaggccuggguggaagaggugggccuugggcaaggugggggcuuagcaugaaggaaaggggagcacggguggcuucagagggcuugucuuuggugccaggaaguaaacuggggaaacagggucagagguggucagagcugugcccccacaucugaaacaccuucucaggucccggcuucgagaccccaucaagccaggaauguucgguuaugggagagugcccuuugcauugccacugcaccggaaccgcaggcacccucggagcccacccagaucugagcugucccugaucucuucuagaggggaagaggcuauuccguccccuacuccaagagcagagccauucuccgcaaacggcagcccccaaacugagcucccucccacagaacugucuguccacaccccauccccccaagcagaaccucuaagcccugaaacugcucagacagagguggcccccagaaccaggccugccccccuacggcaucaccccagagcccaggccucuggcacagagccccccucacccacgcacuccuuaggagaagguggcuucuuccgugcauccccucagccacgaaggccaaguucccaggguugggccaguccccagguagcagggagacgcccugauccuuuuccuucggucccucggggccgaggccagcagggccaagggccuuggggaacgggggggacuccucacgggccccgccuggagccugacccucagcacccgggcgccuggcugccccugcugagcaacggcccccaugccagcucccucuggagccucuuugcucccaguagcccuauuccaagauguucuggggagagugaacagcuaagagccugcagccaagcggugagucuccucgggccuccccucccaaccccgaccuccaguguggcuucccugcccugaagcugggucuucagcuuccgcuuggcaccugagggagaagggccuuggcaucugaccaccucagggcaggggucuuggagcucuuccgcugaccugagccucccaccugcuccccagguucagcccugccccuacccucauuuugcuccccagcucugacuccuuuguaccccucaccgcagcccugccccccugagcagccagacccccgggcccugcagugcgcagccuuuaacucccaggaauucaugggccagcuguaucagugggagcccuucacugaaggugagguuucuugcucaccccugggcagugguggcuuggaauuggggaugaaggggagaggagauaccugcuuacucccagcccugaaugacuuccagccccucugcuuccccugcgccaugccuucuuucuucucccuggggcugggucaggagacagcacagguggugaguggucugcagaagggucggggugggaggaggaggugugggagacacgcuuuguccggacuccccugggaaggccaucacugggggucagguggcugugacacaagagggccauggugggagagauccuguccagccgugacagccaggugggggugugccacgcauccugggcacugucguaucgguugcucccagguuaccauccgcuucauuuuaggccuguguuaacuugacaccgggauaagcacucaagagcucugaacacacagaaucaugggcaucagggauugcuccucucucaguucagaguccccuugauggucucggugaccucaacugaccugaccaccuuuuuuuuuuuuuuucugagacagagucucacucugucacccaggcuggaguacaguggcacgaucucagcucacugcaaccucugcuuccuggguucaagcaauucuccugccucagccucccgaguagcugggacuacaggcaugugccaccacgccuggcuaauuuuuguauuuguaguggagaugggguuucaccacguuggccaggcuggucuugaacuccugaccgaaugaugcacccaccucggccucccagagugcugggauuacaggcaugagccacugcgcccggcccugaccaccucagcuugugcuguugucacauuuccuucauccacagugaccugggcaaccucaaggugcccccucuggggccucucucagcuaaccucccaccagggagcccacuaaccacccuucuacccugucccuuaguccagggcucccagcgcugugaacugaacugccggccccguggcuuccgcuucuauguccgucacacugaaaagguccaggaugggacccugugucagccuggagccccugacaucuguguggcuggacgcugucuggugagggaagacagugugugugugcacacacacaugcauaugcacacagacacaugcccccauaugcauacacauguacacacauauguaugaacacaugcacacaugcaagcacauacacacacgcauaugcgcacagacacaugcacacacgcacacacacacacgcacacacacgcauaugcacacacaugcacaugcauaugcagacacaugcaugcacaugugcacacgugcaugaacacaugcacacacacguaugcagacacaugcacacacauguagacacacaugcaugaacacaugcacacaugcacacacacguauuugcacagucucaauucaacaacaaaacaccauacugagaucacugagggagaauucucaccugccaagcugcgcugagcagagccugaaggaucugaucgggcaccuguccaugucccugggucuggcuggggaugguggggcuguuuuugugcucucacuuguggcacaaaaagcaggguagugagcugaggcucccgaggggaccggggugggguugagguggugucuggcguucuguggccacugccucaccucacucucuccagagccccggcugugaugggauccuuggcucuggcaggcguccugauggcuguggagucugugggggugaugauucuaccugucgccuuguuucggggaaccucacugaccgagggggcccccugggcuaucagaagaucuuguggauuccagcgggagccuugcggcuccagauugcccagcuccggccuagcuccaacuaccugggugagcacccagcugccuccccuuccacuuccgucucuguucggcccuccauaccccuacucagagcagugagcaagccaaacagggggaaguccagggccuagccccuccccucguggaaggagugaggaagcugagagggcuuggggggaucuuagguucuggugggagcuucuauaggcuaaggacacggugugggaggaggaagguauuaucacccuggaauuucccgaucucucaccucugacccgcagcacuucguggcccugggggccgguccaucaucaaugggaacugggcuguggaucccccuggguccuacagggccggcgggaccgucuuucgauauaaccguccucccagggaggagggcaaaggggagagucugucggcugaaggccccaccacccagccuguggaugucuaugugagccuggggccaggggcagcugaaugcuggggagggaggcuguucccucugggcagagcugugguugucaagaugggagagagagcugguggcauccucuucuggccacccccacauauucauuaucuucucuucuccccagaugaucuuucaggaggaaaacccaggcguuuuuuaucaguaugucaucucuucaccuccuccaauccuugagaaccccaccccagagcccccugucccccagcuucagccggguaagacucugaccccugcacuuggaaggaggagggagaggcugcagggcuggcucggggcagugggguggcaucugauucgccugcuccccugcacagagauucugaggguggagcccccacuugcuccggcaccccgcccagcccggaccccaggcacccuccagcgucaggugcggaucccccagaugcccgccccgccccaucccaggacaccccuggggucuccagcugcguacuggaaacgagugggacacucugcaugcucagcguccugcgggaaaggugagacaucacagugcguuccccgcaucucgguccaaaccccccaacugacacucccgcauccuggauuguggggccacgcccgacccugcgucugggacaccacugagcuugggcucuagccuccugccucccuggcugccuucucacccacucaggugucuggcgccccauuuuccucugcaucucccgugagucgggagaggaacuggaugaacgcagcugugccgcgggugccaggcccccagccuccccugaacccugccacggcaccccaugccccccauagugaguaugggggagcccacggggaggguuaggguacuggaaacacagcaguugcccccagaaucuuaccugaacucugcacucaacgcaacaucuccuggcugcagagagacaacauuagauuagaaaggcagacauucgguaggcagcaagaaagccauggcaggcugagccccccaggaacccagacuccaaacgccaaacgugcccacucuccucugaggcccccacguccagugugucuuccaucucugcugccacggcagccccacacaucucaucuaugucuccgccucuucccugcccugcuggugccugcagcugggaggcuggcgaguggacauccugcagccgcuccuguggccccggcacccagcaccgccagcugcagugccggcaggaauuugggggggguggcuccucggugcccccggagcgcuguggacaucucccccggcccaacaucacccagucuugccagcugcgccucuguggccauugggaaguuggcucuccuuggagccaggugaguuugcccaggcaaggaggugcuggggaggggaaugggcacaggugaacaacagcagugguuuuucaacuucuuuuucaucagcagaaacuauuuacaaacaggguuucauauggacccccaauauagaagucagauaagggacugaaccagggacugggggcccagggcccuagggcucagccuccuccucagcccacgaagccaugugacugcugggcuggggaucgaaggcagagccugguucugaagccuagagcuggaagcuggcugagaaggucugggaagcccagcucccuggauuccccucgcccccucagugcuccgugcggugcggccggggccagagaagccggcagguucgcuguguugggaacaauggugaugaagugagcgagcaggagugugcgucaggccccccgcagccccccagcagagaggccugugacauggggcccuguacuacugccugguuccacagcgacuggagcuccaaggugagcccggaacccccagccauauccugcauccuggguaaccacgcccaggacaccucagccuuuccagcauagcucaauaaacuuguauugaucaagcgccugcuauaugccugacccugggaacucagagauaagugagaacaacuuccaugaggggcccggcuaggauuccucguccgggccugguacccggggacauucccaaccacccaggauucggacccaggaugcgucccucccugccccccuacugucccuugugccagucaccagcaggccccucacacaggccgcucuccuccuccgcagugcucagccgagugugggacgggaauccagcggcgcucuguggucugccuugggaguggggcagcccucgggccaggccagggggaagcaggagcaggaacugggcagagcuguccaacaggaagccggcccccugacaugcgcgccugcagccuggggcccugugagagaacuuggcgcugguacacagggcccuggggugagguaagcugagcgccugcugagagcaggaagggggugccagucccagugggauuccuugugggcacuuggggugcucucuguccuccccuccccucaucacccugcccucccccuacacuagugcuccuccgaauguggcucuggcacacagcguagagacaucaucuguguauccaaacuggggacggaguucaacgugacuucuccgagcaacuguucucaccuccccaggcccccugcccugcagcccugucaagggcaggccugccaggaccgaugguuuuccacgcccuggagcccagugagugucuggcugcgcuguccugcccugcucagccugggccccuaggggaggggagcuccucucgcuguacccccuccaggucucucugugccccagaauaagcccagccaagcguuaccacuguccuacuucuuauagacuuggaggaaagaugggcccucuccauuugggauuucacaauguccuaggaggguccccaccaccaccuuuuggggagagagguggcagccagggguuaaggagaaucccgggccuggcaaaggucugauaugauggcuggggucgccccaguguucucgcuccugccaagggggaacgcagacacgggagguccagugccugagcaccaaccagacccucagcacccgaugcccuccucaacugcggcccuccaggaagcgccccuguaacagccaacccugcagccagcgcccugguaaagagcccccucuccccaauccccaauacaguggauuagcugaaguaugggaggagaugagaaaggaccagugggaaugggcagcacacccauucccagacggguggguccuggugacucucuugugcccacuggccuccucuguccccagaugaucaaugcaaggacagcucuccacauugcccccuggugguacaggcccggcucugcgucuaccccuacuacacagccaccuguugccgcucuugcgcacauguccuggagcggucuccccaggaucccuccugaaagggguccggggcaccuucacgguuuucugugccaccaucggucacccauugaucggcccacucugaacccccuggcucuccagccugucccagucucagcagggauguccuccaggugacagaggguggcaaggugacugacacaaagugacuuucagggcuguggucaggcccaugugguggugugaugggugugugcacauaugccucaggugugcuuuugggacugcauggauaugugugugcucaaacguguaucacuuuucaaaaagagguuacacagacugagaaggacaagaccuguuuccuugagacuuuccuagguggaaaggaaagcaagucugcaguuccuugcuaaucugagcuacuuagaguguggucuccccaccaacuccaguuuugugcccuaagccucauuucucauguucagaccucacaucuucuaagccgcccugugucucugaccccuucucauuugccuaguaucucugccccugccucccuaauuagcuagggcuggggucagccacugccaauccugccuuacucaggaaggcaggaggaaagagacugccucuccagagcaaggcccagcugggcagagggugaaaaagagaaaugugagcauccgcucccccaccaccccgcccagccccuagccccacucccugccuccugaaaugguucccacccagaacuaauuuauuuuuuauuaaagauggucaugacaaaugagaaaugagcucuuccuugucggcuauggaccccucagcagugugaaggcagaagguagggugggcaggggaacagcauuagagcccaggagaguuugggucagagaauccccgccagccccaggcccugcaggcuggucaugggcca

SEQ ID NO: 13739 - RNA, 4569 nt, Homo sapiens
auaaaaaaauuucuuuaaucagaaaggauuuaucuucccucaacacaaaugcacacauuaauaguaaaaauacauauauacauaaauauuuacacaaauuagaagucacaguggacagcuguaugcccugggcuagagguugagaagaugagcaucagcagcaacuggaggauggcuucucugcugcucccgguguccuauggucaucuuucuggccaagguggguagacugggaggggauaggguauagcuccagucugauggcagaguuacuggcaaacuguagcaacgaggacccucuccagauaguuucauaggcucaccagggaugacaggagaugcuguaguaggugggacuggggugguuggggcagagugggugaaggguugcacuccaugcuggaggaaaagaaugacgccaaugccgguuccagugccuaaaggaccauggcuaaaggagauaguaccuggggagcugagagggggguugcaaauuggagugguguggauccaggugagguucauagcuggccauugugugaggugccaaggcugcuuugguuuuaaagcuagauguccuagcugugucugguccaucuuuuccauaggagaugcaggagaggaagcagcugaaucacugugguggcuuggaaaaugcuagagaggggagaaaugagaaaaaaagaaauguggagaaagcauucagaugagcuccaccugguuacuuaaaccuuugcauuccuugggaacucaguuugcaaugcaaacauaccucguuuuaugcaacagauaugaucuugccaggccaugauuaaguaaaaguuuugguaacuaaauuauacuuucauuuauuaaacaaauaaauggccuacuauggaccacauacuauauuagacacuggauauccagagaugaagaaaaaacaaacaguuccauagguucucacuauuuauaaaauaaucccuuuuagaauuucuuugaagucuauuuuuaauuggaaucaucauuucccaaauucuguauuuaaauucgaauauucuaucuugaguucuuuaagaaguguaaauuaauauucaggcaagauccuccuacuguuuuuuuaaaauuuuauauuugagacagggucucacucugucaacgaggcuggcacaaucauggcuuacugcagccucgaccucccaagcucaagagauccucccaccucagccucccacccagccucagcugggacuacaggugcacgccaccaugcccaccuacuuuuuguauuuuuuguagauagcagccuucaccauguugcccaggcuggucucaaacuccugggcucaagcaauccuccugcuuuggccucccaaagugcuaagauuacagugagccacugugccuggccuacuuauuuuuuaauagauuagucacagcaauaauaaccauggcugauugaaaauuaggacuggugauuaucuacaggagacucuccuucuccgucauuugaaugcccucuacauacccuauuauuugaggacagaaaauaggucacuuuuuuuuuuuuuuuuagauggaguuucacucuugucucccaggcuggagugcaauggcacgaucucggcucaccgcaaccucugccucccggguucgagcaauucuccugccucagccucccgaguagcugagacuacaggcgugcgccaccaugccuggcaaauuuuuguauuuuuaguaaagacgggguuucaccaucuuggccaggcuggucucgaacuccugaccucaugauccacccgccuuggccucucaaagugcugggauuacaggugugagccaccgcucccggcugaaaauaggucacuucuauaccaggucuaagaaucuaucaacacugcugcuauuggugccccccuccccuacuuccagugagguaccucuuaugaccaguccuugaaacccaguguagacucaaaaacugucaaaggguuuggcacaaggauacgugggcagaaaugaaaagaaggagaagggaaggguuugggggcaguagggaaaaaagaguuugcagagagaagcugagguguauucccgcaugaaucauuuggccagguaaaaagccuuuuguaucuacgcagaaagcagauaagcuguggcaugagggauaggauuaaacuucauggaguuucucccagugauucaaacaaaacaacaacaacaacaacaacaacaaaacauguaggaaucaagacaaugcagaaaguuuaggaauuuccuucccugaaaagaaacuugaagaaaagacucaaaagaaaauggcaaaaggggccauuucugcaugcacauuucauuuucuuggcuauuuucccaccucuuccucguguucuuaaguucuuaccuuggucagcugaugcuugccaccacccaaugaugacuucugggcagcuauuuguggaaaccaagucuuuaacaucccuucuaccuguagcaagguuccuagguaacguucccugugaaaaugacguugcuuuaaaaaaccagcaacaggauuggagaaaucuccuuuuuaugaagacccaagcaaagaaccagcgggacuuaccccaucuguggcuucugcaaaacaccuacaauacgcuggauccuguccauugccacacucugcugaaaacugcuuaauccuggggacagggacagagagagauuaaggauugagauucaagcauguagucagguaaaggaagaacagaaggggguuaaaauugauugaucuaaaaaaauuaagucgggccaggcaagguggcuuacgccuguaaucccagcacuuugggaggcugagguggguggaucaccugaggucaggaguuugagaccagccuggccaacauagcgaaaccccaucucuacuaaaaauaacaaaaauuagcugggcaugguggugggcgccuguaaucccagcgacuggggaggcugaggcaggagaaucgcuugaacccaggagguggaaguugcagugagccgagaucgcgccauugcacuccagccugggcaacaagagcaaaacuccgucucaaaauaauaauaauaauaauaauaauaauaaagucauaguagcaaaaaaggaguaauauaggccccaaacaagaacuucagagaaauacacgucaaaagagggaaagagaaagagaaaugaaccuagcccaaaugaaugcaacaauaagauuaccucucucaaaacgacccaucuucagcccauugaguaggucugugagaggagguauaaauccuuggaguucuuuacacuguaggaaaauaggacaaaggcuguaagaagacaaaaaacugcccacaccagcaguggcucuuccuucaccuccaaaucugggagucaauacuguccucacaggguccuuaucaaccagcugggugcuaaggcacuccaggagaaucuccuuucaccugcuuucucuuaccuucugggcaaacagcaggucucccucugugguacaaccuuggguguuuagacuggucuccaguucaccaucucuugaucuuuucgccccagauccugccauaggagaagccgaaccccgcuguuucggaugagaugguguaugcugguuaccggaaaccuucgaucgaugccugcagcggauaggacccgggcugggccgugaaccuccccucugcccaacagugucuggccugggcccaugggcccccuuguccucccucucacuaucagaggggaagccaaagucacuguucacuggggaggugggaaaagacgaagagagagaguaggaggaauaggaagaaacgcuagauggagaauccauagguccagaagcaggggcuauagaacagcuccuggaguacccaaagaucggaaccugcaacugaagagcaaagcgagggaguuugaaaccagaguuuaaggauuaggaaaugaacugggagauugggguguacugcgugggauaauacuuguucucccccuccccaauauuaccggucucaaacacaauagaaaaagacauuucuacccccacccccgcccauuaagagcuugggauucccucucuggccgccgcagagcagcucucggucugacgcggccuccguucuuuucuucccucaguucagaguaaauaccgacuugaaagacaccuuccccuccgcccguuguucgccagggcuauucgccagccugaguccgcagcaagccucuccaccugaggccaugccacccacaagcagucaaucugggcacgcgaacccaccuggugauccuacgggaaccgcccccauagagacuggccuccugcccucucccaaucuuucaagaucaggaucccugcgccggucucucugggcucgcaccugccacgugaugcaaacccucccaauaccaagaucugcauucagcccccaaauccacucccaaauacucccuaacagcucgcuuuguccuccgaaucuccuuaccuguugucagccggcucagcccuggcucgguuuccagcuccuucgccgucucuccgggucuaucuacccaccuccgccucucucagugggccccgcccc

SEQ ID NO: 13740 - RNA, 4569 nt, Homo sapiens
ggggcggggcccacugagagaggcggagguggguagauagacccggagagacggcgaaggagcuggaaaccgagccagggcugagccggcugacaacagguaaggagauucggaggacaaagcgagcuguuagggaguauuugggaguggauuugggggcugaaugcagaucuugguauugggaggguuugcaucacguggcaggugcgagcccagagagaccggcgcagggauccugaucuugaaagauugggagagggcaggaggccagucucuaugggggcgguucccguaggaucaccagguggguucgcgugcccagauugacugcuuguggguggcauggccucagguggagaggcuugcugcggacucaggcuggcgaauagcccuggcgaacaacgggcggaggggaaggugucuuucaagucgguauuuacucugaacugagggaagaaaagaacggaggccgcgucagaccgagagcugcucugcggcggccagagagggaaucccaagcucuuaaugggcggggguggggguagaaaugucuuuuucuauuguguuugagaccgguaauauuggggagggggagaacaaguauuaucccacgcaguacaccccaaucucccaguucauuuccuaauccuuaaacucugguuucaaacucccucgcuuugcucuucaguugcagguuccgaucuuuggguacuccaggagcuguucuauagccccugcuucuggaccuauggauucuccaucuagcguuucuuccuauuccuccuacucucucucuucgucuuuucccaccuccccagugaacagugacuuuggcuuccccucugauagugagagggaggacaagggggcccaugggcccaggccagacacuguugggcagaggggagguucacggcccagcccggguccuauccgcugcaggcaucgaucgaagguuuccgguaaccagcauacaccaucucauccgaaacagcgggguucggcuucuccuauggcaggaucuggggcgaaaagaucaagagauggugaacuggagaccagucuaaacacccaagguuguaccacagagggagaccugcuguuugcccagaagguaagagaaagcaggugaaaggagauucuccuggagugccuuagcacccagcugguugauaaggacccugugaggacaguauugacucccagauuuggaggugaaggaagagccacugcuggugugggcaguuuuuugucuucuuacagccuuuguccuauuuuccuacaguguaaagaacuccaaggauuuauaccuccucucacagaccuacucaaugggcugaagaugggucguuuugagagagguaaucuuauuguugcauucauuugggcuagguucauuucucuuucucuuucccucuuuugacguguauuucucugaaguucuuguuuggggccuauauuacuccuuuuuugcuacuaugacuuuauuauuauuauuauuauuauuauuauuuugagacggaguuuugcucuuguugcccaggcuggagugcaauggcgcgaucucggcucacugcaacuuccaccuccuggguucaagcgauucuccugccucagccuccccagucgcugggauuacaggcgcccaccaccaugcccagcuaauuuuuguuauuuuuaguagagaugggguuucgcuauguuggccaggcuggucucaaacuccugaccucaggugauccacccaccucagccucccaaagugcugggauuacaggcguaagccaccuugccuggcccgacuuaauuuuuuuagaucaaucaauuuuaacccccuucuguucuuccuuuaccugacuacaugcuugaaucucaauccuuaaucucucucugucccuguccccaggauuaagcaguuuucagcagaguguggcaauggacaggauccagcguauuguagguguuuugcagaagccacagaugggguaagucccgcugguucuuugcuugggucuucauaaaaaggagauuucuccaauccuguugcugguuuuuuaaagcaacgucauuuucacagggaacguuaccuaggaaccuugcuacagguagaagggauguuaaagacuugguuuccacaaauagcugcccagaagucaucauugggugguggcaagcaucagcugaccaagguaagaacuuaagaacacgaggaagaggugggaaaauagccaagaaaaugaaaugugcaugcagaaauggccccuuuugccauuuucuuuugagucuuuucuucaaguuucuuuucagggaaggaaauuccuaaacuuucugcauugucuugauuccuacauguuuuguuguuguuguuguuguuguuguuuuguuugaaucacugggagaaacuccaugaaguuuaauccuaucccucaugccacagcuuaucugcuuucugcguagauacaaaaggcuuuuuaccuggccaaaugauucaugcgggaauacaccucagcuucucucugcaaacucuuuuuucccuacugcccccaaacccuucccuucuccuucuuuucauuucugcccacguauccuugugccaaacccuuugacaguuuuugagucuacacuggguuucaaggacuggucauaagagguaccucacuggaaguaggggaggggggcaccaauagcagcaguguugauagauucuuagaccugguauagaagugaccuauuuucagccgggagcgguggcucacaccuguaaucccagcacuuugagaggccaaggcggguggaucaugaggucaggaguucgagaccagccuggccaagauggugaaaccccgucuuuacuaaaaauacaaaaauuugccaggcaugguggcgcacgccuguagucucagcuacucgggaggcugaggcaggagaauugcucgaacccgggaggcagagguugcggugagccgagaucgugccauugcacuccagccugggagacaagagugaaacuccaucuaaaaaaaaaaaaaaaagugaccuauuuucuguccucaaauaauaggguauguagagggcauucaaaugacggagaaggagagucuccuguagauaaucaccaguccuaauuuucaaucagccaugguuauuauugcugugacuaaucuauuaaaaaauaaguaggccaggcacaguggcucacuguaaucuuagcacuuugggaggccaaagcaggaggauugcuugagcccaggaguuugagaccagccugggcaacauggugaaggcugcuaucuacaaaaaauacaaaaaguaggugggcaugguggcgugcaccuguagucccagcugaggcugggugggaggcugaggugggaggaucucuugagcuugggaggucgaggcugcaguaagccaugauugugccagccucguugacagagugagacccugucucaaauauaaaauuuuaaaaaaacaguaggaggaucuugccugaauauuaauuuacacuucuuaaagaacucaagauagaauauucgaauuuaaauacagaauuugggaaaugaugauuccaauuaaaaauagacuucaaagaaauucuaaaagggauuauuuuauaaauagugagaaccuauggaacuguuuguuuuuucuucaucucuggauauccagugucuaauauaguaugugguccauaguaggccauuuauuuguuuaauaaaugaaaguauaauuuaguuaccaaaacuuuuacuuaaucauggccuggcaagaucauaucuguugcauaaaacgagguauguuugcauugcaaacugaguucccaaggaaugcaaagguuuaaguaaccagguggagcucaucugaaugcuuucuccacauuucuuuuuuucucauuucuccccucucuagcauuuuccaagccaccacagugauucagcugcuuccucuccugcaucuccuauggaaaagauggaccagacacagcuaggacaucuagcuuuaaaaccaaagcagccuuggcaccucacacaauggccagcuaugaaccucaccuggauccacaccacuccaauuugcaaccccccucucagcuccccagguacuaucuccuuuagccaugguccuuuaggcacuggaaccggcauuggcgucauucuuuuccuccagcauggagugcaacccuucacccacucugccccaaccaccccagucccaccuacuacagcaucuccugucaucccuggugagccuaugaaacuaucuggagaggguccucguugcuacaguuugccaguaacucugccaucagacuggagcuauacccuauccccucccagucuacccaccuuggccagaaagaugaccauaggacaccgggagcagcagagaagccauccuccaguugcugcugaugcucaucuucucaaccucuagcccagggcauacagcuguccacugugacuucuaauuuguguaaauauuuauguauauauguauuuuuacuauuaaugugugcauuuguguugagggaagauaaauccuuucugauuaaagaaauuuuuuuau

SEQ ID NO: 13741 - RNA, 4536 nt, Homo sapiens
gggauuagaugggagguggccguggggcugcggccgggauuuguccccucuucggcuuccguagaggaaguggcgcggaccuucauuugggguuucgguucccccccuuccccuuccccggggucugggggugacauugcaccgcgccccucguggggucgcguugccaccccacgcggacuccccagcuggcgcgccccucccauuugccuguccuggucaggcccccaccccccuucccaccugaccagccaugggggcugcgguguuuuucggcugcacuuucgucgcguucggcccggccuucgcgcuuuucuugaucacuguggcuggggacccgcuucgcguuaucauccuggucgcagggugaguagagggcccgggagacgcgggagagcgucgaagagagaggugcggaaggggcuggaggaacuggggcaagccugggagccugaauuggggacgauaagucggaggugaaguuugggcggaggugagggguugggucugggagauuuguccuuucccgcaguugguuuccaccuuccaaggaucucacagauuccuccuauauuccucccagcgacgucagagaaggcccaaggccgagacucgugagggggcugugcugaccuaggcaggccgagucaggugccuuaggggaggauccaggaacggauaccucgcccuuccgugcucgcacacucuggcugucaucgcucugaagacucuuuaauuagauuucuccccuuuccagugcguucacuuuucuacagaugagucucuugguggagacaguuacccuaccugguccaugucucccuaaccauccggaaggcuaacuuccacuuuucaagcagcuuuggcugguuucccuccuugauuucucuggcucccacuacuauugcuugucucacugccccugucuuuucucagggcauuuuucuggcuggucucccugcuccuggccucuguggucugguucaucuugguccaugugaccgaccggucagaugcccggcuccaguacggccuccugauuuuuggugcugcugucucuguccuucuacaggagguguuccgcuuugccuacuacaagcugcuuaaguaagaagauggaguggucuggaggggagaggggcaaaggacugcacuaugggaaguggggcagccccugggugcugguuuggaagaggaggcacuaagggaggacauuagagggaaaggagcaucccugcccucccucauguuuccccuaccccaccccaccccaggaaggcagaugagggguuagcaucgcugagugaggacggaagaucacccaucuccauccgccagauggccuauggugagccaagggagagggacuggaggagggaguuggacagcccccuccucuagggaagucucuaaauauccacauguucuaaguggcuucuuacuuuccuucauccgucacuuccaaagaaaguuggucuggagggagaguagaugugaaagaauuguaaccgggaauggggaggggucaguggugaacaggcaauagugugaucucugacauugaugagauccucccuucccccaguuucuggucucuccuucgguaucaucaguggugucuucucuguuaucaauauuuuggcugaugcacuugggccaggugugguugggauccauggagacucacccuauuacuuccugacuucagguaagauccaccuucuaucuagccuuuaccccccauccauccuugucccugaucugauuuauuggccuucccugagagacuucuuuggcucaacaucucaggagccugggagaagaucagggauguaucuccuccccaucucccucccugcagccuuucugacagcagccauuauccugcuccauaccuuuuggggaguuguguucuuugaugccugugagaggagacgguacugggcuuugggccuggugguugggagucaccuacugacaucgggacuggugaguuggagacaggggccugaguuagggagaaaagcauuuaauggugagugggaugugggggaaaggguauccucacuucuuaacauuuuuaacuuaccugggaggaggaggaaaggugagucuuucaaggucucucaccucagcaucauuucuaucaccugcucuggggaggagguugaaaggauuagucaaacuguaaugcagagggccugaggugagcaggagcggcagaaaccuuugaguuucugaggagcugaaaaucaaaaguccccuuaaccacaagauguuggugcucugaagggaaagacuggagaauuugagagagauaucugggagucagaaagguacagagagaauauggggauuaggucgagggagaaucuaaucucuuuccuacucuuacccuccuuccuagacauuccugaaccccugguaugaggccagccugcugcccaucuaugcagucacuguuuccauggggcucugggccuucaucacagcuggagggucccuccgaaguauucagcgcagccucuuguguaaggacugacuaccuggacugaucgccugacagaucccaccugccuguccacugcccaugacugagcccagccccagcccggguccauugcccacauucucugucuccuucucgucggucuaccccacuaccuccaggguuuugcuuuguccuuuugugaccguuagucucuaagcuuuaccaggagcagccuggguucagccagucagugacugguggguuugaaucugcacuuauccccaccaccuggggacccccuuguuguguccaggacucccccugugucagugcucugcucucacccugcccaagacucaccucccuuccccucugcaggccgacggcaggaggacagucgggugaugguguauucugcccugcgcaucccacccgaggacugagggaaccuaggggggaccccugggccuggggugcccuccugauguccucgcccuguauuucuccaucuccaguucuggacagugcagguugccaagaaaagggaccuaguuuagccauugcccuggagaugaaauuaauggaggcucaaggauagaugagcucugaguuucucaguacucccucaagacuggacaucuuggucuuuuucucaggccugagggggaaccauuuuuggugugauaaauacccuaaacugccuuuuuuucuuuuuugagguggggggagggaggagguauauuggaacucuucuaaccuccuugggcuauauuuucucuccucgaguugcuccucauggcugggcucauuucggucccuuucuccuuggucccagaccuugggggaaaggaaggaagugcauguuugggaacuggcauuacuggaacuaaugguuuuaaccuccuuaaccaccagcaucccuccucuccccaaggugaaguggagggugcuguggugagcuggccacuccagagcugcagugccacuggaggagucagacuaccaugacaucguagggaaggaggggagauuuuuuuguaguuuuuaauuggggugugggaggggcggggagguuuucuauaaacuguaucauuuucugcugaggguggagugucccauccuuuuaaucaaggugauugugauuuugacuaauaaaaaagaauuuguaauugugggggaacuuggcuuuuaagggaggggauagcauguuaauugagauuucuguccucagaucucucauccagccacuuuccuaaccuggcaaccacugauuuccaagcauagccuuggugcaagggcagaaaucugggcuagugguuuaacaugucugaaacuuuggguuaagugucuucccagaagcuuaucuuuccuuccaggggugggauaaaaggaguuaaucacccaugcuucuuuuccccauccuuugcccaucuuuaccaccugagggauucaggaacuugcccacccucaagagccucaaaggauaggccagaauuaaagucagaaacuuuaauuuccaaauauauugaucaaaaauauacaacuucaacagcaacucuuuauccuaaggagagaucccgcaguauaucuagggaaagggccauaaaagugaggggguagaggacuuugggguauaucccaaacuuccccugcaacuaaacagaguuuguucucugcauuaacaacacagcgauuuccucauuuccuccuacauguuuggagaggcugaaggcucugcaguucuuccuggaaugacagccuggguccauuccucucuaggagauguccaggggaaggaggacaucugcuuacuacuccuacaguguuucuggccagauccuacaccccauuuuagaggcuuccugauaggcaugaagggaagucauccacauccaugguaucugagaaggaauuuaugccucagucguggcuugugcugaggugaagaccacacucuuucgguuuuccagccucuucuuccuggaaaggggaauggcucaugagaaugacugcuaucuaagugaagcagauuagaggugaaauag

SEQ ID NO: 13742 - RNA, 7297 nt, Homo sapiens
auuaaagucagaaacuuuaauuuccaaauauauugaucaaaaauauacaacuucaacagcaacucuuuauccuaaggagagaucccgcaguauaucuagggaaagggccauaaaagugaggggguagaggacuuugggguauaucccaaacuuccccugcaacuaaacagaguuuguucucugcauuaacaacacagcgauuuccucauuuccuccuacauguuuggagaggcugaaggcucugcaguucuuccuggaaugacagccuggguccauuccucucuaggagauguccaggggaaggaggacaucugcuuacuacuccuacaguguuucuggccagauccuacaccccauuuuagaggcuuccugauaggcaugaagggaagucauccacauccaugguaucugagaaggaauuuaugccucagucguggcuugugcugaggugaagaccacacucuuucgguuuuccagccucuucuuccuggaaaggggaauggcucaugagaaugacugcuaucuaagugaagcagauuagaggugaaauaggagaaugcuuuuuaacagaaaagagggcugggcaagguguuucacaccuauaaucccagcacuuugggaggcugaggcgggcggaucacuugaggucaggaguuggagaccagccugggcaauguagugaaaacccgucucugcuaaaaauacaaaaauuaucugggcaugguggcacaugccuguagucccaccuacucaggaggcugaggugggaggaccacuugagcccgggagguggagguugcagugagcugugauaaagccaugcacuccagccucgacaacagugagaaccugucucaaaaagcggguggcucaugccuauaaucccaguacuuugggaggcugaggcaggcgaauugccugaggucaggaguuugagaccagccuggccaauauggugaaaccuugucucuacuaaaaguacaaaaauuagcugggugugauggugcgugccuguagucccagcuacucgggaggcugaggcaggagaauugcuugaacccagaaggcagagguugcagugagcugagauugcacaccacugcacuccagacugaguaacagagcaagacuccgucucccaccuaccaaaaaaaaaaaaaaaaaagaagaagggacuggaggaauggaaaguagggccucaccgaaucuuucuagcaaugaaauaaacagccaggagaaggcagagacagccaaccaagauuccuacaccuagacucagcauuucaccugggggagauaaagguaaaaggugucagccuaggacuaacauagauuuugagccuuucccccacucggugaggacaccuccccuccccgcauuaucuuauaaggcuggcuuaccugugguauacgaggauccugcuguaagagaagaaaaugggucagugggacuucagauccccaucccagcugggagcagcacucucugcugcugugccugggagaaucccccgggggcacccugggguggggguugguucccaguccaagcaagucccagaaacccccuccccuuuuagccuuuucuucccauuggcucccuaguuccugccauugugucccccucaguuucccaucucuucugagccgugcagaaucaccuuggaugaaagaagcaaagaccaugcgcugauugagaggcugaagggcucgguaguucuguaccagaagcuuagagggcuccucuucuguggagaacaauguccccugaagcuuuuccagcugaggagcagaagcgugggagagguguuacuuuggggagugggaaggggucugaaguuacaacugugucucaccucaccucguuucuccaccacuuaccuguuccauugaaaucugggaccuucuauaaaaaacuguccagagcacacucugguagcaagggggaguugugagcgagccauuguagcggaaguacugccccagcuguuuggggagcagcucucuuagguugaagggaggcacugaggucuucugaucuggggagaacagacugggacucaucuuccuuucagugugcccuagcuuaccuagauagggcucccagaagcaaaauuccuuggcucuauguaauugcuucaucccaaggcuuuuaaggauaguuuuugaaagucuaaucuuacuuccugcuauagauuuuuaaggcucaccuuuaugccugacuucaugcaagugacucagaauguguucauaagcuauauucuuagucucacccaccuggaagagaaggaaagggagagaguuuggaaugaguccauguuuggaauaagaaauuuauguacagaauaaauggucagggugggcugcugccugccauaggaaggaggccagcaacagaaauagguuugaggguugcagaggaaguggagagaaaccuggaagggacugggggcuacugaccucaauuaggaugcccaggacagccaggcccugaggccucucagcagccucacucaagcugucauaggaaucagagucauaauguacaauguggagcuaaaggaaggaagagggaauugaaucauggaaugucugcacccccuucaaggccuugauccuagcugccaccauccccccgcuguccccggcaggcacuaagucugucccucagagauuggccuuauccccccagcaugacuuuuccuaagguccagauccuuuccccaggaccacccaucccuguuacuuugucugagucccagcucuuuguucccugguaccucugcaaauguggcuucacuguugaucugguguucugaccccccuggggauccuuucugaccccagugcagguggagcugggcagcuacauauuuucggggaaguccacccagauacaggguagagggcagagagaguugcacugugaggaaaagagcaaacucggauugguggaggcauguggauacauucccacuccuggguugccaccacuucuugggagacuuggcccucuuccaguuuucucccccaguagcacccaguuccucccauaggccagugcuuuucuagcauaucuuccuuuuucuuggugaagaccaagucagugcaaugauaccuaccuacugagcuugguuauaaacauuucgauucccgcuuuggcuacaggauccugauccccauucucauaucuccaaauucauggacaaagguuuuugagaauucguagguuaggaaaaugcugcuuuccucugacuccugagguuauuuguuuguuuauuuaugucagauggguaaugugccaacaucuugacaagauuugagggcggcacaucuuacgcaugcucaggaacaccccaucaucaugcccaugaacuacaaaaggaucugacuccuaagaucugagcuggagccuacaacuccuuggagccugugcuuuuaccuguguggccauuguugugcagguccaaaggcucggugccaggcuggucauauccguggggcugcagagcaggcaaaucagggucaaaugucacacugucugucugaauaucgaugggcgacugggcauuguuuccacacucaggguaagaggcuggccaaugguccugaccaugugggccugguggggguuaccaaagacauugguccuguccuccagcucuagcuacccuucaacagcacccccucccuuugacccuuccccuaaccaagccauacaucuguguggagguagaaauggacuucccuccacccagguuaagaccccaguuguauagggaugggugagguaggaguccuguugagucucaugcugcaguuccccuucccuacccagaggcagugaugauuccccaacuauccugaugaauggggagugguagcucuuuuacuuaccuguauuuugaggacaagaaagcugaaugagggcagaggggaugcauagaaaaccugaauacccugagagaugggauuagagaguaggaguagaaaaaugggagaaauaaaaugauccuagauaggccaggcacaguggcucaugccuguaaucccagcacuuugggaggccgaggcagguggaucgcuugaggucaggaguucgagaccagccuggccaacauggugaaaccccaucucuacuaaaaaugcaaaaauuagccagacgugguggugggcaccuguaaucccagcuacucgagaagcugaggcaggagaaucacuuaaacccaggagguggaguuugcagugagcccagauugcgccacugcacuccagccugggugacagagcaagacucugugucaaaaaaaaaaaaaaaaaaaaaaaaaaaaauccuagagagauacggucuccuggaggccccuaucaaguggccuugggauucagauauccugacuucucaucauucacuucuugcucucacacugaccguuuaucaugaacuugaguuugguuaagucauuaaucaguaguucauaggaacugaguuccaccucccccagggucagaaacuauccugccagccucuuccucaccccugaccuccagcucugucccaauuucagaugcagguuagggguaggauggauuaggauagacggagccagaaggagaccuggcagcuaagcucagaguucccacccagcuuccuuuccaccccagcucccucacuccuacacgauuuacugaggacuuaacuagcuuuucugccaaaucaggagguguaggauuugaugauuagagcaggaucuaggagccauauaugugaaacucaaggcaggaggagauccagaagggaggagcuagggugagaagguaaaggaagucuccucccacccgcacagugugucuuccugccaggugaggaggucccagugugaaaggguugucgggaggccuugagaucugcucacccucauacguccaguguugaccugcaaggcagaauaguuuggguuacagccagcgcagccuggggcagaacccuggccuccacacuccccucccucuggcauucuguacugcuccaccucccucucugcagucucuccucccucugcuccagcacuuugcaaaggaagcccugaaaccggacaccucuguggaaaggucggggggccuauuuaaaaucaccagccaggcuguguuggugccugccgaguaaaaggggaggaggaaggaaaagagguaaagcccagagacuaaaauuaaccuggauccaaaugugcgauuggcccaacccuuucuuuucuguaaccugugccaagucaaucuaacacuuagaagauugggguggguggggugagggugugggcagaggguuggaaggauagggacuagaaagcggggaggagaaaggaguuuagaguguguguguguuggggggugcuacugaggggagaaggggagauuauuccuuugcuuuaaaaaauugcaugaauaaagccacugagcuguaaacucauauguaaauucuucuuuucuggucccauuagcucuagaggaaacuccucaucaccaggaggcucugcucccuacauucugagaugguuagggaagggugggagucagggcagggucuacucuagauugaggguggugggugggcacaggcagccaggcuggcagggacaggaugaaagugaagcauuguguguagagaagagagcugccagcugggucacaugccaggcucucgugcaguccugucugacgcaaaggcugagggucugcagguccagccccucccuacggccaaacugccucaagaagaaaacgaaggccuucaugguuuaugcugcaauauucauacuacuagaaacucuggagaaaaauccuaaauuccuuccucucucugucucuuauucccuuaaauuccucaaacuugugagauguccugcucuuauccuugaccuauucugcuagcccaagggagagcuggaggcagccucucauuuuaccauaucugugggaccccccaacaacucaaacucccuggucuguaaaggugccuguccacucuggucagagccucaacacacuuauucugucucuuccuccucuuucccucuuuuuuucuuucuccucagaugagauuugugacucuccauuuggcugccugccugcccccauccucucugcauuugccuucugcucucuggacacccaccucacccugcucuuuccacaaaccucaguuacacaccuaguaugugcuggacacugugcuaggcacaggaaacacaaaaaugaggucuaggaguuccuggggacacuccuggagcgcuucagccuguucucccaagaaucccuccucaucuccugggagcuccugaaaguccuuuguaaacuguaaaaugucaaacaaauguugacucuuacugccacuuucagaggauaacuggggaguuagucgcuccacagaaugaagagggaaucuuggccaaaaggggaugaauuggagaucagggucugaguugggcaggaaguauucuucccccuacccccaucuauccaucuuuuuacuccaggccucuuugacucccuauuuggaggaguuuguaaauaaagaaguccaggaguccugccugggaccagggcagugggggaaagagcucuggagaaaaucuguagccugcaaagagauuccagcacuugcauguguacacacucugccugccugccgcuaguucuccccgaccuccaauaacaacaaggcuggagagacaaaagguaaagaagggaaguggucuccuccacaccccacucuuuuuuccucaucucugagccuauuauuccagccucuaggcuuccuuucacaccucuccuccccccauuaagcacaccuggcgacaugugaacaucagcacaaauccacacacagacauuuaguuguaccuacccccaucugcagccaggauccaaaucaccuccagcaggagggcggagaacaacauagugucccaggaaggggugcaggggacugggaauuugaggacuagaggacuaggacaggcagagagagagggagggaggagugagagagagagagagagagcgagcgagcuccuggcgugaguguauuuaucucugcuucucuugcugucucugucucugugggcuuccaggggauucgguguucaguaggguaucauggguuucuggauccccaggacaaaucucuugcugccucuuugcccucucucuuuaucucccucugcagucuccacuccacuagcuggccagcgacuuuacaacugccuccugcuuuuaagguggcucugaacugguguaugug

SEQ ID NO: 13743 - RNA, 1410 nt, Homo sapiens
gcuuuuccagcugaggagcagaagcgugggagagguguuacuuuggggagugggaaggggucugaaguuacaacugugucucaccucaccucguuucuccaccacuuaccuguuccauugaaaucugggaccuucuauaaaaaacuguccagagcacacucugguagcaagggggaguugugagcgagccauuguagcggaaguacugccccagcuguuuggggagcagcucucuuagguugaagggaggcacugaggucuucugaucuggggagaacagacugggacucaucuuccuuucagugugcccuagcuuaccuagauagggcucccagaagcaaaauuccuuggcucuauguaauugcuucaucccaaggcuuuuaaggauaguuuuugaaagucuaaucuuacuuccugcuauagauuuuuaaggcucaccuuuaugccugacuucaugcaagugacucagaauguguucauaagcuauauucuuagucucacccaccuggaagagaaggaaagggagagaguuuggaaugaguccauguuuggaauaagaaauuuauguacagaauaaauggucagggugggcugcugccugccauaggaaggaggccagcaacagaaauagguuugaggguugcagaggaaguggagagaaaccuggaagggacugggggcuacugaccucaauuaggaugcccaggacagccaggcccugaggccucucagcagccucacucaagcugucauaggaaucagagucauaauguacaauguggagcuaaaggaaggaagagggaauugaaucauggaaugucugcacccccuucaaggccuugauccuagcugccaccauccccccgcuguccccggcaggcacuaagucugucccucagagauuggccuuauccccccagcaugacuuuuccuaagguccagauccuuuccccaggaccacccaucccuguuacuuugucugagucccagcucuuuguucccugguaccucugcaaauguggcuucacuguugaucugguguucugaccccccuggggauccuuucugaccccagugcagguggagcugggcagcuacauauuuucggggaaguccacccagauacaggguagagggcagagagaguugcacugugaggaaaagagcaaacucggauugguggaggcauguggauacauucccacuccuggguugccaccacuucuugggagacuuggcccucuuccaguuuucucccccaguagcacccaguuccucccauaggccagugcuuuucuagcauaucuuccuuuuucuuggugaagaccaagucagugcaaugauaccuaccuacugagcuugguuauaaacauuucgauucccgcuuuggcuacaggauccugaucccca

SEQ ID NO: 13744 - RNA, 1576 nt, Homo sapiens
acgaaguggggggugggggcaguagcugagcuugaggguugcagaagugggcugggacugcuugccugugagguuuagauagaagagagauucuuagagacucauuuccugggagaaugaggcaaauuuauuacuggcagagggguugggagagcggcuggggaaggaggcgagagcuguuuccccagggacagagcucuaggcucagaaccgcauaguaugugaggaccagggcaggaguuagagaaauuugcaccuuucuuuucucccugguaaaccuaugcuguggagauagaaggaaaucaacucaucagcguuccaggccaacaccccagacauucuuccuaauggagggagccgggacugcaguuccuuuaucccuccucaggccccuggcuaacaaccugauggggaaggacaggaaaaguugaggaaagugucacugaaaugagaauuaagauuucguucuuuaccugccucuaccccucacccccucucaacucuguguccuggguuccaccccuuaccccgucuccccauccuagggccuccggagggcacuucccuuugcuucaucuguguaagaaaagaagggagcagagcgguugggaguggaaagggagggagaauaagugcacccugaaagugucugggggcagcugugugcugagaaaguugccccacacagcuacugagccagcccauuugccaugcaucacaguuaccgggggcacggaagggaaauauugcaggcagaggggcuaaaaugaugaagugagggaggagaggcacugggaggaagggaaaugaacguaagcaccuucccauccuccugucacagugcccagguucaauacaaaugcuucaacagaacucaugccagcagccuaccacaagggugcaccuuaagcgauuuuucuagugggaagccugguuccaugcuaagcucuaaaguucuugaagaccagggaccaugcuuucaucccuucuggcucucuccucugaagagagagguccagcacagccuguggccuggaucuagcuaagugacagugaccccaccccgguggccucauucacacagugcuccuuccaacugagcuagcggcucacugcccagagucaaaccaguaacaguagcugcaguggucacuuucugacugacaggcauuuuccauauuguccucacccauccaauagcucugcagcuugcagaugaaaaaaacugauacucggaaagcaugugccuugcccagagccucauaaucaagaaguaacagaguuagaauuugaauccagauccaucugguuucaaagcugggcucauuucaccacccuagggccuggauguuccaguaacugcuggagaacuggaagcuguugguuuuagagccugaagcccaggagcacagugcccagcuccucucuuacuguugugagguccccgaucuuucuuuucugcuucuuucaccugucauucuccucucuagugucucccuccaucuucuggcuccccugggagccacagauaauugacauguugggauacacaugucauuugugcuuuugucuuuuu

SEQ ID NO: 13745 - RNA, 11581 nt, Homo sapiens
gggucaggcaucagcaagagcaaugaguucauuuuuguuuucuuuuuuugauugagguaaauaaaaaagcuuuauccagcaacacggagauaagagucuguccaacccgacaaguuccagaccccacccugcccucacaucaggcucuuccgguacugacugugcgggguggucugucugaggugggaguccggggucugcagguccaucugucuguacaggucucucagcucccugaccuccugcagcacccucuuugccuggcuccaauucgaugaugccucucccagcagccguuccgucuccagcagcagcugcucugacucagaauccggcggagaccgagggggguccuuggccuuucgcuucccaucucccagucccugaaccucugccagaagcuccugagucuccuccaguuuccuugcuaccagguccuggauccgggacagcugccccggguuggggagggcagggguuggggguuccucagcccgcagcuggagggugcgggcagaggcagcaucccgcugagauaggaucuccuccagggaggcgcagcggccuuucucugugggcgucaacuucuugggugccugggggguguagguggccccuuugucuguuuuuucccaaggucgggagagacugcuugcccggucugcggagggcuggaugcggucugaguccgcucuccgccggcucccugccagcugggccacagacuuguccaggucaacccgaaagcucucagcacaagagguugguuccucaggggaagggucuuccucuuggaucaaguccaaggucagcaucccauccgagguagagguggaagccuguggaggaaggggggaaugaguggggaaccugucaucaggagggauuuucggaaugacugccuaaaagaugcaagcuguggucauuuuccucuacaagccuuccuugaaugagaaguacuuuuuuuuagagacagagucuugcucugucacccaggcuggagugcaguggcacgaucugagcucacugcaagcuccgccucccggguucacgccauucuccugccucagccucccgaguagcugggauuacaugcgugcaccaccacgcccagcucuuuuuuuuuuguauuuuuagcagaggcaggguuucaccauguuggccauggcuggucucaaacuccugaccucaagugauacaccgucucagccucccaaaguacugggauuacaggugugagccccccugccuggcaaagcccucugcucuugacugaacccuccuacugaaugugcuguuucuuauuccuuugauagugacuugaauguuucuucuucugugauuuaguuuguuacuuguuuccuguauucuccacucuaccauaagcuuccugaggggcgcccucuuccuugguauuguggacucucagcaauuaaacugcaucugaugcacacaggaugcuccccauggcacgacuguccuccuccaucugcauccucugagucccacacuucagcccccuugccuuauaauaaaauuuguucucuuauuuccagaauacuaaaaaugaugaguauucaauaccaaauauguuguuuuagucauuccucacagcagcccuucaaggcaggcaugauuacugccucauuuuacaguuggagacaugcaacuucagggaaccacacagguagcugauuacagugagguuccaacucagguucuaacuccaaagccuguguucucugcauuauaccugccugccucucucucugaagacuuaagagcucagaggcaugaaagaaacuagcacguuguauguuucaggaguucauugugauccuuucuccuccaaacacccgcgguacuacauguuguuacccaucaagacagccaccauacaguagcuaauuuuucauuuuccuguggguauaacucauuuucuccgaaagaggguaacauuacugggagcugggacuuuugaacuccuaaugggcgcugaauaaaaccuuuugauuuagaucuggcagaggcauuggguggaaggacuucccucgccuuugaucuuggcaucaaggaggccucccgcaaaugccucugguggcauacaguucugucugagauggacugacacagaauuggcccuuuggcaauguuuauuacagucuuacauaccacagccauuagguguccccuuguuggggggcggcgggagugcuggauuuuugcccugucucgagugggaugggcaagauagcuguccuccucaacggugaccugaagagauguacugugaaucaugagugcucuucagcgacucgcugucccaacccagcaucccgaggccugaacaugugcccacuccauucacugcuucugaaugggcaaggggauuuacuggacacgaagggggcucuuuaagcugacccaaggcuggcucccccaucaugaagcggggaagaggaggugucagaugagacuuggagagaagguagaaagagaucagggcuuuuaaaagggcgguaaagaaguagagcugguggaggagcgaguaaacggggccugcacaauccucccccuucagugggccacagcuguucccucugccccagcguuccucccucuccccacagugagcccccugaccucauccaagauacgguucuuggcucgggugauggcagaguugagggcauugauccacgauuccuucucuucuggacucacugccaggaagaucagguugggugccugugaggggaagauuccuguuucagccaggguuuuagagguggugccucaccuugacaaugaagaaauaagagauuauaaucucacuuucuuagaccuagcuccaggaaggagagauauucugcuuccagagucauccauaacuuaaggaaacccagcuucuauuccugcaaaaugcauagcuaggagguuguuuuagaaaugaccaaggaggagcuaagaaggauacugaauauuaguaugguauuagagauaauuagaggaagucugaugaaggauagguauuaaaauacaaaucuuucaauguuugaagaaauagaaugugacaggaauaacuucccuggguucccucagacaagaugaauuagauucagaacuucaaccaccuaucaggguacaaggacagggauuuucuucuaagggauguaaauaugcacauguguggauguguguguauaagacagagaaaaauaaagagauauauagagagaugaucuuuguggcugaacagguuaaaggguggccugccuggaaagaaggaaauggcuacaauauucucaggugaaaugauaaaagccagcaggagagcaauucagggaaucugaaccaagauugcugagagagaaacugaggggaaggaguucuccccugcccccuccaacccuguccauguuccagcggccaagguggcaggagaaacauaccguguuaccgggcuguuuggagugggcaagaguaaacuugcuaugauuuuucuugcuccugcucuuggacuuccggagcucuucacacuucucauagucacucaggucaaauaccucuugaauauuuuucucaucuuuuaccuaggggaggguuggggugaggugaggaggauaaaauuauuuagccccuccacccagacuguuaguuuagaucaucuugggaaacagaggaagccugaggagagggaggcacgccaggagaggagagggccgucugcccaaagccuacaagguccucacaucgaggaggacgcuagggcagcuccaagucuugaauguuaagguguguuucuguuuaaaccccuucucuucacucuccuuagccaggcugccacuuccagagucccacuaugccucucuucaccaaccgccccacucuuuuccuuaaggacacagcuuacauguucuaaaaaggcucacguccuuaaagggacaugguagaugguugauccauugcccucaguaagacagaccuguauggcccuugaugguccacagaaagaagaucaaggcagggccaguuaucggggugucuggagggaacgaggggcggucucuggccuccccacucacaugugugcaguauagcucucccaccccaccucgcuuccuucucugguauguacaauuauagagacucaucuuccuuguucauuucaggagcaucgccaccacaggacggcagccccguguucaguuugcugaauuuguccagagaagcugaaaacuacaauuacaguuccuacccuuuccuccucccucuaagguacugugacaauccaaacuaacuccuccagacccccuaucucuaggcaagaaugcacuuagacucucccugggagacuacacuuuagacuuggaaaaaagugacuucugugacuucuugccauuauuccaguuugagugccugggcccccuuuacugccaggaagcucuuccuccuaucuaaacuuagcccucccugcuauagucuccgucccgcacucugguuccaccuuuagcagguuuuaagcaacauuuagcucuuagcacuccugcugaacgucucaucgaggccgcauuccuagugacauucuccaaccccaacuagccuuuucugagcacugcaaagcagcucuaggaacauuucuucgcagguucaucugaaacugaccacaauguuuucucuuuuccccuaaggugguguuccuacaacucugggacucugaagcaguggcuuauggauuuguuuuggcuugcaaggaccaaaguuacagagaggagacuuaguuacaaguccagaccgugcagucuguccacccuccguggcuugagcccaggguuggaacaccucaggaaaaaccuggucacguuuuccuggaaugagaauuaaaagcaccagcacuugucucauuaaaacuaaacaaacagauaaaaguagccucacgucuuccuuggaugacaucuacccacccugacugaaauuauuuuccaaaacaguccccaacuucccaaguucugaaauaggacucgugugcauggaggugaacucaucuauccuccugguuccuggaaaccuggaaguggggaagugguucucccuuccauuacccagaccaucuacagucuuguaucugcccauccuucugaacugcugcuggaccuggaggcugaugacagaugaggacagaugucaacauggccccauucaggugagugacgccucauacaucuaccuccauuuguuucagcaaggcuuggcuccuccagggccucccacuuuccaggguucccuggcuuugggcuggaaaguggccagaggccuugaaugauuacggguggaaguaggacaaggugcuggcaagggguguccaagagcaauucccagaaacacgggacagggauacaagaugaugcaucaucccuccucucccccuccuucuccagagcugagacuaucagcagagcccagaaaccguggagaggaaaguguugggugugugaauguagccaggggaagagaguuaacuuacuauguuuuccuuaggggaagggaaggaaagggaguuauucuaccuugcauacagacugauuaggagcucuggggagcaggagacacugauagagguuagcccuugguggagagggugggagauggggugaggcaagcaguaggacaaguauauuccagugccugggaagauggacaaagccaagcagccuuguucuccaccauauuguuuuuuuuuuuccccacauaucuaauucccagagucucauuuauaacuacccaucuuccaaauuaacccuuccuuuccccugauucuucguccuugacuauagaaagggauuuuucccacgccuguccaaagaguugcccugaauccaauuuccuccaccaugaggucuuccuaaggucuagcuucuguucuuacacaucagccugugaucauaaggugcuccagcccucuuugagagaggaugcccuuugagaaggaagaaaaugauuacuaucgaacacagaagaaauucuacggcagaggugguugugggagacccugccuuuaagagaggaaauaacaaaagagacuggugaaaauucugggagauaggguuagaaauuuucuugcauuaacaguaaaugauauagauuauacucugccuuaaaaaaaaaaaaucuuggucagggacuguggcucacgccuauaaucccagaauuucaggagguugaggcaggaggaucacuugaagccaggaauuugagaccagccugggaaacauagugagaccccaugucuacaaaaaauaaaaaaaauuagcugggugugguggugcaugccuguagucccagcuacuccggaggcugaggugggaggauugcuuaagcccgggaggucaaggcagcagugagcuacgauugugacacugcacuccagcgugggcgacagagugagacccugucucuaaaaaacaaaacaaaacagaacaccgugucuugauucuauuggcccuggagcuuuucacaagugggcaaaauaaagcccagaguacucugucaauuucacuuuuuaaccaggcccacuguagcauugaaacuggcucuaaaaaagcauaguaucaauaugccuagucccucuuuccugugcccuucccagcaggagacagcuggcuccaugaccagucagaugguccugacucauaggacaccagauauccuaggcugaggucauuccauccuuuccucugucucuguaccuaaaagcaaggaucaacuacgcuuuugcccccagacucugcucuuugggcaaauacaaacaagcaauggaugucuuauuccucuuacccuuucacuauuauguuuuucucuuugauguguaggaaguucucccugauucguaacuagaguuuccugcaauuaagaaguucggggaagacaggagauacacuuugacacuuguuuuuuuuuuuuuuuuuuuuuuuuuuuuaauuagaaagccagaaaauuguggagaaaacuuucuggaggauuugugauugggcagagguaacucuuaaaaauaaauccuccuggccaggcacgguggcucacaccuguaaucccagcacuuugggaggcugaggcgggugguucacuugaggccaggaguuuugagagcagccuggucaacaacgcgaaacacugucucuacaaaaaauacaaaaacuagccagacaugguggcacccaccuguagucccagcuacuccaaggaugaggugggaggaucacuugagccugggagguggaagcugaagugagcugugauugagccacugcauuccugccuggaugacagaccaagaaaagugcccucaccucacuccuaagacuuuccaucaccaacuugcuaguuuuguguaaacagcuagguuucaauacccuuaagagggaucucuuuggcuguggcacagcuuaguucuucccuagaugccucaguagauguucuuuuagaugaguacuuugucucaggguguguguguguauguuucaauaccauaaaagguuuuauuuaccuaaauauaaucuacugaauaaggaugucuacugcagaaagcagaagagguuagaacucagggaggacuucccaguuagcccugggugagggaacacagaauaccucccgugagggcgggaggaagggccacucuaaccgguacacaggacagucuuccaggcuauacugacugccuuuggacagucacagaggcagggaauggaaugacuucuaaccacuguaggggcaauucugauuucuccacauuaguacacguuauugaucccaagacuuagggaaaaaagggagaugggucuggauucaauuaucauagcucaggucuugacacaguguagacugugguuuucaugguuaacuacacagccaaagcuauccaaagacauacagggguucuuaacuccauuucucucccuucugauacaaauggaggggugggcaggaaguggguagaaaauggguuccuugccuuuuuuaaaugggguggggguggggaacagagagcauacugguuagggacacuggcuucaacgaaaauaacugccacucacacacccgaggucacaggggccugacggcggggugcguguuuucugugauucagggcggaugcgccacggacaggaccugugcacgcuccugccacagacaggaaaggggaggcuggcuggguuaagguggggggacaggaagggguggcgaauaggcuaaacuguuucagcagaaauagaaaagaaauccuauaugcaggaggccagguuagggugggaggcagcaagggacacuuagaacuucuggggcaucuugggaggggcuuaucguuguuagaaagguauuugcaaacaaaaaaacacugaguaagcggccaacucaacuucuaauucucacucuggucuucucauuaaaggguggccuuucucugcagaugagauggggguagagaggagaccacugaacuugccuuuggaacaaaacggggguggaguaagcuaggcgagcccuuggggagugacaaagugggggcuaugagaaaacggagaguuagaggcaagaggcacccaccuccuucucagagauguagagcugguccccuuucagcaccacauagcgguuuuuccaaaucucccugaaaaucccuuucccgcagaauuuccggacccagccgaccuucucgggcggugcaggcugcugguuuccauccugaggucccugccccaggacaagaugagaagcgggcgguuaggagauuccagccggcgcuuccucuccguccgucucucacgaccgccucggcggcccagucuccuccgaaggcugcggccggggggcggggggccgccccagguucgcucccacuucggaaagguuuucacuccgaggaacuccccccgcuccccucccccgcucccgaauaaacaaccggggcugcaaguggcaggggcgccggccgggcgcggagaggcucccagguucccuccaggcccugcgcccccgccgccccguccucgccgcgcggggacuaacggcguuucucugguuuucucucccauugucuccucgccacggcggagcgcgaggcaaacgcucgcccggcgcccgggggcgggggaggugcgggucguggggaaacucagccaaguugaagccccccgaggcgaguaaacaaacaaaagcccccgcgggcgccuggcggggccgaggccgaggggaccgggccgccggggcgggggcgcggccgggccgugggucucccaggccgccgcggcgccgacggagcgggggucgucagagcgcggaggcggcggcggccgcagggcaggcaagcgcacucacccgcuuggcggaauuguucuucuucaucauucccagcgggcgcgggcgcggggcggcgagccgaggggcggccccgcgucggggccucggcggcaccgcgggggcuccuuccccgcgggagggcgucggagcugccccggcgccgccgcuccucccucgcgcccucccgcucccggacucuccccuucuuuguagcuccgguuucacucaaggccggccucccucgcauucgcacucgcacacacacgcacgcccgcuccccgccccuuggcgcccuccaucccggcgcccacgcggcccggguccccgagcgcacccccgccacccgcccgcccggcccagcgcggccgcucccccggcccggugcgcugugggcggcccaguccgcaccccgcagcuccauccgcgggccgcugacguugcgaguucagaauaaagggcgaaucgcggagccgcagcucgggcgcuccccccgcccccccgccuuuguuucugacucacggagggggaagaaggcggcuucgaagcggcuggagaccgcuccccagggggcagggacccucgcuccggcggcggcucgggcgacacgcggagcccgagagacccggccgccggccgccccggggcccagugggcgggcgcgguggauaauggagagacgugcggauucgugaagacuggagaucgccagccucuacagcaucgccuuacccgaccaaaaacaaaaacgagagcgggaaccgggagggcgcgccacccacaacccgcaucaggaauucacgcuccuaggugcuaggguggccugggcaggucagaugcugggggaaaguuuuaugcuccggaggggaucgacguguugggggauggggugggacagaaguugcuauuaauacacguuucuuccagcguacaaugccucaggccuuauuguagcuucaggagaauaauccuaaggaugaggcggauuuuaugaucuccaucucacagggagaaaacggagacucagaauagcugagggauuugcagacacagugucgaugcuggcuuuucagacacagugucaaugcuggcaggaauagaacucugucuccaaaccauuauccuuucuaccaaguggcuuucaauauaaguuccaggugaggcuuaaacuuccugccaccuggguaucuuuucccgcuauacugauagguaaaaaccccacccucucuacagcgcuggagcccaguggagggaagggcugaacgcccagagaaugcccugacuagagaagccucugcugaucccuccuacagcagaucugccucagagccuccaggacacaucuuaguaacuucaugucuuuuuaauauauauacgugugauggaaaaggggagugagaaaccccgcgcuuggguacugguuucaucaccacucugggcuuuggucaagucacugaauuucuuuaggcccgcgucccuccacguauuaaguggugagggaugaacugccauuuuuaucaacaaggaaagcuaggggaagauaugagaugaccucugagaguccuuugaagauauguguugucuuccagggcuaauuuugaaaucauaauaagcuaauaaacacauugccuggcauauggcaagcaugcaguaaccacaaaaugaauaaaaaucccuggcacugaggagcagggaaaaggaaaaaucauuuuuccagagaugucucaagauaaaaguguuggcuagauuugugguuugaauaguggaggcucuuuugacuuuuucuggugucugucaaaugaaggaggggcucccucucuuuuccaguuccaccuuuccuccuaauccaaugauauuccucucaacuucuuuccauucaccauaccaauuaauuccacgauuuuagacugacacagaacuuuauccuuucaaaaugcucuuauaugucauuucuuuacacuuuuaaugccaccuuguaagguauauagaguauuaauauuuccauuuggaaaaugaggaaacagggcaugccagauaaacugacuugcccaaguuuauacaucaaguuacuggcuaaauggauuagaauccaggcuuccugacugcagucuccucuucagauuuuguaacccccucccaugggcaugagugugcacacaccacguuccccaaaccaucuuguccccuuuccaccgucucuauuuucuaacccccuguuuaaagagcg

SEQ ID NO: 13746 - RNA, 2314 nt, Homo sapiens
caggaaagcuggagcgccuacccaaaguuggaggaaauucaggguccugaagucuuugcucuccccaucugcaugcaggcugcuaccaugagguugaaucagaacaccuugcugcuggggaagaaggugguccuuguacccuacaccucggagcaugugcccagguaucuuucccgcuugacauggggugcguaucagcacccagagcuguguaagguacagccccagucucagggcuauuuccccuaagaagaaacauugguugugagaaauaauuauauaugaggggggaaaaaaggcugggugccguggcucacgccuguaauuccaggacuuugggaggcuguggcaggaggauugcuugagcccagcaguucgagaccagcuuggguaacguagcgagaccuugucucuacaaaaaaauacaaaaauuagccaggcaugguggugcacagcugcagucccagcuacuagggaggcugaggugggaggauugccugagcccaggagaugaagacugcugugagcugugauuguaccacuguacuccagccugggugacagagcaagaaccugucucaaaaaaaaacaaaaaaaacaaaaaaacaaaaacaaacaaaaacaaaaaaacggccgggugcgguggcucacgccuguaaucccagcacuuugggaggcugaggcggguggaucaugaggucaguaguucaagaccagccuggccaacaugauaaaacgccaucucuacuaaaaacacaaaaaauuagcugggcuuguugcccggcaccuguaauuccagcuacuugggaggcugaggcaggagaaucacuugaaccagggagguggagguuguggugagccgagaucacaccacuguacuccagccugggcaacagagugagacuuugucucaaaaauaaaauaaaauaaaauaaaggcugggcgcaguggcucacgccuguaaucccagcacuuugggagaccgaggcaggcggaucacaagcucaggagagcgagaccauccuggcuaacauggugaaaccccgucucuacuaaaaauacaaaaaaauuagccggaugugguggcgggcgccuguagucccagcuacucgggaggcugaggcaggagaaugugugaacccgggaggcggagcuuacagugagccgagaucgcgccacugcacuccagccugggugacagaucgagacuccgucucaaaaaaaaaaaaaaaaagagaccagccugaucaacguggagaaaccccgucucuaauaaaaauacaaaaaaaauagcugggcaugguggcacaugccuguaauuccagccugggcaacaagaguaaaacucugucucaaaaaaaaaaaaaaaaaaaauagcagaaccuggggacugugacuuccuugggaggagcugcccauccucuucccuuucauucucucagcuuuuuggccuuucagcaaggaauugcuuuauguaaacuaaacguggaagaaaaagaaauugucuucucaccuaauuguaaauuagugauguuucccuggugccagugaguauguucaguucuuggagacuuaauguuagcuuguccuugaacucugagcugaugaguugugauaucuaccauucaaaaggccaggacugagucaugaugggauuccugugggggcaguuggcacaugucugguagauugggauaguggugcuguagauggguauucucuacuuguaguuuuccguuugaggguuccuggugcccuaacuucgugggaucuguccagccgccuuuguugagguuggcuugccauauacauccccuucuggaauuugaagaauguuugguuucagacugcuccuccgcacugacccgagacaggauaggaaauuggacagauagaacugacucguccugcuguucuuguguaagacuagcuugcuucugggucuugugucuguggccccugccuuaggagcaaucauaacccuuugggucuucuuugagcccuauguuagcccugucugguucuggacccucauaaggugucagacguaugccucugaaugaguccuccaugucuaaagccaccccucugucccagcagguaccacgaguggaugaaaucagaggagcugcagcguuugacagccucggagccgcugacccuggagcaggaguaugccaugcagugcagcuggcaggaagaugcagacagugaggagugcccccccacuuccccuagcccugguacugggagggcugacuccacagucagucuccagguuccuucccuuucccagccccggccauagaagcuu

SEQ ID NO: 13747 - RNA, 2314 nt, Homo sapiens
aagcuucuauggccggggcugggaaagggaaggaaccuggagacugacuguggagucagcccucccaguaccagggcuaggggaagugggggggcacuccucacugucugcaucuuccugccagcugcacugcauggcauacuccugcuccagggucagcggcuccgaggcugucaaacgcugcagcuccucugauuucauccacucgugguaccugcugggacagagggguggcuuuagacauggaggacucauucagaggcauacgucugacaccuuaugaggguccagaaccagacagggcuaacauagggcucaaagaagacccaaaggguuaugauugcuccuaaggcaggggccacagacacaagacccagaagcaagcuagucuuacacaagaacagcaggacgagucaguucuaucuguccaauuuccuauccugucucgggucagugcggaggagcagucugaaaccaaacauucuucaaauuccagaaggggauguauauggcaagccaaccucaacaaaggcggcuggacagaucccacgaaguuagggcaccaggaacccucaaacggaaaacuacaaguagagaauacccaucuacagcaccacuaucccaaucuaccagacaugugccaacugcccccacaggaaucccaucaugacucaguccuggccuuuugaaugguagauaucacaacucaucagcucagaguucaaggacaagcuaacauuaagucuccaagaacugaacauacucacuggcaccagggaaacaucacuaauuuacaauuaggugagaagacaauuucuuuuucuuccacguuuaguuuacauaaagcaauuccuugcugaaaggccaaaaagcugagagaaugaaagggaagaggaugggcagcuccucccaaggaagucacaguccccagguucugcuauuuuuuuuuuuuuuuuuuuugagacagaguuuuacucuuguugcccaggcuggaauuacaggcaugugccaccaugcccagcuauuuuuuuuguauuuuuauuagagacgggguuucuccacguugaucaggcuggucucuuuuuuuuuuuuuuuuugagacggagucucgaucugucacccaggcuggagugcaguggcgcgaucucggcucacuguaagcuccgccucccggguucacacauucuccugccucagccucccgaguagcugggacuacaggcgcccgccaccacauccggcuaauuuuuuuguauuuuuaguagagacgggguuucaccauguuagccaggauggucucgcucuccugagcuugugauccgccugccucggucucccaaagugcugggauuacaggcgugagccacugcgcccagccuuuauuuuauuuuauuuuauuuuugagacaaagucucacucuguugcccaggcuggaguacaguggugugaucucggcucaccacaaccuccaccucccugguucaagugauucuccugccucagccucccaaguagcuggaauuacaggugccgggcaacaagcccagcuaauuuuuuguguuuuuaguagagauggcguuuuaucauguuggccaggcuggucuugaacuacugaccucaugauccacccgccucagccucccaaagugcugggauuacaggcgugagccaccgcacccggccguuuuuuuguuuuuguuuguuuuuguuuuuuuguuuuuuuuguuuuuuuuugagacagguucuugcucugucacccaggcuggaguacagugguacaaucacagcucacagcagucuucaucuccugggcucaggcaauccucccaccucagccucccuaguagcugggacugcagcugugcaccaccaugccuggcuaauuuuuguauuuuuuuguagagacaaggucucgcuacguuacccaagcuggucucgaacugcugggcucaagcaauccuccugccacagccucccaaaguccuggaauuacaggcgugagccacggcacccagccuuuuuuccccccucauauauaauuauuucucacaaccaauguuucuucuuaggggaaauagcccugagacuggggcuguaccuuacacagcucugggugcugauacgcaccccaugucaagcgggaaagauaccugggcacaugcuccgagguguaggguacaaggaccaccuucuuccccagcagcaagguguucugauucaaccucaugguagcagccugcaugcagauggggagagcaaagacuucaggacccugaauuuccuccaacuuuggguaggcgcuccagcuuuccug

SEQ ID NO: 13748 - RNA, 6375 nt, Homo sapiens
cuagauguauaauauuuucaguuuuuuuuuaaauuaguaacuauuaauagaguagcacaaauuaauugggugcuuguucuggaccagauacugugcuacuacugugcuagguccuuuguuuuuuuagacauggggucucacugcuguugccgaggcugaagugcaguggcacagucacagcucaccacagccucgaacuucuggccucaagcaauccucuugccucagccuccugagucgcugggauuacaggcaugagcaccgcaauuuacagaaauugucacuuucaugauuuccaacaaaacaacgagcaaguuacucguuguuuuacaaaugggaaaaguuaaaccuguugagauuugcuuccugaagucaugcaccuguuuacauggacaaggcuaggaaucaaacuuggguuugucuaacuccagaguccuuccuaguaauuaaccuccggugcucugaacugccaugcaaaagaaugugaacuucauucugaagggaaugggaaggucguggaaaauuuuuaagcaugaaagugacaggcucaaaacagcaacaccaaccaaccaaccaaccaacaaaaaacccucaguuuuuaaaagauagcucuuggccgggcgcgguggcucacgccuguaaucccaacgcuuugggaggccgaggcgggcggaucacaaaauacaaaaaauacaaaacuacaaaaaauuagccggacgugguggugggcgccuauagucccagcuauuccggaggcugaggcaggagaaucgcaugggcccgguaggccaagguugcagugagccgagcucgugccacugcacuccagccugggcgacagagcgagacuccgucucauaaaaaaaaaaaaaaaaaaaaagauagcugucauacggaguggaagcucaauggcagggcagaaagaccagccugacuauguaaucuacuagaccagagcuggcgaggacuucaguuaaggcauggucauggguggacggagaaaaggugauacaauugaaagucagaagacagauuuaguaauauuuggaacucaugagauuuggacagaggacaagaggaagggacacccaaccagaacagauggggcuaaugaaggugucuuccaggaagauggggaauguggaaagaaacaaaugggcuuggaaagcaagaugaggcaugugguuuuggaaauaagcuggguuugaagugccuaguauccauccagaaggaccugucuaccaggcaguuagaaacauugguguagccaggcacaguggcucacgucuauaaucccagcacuuugggaggccaaggugggaggagggcuugagcccaggacuucaagaccagccugggcgaugaagugagacccugacucuacaaaaaauaaaaaaaauuagcugggccugguggugugugcccguagucccagcuacucagauggcugaggugggaggaccccugaacccaggaguccaagguugcagugagcuuugauugugcuacugcacuccagccuggacgagugagacccuguuucucuuucucucucuaucucccucucucucucucucucucucucacacacacacacacacacacacacacacacacacaaaauguguagagcucaggauagggucucagcagaagauagcaauuugggagcgcuuagcuaagggacagaaauagugaaagcaggcaaucaaucucacuugaguugcagggagaaaagaagauggccaaggccagcaugggggaaaccaggaauauugauggggaagagaaagacaugagaagacugagauggggaccuagagaaggauaagggugaccaggagaguggacccaggggacaaguccucuucuaaggaagaaaaaucaguguaaacguggccaugucucuuaccacguaguuucccucuaaacacacacacacacacacacacacacacacacacacacacacaccugucccccacuagccuaaggcagaauuaaaugugaacaaagcacguuuuucacuucauaaaagccacagauucagaguggacuuacuggcaaccaagguagccacguagaagcugguuauuagaggaagagguggguuuucuucgagacagggucucacucccugucacccacacuggagugcaguggcacaaucucagcucacagcagccuccgccucccggacuuaagcgauucucccaccucagccucccgaguagcugggaccacaggcaaauggcaccacccccggcuaauuuuuucauuuuucuuucugucuuuuuuuuuuuuuuugguagagacacagggucucgcuauguuucccaagcuggucuggaacuuugacuucaagcaauccgcccgacuuggccucccaaagugcugggauuaacagcugugagccacaaugccuagucagaggaagaguauuucuuuacccuauccuuaauuauccuuuaacucucaccugaggguagacaaugauuuaaguacagggaaugauuaaauguuaaaacuuaacauuuuagaauguuaucuuguauugaugaauucagcuuaugcuggucucgcaaacaaauacgaagacugacagauuccugugagugcaggccuucacagugccaggaccacaagauguaaugaauucuauuccugacuggauauaaaaaaugccacgaaauuuuccuuuugagauucagccagggagaccuccuggaguuuagagguacccagacuggugaguaaaaggagugugaccuugugggggcagucagaggaccuagaugucugacaccaacauccccagguuccagucucugcucaguuacuacugggccugagaagcugggugcagagauagugacccacccaccucugaaagucacuacuuuuugaagucagaauaccgcccauacauugugggccuaagcagguuacgagggucucggcagagacccagaggcaugcucuagaaauugcugugacccuggagcagaaacauguggcaguccccagcagagcucaccuacgcugcucuccucgcuuaacacgccucaggaaaggcaaaauggcagcuuuacaaaacgaaguuuuauuccauuuccccuucuccccucuuaauucucauagaucgcugcagugaaugcuuuuaaccugucaacugugaugaaacaaacagaaaaccgaagcccuggcuucuucugaggugcaaauaaaugaccgagaagguguuaucuaagaccucuacagccauuuguaucuggccguguguagagugggcucugcaagacccugccucacuuucccacuaagaggccuuggacuucccagcucccagagacuguagagaucaccucuguggccuccugucacgauuuccuaaggcgaagagcuucauuugcccaacggaggcccacguucuuccugucugaucuacugucuucccaaggaucugaacucgggcaccagcgucugcccacauguccgacgaaaacaacguaaaggaacuacugagucuggacagaaaauccagacauaccaugcagcuucuaagaggaccgagugccuucacuggaauagugaaucuccuucuguggacauggacagggaacggcucgauaaagcccagauucacaaaauuccgcccacaccccgugcccccgggaauuuuggcuuaggggcaggauauggggguuaccacugugcuaguggagguggcgcggggacugaacggcagccccagcgcaguucuccccacguuuguccgcagaaccccggcgaggccgagguggucauuucccucccuagccggauggccgcgccgggugaggccgguuugggcgcgaagcacgggcguguggcgcuccacuuccgcaaaggccagccgcgcucaggaccgcgagcccugagcgucccccuagugaccccuggccucgugcccgacgccccgucucuccugccccggcccccccgccacgcagggccccggucacgcgcggggggagccggaccgccaaagcccgcgagccggcgcccaggaaagcguccgcagcccggccagugcggauaggccaauuggccgaagucggcaaagcucaagacggcaccgcagcagggggacccgaccccguuuuguugggagccuaagcggaagugccuuccccgcucuaaugccggaggagcacggagggcaagcgguacagcuucuuccaagugcugauguggguggcucugaaaagagccuuuuggauacgauggaaccuccggccgaaccgccacuucuuaagcccgcucuccacggaugcggcgggccagcuggauguccuugggcauaauggucacgcgcuuggcguggauggcgcacagguucgugucuucgaacagccccaccagguaggccucgcuggccuccugcagcgccaucacggccgagcucuggaagcgcagguccgucuuaaaguccugcgcgaucucgcguaccagccgcuggaagggcagcuugcggaucagcagcuccguggacuucugguagcgccggaucucccgcagggcuacggugccgggccgguagcggugcggcuucuucaccccgcccguggccggcgcgcucuugcgggccgccuugguggccagcugcuuccucggggccuugccgccggucgacuugcgagcagucugcuuaguacgggccauagcgaaccaaaacacaggcuuaccagcgcagcggcggggagaaaaacgagcuccuagccccgccgcagccgucuuuauaagcacagucuuuucccgauugggcggaacaauaauugaaaaucccgcgcuggcuguccauuggcugugacgucacccguccuaaagucaccgguuggcuugggcagauuccucccuaaucccgcccaccccgccucacuuucuacuuaccaguuggcgaaguuucgcaagcuuguuuuuccccuuuccuucagggugaaagucauuuuccauugcagcuuugucagauuguucccuuuccgcccuucgcuuccuuagaacacacugcccgcaauacccccccuuucuugcugcgcccuacagcucccgcguggaaccucauucuuccauuugccccccgcccccaguugcuacuuggcggaucguuuuucgccugucgggugccuuuugggugggagaggugcccgcccccaggacgcaagauuccgccuccgaggcccuuacucuccgccgccagggcgcuuuggaaaacaaaacagaaacuaagacuuaagucagcucagugaagccaagacccagcuccgccacacuagcgagcacuacccgcucagggcccuccccaucggggguggggacgaggagcacgucccgcuggugccagacuaggucuaaguguccggccauagccugcggaaaccacuagggaagcgcgcgcuccgcgcgcaacacuucagcgcguuggguacugcccgcggcgcugguguuugugacuguguggagcggaccguggcggcgcccaggacguuuggugccugcaccugcccugggaaguccuaggacuggggacccacucaucgaagagccaaggcaguuacgugcuccagauggaagacggcgcgcacacacacacaccccgccccgccccgccccgucccgucccgucccgucccgucccgucagcuccagguucgcuauucacuacugaggaacgcuggacugagaguggccagcauuaacaacucuuuuauuugaaaacguggguggcucugaaaagagccuuuugaguucacaggugccccuucgagacgcgggccgggcugggcccacuugggccggacgucagccucacuugcccuuugccuuguggugacucuccgucuucuuagggagcaguacggccuggauguuaggcaagacgccgcccugggcgauggugacuuugcccagcagcuuguucaguuccucgucguugcggauggccagcuggaggugacgagggaugaugcgcgucuucuuguugucccgagccgcguugcccgccagcuccaggaucucggcggucagauacucgaggaccgcagccauguagacgggcgcgccggcccccacucgcuccgcguaguugccuuugcgcagcaagcgaugcacucgcccuaccgggaacugaaggccagcgcgggacgagcgcgacuuggccuuggcgcgggccuugccuccuugcuugccacgaccagacaugacagcgauaguagucaccgagagaaacuccugccuggcgaucgggaaagucgccgaaaacgccgcugcuucaccuuuuuauagacagaacggcgauuguccacggagcacuuugauuggcucaagcaaauuuug

SEQ ID NO: 13749 - RNA, 4261 nt, Homo sapiens
ugguucccugaccucagugagacagcagccggccuggggaccugggggagacacggaggacccccuggcuggagcugacccacagaguagggaaucauggcuggagaauuggauagcagaguaauguuugaccucuggaaacaguaagucaaaaugaaauugcaauuccuuuaauaagcuuuuauauugaaguuagacuuuuauaaaauuacaaacaccuacuuggaugucucucguccaaaugcugggaucucucccuaccaaggugccccaaucuccauuucucuuucugucuuauuucuuucuggccucuggccucuagcuuuuugaaguuuaauucucugucucuccucuggcagucuuagcccucucuuuaccuuauuaccucaagacuccugaugaaguuuuagaaggaguucccuacguccucuauucuguaguuuucuuaccaaggccaaauaugaccucagaugaugagucacugauacccuucuauccugcccccacuuagcaaugcccuucacauugagauuccaagcaugggggcugcucccuguaaaugauuucuccccacaacucuagucccuccauucuauucucccucuugcaggacucuucccccaaucauauccuuacccauaagauaggggaguuaggcaggagggauuuagccccucuccaacuccugucaucauaaaagacugagaacuucagaauuugaaaagaagagauuaauggaaggagugauauuugggaaaauacaagaacuguugacuuagaaaaaacaaauauugauuugcauguuugguuugcaucccauuauuccaugagagagggagauuaaaauugcagcucucuagagcugaugaaaagagauugguuuccuuuucauuugaauacugauauucuagacgggauggguaugccacccuuaauccuucuuguguucugacacaaaggaggaaaagaaauguaugacuccuagagggcaucuccuccuaauggagagggacaaauaagaaguauguuucugaaauauuuucagguccuaauuuuacuaggguacccacuaggauuacugguaucugaucuagccccaugauuccuccaucuuugacauaccugcuguuugguagcucagaauggagcaauacaguggacucugcccccuugaguucacucaaccuucccuccacccccaccuagggguauugcacaagggcccuaaaaguggccacaggaacagggcaaagaggcuuaacugccacacuuauaguuugaggaacuccaaucuccccaaauuccagucuguucauccuuuucuugaucuccccagauucacuccacauuauccuuaccaaucuucaauucuucucucucuccauguccagccaaauuucuuuuuucagucacuuacagggcuuccggucaaaauucacuagguaggagggucaucagcugggaagaaccggcgccugggaaaccuggcuggauagguaugggggagccaggccaguccccuagucccagguccucccauggcagucccccaacucuaagcacucucacucuccugcugcuccucuguggacaugguaaggaagggccagggaaggguuuggggaaaucuagaggguaggcugcuauguaggggugggcaugugagccugaaugagugaggagagauaggcgcugagagucccgaucacucgcccugcucucaaauacuaauauuuuauuucccguucagucuggggaaggccacuggggaagcccuuggucgacaggcagaagagauguggcaggcuuacacacuuuuaguaagacagccgagagaacuagggacuaggggguugggggcuggggaaggcccuuaguuagguuuuaggaaggcuggaaaccccugaugagauuuggaagaguuaugagcaaacuacacuccgauagagcagaggucugaggaccgucucacaauccucucccuucugucuuuagcucauucucaaugcaagauccuccgcugcaaugcugaguacguaucguccacucugagccuuagagguggggguucaucaggagcacuucgaggaggaggaggaggaggccgggguggaggggugggcucuggcggccucugucgagcccuccgcuccuaugcgcucugcacucggcgcaccgcccgcaccugccgcggggaccucgccuuccauucggcgguacauggcaucgaagaccugaugauccagcacaacugcucccgccagggcccuacagccccucccccgccccggggccccgcccuuccaggcgcgggcuccggccucccugccccggacccuugugacuaugaaggccgguuuucccggcugcauggucgucccccgggguucuugcauugcgcuuccuucggggacccccaugugcgcagcuuccaccaucacuuucacacaugccguguccaaggagcuuggccucuacuggauaaugacuuccucuuuguccaagccaccagcucccccauggcguugggggccaacgcuaccgccacccggaaggucaggcacucaaucuuccuuccgauccaccucaugagauucuuccacgggcaccauuccuccccauccccacuauucaacagcaaugcucccuaauucccuuuucuuccucaaccucucccccaucucgaaucacucccuucuaccaaacaccuggagcuguaaaucacuuccccuugaugggaauuugacucaaaugcagaaaaccuugaagagacagucggagagggcggaccugaggaguuucagaagggaaacuuuucccucuccuaggaaguugccacgauuaaguagagaggggguuaaguagggaugagguaauacuggaacauaaauaggagaagggaucaaggauugagggccauaguaguccugcaucucuacuuggaucagaucucuaacuauguaugaggucugauuggggggaagaugcacugaacccaaaaugaacuguuuucccucuuguccucacagcucaccaucauauuuaagaacaugcaggaaugcauugaucagaagguguaucaggcugagguggauaaucuuccuguagccuuugaagaugguucuaucaauggaggugaccgaccugggggauccaguuugucgauucaaacugcuaacccugggaaccauguggagauccaagcugccuacauuggcacaacuauaaucauucggcagacagcugggcagcucuccuucuccaucaagguagcagaggauguggccauggccuucucagcugaacaggaccugcagcucuguguuggggggugcccuccaagucagcgacucucucgaucagagcgcaaucgucggggagcuauaaccauugauacugccagacggcugugcaaggaagggcuuccaguggaagaugcuuacuuccauuccugugucuuugauguuuuaauuucuggugaucccaacuuuaccguggcagcucaggcagcacuggaggaugcccgagccuuccugccagacuuagagaagcugcaucucuuccccucagaugcugggguuccucuuuccucagcaacccucuuagcuccacuccuuucugggcucuuuguucuguggcuuugcauucaguaaggggaccaucagucccauuacuaguuuggaaaugauuuggagauacagauuggcauagaagaauguaaagaaucauuaaaggaagcagggccuaggagacacgugaaacaaugacauuauccagagucagaugaggcugcaguccaggguugaaauuaucacagaauaaggauucugggcaagguuacugcauuccggaucucuguggggcucuucaccaauuuuuccagccucauuuauaguaaacaaauuguucuaauccauuuacugcagauuucacccuuauaaguuuagaggucaugaagguuuuaaugaucaguaaagauuuaaggguugagauuuuuaagaggcaagagcugaaagcagaagacaugaucauuagccauaagaaacucaaaggaggaagacauaauuagggaaagaagucuauuugaugaauauguguguguaagguauguucugcuuucuugauucaaaaaugaagcaggcauugucuagcucuuaggugaagggagucucugcuuuugaagaauggcacagguaggacagaaguaucaucccuacccccuaacuaaucuguuauuaaagcuacaaauucuucacaccau

SEQ ID NO: 13750 - RNA, 4158 nt, Homo sapiens
ugaaacuaaccccucuuuuucuccaaaggagugcuuguggagaucggaucuuuucuccagcaauugggggaaagaaggcuuuuucucugacuucgcuuaguguaaccagcggcguauauuuuuuaggcgccuuuucgaaaaccuaguaguuaauauucauuuguuuaaaucuuauuuuauuuuuaagcucaaacugcuuaagaauaccuuaauuccuuaaagugaaauaauuuuuugcaaagggguuuccucgauuuggagcuuuuuuuuucuuccaccgucauuucuaacucuuaaaaccaacucaguuccaucauggugauguucaagaagaucaagucuuuugagguggucuuuaacgacccugaaaagguguacggcaguggcgagaagguggcuggccgggugauaguggaggugugugaaguuacucgugucaaagccguuaggauccuggcuugcggaguggcuaaagugcuuuggaugcagggaucccagcagugcaaacagacuucggaguaccugcgcuaugaagacacgcuucuucuggaagaccagccaacagguaagcggcccaauucauuguuggagggugaaagcugauuagagaagagaauugaauacacaaaaccuguacgaaauguuuuaaguugcucaguuugagugguuugaauuacguguuguugcuuccuuuuuucuguuuuaauuugcagacauucuccuccccccccaaaaaaaagggugauuuguacaauuuuuuauggugcuguguccuaaaggggauccugaggggcguugccucggguaguuaaagucuuaugugugcauaaguugcuuauucuuugucuacuuccuauuugagauguuaguagagaacuguccugggugaaucuuucaguauugcagggcuuggcaacuugcugcccgacaaaauacaucagaauuucucuuuaagaacaauaugggauggauuaaaaaauauauauaugggaugaaauuggggguacuucaauaccuugcaugccacccaagcauuccuuaucacacagaugcauuuuaaguguaacagcaagccuaauggcuacucgauuuucuuucccuucaggugagaaugagauggugaucaugagaccuggaaacaaauaugaguacaaguucggcuuugagcuuccucagggguaaauaucagcuaaaugcaucuuugaacuuuucugucuaaaauaucuugcccuccuuugaucacuuacuguucuuggagagcguuuuaaaauuuucauuuucuugacacaggccucugggaacauccuucaaaggaaaauauggguguguagacuacugggugaaggcuuuucuugaccgcccgagccagccaacucaagagacaaagaaaaacuuugaaguaguggaucugguggaugucaauaccccugauuuaauggugagauccauuuuaaagauucuauucuccugggucaugaggaugauaaaucagacgucuugggcauuagauugaagcaucucaaaacaccuuuuuauccccuucuauauaggcaccugugucugcuaaaaaagaaaagaaaguuuccugcauguucauuccugaugggcgggugucugucucugcucgaauugacagaaaaggauucugugaagguaaaauccuagugcuuauggcaguuaaaacaggaacuggguuuaggggcaagggcaugggacugggguagaggaagugucauuaacuauacugaguaucaguaaguuuucaucuuucucauugcuaggugaugagauuuccauccaugcugacuuugagaauacauguucccgaauugugguccccaaagcugccauuguggcccgccacacuuaccuugccaauggccagaccaaggugcugacucagaaguugucaucagucagaggcaaucauauuaucucagggacaugcgcaucauggcguggcaagagccuucggguucagaagaucaggccuucuauccugggcugcaacauccuucgaguugaauauuccuuacugguggguagaugcaggguggcuucagcagagaaauuguucaucuguuaccacagcugucuuguuucuccagaccucugguguaauaaacugccaucuuccuuucuagaucuauguuagcguuccuggauccaagaaggucauccuugaccugccccugguaauuggcagcagaucaggucuaagcagcagaacauccagcauggccagccgaaccagcucugagaugaguuggguagaucugaacaucccugauaccccagaaggugagccagaccuaaugucuuuucuuuguuucuggucuaccuggguuuguaaaauugugaugguccagcauuucuugggcaggauucuuauguggccauauuuucuuuucuagcuccucccugcuauauggaugucauuccugaagaucaccgauuggagagcccaaccacuccucugcuagaugacauggauggcucucaagacagcccuaucuuuauguaugccccugaguucaaguucaugccaccaccgacuuauacugaggugaggauugucaucuuuacuguuaaauuuguccuaagcuuucuauaagaaguugacuuagacggauugcuaaacugguuuguucuuuuuguucuuaccugaacugaaauagucuguuucuuucuuuagguggaucccugcauccucaacaacaaugugcagugagcauguggaagaaaagaagcagcuuuaccuacuuguuucuuuuugucucucuuccuggacacucacuuuuucagagacucaacagucucugcaauggaguguggguccaccuuagccucugacuuccuaauguaggagguggucagcaggcaaucuccugggccuuaaaggaugcggacucauccucagccagcgcccauguugugauacagggguguuuguuggauggguuuaaaaauaacuagaaaaacucaggcccauccauuuucucagaucuccuugaaaauugaggccuuuucgauaguuucgggucagguaaaaauggccuccuggcguaagcuuuucaagguuuuuuggaggcuuuuuguaaauugugauaggaacuuuggaccuugaacuuauguaucauguggagaagagccaauuuaacaaacuaggaagaugaaaagggaaauuguggccaaaacuuugggaaaaggagguucuuaaaaucaguguuuccccuuugugcacuuguagaaaaaaaagaaaaaccuucuagagcugauuugauggacaauggagagagcuuucccugugauuauaaaaaaggaagcuagcugcucuacggucaucuuugcuuaagaguauacuuuaaccuggcuuuuaaagcaguaguaacugccccaccaaaggucuuaaaagccauuuuuggagccuauugcacuguguucuccuacugcaaauauuuucauaugggaggaugguuuucucuucauguaaguccuuggaauugauucuaaggugauguucuuagcacuuuaauuccugucaaauuuuuuguucuccccuucugccaucuuaaauguaagcugaaacuggucuacugugucucuaggguuaagccaaaagacaaaaaaaauuuuacuacuuuugagauugccccaauguacagaauuauauaauucuaacgcuuaaaucaugugaaaggguugcugcugucagccuugcccacugugacuucaaacccaaggaggaacucuugaucaagaugccgaacccuguguucagaaccuccaaauacugccaugagaaacuagagggcaggucuucauaaaagcccuuugaacccccuuccugcccuguguuaggagauagggauauuggccccucacugcagcugccagcacuuggucagucacucucagccauagcacuuuguucacuguccugugucagagcacugagcuccacccuuuucugagaguuauuacagccagaaagugugggcugaagaugguugguuucauguuuuuguauuauguaucuuuuuguaugguaaagacuauauuuuguacuuaaccagauauauuuuuaccccagauggggauauucuuuguaaaaaaugaaaauaaaguuuuuuuaauggaaaaaaaaaugucugugag

SEQ ID NO: 13751 - RNA, 4158 nt, Homo sapiens
cucacagacauuuuuuuuuccauuaaaaaaacuuuauuuucauuuuuuacaaagaauauccccaucugggguaaaaauauaucugguuaaguacaaaauauagucuuuaccauacaaaaagauacauaauacaaaaacaugaaaccaaccaucuucagcccacacuuucuggcuguaauaacucucagaaaaggguggagcucagugcucugacacaggacagugaacaaagugcuauggcugagagugacugaccaagugcuggcagcugcagugaggggccaauaucccuaucuccuaacacagggcaggaaggggguucaaagggcuuuuaugaagaccugcccucuaguuucucauggcaguauuuggagguucugaacacaggguucggcaucuugaucaagaguuccuccuuggguuugaagucacagugggcaaggcugacagcagcaacccuuucacaugauuuaagcguuagaauuauauaauucuguacauuggggcaaucucaaaaguaguaaaauuuuuuuugucuuuuggcuuaacccuagagacacaguagaccaguuucagcuuacauuuaagauggcagaaggggagaacaaaaaauuugacaggaauuaaagugcuaagaacaucaccuuagaaucaauuccaaggacuuacaugaagagaaaaccauccucccauaugaaaauauuugcaguaggagaacacagugcaauaggcuccaaaaauggcuuuuaagaccuuugguggggcaguuacuacugcuuuaaaagccagguuaaaguauacucuuaagcaaagaugaccguagagcagcuagcuuccuuuuuuauaaucacagggaaagcucucuccauuguccaucaaaucagcucuagaagguuuuucuuuuuuuucuacaagugcacaaaggggaaacacugauuuuaagaaccuccuuuucccaaaguuuuggccacaauuucccuuuucaucuuccuaguuuguuaaauuggcucuucuccacaugauacauaaguucaagguccaaaguuccuaucacaauuuacaaaaagccuccaaaaaaccuugaaaagcuuacgccaggaggccauuuuuaccugacccgaaacuaucgaaaaggccucaauuuucaaggagaucugagaaaauggaugggccugaguuuuucuaguuauuuuuaaacccauccaacaaacaccccuguaucacaacaugggcgcuggcugaggaugaguccgcauccuuuaaggcccaggagauugccugcugaccaccuccuacauuaggaagucagaggcuaagguggacccacacuccauugcagagacuguugagucucugaaaaagugaguguccaggaagagagacaaaaagaaacaaguagguaaagcugcuucuuuucuuccacaugcucacugcacauuguuguugaggaugcagggauccaccuaaagaaagaaacagacuauuucaguucagguaagaacaaaaagaacaaaccaguuuagcaauccgucuaagucaacuucuuauagaaagcuuaggacaaauuuaacaguaaagaugacaauccucaccucaguauaagucggugguggcaugaacuugaacucaggggcauacauaaagauagggcugucuugagagccauccaugucaucuagcagaggagugguugggcucuccaaucggugaucuucaggaaugacauccauauagcagggaggagcuagaaaagaaaauauggccacauaagaauccugcccaagaaaugcuggaccaucacaauuuuacaaacccagguagaccagaaacaaagaaaagacauuaggucuggcucaccuucugggguaucagggauguucagaucuacccaacucaucucagagcugguucggcuggccaugcuggauguucugcugcuuagaccugaucugcugccaauuaccaggggcaggucaaggaugaccuucuuggauccaggaacgcuaacauagaucuagaaaggaagauggcaguuuauuacaccagaggucuggagaaacaagacagcugugguaacagaugaacaauuucucugcugaagccacccugcaucuacccaccaguaaggaauauucaacucgaaggauguugcagcccaggauagaaggccugaucuucugaacccgaaggcucuugccacgccaugaugcgcaugucccugagauaauaugauugccucugacugaugacaacuucugagucagcaccuuggucuggccauuggcaagguaaguguggcgggccacaauggcagcuuuggggaccacaauucgggaacauguauucucaaagucagcauggauggaaaucucaucaccuagcaaugagaaagaugaaaacuuacugauacucaguauaguuaaugacacuuccucuaccccagucccaugcccuugccccuaaacccaguuccuguuuuaacugccauaagcacuaggauuuuaccuucacagaauccuuuucugucaauucgagcagagacagacacccgcccaucaggaaugaacaugcaggaaacuuucuuuucuuuuuuagcagacacaggugccuauauagaaggggauaaaaagguguuuugagaugcuucaaucuaaugcccaagacgucugauuuaucauccucaugacccaggagaauagaaucuuuaaaauggaucucaccauuaaaucagggguauugacauccaccagauccacuacuucaaaguuuuucuuugucucuugaguuggcuggcucgggcggucaagaaaagccuucacccaguagucuacacacccauauuuuccuuugaaggauguucccagaggccugugucaagaaaaugaaaauuuuaaaacgcucuccaagaacaguaagugaucaaaggagggcaagauauuuuagacagaaaaguucaaagaugcauuuagcugauauuuaccccugaggaagcucaaagccgaacuuguacucauauuuguuuccaggucucaugaucaccaucucauucucaccugaagggaaagaaaaucgaguagccauuaggcuugcuguuacacuuaaaaugcaucugugugauaaggaaugcuuggguggcaugcaagguauugaaguacccccaauuucaucccauauauauauuuuuuaauccaucccauauuguucuuaaagagaaauucugauguauuuugucgggcagcaaguugccaagcccugcaauacugaaagauucacccaggacaguucucuacuaacaucucaaauaggaaguagacaaagaauaagcaacuuaugcacacauaagacuuuaacuacccgaggcaacgccccucaggauccccuuuaggacacagcaccauaaaaaauuguacaaaucacccuuuuuuuuggggggggaggagaaugucugcaaauuaaaacagaaaaaaggaagcaacaacacguaauucaaaccacucaaacugagcaacuuaaaacauuucguacagguuuuguguauucaauucucuucucuaaucagcuuucacccuccaacaaugaauugggccgcuuaccuguuggcuggucuuccagaagaagcgugucuucauagcgcagguacuccgaagucuguuugcacugcugggaucccugcauccaaagcacuuuagccacuccgcaagccaggauccuaacggcuuugacacgaguaacuucacacaccuccacuaucacccggccagccaccuucucgccacugccguacaccuuuucagggucguuaaagaccaccucaaaagacuugaucuucuugaacaucaccaugauggaacugaguugguuuuaagaguuagaaaugacgguggaagaaaaaaaaagcuccaaaucgaggaaaccccuuugcaaaaaauuauuucacuuuaaggaauuaagguauucuuaagcaguuugagcuuaaaaauaaaauaagauuuaaacaaaugaauauuaacuacuagguuuucgaaaaggcgccuaaaaaauauacgccgcugguuacacuaagcgaagucagagaaaaagccuucuuucccccaauugcuggagaaaagauccgaucuccacaagcacuccuuuggagaaaaagagggguuaguuuca

SEQ ID NO: 13752 - RNA, 4823 nt, Homo sapiens
agaaauuacuuauuuuuguaggcuuguuuccaaguuaucagcaguugaaagggauguuucuacaguacgugguaaauggcaauaaaacaggauaaaggaaagaucaaaacaaggcuguggaccaaacuauaaauccaagagcuuugauuauuauuuuuuuuuuuuuuggagacagucuuacucugucgcccaggcuggagugcaauggcgcaaucucugcucacugcaagcuccgccuccuggguucaggucauucuccugccucagccucccgaguucccaaguagcugggacuacaggcaccuaccaccacgcccggcuaguuuuuuguaucuuuaguacagacaggguuucacuguguuagccaggauggucuccaucuccuaaccucgugauccgcccgccucagccucccaaagugcugggauuacaggcgugagccaccgcgcccagccagcuuugacuauuuuuauacuccucacaauucucaagcacuucuuaggcagagcacaaaaacaaaaaaaaaaaaaaaacuuagaaauauaugaaugcaagagaugggaagaggaaagaccauuucccaacuagcucagaguagccugaucguaacuccaaacaguucacaaaauucucuuaggcugaaacuauucaucuuuccuaaaugucccucaugucugcuaaaaucacuuucccaaaugccuuguaucuaggaaucugaugccuacugagcuuaccuuuuaucaaauuaauagugacucaaucuccauuacuggaaagcaggcacuuuaaccuuguagcucuaaacagaaauaguuuuuacugauucaguuggaaaacccagcaauuuaacaaaaagggggaggggcagcccaauagcauuuggaaaauguuaaauuuuauuauuuaacauucuuuaccauuauaguuacugcacauaagacuauuacuacuaaaggucacuucagagucccugcaaaauggccuggaauuuuggcagcacccauuuuacacaauauuucuuuuuccacaaaauaacagacauaccaggaaaaucauuucagcuaaaaauaugagugaggugguagaaauaucaucccuuauaaagcgcaauguuagaauaguacuugagaaagcaggauuguuuuaaguuccaagauuuaacaaacuuacuguucagcaucauauucaagccuaaaaggaagauaggauuuucaagauauauuuccaacuucuuuaacauggcaccauggaugaacuguuucucagcacugugcugcuucacuuggaauuaaggaugaauugggaggagacaguaugacauagguggguagguuggguggugaggggaaccaguucuaauaguccucaacuccacuccagcuguuccuguuccacacgguccacugagcuggcccagucccuuucacucagugugucaccaaaggcagcuucaaggcucaauggcaagagaccaccuauaaccucuucaccuucugcugccucuuucugcugccacugacugccauggccaucugcuauagccgcauuguccucaguguguccaggccccagacaaggaaggggagccauggugagacuccaauucccaggccuuaauccuuaacccuagaccuguugccucuagcaucauuuauuuaucuaccuaccuaauagcuaucuaccagucacuaaaccauggugagauucuaaccaugucuagcaccugaugcuagagauaauuuuguugaaucccuucaauuauaaacagcugaguuagcuggacaaggacuagggaggcaaucaguauuauuuauucuugaacaccaucaagucuagacuugguggcuucauauuucuaucauaaucccuggggguaagaaaucauauagucccagguugggaaggggaaaacgguuugcaacauucuccuccuuguaggaggugagcucugucucacuagcuaugccccuccaucaauucacccuauacucagaucagaagcugagugucugaauuacaguauauuuucuaaauuccuagccccugcuggugaauuugcccucccccgcuccuuugacaauuguccccguguucgucuccgggcccugagacuggcccugcuuaucuugcugaccuucauccucugcuggacaccuuauuaccuacuggguaugugguacugguucucccccaccaugcuaacugaagucccucccagccugagccacauccuuuuccucuugggccuccucaaugcuccuuuggauccucuccucuauggggccuucacccuuggcugccgaagagggcaccaagaacuuaguauagacucuucuaaagaagggucugggagaaugcuccaagaggagauucaugccuuuagacagcuggaaguacaaaaaacugugacaucaagaagggcaggagaaacaaaaggcauuucuauaacaucuaucugauccuaacagaguauguaggaacagaauaguaagucuuuagugccauaagaucuuaacaucucacuucuacuccugcucuccuaguuccccccaaaaaagaaauacugaccagugucucuacuuuaaacccuaccugaaacuugagacuaugucuaauauagaaacucacauaacuagcccagguaacacagcaagaccccaucucuacaaaaauauuaaaaauuuagcugggcaugguggcaugugccuguaaucccaacuacuagggacagugaggcagaaggauggcuugagcccaagaguuugaagcugcagugagcuaugaucagcugcaauccacccuggguaacacagcaagacucuaucucaaaaaaaagaaaaaaaagaaauacauagaguucagucccuagaaguaucuucacaaugauccauacagccuugcuaugcuuuagaacuuucaauuuuaggacaggaaaguaacauuaaauguagaaaacaaaaauggaacauuuauucgcaacucaaauacuacgcauauacgguaagagauuaaauauaaacacagcaaguuccaccccaguccuauuuguccaaggcugcauggucaaauggaaucuugaagagaacaccuggacaacagaggaccugucagcgacgucuccggucuggacuucugcugcgucuucggccaccucuagggaaaaagaagcagggagaggaguccauuagagggacauaauacuaaguccucauucuguuucguucguauucccuucacccagacaguauuugcccucuucauuuuaccuccucuugccuuuugguggaccccgaacaaaacaccagucaacgcugaugggcugucccaucaaauccuggccauugagucccuccauagcagccugggcuuccuuguauguuucauauucaacuagaguauaccccuggggaaagugaaaagacagauaugaaaacccuccuauuuccccaaguaucacugaguaucuuuuuccucaaaucuaaacucagaaaaaucuacacacuuuaaacaaugaauguacaucauauaucucuacuguauauauacaucaucuccguuucugucucuuuggcgugucugacaaaacauagauuuccaaugucauuuuauuucaacuuugcucuuggccaaccacagcaaacacagaacuacgaaugcuaccuaaggcuuaugaaagaaaggaggcaauaaagugucacuuaggauaccuucagauauccuguucgccugucgagguugagaugaauguuuuuaauuuccccauauucugcgaauuugucguguaugucuucuucgguggcuuccucauggacuccaguuacaaagagaauccagccuucaacagcuguugggggacggggggaaguuguaugaguacaugagagacacuuuaagcaggcucacaggaauagagugagugcggacucagauuguuuaagcuaucucugaacccauuccuacugcguuuaacuauuuuauugguuucuaacuacuaccacagacacggauaccucacagguuccauuauuacucacagcguugugguccggguucaucgccauccugcuccacgcugucauaauccucacgcauccgcgcucgggaccccucuucuauaagggacauacacgagaucaccgaaaacuccuccuuucucccauuguuccuaugagguggguggggacuccaaaacccguagcuccugcccuacuaggccacucuaccccauuuuccccacacucaccggagccaaagccgcgacccuuccguuucuucgcuuuuucuuucaguuugugaaugcucucuggaaccccagaagauaaaagaauaaguaacuaugacagucauuuguaacaaucgucucuuucccaauacacuaccagcaagccgacccacaccgccuccagucuuagugccuucccggucacgcccucccuucuccugaagggggcggaaucucuaauccacccaagacccgguuccucgauucccauccuuacgaccgaggaaaaaagaguaaauuuuccuauuauagccuucucucgcaccuuccccgcuucccaccagccgucuccacuguccucaccguccccauccucauccauggcgaaaucuucgcccccagccucgugaagaucuagcacguccgccaucucgccuucgaucgagaucucgucugugccgcucagacacuagguaccucgggaaacugucgcagaggggaaaggucgccagucaagcugaccaaucaaaggcuaacucuaaaucccucccucugcacgguaaaaacacgcaaauuggggcgggccuagugcggaaagaua

SEQ ID NO: 13753 - RNA, 12040 nt, Homo sapiens
cagcccgagcgcuaggcggggcggagcuccggcccgggcggagccgcggccgccgcguccggcugcuggaccgaacuucugccgugcggacagcaggagcagcgccgagccccauucccccaccucuccagcucgcccucugagccucccgagcccucucuccauuucccacaauugugcugguaagucccgcuccccgcaccaaacuuuuuuuugcugccgaguuugaguccuacgaucggaccacgagcugcacuguaguugguguaugggggaggaggagagggugaauuacugaaugccgacuccacggcuucccuaagacggaucagcgcucgcccauuucccgaguuggaagaccucucgauuuuaguugauuaaacuuaugcagagauggagaugaggguuugcgcuccaacuucgcuacccccucccccauuucucugagcucuagcaguucccgauacuuucccuccaucuuucaaguaucuuuggcucccuaaaagcuuguccccucccaacucugccguggcaaagccccccuccaccaggcacuucgggcccgccuccuccccguugcccuagggaccccgcgaucuugggggccauacacucccuccggggcuacgcguccugccaaccggccgcagacguguagcugcugggucggcuguggagggaggggcucaggcuggggcuuguccgaagccaggcgggcggggccgggaaggggagguauagggggccggacugggcggagcaggcggcauuugcggccggcgccaggguggagaguugugcgccggucccugggccugagcuccggcuccggcuggggcgccugcgaugucucaagauggcggagcugggcgaauuaaagguaccggcccccuccccccauccccaucuggacucagcccggcgguacgccguguccgggaagcgaccgagacugggugccggggcucgggugggcgccgacgacguggcaggcacgagcugcugaggaugggagagaaguagcugagagcgaggaaggggcugcggcggggcuccgggggcggggcugcggggcagauguagggguggggccgaggggaauugcagcuguugggggcugaggcgcagggggcggggacgagggguagaagucggauuuaguaguaggggcgguuguugggguagggccagggggaaaaggugcuguagaggcacugggggcgagucgaucaaggccaagagaugcaacaguagggggcacaugcagggaugggaccgcggggcagacguaggggaggcuccgggggaaaggcagcugagaggauagggucuuugggguacucucgggauccgagcuuugggaaauaccaguaggcugcugagaugcagggggcggggcugugcgggccgauaccucgagggguggggcagaagcauccuggaggcucagaggaagguccugccguagugaaucgcgguguuugggaagaggcagaggcaugugaaacuaugggauagaaaggugggaaguuauaggggaagcuaauggagaaaaaaagacaggacagaggagauaaggauggggagaaagaggagcaaguuucucaucacauuccauaaaagggguccaagacaaagccuccuaugagaagaauuguguagggcuagcaagcccugcacaugacaggaucuccuagagauucacagaagggagucuucuaaggagagcgcuccccuccugcuacauagaguuuggagggugaccacaucugaggacaucucauagaaccucaaacuaccgaguucauccgccugccuccugguuuucuucugcccuuugaaaugggagcuaugguccugggaaggcuggaggucuagccacugggcccagcuaccuucaggggauuugcgauucugugcccugacucagaggcuuuuccuucauccacccagggucucuguuuagagcucugcccucuccucuuccaccccuauaggggggcgcuguaaguuguagaggaguauuaauuucucuguguaggagagaugccagauuaugguuccuggcagauagaguaaacaggcaggauacuuggacucagugauucacuguuaaucuccccgacccaaguuuugguccuguuucccuuccagaaaaauaggacuaaguuguggggagggggugguuauauaaacgauuccaagaaaggaucuggggaaguuaugagcauugaacccugaccugaaaacccuggccacagaagcuucagaggcuugggggaaauagcugaggugaauuaaggugguugggaggggugggcugaagggcacaauccuccagccaccuagccccuuucuuccccuggggcugucuggcuugaauccucuugucucucccuccuucucccugucuccuauccuguucccaggaggcugggauggguuugagagucugagaaagggcaagagaggagauaagcagcuuaaagcagaguccagggauggaggcgggaggcugcauggacucggaggugugucugaggguggcuugcugucugccauucccugccccacucuggcugcuuccaggccuggggaaauaguguugcucaagcucgggggugguggugaugaugcugaccugaugguugcuaaagugggacugagaugucccuuuggauaggucgacuaccuggcaguaauccacuagcugcgaagcaucaucuuucccaucagugcuggagagaaaggcacugcccaccugguagcucagcccaugucuuggcagggcaggccugugcaagggaggaugcucaagcuucucuguuuuucuccacagcacauggugaugaguuuccgggugucugagcuccaggugcuucuuggcuuugcuggccggaacaagaguggacggaagcacgagcuccuggccaaggcucugcaccuccugaaguccagcugugccccuaguguccagaugaagaucaaagagcuuuaccgacgacgcuuuccccggaagacccuggggcccucugaucucucccuucucucuuugcccccuggcaccucuccuguaggcuccccugguccucuagcucccauucccccaacgcuguuggccccuggcacccugcugggccccaagcgugagguggacaugcaccccccucugccccagccugugcacccugaugucaccaugaaaccauugcccuucuaugaagucuauggggagcucauccggcccaccacccuugguauggcucuuuguggucccuuagucuucuggacucccuaccuguuccccaaacauuucuuaggcuuuaguccuaugggaucagugaccugggaugggggcgauuucuguggcugccugugcaugggcuuggaauaacugccccuuuguauccucagcauccacuucuagccagcgguuugaggaagcgcacuuuaccuuugcccucacaccccagcaagugcagcagauucuuacauccagguacaucucuuccagucuuccugccucaucccuggucucugcuuucugacuuucuucucuucugcccugugcucuucccuaucccuccuccuauaccuacuugucucuuguucuucugugugucucuucucuaucuccuggacaucugacuuucagccuuucugugcauucacccuugcccucugggggcuacaugcugacaucucuucaucucccucccuguuacagagagguucugccaggagccaaaugugauuauaccauacaggugcagcuaaggugaguucauccucccugccuauccuggguacccacuggggguaggagugaaguagggguaugacagauacccuuacgagaugucccugcucugccacugccuacugcagcccugcgacucuuguuggaugcugagggcuucaggcaucuaugacugauuuucugggguucccugucucucugccagauucaaguuaagaaauuucuucccacucuuucuuccuuucucaucucuuaccagguucugucucugugagaccagcugcccccaggaagauuauuuuccccccaaccucuuugucaaggucaaugggaaacugugcccccugccgguaaaugcucuccccuucuucugucaguaaucccuuaccguuucaguucauaaauauuaacuacaaaccuauucugaaagagacaugccuagcacagugcguggcacauaguaggugcucaguuuacugacugaaucaauagaaucucgagaguauuaagauagggcugaacaaagguuuugugagaacucggaggaggacauuaguucaacccgagauguaagaaagacuucuuuuuuguuuuuuuuuuuugagacagagucacucgcucugucacucaggcuggagugcaauggugcaaucucugcucacugcaaccucugccucccuaguucaagcaauucucuugccucagccucccaaguagcugggauuacaggugcccaccacccugcccggcuaauuuuuguauuuuuaguagagacggaguuuuaccauguuagcuaggcuggucucgaacuccugaccucaggugauccacccaccucggcuuccuaaagugcugggauuacaggcaugagccaguacacccggccagaaagacuugaccccagagcugagaguuagaaaaggugaggcauccuuauuccuccuccucagggacucagugaguuccuuuuuucucagucaauaaauaagcucuccuuucuccccaggagugaaccccacacauaacccuagacagugcuccaguuuugugagccacugaaugggccuccauccccuuggucagugagugagcgaguuggccuucccuccagggauugaauaacccgagacaagauaucuuuuguucaaagagcagagccccuucccagagccacuucuccacugaccaaucccucccuucuccaggguuaccuucccccaaccaagaauggggccgagcccaagaggcccagccgccccaucaacaucacaccccuggcucgacucucagccacuguucccaacaccauuguggucaauuggucaucugaguucggacgggugagcacagcuaaagcaggugccuggaaaagccugcugagggugaaggggaaccauccaguguccuggguuggggaagcauuuuccucuuuaugagucugucucugguccucauggaacaaaagugggcaguggugguaugagaagcagaggcuaauugucuacccccugccuccaaguagaauuacuccuugucuguguaccuggugaggcaguugacugcaggaacccuucuacaaaaacucagagcaaaggguauccggaacccagaccacucgcgggcacugagugaguaacaucuuuccucucuuccccaccugaucuggauucaagucuuccuggcccuccagccuucauaauuaaacccauaccucuuuuuugacaacuuacuccccuucucacaugaaccccaacccucccccucuaccccugaccagucuuccagucuuuauaguugaaguuggaccacucccaggcacccuugaauuuccaaucauguaucugcuuugcaccucacagucccuaacuccagcccugcuagaauaugggcucuccggacuggaaagaaucuuagggguccucuaaucuaacccucacaugaugcuucaacuccuccagaucaucucuaacauagccagagugucacgcuauguuuaagcaucuucagggaugggaaaaucccccacacccagccuucaucauccauaucccagaccacuuccaugugacgucccacuggcccccaaagacgcuccacccagcagccucucagccagagccaucuguuccuggccuuaccaacuccugggcuuccuccagccuugcugaccccauggcucuggccucacuuuuguuucagucaaggagaaauugacugcugacccugacagugagguggccacuacaagucuccgggugucacucaugugcccgguggguaaaaggggagaagggaacagggugggaagggaguuggguuuagccuguggacuuugaugaggguuccuagggauacuggcgugaaguuuucugggaugaaaucagaguagggccucugacaagagaacuugcuucuccucagcuagggaagaugcgccugacugucccuugucgugcccucaccugcgcccaccugcagagcuucgaugcugcccuuuaucuacagaugaaugagaagaagccuacauggacauguccugugugugacaagaaggcucccuaugaaucucuuaucauugauggguagggccauuuugcuuccucuuaccuaggacauccacuagaaccucuuuucuugguuauuucuuuuucuuuuucuuuucuuuuuuuuuuuuuugagauggaaucuuacucuguuccccaggcuggagugcaguggcacaaucuuggcucacugcaaccuccaccucccggguucaggcgauacuccugccucagccuccugaguagcugggauuacaggcacccaccaccaugccuggcuaauuuuuguauuuuuaguaaagacuggguuucaccauguuggccaggcuggucuugaacuccugaccucaggugaucugcccacuucagccuccuaaagugcugggauuacaggcaugagacaacaugcccagccuauaauauuucuuuuuucuuuuagccaccaccuccuucaggguuuuuaauucauauggcuuacuuccccucacaugaacugcaauucucaccuuaucuaucccuuuuaccagucuguguguguguguguguaugugcauguguguggagggggagggcaacauuaaggacuuaguauauacaaggcaucuugcugagcacuuugcaugaguuaucucauugaauccucacaauaacccuauggacucggcuccuaccuguaauuccaacacuggaaggcugagaugggaagaucauuugaggcuaggaguuugagaccagccugggcaacauaguagacccucucucuauaaaaaauuaaaaaaauuagccaggcauguuauaauagcucaugacuguagucuuagcugcucaggaggcugaggcaggaggauggcuugaacccaggaguuugaggcugcagugagcuaugauugcauuacugcaccccagccugggcaacagauugagacccugucucaaaaaaagaaauaauccuaugauuggcuagugacacucacccagaaaaaaaaaaagaaaaaaaaaaacccuaugagauagguaguaucauuacacaugaggaaacugaggccgagagagauugagccuugcucaagguuauauuguuaaguggcagagccaguguacugaacugucauaauauaucaccuauaacaacuaccugacuucccacugagcauugcaauaagguucuuuucagggccuggauguucuaaucuuuugaucuugcuagucuuaaccucuuuuuggaaucuacauuaugguuccuguucccagugcucccccacuuuuuguuuguuuguuuguuuuugagacagggucucguucuguugcccagacuggaguauaguagcacaaucauagcucacugcagccucgaccuccuggccucaagugauccucccaccuuggccucccaaagugcuaggauugcaggcaugagcuaccaugccuggccccuagugccuuuauuuauuuauuuuuacacaaguguuuagaaagccaaagacccagugccuuuuggagaugguuuauggacuucugugucucugcuccuuuuguuccuuauacuacacguaagugcucagauuuuuuuuuuuuuuuuuuuugagacgguguuucacucugucacccaggcuggagugguauggcacagucucgugaucucagcucaugcaaccucugccuccuggguucaagcaauucuccugccucagccuccugaguagcugggauuacaggcaugugccgccacauccggcuaauuuuguauuuuugguagagaugggguuucaccauguuggccaggcuggucucgaacuccugaccucaggugauccacccaccucagucucugaaagugugauuauaggcgugagccaccacgccggcuuuuuuuuuuuuuuuuuuuuugaggcagagccuugcucuguuucccaggguggagaacagugguguggucuaggcucacugcaaccucugccuccuggguucaagcgauucucgugccucagccuccuaaguagcugggauuauaggcaugugccaccacaccuggcuaauuuuuguauuuuuaguagagaugagguuucaccauguuggccaggcuggucuugaacucccagccucaagugauucaccugccuguaccucccaaagugcugggauuaaaggcgugagccacugcacccagccucagauuguauuuauuuuaaaaccuauuacuuacuuugcaaagcucuuuuacauaccuuguguuauuugauuccaacaacucagagcgguccaguaggauggauaauguucuuauuuuacagaugaggaaacugagauacaggaaggugaguuacagaacucuggcuacuguucugcucaucucccagccccgugaauuuucaucucucucuucccccaguuuauuuauggagauucuuaguuccuguucagauugugaugagauccaauucauggaagauggauccuggugcccaaugaaacccaagaaggaggcaucugagguuugccccccgccaggguaugggcuggauggugagugacccccuguuccccagcuaagcuaaaucuuggauggccucuucucugagacguagucuucuuaauacccacaggccuccaguacagcccaguccaggggggagauccaucagagaauaagaagaaggucgaaguuauugacuugacaauagaaagcucaucagaugaggaggaucugcccccuaccaagaagcacuguucugucaccucagcugccaucccggcccuaccuggaagcaaaggguaugagaaaauaggcugagucuacagcaaaacggacaggggaagaagucaggauugcuuucugaucauuggacaaagccuggggcaagagaaauguggaggggacagagagggaaccuggggaccugagcugggugagggcaucugugguuugcuggcugccucagcuccucucuacccacagaguccugacaucuggccaccagccauccucggugcuaaggagcccugcuaugggcacguuggguggggauuuccuguccagucucccacuacaugaguacccaccugccuucccacugggagccgacauccaagguaugacaugggucauaagauggacccugcacugccacacccuccccagagcuacaucagaaccccuguuccuucucaaagccuccugcuucuccugcaaggggccacaguccacagugcuuugucuuuuggugguaaaggggucagauaggagguuaauuuugauuuuucuuuuccugccagguuuagauuuauuuucauuucuucagacagagagucagguaagugguucuuucuucagaaggucucagaucucugaagcuuccuuucuagacacugauggggccccucccucucuuaugaucucuggggauguaaaucugcuuucccgugagggcagugggguguagguaucuuauuaucuccucagccccacugguaguuccugagauuccuacuuaggccuccuuccuagauccccuguuacuuuucugcccuggccuacucaccccuacccccgugugcacuuagagcaccaugccugcucuaaccggacauuccacacauuucagacgcccacaaagccaagaaccuaacaaguuggaggagcucucucaaggcagggaaaggggaaggguguagggaaguaggggaaagagggagaggcucuccugcuucucaagagaauaccuucggauccacagggguugauugcucucauacggcauuucugagaugagugacugggagguggggaagucaggauugagaucuuaaacuaugcccuugauucuuccuagcacuauggccccucugucaucaccucacuagaugaacaggaugcccuuggccacuucuuccaguaccgagggaccccuucucacuuucugggcccacuggcccccacgcuggggagcucccacugcagcgccacuccggcgcccccuccuggccgugucagcagcauuguggccccugggggggccuugagggaggggcauggaggaccccugcccucaggucccucuuugacuggcugucggucagacaucauuucccuggacugaguucccuggauuauggaaacuucgcugucccccaacacugagcaaguaugcuguggagucccaaccccagcuacucugaucccucugggggcucuggccaagggccagacagaccuucacagaugccuacuuuuggccucaucucugccugacaaggccagcacccaaaggguuaauauuuaaccucuuuuuaaggacacuggggucuguuucuggaaauguucuuuagaugguggcacauuccuuuggguauguuaaccuaggcagugggaggcaaaugggaugguaugugagcuaggagaagggcugaacccucagccuugacuaugucuagagccucuuggggaaggggcaccucucuugaaccccaaaugcucucucuucuuauuacccaaacccauggcucuauuucuucuucacauccauugucucuucaugucuauuccauucccuucggccaaacagacagguggaaaaacugagacaggcaguuucagagauggacagagaacuuuauuuuggauuguggauguggacuuuuuuguacauaaauaagaaaaaccaaaauacuccaaagaugacuuccccugccuccuacuccaguaugacagaggaggauguaaggccuuagccaugaucugcaggggucugggagucaggcccggccuauugcuugggucucucuccauuuauauaucuaaguucacaguguuucuuauuccccccuaagcuucuagaggcucauggcccuguaguuaggccuggcucauucugcaccuugccagggagguggaaggacccugugcccuccuucccaaucuucuuuuucaggcucgccaaggccuaggaccuauguuguaauuuuacuuuuuauuucuaaaguuguagugaagcucucacccauaauaaagguugugaauguucugugagugucauggagaugggcuagggaggggauuuuacacuucacuuuccagaccccugguuugggggaagaggguccauguuccauucuuccuuugcuggcccuggguccagguaagcugcacuuuuacacgguggggguguucuguggaggaauuccaagagagguuguccuuuccugcuuucccccgugccuguaaaaacuagaccauuccagcccaguacuguggagcucuccaguccuuuuucacuuuuaccugcccagauguugcagccagagcuugagggcaaacuugguuccagugcugacucucucuuuguccucugccaugguugggaucauccgcaggaggguggacaugugcaggaccagaggucgggcucuuccauccuccucuaguuccacugcacugcauggugacaacuccuguuggggcugugccuuguagcuuacaaagaacuuacauauauguuagguccccgaauccucccaacuaccacaggagguggguggguguugaccucauuugcagaaaggaaacagguucaaggaggguuaaaugacuugccccuguguuagaacugacacuuagaccuucaaugcuagccaguuagagcaagaaucuuugggguuugauggucagugucuuagauuucauguaccuucuuaauuaucagcugacccacucuccuuaaaucucccccacaacacaaaa

SEQ ID NO: 13754 - RNA, 2986 nt, Homo sapiens
uauguuguaauuuuacuuuuuauuucuaaaguuguagugaagcucucacccauaauaaagguugugaauguucugugagugucauggagaugggcuagggaggggauuuuacacuucacuuuccagaccccugguuugggggaagaggguccauguuccauucuuccuuugcuggcccuggguccagguaagcugcacuuuuacacgguggggguguucuguggaggaauuccaagagagguuguccuuuccugcuuucccccgugccuguaaaaacuagaccauuccagcccaguacuguggagcucuccaguccuuuuucacuuuuaccugcccagauguugcagccagagcuugagggcaaacuugguuccagugcugacucucucuuuguccucugccaugguugggaucauccgcaggaggguggacaugugcaggaccagaggucgggcucuuccauccuccucuaguuccacugcacugcauggugacaacuccuguuggggcugugccuuguagcuuacaaagaacuuacauauauguuagguccccgaauccucccaacuaccacaggagguggguggguguugaccucauuugcagaaaggaaacagguucaaggaggguuaaaugacuugccccuguguuagaacugacacuuagaccuucaaugcuagccaguuagagcaagaaucuuugggguuugauggucagugucuuagauuucauguaccuucuuaauuaucagcugacccacucuccuuaaaucucccccacaacacaaaauuccauccugaggacaggauagacgcugaacuucucaacaugaauauguugguguauuagaggcugagggagaagcucuuacuuacaggacagagggugguagguccugggggagaaguccgggugucucugucccauccucugcggcagccacugcagcagcuacaucuggugucagccacauaagggcgcucaccucauuuggguuugguuggauccgggccuggggucagacauggugaccccucagucauugccucucccugggcugccuguucgugaucaaaaccuacccgcagguuucauggagaaaggcaggagcaaggggaaagggcauugcauauucuucguuaucucugacuacccccgccacccccgcccagcuccuaaucacagucagaaccagguugcuugggcuccccugagcccuguuuccuucccucacugccagcccuaccugcaacugcugcugugauuccugggagaucacgaguagauacagaacaaugugaugguauuuggguaaaccccagcucagccuaggaggguaggcagacuaggaaaagaaaacagcaaaagugagaacuuuccgucacuuuuuuuuuuuuuuuaagauggaguuucgcucuugucgcccaggcuggcaugcaauggcgugaucuuggcucacugcaaccucugccuccuggguucaagcaauucuccagccucagccuccagaguagcugggauuacaggcgccugccgccacgcccagcuaaaauuuuuguauuuuuaguagagacgggguuucgccauguuguccaggcuggucucaaacuucugaccucaggugauccgcccaccucagccucccaaaguguugggauuacaggcgugagccaccgcacccggcccuuugugucacuuuuugagacuuuguuaauacagcuuuagggugaaacaaaaugguggccaaaagcugagggcguggaugguacagaugacacagcagggacaugggugaggguuauggauuuggggauuccagcccacuuaugugcuauuguuucccuuguagccaaggcagguaggggcugaucuauggaggagcuucucccagcuacuugucucaccucccauaaacccagagggacccaagagaacuggcccuggggcagguguaguccacucuccucccaaaguucucgaagcccuccguccagcagcugggagucagagaagacacaucagaggggccagugccugacucuuccaaguccuuuugcuugccccucccucagcccacacccaagauggucccaggcaugggucucuuggcucagguuggaucagcugacugguuaccuccuccucaaguuccacgugcccaccugcaacaacaguggggccaguaggugaauggugguggucuuggccagggagcccccacucacuguugacacuccucuccccuccaguggacacagagggaguugcagucccuugugacuaugaacaugccacauuuuggggcccacuuuauccuucugagacugggaaaaacauuguugcggggaaagggcaaauuucuucucuguacuuggggccuuguccccagaauacucacccggggguacccagagguugggggaaacgcucagggugcgugcccuucggguuagcaagacagucuugucgcuggacugcagaaugacggccacacccagguccacaccucgaucugugggcagcucagccccagggacccugggccgcuccuccagggccgcaaaagggcagaaagggggucgcuggcagaaggaagccagcuggguuaaggcuucagaagggcggcacugggugggcgugacuuccaaaaauggggcuacaccgcgcguugggggcgggguccucgccgccaguucccacccgauuucaguccccaucuuuggcccuucacugcccccgcucuggggcccccuucugccgaccuggagcggaagccuagcggaggcgccugggaagggccugcucgagaggacaagccguccucgcuucaagcugcagugaaugggccacgucccgagcccugguccggcucccaggaggccacacacacuccgugcgaagcucaccgacuccggacgccgggacaggagcagcugcacccgcaccucggccauaacgcgacucuggagucgcugcggcccgccug

SEQ ID NO: 13755 - RNA, 23961 nt, Homo sapiens
cuugacuguuccccacauccccugccaugugagcaggaaguuucuucucuauacccaaauagccccucaaauaccuauuacagcauaaaacauacagcacuguaucacugauuuacucggcugccucucccacuggacugcaacaacuugagggcagaguguuuucaccuuuauaaugaucacuacuuaguagguagcucaauacaugugaaauuaauauaggagaaaagaacuaaaguccaaaaccgacacaauucuacagggucaugauguccccagcccgugucacacaaagaugcuucuaaccuuagaaaccaacucacaaaauagagaaauauccuuuuggucucaauauuauaccccuuuuccguucaggaagaaaucuuaguaaacccacagaaaggaaauauccuuacauuauauuaaaguacauuaccccuugcucucuccucuucccaaacacacaaagcaggaggcauuguauaaaggcacuuuauuuuaaaaucaacacauccugcuuuuauaaaucaguuacucuucauuuccaacuuccaucaccugaguuugagagcagagugcgugguauuuuucugggcuuaagguauaaacugacauggcauucaagaacauguccagcgggcagagcccaucagggcaaccucucggcaccugcuccugcagaagaaacauaacucagcagguccgccgaggaaccuguccuucugcuauuuccagcuaagcccagagaucugagaggcucugauccaugugguauacaugugcauacauauuacagacaggaaggccccacuacccggugagcuuccagaauaaaagcacuaugcucugcuuguaaaagucacucaaaaaguguugaauugacugggaagaaagagucgaguuacauccccgagcugggagaaccaacaggcucaucccuggggcgugcucuggccucugcccuggaccccagcccugaugaagcagccaacaccacgggugcuaacagcagcacacaucaccucccaaagauaccaccaacaaucuccaaaacaggucucacagccaggaggcgacauccugacagggacgcucaggagaagaggagggggacccuguuccuaggagucuguaacagaacugggauaaggcucaagccccauccugccaccaucugucaaguucugccugaccccugggccauagccaggaguugcccuauaggauucagagagcugacugugccaagagagacuccacugggccugaggagggagacuuggugcuaacucagguagguggguuuugcaggagggugccucaccaccacccaaccccaccucagggguauuaccuucccgugguaauagagcugcacaaaccacuccuuagauuccaggugcugguaaaguuccauggucaggucaacagcaaacgguggccauuuguggucaaaaauccccagggucauuaagagcgguaugaaggucacaucaugagccgcauagagauacagcuuucugcaagaggaaacagcucuccacaauucucugccucaggacucugaaggucaggauguggccugccuccuuuacguaagacacacuugccucagaaacuaggugacaucuagaaaucagcugagccugguauaaaaguccuuugcaguagaucgugggaagaacccuuguucccacuccccgugucuucaugaggaggguccccgccagagaaauucuccuggccuccuccuugccaccuacucacuccucccuggugaguuucaaagaagaaacugagcguguguggcuuagacccuaccucucuucucucuuuggguccugccagccuacaugaaugcccuuccuacucucagccaugggaugaguuuaguagggcuccuuguuggggaagcuugaaguuuugggguauuaaguuuauuucaaaauaauauucacaagcccauuuggcccucagcacauucuccaaauggcuuuaaucuguaauaagaaugccauuuuaaucuacaucugccugacaccaguauccaucucuuaggaaagaccaaggauuuuauuuauggacccccauccuagaagacuagcauuggauccugugguguucuaaagauccaaggcagaagguggcaagguggcaaaagccagaaaaaauguacugucauugcagguacugugaaggacaggaaaugguauucacaagauuugcuauuacaaaucuuggcccaaaguuccuguuucaacucacugucuccuauuccucuuacgccaucaugaguuucuagcugugauaccacaacagugcuucuccaaaauucaggugacuaucaaucaccuggggaucuuguuaaacugcagaugcugauuuaguagaucaggcuggagccugagaaccugaugaguucuugggcaacggugaagcuguuuuccugcagaacgcacuuagcaagugccuaggacacauaauauuccacagccguagucccaaccuuggauucaaggcuccaaaaguggcaauggaggcucaugagcuacuuccaacauuuuuuuuuuuuugagacagagccuggcucugucaccaggcuggaguacaguggugugaucuuggcuaacugcaaccuccgccuccuggguucaagcaacucuccugacucaaccucccgaguagcugagacuaaaggugcgugccaccaugcccggauaauuuuuguauuuuuaguagagcaggguuucaccauguuggccaggauguuuucaaucuccugaccucgugauccacucaccuuggccucccaaagugcugggauuacaggcgugagccacugcaccuggccacuuccaauauuuuuaaaugccuuauggauaucauaccuucuuuacacucaaugaaagugguucaaacuacacaauccauuaagcaauuuaucuuuguuuuggacuauuaucauaucaaaucagugugacaucauaauuggcuacuguuugacauaucuucaauuaauaaaaaaaagagagagagaaagcaaaaauaaaauuuucaaaacaugguaggaggggugcagcaggaagaaagguuaaaagauugugaaccucuuugacacuugaggccuguuaaacaucuaccuucggucacugacagccugguucuugccucacuaagauuuggguucccucccuacagccagaaguucccacggcccuuagcugcacaaagcagaguugcugugccagguaccugaucuugucgggggcaguggcagaguccacggcuuucagcagguugcucucuaggauguggaggaaugggccuacugccaucugaagacuuucccugugaaaagugaacaacauuuaagcaccuagagggcacucagcauucaggggacacagacugauucugcccccaggaccucaugaguccagacagagcugagaaaaaggcaaguaaugcauaagggccagcaacgggccagaaggagagaaauggcaccgaguccggucuugggguccucugugaaugaagacucccaacaacacaggcaccagcacacagaccuguugugaacacaacugagaugggaggggcugagggagcaggagagugguaaccuggauaagccgugaccaacuaggccuuggggaaucaaagaacaaagcugacaagcugggaagaagaagggguaauaauuuccaggaauucuagaaggcccuuagaaaaauaaucagaaggaacaagaacauccuuaauuuuguuuccuaugugccagccuuccuucuuuuggaguuugggccauaaagacauuucuuauuuaugucuuauuuauuuuacagaagaaguucaguggucgugcucccaggcuuggcuguguggcuccaccacuuucauucucaggccugucacaucauggccacaggugacuacugcagcuuaaagcauguucacucacaguagugaacaaaguccacuuacuauagaagaaagaaauguuucucaucuacucauccuagcagcugaucagcuuccauggagacuucagagacuggucuucuccuuguuuuugugcuucucacuuuuuaucaaagagaaaaaaacaccccuccuagaauucccagaacccagccacugacaaaugaaaacaagguugccaugauuggcuuagacaaauccuuauuuguggugauuggguaaaugaccaucuuuauaagucaaggaauguugcagcaauggaugaagagcaggcaaccaacacuguaugcaacacauacuuuucagaagaauguauacaggcaaagccaaguuggauggccuugugagguuguaaccauuuguccuugaagaaauguuaguuuuacaaaaccagggcuaauuggaauggaauagacaagguccuguuuaaaaugauuuacaccagaauaaagcaaacuauaccauaggccaaaucugaccaguuuugguaaacaaauuuuacuggcacacagccaugucuauuuguuugcauauugucuuugguugcuucauguuacaagggcagagaugaguaguuguaacagaaauugcaugauccugacagcuuaaaauauuuacuaaauauguguguguguguugauaaaggagagggaaguaaguaacaauuuagguaugguggcaccccuucacaagcagaaaagggaagcuggcaagucccagggaguggcagcaagcuguguggcuuggcaggaaccuucuagaugcccuaggcuugcacagaaguggacacacugacccugaguggaaggaaugcagucaggggcucuuauccuugggcacccaaccgugcaaauucuugaacuguuagaugccuuuccccccuacucaucuuucccagggcuacuuccuaccuccccuccucuaucaagucaccuauuuuuagugcaaguugaaugcucucaacaaaucagaaaaaaaggugucuucugaaauuuggugagagaaaaacuuuccauucugguagucaggaaacagaacccuaacugcuaguaauauagcgaaaacacagaauaggcagucaguggaucuggguccaaguucuggcuccaucacuugcuagcugggccuagaccagguaggcaauaucucccagccucaguuucuuuaucuauaaagccagggagaaagguaucucucucaccucacagugagaaugugaaaaugguuugcaaauuguaacaugaugacuaaagacagaaaugaauauucuuucuucagcuccccccacccaaauccuuuaaaccuuaaagcaaaaggaaaaggcaagugauaaagucaugagggugguggcuccugguucugcauaacagggaacagaagcacuaggccaccagucccagcuguagaagugcgaggaccuagggccuacugguaggugggcagaaugggguucagccuccuuacacgaggagacaucagcugucaggugugagugggccugaugaacuccucuuccccauacacuuggaugucugaccaagcgugacuucaugccagcagugagagccccucaccugucuuccuugggcaguauguacaaggauguguccacagcucucuguucgaucauccuugcaaaucucuucagcauggggcagcuugggagguugugugccugaaagggccacauguaguuuuagaaaaaaaugcuucuuaccuacugauucuggcagcugaucagcuuccauggaaccugcaggagcccaucuucuccuggggaagagaagacaggcucaagaacagcuaugucuguuaacaggucaagaagcuaugucucuaaagcucuuccaaagcuauuacuagauaccugaaggccaggaaaaaaaaaaaaaaagaaaggguuucuucccuuucugaugacuccccauccacucaaaaaugaaaagcauuuuuguuguuuuuuugguuuuuuuugagacggagucccgcucugucgcccaggcuggagugcaguggcacgaucucggcucacugcaagcuccaccuccuggguucacgccauuuuccugucucagccuccugaguagcugggacuacaggugcccgccaccacgcccggcuaauuuuuuuguauuuuuaguagagacgggguuucaccguguuagccaggauggucucaaucuccugaccucgugauccacccuucucggccucccaaauugcugggauuacaggugugagccaccgcgccuggccuguuuuacugguuuuuuuuuuuuugagauggagucuugcccugucacccagguuggaaugcaguggcgugaucucggcucacugcaagcuccaccucccgcuuucacgccauuuuccugucucagccuccugaguagcugggacuacaggugcccgccaccacgcccggcuaauuuuuuuguauuuuuaguagagacgggguuucaccguguuagccaggauggucucaaucuccugaccucgugauccacccuucucggccucccaaauugcugggauuacaggugugagccaccgcgcccggccuguuuuacugguuuuuuuuuuugagauggagucuugcccugucacccagguuggaaugcaguggcgugaucucggcucacugcaaccccugccucccagguucaagcaaguauucugccucagccuccugaguggcugggacuacagacaugcaccaccacacacggcuaaauuuuguauuuuuaguagagacaggauuucuccauauuggccaggcuggucucgaacuccugaccuugugauccucccaccucagccucccaaagugcugggauuauaggcaugagccgccaugccuggccuguauuuuuuaacuuaaaaaaaaaaaagaugaauaaaauacaaagcaaggaauucauaaauuccuacuugaucuucauuuucccaaaaugaagucuaaaaaauacgccauacaaauacaugauaugaacucuugccuucuaaccuuaaaccuauuuuacacauaaaagcaaggugcauuucugccuuuaggguacacagucauuuuauuuucacaagaguggggaggauccuauauaacuuuggauguccaacuuuuaaaucuagagaaaccuuucccauuguuagucuucuuuauguauuuauuacagaaaaaaagauccuauggcuaaauaagcuuaaggaaaacagauuuaaagauuaaccagcuuucuuuaugaagggcaucucagauuuuuuuaauaugcugauguacauauaguacucucaagaagugaugcaauaaauaaggauuccaaaauuuuuagacccuacucaucccucccuacccauugccccugccugcccaaacacaaacugcauauuggguguucuggggaacaugccucaagaagcucuggucuagaguucagugucuguguuccuaccuggguaaggagucuuccucgauugcucccuaucccucaguccccacacccauucuaucuguaggucuuaucacaguugccuucaaaccaggaggccuccacccacuucucuccacccgguucuaacuccggagccagcccaccaaggcuauuaucccaggcuccccaaccccaggacucaccugcucggcagccacguuguccaggaggaugaagaaguccacuuuaucacuacugucaaugcccauccuguccuucaccuuuuucaaauccucugagauuccuggcuguaaagaggcagucugccuccggccucugacaaaaaauaaaaaguaaagccuuauauucuauagugauuaacaguuuacaaagugugcuucacacuuggguuaucauuugggauaucauuuaauccccacaacccaaugggguuagcugguauuaucccaauuuuauagaugaauaaacuaaggcucuauaaggucaaaugacuuauaacguuaaguuagcaaguaccaggguuaggauaacaggaugaaauuuuccaaaucucacucuagcauuugcauugcaucaaaaaugaugcaagcauggcccaggucugucugaaaacagcauuuucuuuucuuuacggaauaaauaccauauagucuuagugcagccuagagauaccugaaaagugucaucagcccaaaccgaucuaucuuacauagaaacauauugguaagagaagaaaaaucugugucuuguugggcuuguacaacuggauuugccgguuaaagacagucucaaucaucuuuuauuuaaccuguugguuuucucauuugccccaccugagagaccgggguugucagaaggaucauacuuuguaaauggcaaaggcccacucguggcuguauguaucaucucgcuagcccagugugcggcucuucccagaauuccuggccuucaccaugggucugucauugugaacaagacuucuucgcuuccuagacagcugaugucacacuuaaguguaauuuaaaccuucccauccauuauucgccaguaggguaagccuggacaggcccucaguauagacagaguucugccagcaaagguuguaaaagguuguccccaacuggugagcaagaacccaggggcaguuaccugguucucugccucaggcuccagcagcuuugguaguugggauacaagacuucugaaucugcuucaucaguguggaugaugauggguccuggaagaaagggaggaagcacaggcaggcagaggcuucagcuuguucuucccagcaucuccacccccuucucuuugucuacagagauggagcagagaucugcucugagaggcagaucaucaagguuacuccuuaaggacagaaaaugccuucaacaugcccuggcccugccaaaggaggcucuccuauaaucugagcaaugaaaaaaguuaguggcagcagccuuguucugucuagcgcaagcccuccuaucgggccacaaauagacuagagcagguaauagaccugaaacagacuggcaacucccugacaccuuccaaaaaaucccugcuguaaagcacuaccagcauuugggcauucuaauaaauaauaguguuaucagaacuaaguugcuuccugaagccugauccuauaggccacuauggugacuuaucacauaacaaacugagaaaaguggacacaaggccacagauccucucagagaccccauagccuugcccaaaauaaaaagccaggcuuuuagaugaauugcuggucuaaccaaagaucuaaccaaagaaacuacaauguuucucauauaucucauggcagcucauugcuauucagacccccucaguaccauuguccccucccgucaaugcccaaagaaaguguccuaacgccuucccaugcuuugcucugugucagagauggcaagugccaucucugugugguagguucuuuuuccacacugcucaagccugauggcaaaagaaggagcuccccagcagcaauuugggauucacugagguccaucuacagagugaucagcugaaucaaagucccaaagggguauuuauucccaaauuauugauagucagaaccaagggcuuuaaaaauagccuauaacuuuacuagaauaucagaauucacacacacaucguuggucuggacagaagaagaaaccacacugaaagucaugaguuuagucuucaguccagaacuaaccagcagucgcccugggaagucacuaccauucucugggguucaucuguaaaucaaagggguaggacuauaucagccacagaaccuccuccaaccuacggcuauuauguaaaguauaauaauaaaagaagaggugcugauggcugcaagguggagaucgaaagcauaguccacuugcaugucccauccccuccuuuucugugcuuccucagaccccucugaagaauccugggguucugcaagauuuguugugaaaaggaaaaaccaaaugauccgaugccgccuccagauauacauguccucaaauaaacaguugagcauaaaaggaaaaaguaggauucugaaccaagacugccagaguuugaauccuaauuccaccauuuaccaguuuugugucccugggcaagucacugagccucucugugucuugguucucuuaucuguaaaaggggauaaugacaccuaucuuauaggguuacuacaagaauuaaacaaguuaauauaugcgaaguucuuagaacaaaguuugcugcauacaauugguccuccauguccuuggauucuacaucuauggauucaaucaaccauggauuaacaauauuugaguaaaaaagaacaauacaaaauaacacaauaaaaauaacauaaauuagaaaauaguacaggauaauacacagcauuuacauuguauuggguauuaugucaucuacagaugauuugaaguacaugggaggaugggcauagguuauaugcaaagcuaugccauuuuauaaaagggacuugagcaucuguagauuuugguaucugcccggggagaggguuguccuggaaucaaucccuuuuggauacuguggaaugacuguacuaaguccuuuauguguuagaauaacuaugacuuaaacuuauaacacuaauaauauuauaaaccucuaauauuuccaucuggagucugauauuggugucuggauuuuggacccaguuuaugauaaauaaggcacacuugaguagacaaauguacauugagcaaaugacuuggccagugggcagaccaacaaucuccagcuuuccccacagccugauucucuguagccuauacguaaccacugggauuuuucuaggauuuuacuccuaaagcaauaucccaaaguugcaccauuuccaucaacagugccaccuucugggauucuuuuuuuguuuguuuguuuuuugagauggagucucgcugucacccaggcuggagugcaguggugcgaucucggcucacugcaaccuccgccucccgaguucaaacgauucuccugccucagccuccugaauagcugggauuacaggcgcccaccaccacgccuggcuaauuuuuguauuuuuaguacagaugggguuucaccaucuuggccaggcuggucuugaacuccugaucucaugauccacccgccucggccucccaaagugcuaggauuacaagcgugaacuacugugccuggccccuucugggauucuuuguucaagucccuucauauaggaaaggcauggaaguagcuacaaaagaagccaaucuggagucccaacaacuguagguccagcgcagggagcugcuacccagacaccugcaccugaggcuagugauuuccuucccugauggaaaccugggacauucccagucugggaccugccuaaagagaauguugccaccaauaaacaucuuuccuucucaguaccacuucugauguuucugagaagaucuuugccuuuuagaagcugagcaguugagagcuuucagaagaucaggugcuguggaucacuccuaaacucaaggcuucccaagaaguaaggggcagcccauccugcuuuaugugaccuagacacguacuguuugugugcagcagccaacuacagccagaacuagcagcaguauccaacccaguugggggcaagaccagauuccucuuuccugaagguuccauuauuuuacauauuucuuaaaaaaugugauggaaauuuuguuuccauuugagauacugccaaaaagcuaaacaaaguaacaagaaccuuugcuuuuuggcaccuuuuuaauaaggucaugaugaucugaaacucagaccaguaauuaaauguaaauuugagccaauaacaaaugacaaaaugcagcuucaugugauggccaaaggcucucaacacaugggauccaugagggaaaauaauuaaugcaguccuuggggaugaaaagguugggaaccacugacugcaaccauucaggggcugaauguaucaaaacccaaacucgauggacuuucucaacuaggaaaggcuagacggaacaguguucaugcuguggauuaucaccaagauuagggcaguagcagcaguguugggucccaguguccuuccuuuccagcaaugucucaccuaaauaaaaagcccccucgauuguucacaaaacaugguuaggacugccuugugcagcuuguguagaagcuugaggggagaagccaggagccagaggcagaucagagcagcugcuacacugcugcugcuguggaggucaggcuggcaggggcaccauaaggccagacagggaaagacccacuggacuagguacacacuggaagucacacaugcaggagaaaaaaagucaagggaacaggcaccaagaaagagauaggggcuucggaagugagaagcaagaccccucagggacagggacugacugggaccccaaauacgaaccuucuuucugacacuggaaaagcccagccagcaaacaacggguggacuccagauuccgaaaaauguuaguggaacgaauacugaaaaaaaugagaaaauagugacacucauaaaaggaauauuuaauuauauacacucuauuuuauuccacauacgcuccaggggucuuucaagaguacauaaggagagcuauggaacuaggaagaaugcuucacuuuucugugggaugucagccccugagagacucgaagugcaaugaaugcgaccuccaggaacgaccuguucaccagauccugugacauaaggguaugcagcaugacaaguugucccccaaacuaccuugggugacagugggaaccaucuuggggagucaggacagguauccucauguucaagaccuuaaauuaagugcaacauccccuuucaagugacucacaagaccuccuguggguugaagguuggugaaagaaagggaaugucuuccacauaguucuuccucagucucucucccaaggcaaacauuugcugcaugcccaccuuggucagcugcccagcaaacaugccccccuaaaguagggaagaaagagaaagaagaaugaaaacaccugacagccugcugaacucagcccagagaaaacaacccaaccuuugcaguggggcuccccagagcaaggaagcauugcucaccuucaggguggucucaugguauugagagucguaaggagaauaugguuucggaccaccagcuagauuggugacuguguaaucaaacugaguuuggggugggaccucuaauagcuggggguuccacucuaccuguuaguacaaaaaaaacacaccacauuguuuaaaaaugguucuugaaauguauagcauuaacaucucaagcacucagaacacauggcuggaaucacugacacuaggccugcaaccuuccuaugggauggaaggaaagaaauguuagcuaaaauuaagggaagaaaagauggugauuuauuauuccagguguccuuagccuauguccuguuauugcuacacuaguaaugacugcuaaggggcugcucuggcacuuagcccacacugaaguaaaggggagaagugaccagaaugccuggcaugcggauacguggugaaugaacgaauagauggaugaaagaaauaagaugucagugaccauauguaagaauuuauaaggaauuaaucuggagguuuauaugcccuaucccagcuuaaggauucuacuuaaugucccuuguaacuaauauacuuuuuuccuccuuucaugcaauucgugaaacaagcagcugccaucucagaagauguugcuuuuucaucaucuuccauuauuccuugcaaucuggcuccugccccaacugugcuguaaugauuucaaaacaucacuaguggccacaggucucauagcuccaacuguucauaaaacucugacacucauugagucagaugugaauacuucaauuuuaaaaacaagucuaaucccauagaccaguuccccuucccaaucuacuaugucccucucaauguuaccacaguucuccuaggccccaaaccucaaaccuuuggcucccuguggauccacuauccccacaccaagcccuguugaucacugccuagaagaaaagucccucccaaugguccuuccauuaucuuauuguagaauguaaaccuuauuagugccugugacaaacuccucccuuucaccugcacaauccaucuauccauagccaacuaauuaaucuuuuuggaaaaaauauuuuuauugcauuuaaauauuuuguuuuauuuuuaauugacaaauaauuguauauuguauauauuuauggaguacaaugugauguuuucauauauauuuacauuugauauaugauuaacuaauguaaacaaaauccaucagcucacauacuuucauuuuuacgugaugaaaauauguaaaguuaaccuuuuaguaacauaggcauacaucauuuuauugcucuuuacagagauugcauuuuucacaaauugaagguuuggagaacucugcauugagcaagucuaucagugccauuuuuccaacagcaugugcucauucaugucucuguguaaaaucugguaauucucauaauauuccaaacuuuuucauuacuauuaaaucugucaaggugaucuaugauuuaugauuuguuuuucuuuuugaaauggggucuggcucuguugcccaggcuggaguacaguggcaugaucuuggcucacugaaacgucugccuccuggagugcaguggcauuaccuuggcucauccucucaccucagccucccgagcagcugggacuacaggcauauaccaucaugcccagcuaauuuuuuuuuuuuugagagacaggguuuugccauguuucccaggcugauccugaacucugugaucuuugauguuacuauuuuaacuauuugggagcgccacaaaccgcccccauauaagaugccaaacuuaaucaauaaauguuguguguuuucugagugcucugcugacugguauuucccccaucucucucccucuccuugagccuccuuauuuccugagacacaacaauauuaaaauuaguccaguuaauaacccuacaauggccucuaaguguuaagugaaaggaaaaguuucaaguuucucacuuuaaauccaaagcuagaaaugauuaagcuuaguaaggaaggcauguagaaagcuaagauaagccaaaaccuaugccucuugcaccaaacagccaaguuaugaaugcaaaggaaaaguucuuggaggaaauuaaaaguacuacucuggugaacacacaaacaaugagaaagugaaacaaccuuauugauaacauggagauauucaaugcagaagaaacagccuauauaggaagaagaucccagcuaagacuuucauagcuagagagaaagucaaugccuggcuucaaagcuucaaaggacaggcugauucucauuagggauuaaugcagcugguuuccuuaaggugaagccaaggcucauuuacuauucugcaaauccuacagcccuuaagaauuaugcuaaauguacucugacugugcuguauaaauggaacaacaaagccugcauggcaggacaucuguuuacagcauggucuacuuaauauuuuaagcccacuguugagaccuacugcucaaaagaaaaaauugauuccuuuccaaauauuacugcucauugacaaugcaccuagucacccaaaggcgcuaauggagauguacaaaauuaauauuguuuuugugccugcuaacacaauguccuuucugcagcccauggcccaaggaguaauuuugacuuucaagucuuuauuauuuaagaaauacauuuuguaaggcuauuguugcccuagauagugauuccucugaugaaucugggcaaaguaaauugaaaaccuuauggaaagaauucaccauucuagaugucauuaagaacauuuauaaggaggaggucaaaauagcaacauuaagcgaaguuuggaagauuugacuccaacccucauggaugacuuugaagauucaggcuuccguggaagaaguaacugcagaugugauggaaauagcaagagaacuagaauuagauguggaaccuuaaguucugacugaauugcugcaaucucaugauaaaacuugaaugcaugagaaguuacuacaaagaagugguuccuugagagggaaucuaguccuggugaagauagugugaacacuguugaaauuacaacaauggauuuauuacauaaacuuaauugauaaagcaguggcagaguuugagaagauugacuccaauuucaaaagauguucuauuguggguaaaaugcuauuaaacugugucauaagcuacagagaaaucuuucaugaaaggaagagucuaucaauguggcaaacuuuacuguugucuuauuuuuagaaauugccacagccaccccaaccuuuagcaacuacuacccugaucagucagcagccaucaacaucaaggcaagacccuccacuggcaaaaagaucaugacucacugaaggcucagguaaucacuagcacuuuuuaggaauaaaacauuuuuaaauuaagguauguacauuuuuagacaugcuauugcaugauaggauacagaagaguguaaacacaacuuuuauaugcacugggaaacaaaaaacaacugugggucucacuuuauugcgauauuugcuuuauugugguggucuagaccugaaucugcaauaucuucaagguaugcuugucuguguagaaucuaaagaagucaaagucacagaauuagagaguagagugaugguuaucagaggcugggggggugcaguaaauggggaaagagagauuuuuaucaauggguacaaaauuucaguuacacaggaagaauaagcuuuagugaucuauuguacaggauggugacuacaauaaauaauaaugcauuguauguuucaaaaucaccuaauuaaucuugcuaagccagugucaucauaucaguaacuuuuuccuaaugucucagaggaaagcaucuguccuucaagaacuucuacaucguggcugagugcaguggcucauaccuguaauccuagcacuuugggaggcugaggugggagcaucacuugaggccaggaguucaagaucagccugggcaacacagcaagaccccaucucuuaaaaaaauuuuaaaaaaggacuucuacccccuuuguccagccccuguacucagcuucacugccucuuuccuccccuccaaccuagaaccugcccacuguuucugcaucuucuuccagcuugcuucucuugcuuggagggacuccuguuccuaucugcccaucaccuugucuucaauguucaaggauagcucaagucuuacuucccuaucacugaccacucuggcuuuugaugguuaucuuuuaaaucugaauuccuauaacauugauaacaaaaaaaaauuuaacucaauuuccuacuacuuuguuuaguuuuaaaacuaacauuuggaaaccuacuaugucacauaucgucauauuuaucuucuacccuccccgaacuaucccaggagaaugguacugggagccucagauucucuuggcaucuagggagcccuccauucuucccaaaggcaugugucagucccacuggcaccuggucuccaacaccugaaccuccuucugacacaucagaggaccagguguucacagagaggccuucuuccuucuuucacaguuaaucacugcucccucuuucugacccucuaaccccucuggauaaaaaaaacccuucgaggguucauggcucauguggccccaccuccucucuagcagcccccuuaccacuucuucccuauucuacauacuuacucacuagccacgcaacuuccuuuccuuucucauauuucauggccuuucaguaucauguuucuuaugccuggaauuuucucuccucauucauuuagaaagacuuuuguucauuccuuaagacuuagcuuaaguguucccagaaaccuuggucauggccuuaugcuuucacaguagcuucaguggcucucuuuaguagccuuuaccaaaguguauuaaacgagcuccuuuacuggucuguccuggcuuccugagaacagagacucggucaucuauugacuucuguuucccagcaaagggccucacacacaguagguacaauuaauagcuccaacaauuugccagcuccuguggaagauacccaucuugagaaaacuugacccugccuuuccuggguguucaaguuaguaaagaaaaaaggccagcugugaauguaaaugacagcaauaccauaauagaagcugacaugugcugcaagaaaccauaugaaggccauagcaguucaaaggcaagacagaccuucucuucuggcuggggauucaggagaaguuucauugagggaauagcauuuuaaaugaauaguauuuagacaagcaaauaccuguacuuauaaagggugacauucagaauuccaaaaauaacuagaaagcuugcgcaaagcagagaugguaaagaauguguauggcaaagaagugguuugguuugccucaaccugggaaugguuuuccaauuuuuaaaucagaaaauaccacauaaaguuuaacuuuagauuuguauguauaaaggcaaaaacucgaauuucucuaguugaaguaggagggaaucccacagccccagccgcucaacauccucuuagcccacaggcuccacagaauaaaucugaaaccuggcagcauacaucacaauuggaaugggaagacuagaugcagaaaagcccauuuugagauguuagcaauaguccacaugagagccuaaggccucaucuaagccaguuaacaauagaggagguagauguaagacauuugaguuagacuuggcaagugaguaaauaaaagcuuuauguggggacuguguugguagguaaacacagaagaacaaaaaagagacuacuuugauuuuugagccuuguaauggagauauuccuugacuaaaacuaagaccaagacagaaaaacagguggaaagcugauuucaguuuuggacauuuggagacaccuccuuuguguucccagugcucccagcauauugccuuaauugauaucuguugucucugcuuuaucacauugaaacuccuuuaaaggcaagacugaauuauccauccuuguaguuccaguguccaccacagggccugacacaaagcuccacagggccauucagccucacuaagaaaucuguuaggcacauucaccaagagaggacccuuggcgucuccuaggagucuggaguccaggucacaucaagucuaaaguacaguuuucagauuuucaagaauggaugauacaucaguuucauauaauaguguccaccccacauacacacucucauucucauuccugcucuuaagcuucccaguuaguggcaaagacuaacuugauaauuuuacuuauuuuguguauaccccucuucaagggguaauaaaguagauauagcaaaaauuaaaauauaguaagacaaccaauucaaaguaggcaagaaagacaaaagcaaacaaauguagggacaaagaaauggaugcaguaacacgguuacuaaaauauguacaccaugaagaucuguuuacuuacuauaggugggccacagacuuggcacccagcuuccugacuuuuacauaaagaaacaaacuugaucagcuagacuaguuuaaagaaaaaagcaagccaauuguucaggagaagcacaccauuccuaaugcuaacagacaaauuccucccaaggguccucauaaagaggauagaguaauauaaugaacaucuuuucagcagucacagcaaugaguucugugggauuguuucuccuaguucucucaacacagaaagauaaccucuuaccaaagcacauuucagcgaaggcaauucuguacugggauugauauacuacauuccagguaaaagaacaaaucuacauaaaaguaaacaaaaaccucccagguguagauuuuaaaauaaagcaaucauauuaaaccuugucuguauacugguauuaccaggacauuuuuuaaaaguuacugaugccugagucccaaccugggauaaccgcauuuggauuaucccccaaaaaaguggggccuccacuuuuuuaaugcucuucaguccagauaauucucaagcuucaccagagagucuuuuacauuaucuggauaccccggaccaauuaaauuagaauccuucggagggagacccuggcauguguauuuuuuaaagcuuuccaguugacuccaauguucaccacgguuaagaaccaucgauccugaagaauggguggaccucauguaaugcuucuugaauaccgcuucuuuuagcugaguuuuggaaagguacuaagcaauaaaagauucuuacauuaugcuucccagcucaucuauauugucaaauaaauagggacccaaaugucuuaaucaacagugaagcugggguagguuggacuuuauuuuauaaaaacugaggaaucucccuggguggaggccaucuugacacccaggggaguugagggaagccuggaagcagugccaaaucuuuucuuuugauagugcauuuggaucugcucuaaugaucaggaaaaaaaauggccaaucaaguucuauauuuuuauuuccaaagcacaaucuuuuagcaaaacagguuaaaccaacagccauucaagccauaagaaaacaacccaauaaaacacuaguuuuuuguuuuuuguuuuugagauggagucuugcucuaucacccaggguagagugcagugacccaaucuuggcucacugcaaccuccgccucccggguucaagcaauucuccugccucagccucccgaguagcugggauuacaggcgcccaccaccacaccgggcuaauuuuuguauuuuuaguagagaugggguuucaccauuuuggccgggcugaucucgaacuccugaccucuugauccaccugccucagccucccaaagugcugggauuacaggcaugagccaccacacccagccaaaacaucuaguuuuaaaucaugcuacuuucugagaauuugugagauggcugaaugaagugacuugucacauauauuaaucuauaaaccagucagaaaucaggaaacauguaccaaagacaaaaaauuuuugccaggcagucccuucugacuauaauuaauagcagaaccaagaagauuaaaaaaucccaauaacggccgggugcuggcucacgccuguaaucccagcacuuugggagacuugaagcaggcggaucaugagaucaagauaucgagaccauccuggccaacaugaugaaaccucgucucuaguaaaaauacaaaaauuagucgggccugguggugugcaccuauagucucagcuacucgggaggcugaggcaagagaauugcuuaaacccgagaggcggagguugcagugagccgagaucgcgucacugcacuccagccuugcaacagaacaagauucugucucaaaaaaaaaaaaucccaauaacaaccucuaucaaauuggaucuugaaaugaacacuggacagagacuauccagaaacaaguuuuaagaggcuaauauuugcucauagccuaaauugaaagagaguugguucaccccugauuuucaugcacacaacuuuauacuagagagccgaagacguuuaaagcaucugucuaaagucuggagaauaugagcagaaaggagagguaauaugccuucucuaauugcaaagucaggccauggauucagaugcuauuuuguggcuacacagauugaagaugaaugaagcugguauccuaagcuacaacggaccuuucaaccauaaaggcagaagauauccaucacacacccacucucccuuagggauaaagcccuaaaagaaucuaaaucuuuuccuagugccuucaggauauauauauauauauauaugguacauacuaggucuaggccuacacauucaaaguuuuacucuccauuaccacugauaauuuuuugucuucuacgugaauauaauauauauuccuacaugugauuccccaguccuucuguaccaagaauaaauagagaagaauugggggaaggggagcaucagagaugggcuguauacaaaaucauaaggaaaauuuagugaucuaauauaaaaaggcaaaguaagagacugaaaaaaaaaucaaagaaucaaaaugaaagaagaaaucccgguuccagagagcaagugguaaagccagaguaaggcuaacuagaaaccugguaauagaauuaagugccuuccaaauguauuuauuuauguggaaaaugcuuuagaaguuuaauuucaugugcggccaaccuugaaaaauggguuuccaguuguacaauguaaagacacaauccugaagguuucuagaaagcaacuguuauuaugaagaguauaccuaacaucaauuuuggacaaucuuuucgaccuccuccaacaucaaccuggaagaccaacgauacaaaagcacuccacagguguaauaccugggaguuuggggauuucagguugccuguuccucuucacuaggccuuucugcuauaaaaagucacauccaggaaagauaaucauuuuuuuuuuaaacuauuugugcuuuagucauaauuauccugacaaaaccagacagauuuuuaaaacauuacugccacagacuagcccauuuuaaauuuguuccgaccucagaucccucccacuauagguuuaguaaccuuaaauagaaaaggagaacccuagaauacaacacuuguuacaaaaaaaaaacuucaggagaucucaaauggccuccagcaaacccugagaaaaagcaguuauaaaguuuguuuccaaaggcaacgaccucuuauccacuguaaucucaguuaagagugguuccuaucacuaaagucccuucagcccuucagcucugacaaaccaccuucaaaauggucacacagaagugcacugcacccuuguauucaaguucaccuagacccuuaauagaaaugcugaccuggggcacuacuccacaccugcugaaucagaaucugcaacguagcaggauccccaggcgacucccaugcgucuuaagcagcgcuuacugauggcugcgccaucagggcaaaacuggaaguuccggggcuguccuaaccccagcagguccuuugcucaagagccuggggagucacuggcuacugcuguuuucccuucuucuggacccaacccgagccccgcuccgcgcgaguaaagcucugaagaugugugucagggcgagacuccuggccuggcacacgguccucgccccaccagccccagcccgggccgaccucucaccugcuccuccagcgggagcggcuugagaggacuccgagccccgugucgaaacacgaccugcaccauuuucaacuucagcaggcugcggucgaccggacacuggccaucggccuccugcagcucggccagggccacccgccgcuggugcaggcaguacgccagcgaggucaggacgcccacugggguccacaagcgcaugcugaacacaccagugaucauggugguaggcccucgcugcccuccggguugaggcugcaggaggcaaacacaagucuucugcgggcgccggggcucagcgggcgcccccaaguccgcgggaaccugcggaugcguacauccagcccuucagcaagcagggaccgcugugccucccggcccugagggagaccccgagugggaacgggggagagaacaagagguggcagcagcgaagagucccugggaguuuuaacccgggucgggguuggucgcuccugcugcacaccgggccgggggagaucggauccuuaucuuuugcccgacgaggaacauuaaacuuguauuucaaguuuggccuccagcacucuugaaggaacaggagccggcccugaguucccuggcggcagcggcuccaccagcaaggacuacucgauuccacuuuucuauaagcaagcuccuacccaccuccucaccuacucagggacccgucccaaguggacccgcg

SEQ ID NO: 13756 - RNA, 1928 nt, Homo sapiens
cauggcagacauuguuuccucuuuucacagauggaacuuucugcucuacaguccaugauggcugugcaggaagaagagcugcaggugcaggcugcugauauggagucucugaccaggaacauacagauuaaagaagaucucauaaaggucuuucaaaacuuuuuaaagaccacuggaaauguucacagcucagaauaccuguagggccucuucagacaauauuugcacacaucgaaucccuuggccagugauuauccauaucccacuugaaaguauaggcagaauauuucaagacauuuguucccgugcuacucugcugaauaauccuuuuauuacuauuuucacauccauacuuauuuuuugacuucuaggaccugcaaaugcaacugguugauccugaagacauaccagcuauggaacgccugacccaggaagucuuacuucuucgggaaaaaguugcuucaguagaaucccagggucaagaaauuucaggaaaccgaagacaacagguaaguuacuggaauauaaaccuuauuuauuuauuuacauuuuuuuguauucuuuuuuuuuuuuuuaguagagauggaguuucaccauguuggucaggcuagucuugaacuccugacugcaagugauccauccuccucggccccucaaagugcuggaauuacauacaagcaugagucaccacauugagacaaggucucacugugucacccaggcaggagugcagugguaugaucacagcucacugcagccucaaacucuggggcucaaggaaucuuccugccucagccuccugaguagcuggagcugcaggugcacaccaccacgcccggcucaaaccuuauuuuucuacugugaaauaaaccaugguaaagcugucaaucucagcuauuuguggaggguuaguugaugguauuuccuagagaaacugugcucuaaaauuuccuacuuuggucgguagcagcuauagaugccccuuucugacauuuguaguucugaaaagagcagcaguucuuuuggacacauaccaauaguuaucccucacacucauaccuaagucaccucccucaacugaaucuuucucuuuuaucugcauuuaaccauguucagaucucucccaguuaaaaaaaaaaaaaaaagagaaagaaaccccuacauuugccccaaauuucucuguagcuacagccccauuuaaccuuucuucaaugccagacuuuuccaaaagacuuacuugccuguacucccugucuccauuaucaucugucucacuaacuacucaccccacugcauucuggcuuuuaacuguaccuuaaacaacucuguugauuauacauugucauagcucauuaucuuuauagcacuuauuacacucacaaugacacacaucuaugauuaaugaaugucuuuuuccuccacuagauaguaagcuuuccccuagaaccuagaacagagucugucccguagaacgugcucaguaaauauuaauugaaugaaugaagaauacuaguaaguccuauuauauacauuucccucuuguccauccuguuucccucuuacuccuuuuucuuagcugcuuuccugugcuuccagcuucucucugcuuuuucuucuuuuugcucccauguuugaauuccaccuuacagguuuuaaagauaaaaaaaagauaauaugacauugauuugaaaacuauaaaauaguaucaaaagcuuaaguacuaagauagugggcuuuuuaagucauaguacaugcuaaugcauuuucuuguuucuuauucaugucucacugugccauuugcguauugcuuccucucucuucuuuacucaguugcugcugaugcuagaaggacuaguagaugaacggagucggcucaaugaggccuuacaagcagagagacagcucuauagcagucuggugaaguucca

SEQ ID NO: 13757 - RNA, 20409 nt, Homo sapiens
cgguaguggaaagcucuugcgcuguuuccggccaccucagcgggaagcggagacgcaagcagcuggaucuccgguaacugagacauaggguauaacuguugucgcggcggaggaagugaggacggcgccaagggccuuccgggccaguguuggaucccuguaguuugugaagaugguguugcuaacaaugaucgcccgaguggcggacgggcucccgcuggccgccucgaugcaggaggacgaacaggugagcugcuuacucacgacccgcgaccccaagucucugucagcgcgcuuugcccucagcaucggauuccuuccuaggaccgggagaccuuugugacuucccgggcacucccgaccucucugaagugcgcuuuuaucuuuugguguaggagagacuaccggcgaagaggaaaucuuuccugaaggaggaguuaaguuuuuuguguuagcuguuucucuuuagaaaaacgcucuggagaagugguagcuuugguugauugugaucacccaguguucuuugacucuuuagggacuuuguuaaaauucaggauuucuaauuuucugcugcuaauaggacugcugauggauaaauccugggaaaaaaucagccaaguucuucaagucuauaacguggcaccugauccuugaccuagcuugcugacaucuuuugaaagugggugagguaauauugccacauaaaagcaccuguuaaauuucaguacaucacauucuuucaggauuauccccaguucccaccuucuccaauacgccguaccacauuccugcaauacauuguaacuuauuuuuuucuuugucuuucaauaacuugaguuuccuagcgggcaaacgacgggucuuaaucaucucuuuguuauccauaccuuuuacaauagcugcuuuaugcuaguaggugcucaaaaguauacugaauugauuaaaaacagcacuaacuccagaugucuuaaaagaaagauguuuuguguuuuagaaacacaguggaaauuucugaaguaagacaaguuucuggagcaagcuugggagguucugaagacaaagcugagaauggaauuuauauaauuuguuuaaagugaucaauuuuauuuuacuuuuccauacagucuaaguaaaaccuugagccuuaaaaaaagaugagauauugaaaaaauaguuugcacauuucuucuguuggacuuuucauucauauauuaaugcaaaaaauuuuuacugagcacaucaaaugugccaggcauaguguuaaugcagggaguuagaguacacagucucuaccuuuguggagcuuacagucuaguggaaaaaucagauaaccaacaaacuauuaaaauguaguuuaacugcuaaggagaaggaagaggguuuugugcuugaacauggaaaauauaucuaaguugguuuuaggaaaucaggaaagucuucccagaagguaugacacuaagguaacaguaggauccaguaguaaggaacuauuauucuauuugguuauaugccuuuuuagguuugauuuggaaauauaguuacuuucacuuuuaggagaguggugauacagauaauaaaguugcaggucaugcuaagugaaauauauucuauucauuacauaaaaacaaagucuaaucuuugaaauaaaccgugaacaauuuaacauaccccgauuugcuaaugugaaauguuuuucaggaauacucuaggaccauccugcagaaggaguguaauuguucaaaugaaccuaggaauaugauuugaacaaaguagauagugcaggggaauauccuugaaggauguguaguuugacuaaaaaauaguuuuccuacaguggguggcuguguguuggggguaggggggauggaaucuggucaauuuuuaaauuauugcauugaauuccaguguuagcaaagaauacaaagugaacuugaaagucuacuuaauauuaguggccccuacucucugccaugauacuuuauugaaaaauuaauugauuuauuguuuuuuaauuauaaauuugguauugguuucauauugguuuaucaagaugggaugcuuuguuuaauugacaaggaaagaaauuuuacacacaaauauuuuugugauuguagugccauaguauuuuccuuuaggaauuuugacuuugaauaauaaaguuugccuaaacuuuuaaugucuguaaagaucugaaucuuaggcuuacuuuuacuauuuuaauaguauacagaacauuuauaaaagcgccuacuacauaccaaacacugugcuaagccuauuaaguucauuuuuuuauuuaauccucauacuaccauauuagaacagguacuauuaaaaucuccaauaauagauaaggaagcucugaggcuuagagaggauagaucacuugccuaaauucacagcuaaugaguggcauaaugaaauuuuucaucaggguuuuuccccuuggcacuguugacauuuggggauggauaauuauuuguucuuggggacuguucuguauauuguguaggagguccagcaauauuccuggccucuacccucuagaugccaguaguaccacuacccuuccccacuuuguuuguuuguaugacgacaaaaauauuucuagacauugcuaaaugucucaugggggcaaaaucaccccaauugagacccagugguuuuuauuaaguuuuugucgacucagacaaaaacuuaauaaccacuguacuuuagugccuaaccacuguacuuuacugccuuguucuaaggccuuuuaaugaugucuuaccucuuaggaguccaggaauaacuuuuuaauaaacagauaucucaaccaaacaguuuuauauuuaaucaccuuaauuguccaggccagauaauucaauguauuuucauuuuuguauguuuuuguuuucuuaucaguguacuuucaguauuuacacugauaauagauaucauauuuuagguauuuacuaggugccuguacaagcugccauauuaccgaagauggacaguuauucagauaauacaauagagaguaaaauuuacaaaauaauguagacagaguauuuuauacaggguguuuccucuguguuuaacugaaaauuuagacuuagggcaggaagagagaugagcguuucuucucaaauguggacucccuaacugauacccuguuuaucuuuuuuccucauuccuuuuauggcauguuucuccuuuuaggauuuuugcaauuucuuuaucuaccuuucuguucugccucaaaauuauuguauuuucuuucauuuuccucuggcaucgugaagggcaguccagacuugaagaaaguguuagaucucaccaaauaggcagcaggaagcuccaagaaagcagauagauaacauguuauacaguuaaauugucucacgcucccaaucacugaggguugauuaauccacuuacuguaacugcuuuuagaggaaagugguugguucuuggugcugcuggucuuugaccagcugaguucaguggguauugauacccacugaacucagcuaugaaaaugauaagagcuaugaaggcaaaaguuguuauugauacaacuaguuguucagcagucuuaggugacagcaacgaaaaguauugcgguugugugucaaguuacuaccuucuaucuuuuguaauauauagauccaaauccuacauuugcuguuggauaaccucaaauuuguuucacaguuuuuccaguuauucugauccacugcauuauuggauuacuaauagauaucucauaaucauaucauauacaaauuucauuaaucuuuucuagaugaaguagaaaacacaaugaggauaucuaaauauuuuuagguggacuggcuaacugugggcccuuugugacuuugaucuugaaagcaaacuaaaggucaguauguaaaacagugguuagguuguuuugugagaucuagaucagagcugccccaugguuucuugagcauuuccaaugaguuagaauuacauaguaagacuucaccuaaaagguggaucuacuauugaaacaauuucaauuauagaguuaggguagcauaaugcuuaggaguaggggcuccagggccagauugccugcauucagauccuaguuccucccuuuuuagcuuagaggcuaaaaaguuugacuucucaaguaaaaaauugacauaauaauucuaaucaccucaugaagaauaaacgaguuaaauaauguaaaguguucagaacaguggcuggcagaaagugaacacuuaauaauuucauuugaucauuucugaagaaucuuuucuaauuccaucuugccuuucuuuuuuuuuuuuuuuugagauggagucucacucuguugcccaggcuagagugcaguggugugaucucagcuuacugcaaccuccgguccccagguucaaacgauucuccugcuucagccucccgaguagcugggauuacaggcaccugcaacccuacccggcuaauuuuuguauuuuuaguugagaugggguuucagcaucuuggccagucugaucuugaacuccugaccucaugauccaccugccuuggccucgcaaaguacugggauuacaggcgugaacccccauacccagccucaucuugccuuucuuaaagguucacagaucagaacugcacauaaucgauacacuggaugcaaauauguaaugaaugaaugauuuuucacauuacaaaauuaauuugugcguauuauagaaaguucaguaaauacauaaaagcaaaaugaccaaaauguuaacaguguuuauuaacuauaaucuguacucaaauuauauccauuuugguggaugaccuuaaacauauguauguguguauaacauuaaauaauagguaauaccguaagacuguuucaccuaauuuuuuccacuuaacaguguuuaaugaauauuuucucauaucauuaaacucuauacagcauuguuuuaauggcugcauaguauuccauuguaugaauaugccagaaagauuauuauuuaaccaugaagauugugcuagcauuguguucucaaggaugguaaugcuaacugaaccagcaugguaagguguugguuggcauaccauaaucccuauaaauacauccccaguguuguauauuggcagucuuuacauugcuguuugcaaauuccugaaauugcagaaugcuuuuggccaguuucuuauaguugauacaguuguuagucuuuuucucagguuacaguaauguuuacagugccucuuguaaagucaaaggauuuguaccaaucugaguggcaauuuuuuccauguuucuucaacuaguccuuuuaagauucucaccugccuuuagcaaagaacauauauuuaacaccugugguugcaguuauguaaaaaauaccgaugucacagccccaccuccaagaugcugacuuaauugguuuggugguggagacugggcauaaguaguuuuguuuuugagauuuccccaaaugauucuauugugaagccaagguugaaaaucaccgaucuauguugauauucuuucuuggcacuugaguagcauucccaacauuauuugcaugcuuuuuaucuacucuuguggguucagaucucuucagaauggcacuggggaaacaaaaagauugguaaguaccauucaaauuuaggaaaauagaauauugggcacuaguucuuauuggcuaaaagcauaugacaguauucacucuuacuggcuggccauauauuaguaguacuguuuaauaugauaauuuugauauaauuauuauaaaguacuguuuaauauauaaaacuguacauacauacagacauacauauguuaauauagaacuauuucucaaauauauaacaaauauaugucaauaaaacaaauaauugccauaacagugguauuaaacaagauaaaucuacaaacuaauaccucgacuggacucugccuaucuccccugguucaccucaugcuuauucaccuucuuauucauacugaaauuuccaguucaccauuuuuacauauagcuuagaaucuuauuauccuguaauuguacauuugcugaucugccacuuuaucauuuuauuguugcuuccuuguuuuuauuaucagcuuagcaguacacuaucuacaauuuuaagauaucacuuuguacuuuaucaaaguuagaccucagauccugggagacccuagcauaaauacuuuucuacuuaaauauuuaguuauuaaacaucugccaaagggaggcuauucuuucuauguaaaauaaauaauuccaaaauaggauuauuucuuugcaucacauggcaguguccuagucuggguuacuauacaaaauaccauaaauuggguggcuuauaaaugacagaaauugauuuuucuaguucugcaaggugaagaucaagcaccagcagauuuggugacuauugagggccuauuccugguucauagaugucaccuucuggcuguuuccucacaugguggauggagcaagcuagcccucuggggucucuuuuauaaagguacuagucgcauucaugagggcucuacccucaugacuuaaucaccucccaaaggucccacuucuuaauaccaucacuuugggggguuaggauuucaacaugaauuuugugggggauaccagcaaacauucagacuauagcuggguagcuggcagaaagcuccccuaccccacauguggauggaaaaacaaugucuauuugcuucccauucuucaggcacuuccuuucccuguuggaucuaguagauuggagaugcaugguuuucuucuuuugaaaugacacugcugguuuuuccaguagauuugcccccucuuuuuaacaaaaauaauuguaaaagcaguuagaaauuguucaggaaaauauuaccuguaauuauaacaugugaaugcuauuauuuucauuuuugucugcauauaucccucgauauucaaacuuuugcuguccaaacuugggaaccaaauagauuucuucaguaaaggguaucugacaugcuaaucuuugucucuacccuuggucauuuuuauguaauugcagucaaaguguucauaauaauuugcagucacuaguacacacauuuaguuuuguuuaaaugcuaaaaacuguaacacuuguggaagguucugcuggauauuccaacauaaaaaugaaauucaccaaucuuguuccuaggauauuccccugaguauagcacaugcuguguaguucugugccaauaacugcaaaugaaauggguuaggaggagaguacuguccuaauaguggaaagaagacuggauugaaaguuaagagugcuuaaguguauuugagguauaugcuuuugcuucuuagcaaauaacuaaugcgaucaucuugaagaaguagggguuaggucuuccucuguacucugaaaguagguugucuuuccuccguuaaaaugaaucuuacuuaccuguaaaugaaggaccucauucagaguguccucauaauauggugcuucucacuaauugauacagcauuuuguggaaaauucuuaaaugaagaugucuucuuucagucuggccgggaccuucaacaguaucagagucaggcuaaguaacucuuucgaaaguugaaugaacaguccccuaccagauguaccuuggaagcaggagccaugacuuuucagugaguguaaucuugauuucuuuaugaucauuuaagugugaaauacaguaacagaaugccugauaaaaaauaauaauuuuuaaaaaguaaagauuacuuaaaaauguugucuuuugggaggagcaacuucucuggcucuaauucuacaaaauggacaucuuguugguuuuuucagcaugcuuacaguaauuuaaccuguuaacaugugucuaugcugugcccaucaugcaauaauagauaacuucuugcuuuaggacugucuuggagccagauauguguagguuaguacccuugcucaaacauuuccuaacaguguaacuuugagcagcucacauaacuucucuaagccucaguuuccucuauaaaguagugaaaauaaacauaggagguuugagaggauugugagggaauccguguguauuacuuagcaucuugucugacacacaugggaagggucaauaauuauuaguuauuauuauuuugaaaaaagaaaauuauaaaagauaagagcaucuuaaucagugguuauaaacgauacagcugauagaggacucaaaggaacauuauuggauuuuaaauuaucuacaaauaauugguauuuaauguuuaauacaugccaaguuugaagcugacaaaaugggaaggauuaaaaaggaaaagaguacaagagcaucagaggaaaauaaaaacggauuaguuaaauaaucuuugcuauuuuagggacuuagauaguaagauaacuuaggccagggaggaagcugcuauguuuacuuuuaaaaaacaaaacaaaaauucucuaccuauaaaagacaaguaaaaaguacaucaaaacaaaaauaaaacccuaggcaauuggcuaagaaaauguuggacauuauguuuuaugauguauuaauuuuuauaauaucugaaauauuuucuagaacucuaauuuucaacaccaaaaauagucacucacuuaauaucuaguauccucauuuucaccaugguuuagagaaccaagaccuaggaaaguucucauggaauugagaagagauuuucuucugccugauuccuuuaggacauucauaaucucauaucauccuuuauuuccauccaagagcuauuaaggguuuauucuuugccggaccuuauauugaguccugcauuuaauguccauaccuuuuaacacuguucucuuaguacagagagagacauauacucaaacaaguauacuauaauaucuucauugaaaagauguuguaaauuagauuuaaaugaaauguuuugggaacagagagaaggaaggaacaaauucccauuuguaggggguaaguuugaagaaacgggacagaggaggggaguauauuuaaagaaguuucacagaaaaaauuaugguagaauugaacauauggaaaugaacaggauuucuccagguauuuaaaagagcauuaaugguuagaaaaaacaauauaagcagaaguccacaaauauguaaagaaccuagcauguuggaaaacaguccgccauuugguuuauuaaaauauaugauagaauguugcuuacacuuguuuugaaaggcuguaaauauaauaccauggaguaugauuuuauuuuguagguauuagggaacccuuagaguuuguaagcaggguaauauggucaucuguagucucugggaauaaaacugaugguauagaagaugguguagacuaaaagcaaagagaccaguuaacucaggugcccaagcaaggaauaagacagcuguauuauuaauauuauuuuaagggaccugagagaucauauaauagucuuuauccuuuauggagcccuaggaugccucaggagccacauagaaagggcaaggaugggaguauauauaaugcuuugggccccuaaacuccuccuuauguuuuaaauuuuuuccuuuuauuuucaguugacauguaauaauuauacauauuuaugggauacagagugauauuucaauacauguauacaauguguaaucaaaucagaguaauuagcauauucaucaccucaaacauuuaucauuucuuuguguugugaacauucaaaaucuuguagcuuuuugaaaauacgugguaaguuauagcuagccauauuuacccuacaguucugcagaacaccagaacucauucuuccuauccaguuguaauuuuuuauccauuaacuugccucugcccauccuccccuucucucuaccuuucccuacuucuaauacccacaauucuacucucuacuuccaugagcucaaaaauuuuuuuuggcuccuacauaugaaugagaacaugccauauuuaucuuucugugcaugacugauuuuauuuaacguaauguccuccagauuuauccauguugcugcuaaugauagaaauucauucuuuuuuauggcugaauaguauuccaugguguguguguauguguguguguguguguguguguguguguguaaaaaacacuuuuaaaauccauuauucucuugauggacauuucucuugauuaucuauccauagauauuaugaauggugcugccguaaacauggggguacagauaaguuuuuaacauaaugaguuuuuuuccuuuggagaaauacccagcagugggauugcuagauuguaugguaguucuguuuuuaguuuuuugagaaaccuccauacuguuuuccauaguguauaaaaguucucuuuucucuucauccucaacagcauuuauugacuuuugucuuuuuaauagacauuuuaacuggggugaaauaauaugucguugugguuuuuauuugcauuuaccugaagauuagugauguugagcauuuuuucauauacuuggccauucgcaugucuuuugagaaaugucaauucuguuccuugccuacuuuuuaauugaauuauuuuugguuuugcuguugaguuguuugaguuccucguauguucuggauauuaguuccucaucagaugaaugaaacuagaucccuaucucaucauauacaaaaaucaacuuaaaguagauuaaagacuuaagcauaagacccuaaacuauaaaacuacuagaagaaaacauaggggaaaugcuucaggacaugaaccugggcgaagacuuuauggcaaagacuucaaagcauaggcaacagaaaagaaaguagacaaaugggacuguauuaaacuaaaagcuucugcacagcaaaggaaacaacacagugaagagacaacuugcacaaugggagaaaauauuugcaaacuccuacuuaaacuaaagaaccucugauuuuaucugauauauacauuggccuucugaauauaaguuuugcuuguuauauauacauauuccauauauaaauauauauauuugcauguguguguguguauacuauggcuaaaaagaaguuggaaaaccacuuaguagccuaacauuuuucuaagaauuucucagauguguaaucauauagccccuuccagagugcaugggcgcucaucaucacaaaagaaagucaguuccauuguugaaaaguuuccaguugauuacagaguccuccuggacuguaaauuaaggagucuuauuagucuuguacccaguaaacauuaugucauuaaccuuacauuucuauccacagaaauuuccaguuacaguguuuuccuuuguggcuggaaagaguuuaaauauguguaugcuaguuuaccauauagaaucaaaggguggauggagucacaacucugaauuuuucaggaaaaagucuuaaguauuaagcaaaaaacaaauaaccccauuuaaaaaauggacaaaagacaugagcagauauuucucaaaacauacuagaggcuagcaaacuaaugaaaaaaugcacaucacuaauuauuggagaaaugcaaaucaaaaccacaauaagauaccaucucacaacagucacagggcuauuauuaaaaagucagaaaacaacagaugcugaugaggcuguggagaaaaaggaauugcuuauacacuguucgugggaauguaaauucagccacuguggaaagcaguuuagagauuuuucaaagaacuuaaaacagaacuaccauuagacccagcaaacccauuaauggguuuauauccaaaaggaaacaaaucuuucuaccaaaaaucaugcacuugcauauucauugcagcacuauucacaauagcaaagauaucaaccuagguacauguuagugguggauuggauaaagaaaauauaguauauauucaguauggaauacuaugcagucauaaaaagaaaugaaaucauguccuuugcagcaacauggauggagcuggaagucauuaccuaagugaauuaaugcaggaacagaaaacuaaauacucuauauucucauuuauaaguuuauaagcuaaacauugggcacucauggacauaaauauacugaggacuuacuagaagaggagggaaggagggggcagggguugaaaaacuauuagguaguaugcuuaguacuugggugacgggauuguuuguaccccaaaccucggcauuaugcaauauacccagguaacaaacccgcacauauacauccucaagcuaaaauaaaaguuuaaaauguuaguugaagaauuguguaaugggcuggguccaguggcuuacaccuguaaucucagcacuuugggagacugaauuggguggaucgauugaggucacgaguuucagaccagccuggccaaaauggugaaaccccaucucuacuaaaaauacaaaaauuagcugggugugguggugggugucuguaaucccagcuauuugugaagcugaggcgugagaaucaccugaaccugggaggcggagauugcuguaacugagaucaugccacugcauuccagcccggguaaucugggugaucgaaagagcccugucucaaaaaaaaaaaaaaaaaaaaaaaaaaaaaagagaaucuaauggaugaaaaauuauaauaaauaugucuaaauacuccuuuuagaauauacggcuaauaggcugggugcaguggcucacgccuguaaucccagcacuuugggaggcugaggcgggcggaucacgaggucaagauaucaagaccauccuggccaacuaacguggugaaaccccgucucuacuaaaaauacaaaaauuagcugggcauaguggcgcacgccuguagucccagcugcucgggaggcugaggcaggagaauggcuugaacccgggaggcggagguugcagugagccgagauaaugccacugcacuccagcccgggggcagagcgagacuccgucucaaaaaaaaagaaaaaaaaaaaccaaaaacaaaaaaaaaagaauauacaucuaauaaugggaagauguuugcuuucugauuccaaggauuugcgguuuuaaauugacucucguuuagccagccucaaaguauuuaggcuagauuuuuaaaaaaguuugcaugguacagagauucugcuuuaaacuauugucagugcuauuacuuuacagacaacuuugucuugcuuuuuaugucucaccagcuacauuauugagcagggggugugugauuugguuuuaugugaagcugccuucccuaagacguuggcuuuugccuaccuagaagauuugcacucagaauuugaugaacagcauggaaagaaggugcccacugugucccgacccuauuccuuuauugaauuugguaaguuuuugccccucacuucucucuaucaagggagcaaacaauauggagaagcuauuuguuacacugauauaauauuuauacauuuuuucugauguuuacuugcugaaguuuuagcuucugcuuccuuuuccauuccacuucuuuuugucuuuuugagugacuaaggcuuuguucugaaaaguaauuuucucuagucuuuugaucuuucccccauagaaauuguugccuuuugcccuuucuguuauuugguuugauucuucuuuagagucacaugugacaggaacuuugcuaaagaucuacuugauuggcauauaauggcugaguucuucuuuaccccaguccacagacucacacucacaauaaggcucauuuuauggagaucagaauugggaaaucagaaagaaugauguuuuguuucuuuuaguagaauaagauccucuaauuaaaaaaacaaaacagaacaaagaaauagaagauaccugguacucaugguauugggguauaauauuuacuacauucaggaauggugagcauaggugucuguauuuguacaagaauuauagaaagacuaauuacuaaucagaccugguaaaguaucugaugguaagggaucaaaggaaauguccuaaguacaguaaguacagggagugagaacaaguaggaucaggcuauaucgcugcaauuuuuaguuaaaagagaaauugguuuuacuggcuuagaauuuuugaaguguuucaaguuugcuagauaaaugggucaucuugcuuuggaaaaacacucuaguguuucauaacuauauacucuccaagugcugcuuuauauaauguccaguuuuucaaauuuuauuuuuauagacaguaauacucccauaaaccucccucaaaaagaagacaaauguaucagggucauacaggaaacagauggcacacccaaauuagcuuaagggauuauauacaaagauaugacuaggcuguaggagaauuacaagguacaguaaccucugaccaguagcauacugguuguuaccaucccuaggccugaauguauaagggggaggagcaguuucugaaacugaaaaggagaaaauuucuagagaaggccaacuugagaggagcguaacuuuugguagagggauacuuccagaagaagguuauuuccuucucugaaagaagccaggggaauaaauacccggacaucacucacugucuguucuccuucuucccuacuguuggggcuucuucauugccugaaccuaacuggcacagagcaaggagucuauugaggcgcuucauccaagucagcuucccagugcagaaagcaaggugcaggagggcagagaggagaucuaaagaggcaaaugaaagggguacagcacacuuaaauuaagauuuuugccaaaaguugaaaauaucuuuaauaauaagucguucuuccuauaguuuugagaaauacugauaugagcaaaagauggaugagacuucaguuuuuauuuauuuauuuauuuauuuauuuacuuagagacagagucucgcucuauugcccaggcuggggugcaguggcaugauuuuggcuaacugcaaccucugccuccuagguucaagugauucuugugccucagccuccugaauagcugggacuagaggugcacgcugccaugaccagcuagcuaauuucgguauuuuugguagagaugggaguuuugccuuguuggccaggcuggucucgaauuccuggccucaagugauccacccaucuuggccucccaaaaugcugggauuuauacgugugagacacaguaccuggccgagacuucaguucaguuuuauauugguauuuuggaaaacucccuauuacauacuugcuuuaccugagguuuaagaauggaaugaaacugggaauguauauuagagaaaauaagguaaaguuucucagcuuuuuaaugaucaugagcccuuuugccauguuaggcuguaauaaugcuagaguguuaccagcauccuuuuaaggaauguguagagguaaguaacacuuagccuaaggguccucagaauacuguuugaaaauuucuguuuucaggaaaggcuuacuauagugggucuuaauuccucuaaggauucugauagcagccuuagauagcaaauacuucuaauuuaaagguauucaaaggacauuucuccugaauggucgucuaauuauaccuuuacaucuuacaaaugaaauaaucaaagccuagauuuugauauucaaccaagaguuugguuaaccauggacaguggcaaauccaggaauaaagucagaacuguuuugguuuuuuuguuuuuguuuuugagacagagucuugcucugucacccaggcuaaagugugguggugugaucucagcucagugcaaccucugccucccaaguucaagugauucuccuggcucagccuccugaguagcugggauuauaggcgugugccgccacgccuggcuaacuuuuuauauuuuuaguagagacgggguuucacuguguuagccaggauggucucgauuuccugaccucaugauucaccugccuuggccucccaaagugcugggauuacaggugugagccaccgugccuggccaacucagaacuuuuaauuuccuaccucaguacuuugauggccaugaaagaaauggucaguuuucuucaucauucuagauacuuucauucagaaaaccaagaagcucuacauugacaguugugcucgaagaaaccuaggcuccaucaacacugaauugcaagaugugcagaggaucaugguggccaauaucgaagaaguguuacaacgaggagaagcacucucagguaucuaaaagcaaugagucuuaugaagaaaugguucucauuccauagacaaggauagcuuauuuugcagugccuuuuaugcuauuagauucuaccuagaacuguuaagaauuuaucucccagaaguacauuacauuacaaugcuuccaauauauuuuuuuuccuagcaugauuaguuuuuguugaguuggaacaguguaaaggacucauccauauuagaagcaaugauuauuucuaacauauucacaaaauuaauuaaauuauauaacuuguauaaauuaagggaaaugaaugagagaaaacucaacaauguauugcagugguuuuuugaguagccucuuugggagacuuuacugcugccagaucaaucuuuauaaaaugccauuuucaucaaagcauuccucucugaaaaacuuuuaaaucugggacuacaagauaagauccagucugacuuauuuuuccgucagucagccauuguuauugagagcuuguuauuuguaaggcguugugcucuacauauggaaaauaaggaagaugcaaaugucugucauucucuaguucacaaacauucuucuguagccacaccagcuucuuuacuauccuuagugguccuuagaacagaauacugccuuaugcuggaccuguucuguauguaagaccuccauaagaacugucucuuuaaagaaccuuucucugauccuuauagccuguaucacauuaaucucuucuguccuuuaaacuccuaaagcacuuaguaacauaaugguuuuagcacauauuacauguauguguguuuaccuaauuuaccuuaaauauauuuauuaaauaccucuuaccauauuaaauauauauuuaauauauauuaaauauauuuccauauaacauaaguauauguuucauauauuuauauuaaaguaggcaaacauauuuggauaauuaaauauuuuuauauaauuucauauauuuuuuugagacagagucuuguucuguugcccaggcuggagugcaauggcacgaucuuggcucacugcaaccuccaucuccuggguucaagcgaucuucccaccuuauccuccugaguagcuggggcuacaggcaugugccaccacgccuggcuaauuuuuguauuuucuuaguagagaugggguuuugccauguuguuccggcuggucacaaacuccagggcucaagcaauccacucacuucagcuucccaaagugcugggauuacaggcaugagccacaacacccagcccuuuauauaauuuuaaaaguguagguaauuagguaaaauuagguuaaaaguauauguauauuuaccugauauuuaaauauuaccuaaguguuuaauguggacauguaagcucuuuaaagauagugcuuauguauuuuauaucuguuucacauacuccuuauauaucccccacagaaauggucacaaauagguuccuuaauaaguauuuuugaauucagccaugcuauauauucauuaguaagugaguuuucuuuuauuaugaacuacaaacuuuaaccuuuuuuugaguagugagcaguuauucauuuaccuucacacucuuuaaauaccaaauuuugagugagugaguguguaagguuuugucauacagacuugcaauuccuauaugggauaaaguagacuagcacaggaauuuuucuuguaucacucaugcaagacucuaaauuccuuaaaggcagggaucauguauauuuugaucacuguuguauccucagcacuucacauggugccugucacauaaauauuuguuaaaugacuucuccaagcaauagcuuugucuuuauguuauccuguauuucaaaacguucauauauaaauucucucaacuaugacuuguuucauagggucuaauaauuguuccucugcugaguuauucucagcagauuuagauucauuuagcaaauguuuauugagcacuaacuauauaccaggcccuguucugggcauucaggauauagcagcaaacacaauaauuuaaaaucccuguccagugaaguguauauucuuguaggcucuguaaaaagaugcccugugcauugucaugguuauuucucagucccugacucuucuuccgucacuagauguuuuucuuacucaugugaucaguugcuaauucagacguggcugucaugccuguguuauuaaguaacgccauguuucccaaucaaaaccagucucuauuaagcaacuccaaauauuccaaaagcauucuuuaaggaagaaacagccggauugcaaaauaguuuuuucugaaauuucaagaagugaaaaguuugaucagaauuuauuaugucaaauggagaguuuguguuuauuauuaaaauaugcccuauauuuuaauauggucuagcuugugucuaucuggcuauuucucuaaguguuuaguuaacuguuauaagaagauaacaacauuacaaauguccuugggggugaaaaaacuugccagaaaauacuaaaaagcuuaauuuacuugcguuuuuuuuuguaguacuuauuguauuuuaguuacaacuuuccuaugucuauugaaauauaaauccugauagcuuuaacuucauaguagucucuacuauguggagaaucuuagaaauguuagcagucaucauugaaguauagcuuaagacuguguuugguuaauugaauuuucugguuaucugaguuuguuuuacauggauuaucauuaucguuuuucaaaauauaagagaauaugauucagaccauuagaagauuaugaagauaauaauuauuaacauguaauaauuauuauaauuuaucaugugcaggcauuguugcucacuuuacaggcaaucucauguacauacaacuuuaugacauaguuacuguuauuauccccaauuauagaugaagaaacuagguuuuaaauagguuacaugacuugaccaaugucacauaacuuguacaggugauaucugaaccaaagagucugaggccagaaccugcacuucuaaccaccuuacuauauagccucaaaaauucagacauaaucugaucagcaucaucaguuaauuaguauaugcaauguuagccucaaaauaaaaaugaugauuuaagauucaugguuguugcagugcugcucauuuugguuauuuuuaaugccuuaauacuuucgguaaaauacuuccagggacuaauuaauguuuuccuuuuuuccucuuugacagcauuggauucaaaggcuaacaauuuguccagucuguccaagaaauaccgccaggaugcgaaguacuugaacaugcauuccacuuaugccaaacuugcagcaguagcuguauuuuucaucauguuaauaguguauguccgauucugguggcugugaaauaaugaauacagucacugguaagggagaaccuagaacccaguagguguauauuuucaggaaacugagcucacagagauguguauuagaauccaaguggaacuucugccucuaaagaccuugcaagaaaagagauguccugaaaaugaaagguugcaccucauuuaaugaagcuuaacccuauguagaaagucucuuucgggggcagaggcuuucucugggugccaagccauauauauuagggaauaguagauuguuauuucguuuuuucccucccagugcauuuuaaaaacagcacuggcuggggcauucucauucucugauggagccaucaaugagauuuaacuuagucaaccugugcuagcaacauucugaaauuccuucaaagaaggcaguccuuugggaagguguuuuuuuuuuuguuuuuuuguuuuuuuguuuuuuuugacucuaaucaacauuccuuuuguuggugacauuugugauuuucaguaaucugaguuuuugauggccuuuuaaacaagacuccaguaugugaaaguuaauugcugugcuccacagaucuugucuauuggccccuguagaaaguuaaccuuuguuguuuuccuuuuauaauuugcuuauugcacaauugcuuuaggguaagugaauuauauuaagaugccuugaaauuauagcacuccuugauuaagaagcuaaaauguuucucucauuuacuccuuaaacaaaagacuuaaauuaguuugggucauuauuacuuuuauuuugcagcauuugguuuguuauuaguguaagagcaaguauaggauauggagaggccccuggcuucaugagaacaaaggcaggcccagguuauaauuacagcuuucuccugccccuucuuuacuuucucua

SEQ ID NO: 13758 - RNA, 1477 nt, Homo sapiens
gccacaauuugcuaacacuuaaaaaauuuuccugcacccaguaguuucauauccuguagacauccucuuaggacauucucaaauuucaaaauaaaaaauauucaucuauguaguuaauuaaaguuaaaguuucugcagaucaacuacucaaacuacuaaauacauuuaccugagaaaaagucucugagagcacuucauuccuguuuuaguucguguaaauucucugagaauguucuggagauagauaacucauuuacagugguuucuauuaacuaauuaaaguacccaugauuuuuuccuuuucugcucagggaugauggagauuuccuuuuaccuuuuuuaaugggguaaauuuuuuaauggggaaaauaggccuuuuaaauauuauugccagggucugcaauauaacuuaaaauuccuguacauacugcaaauauuucuuuaaauugcacaggaaaaugagcgaacuuuuuauuucuuaauaucuuuggcaaaaaacuuuaaccaguaagcaauuuuauaacccugagggaucaucaaagauacuauccugauuccugguaaggaaaaauauauuauuuccuuauaacaaggcaaggagaaaugcuauuuuauuccugauaauuuauauagcuagaauaauuuuuuuccuuucuuuuauggaccuaaaucugccaauugggaauuuugugcaugaaauaugaaguuacuuuuuauagauaaucagugcuuuuaagucccuaaaaggcuccugcugaaguaaugaugauguucauaauaaaagccuuugaaaggcugaaaaccuacauagugguaccauaguauuuggagcuucuauaggaguggagaggggcagcucauuguugagaguugcaugcugcaaccuaauggucagcaaugaaagaaauacuuguagaauguucacuucagugugaaguuuuguuaucuaguuaauuuauauacauauauccuuuguagauacauuucuaucuaaucuuguugagcuaauuaagaaauaaggggugggguaauugucaacaaagggagaagaaagugguuuaagaucagggcagcagaaaaauuagagaacaagaauaucauaauauggcuccugguuuucuuuauaagaggcagugggaagaucugacuagaugaaauguaucaucaaccaaacuggcaucuaaaauagaaugggauaaauacuguaugggguuauuggaggcauauuaagaaaggacaccuaauuuauuuugggaagaaguauguuaagagaagacuuucuagagaaggagaauggggcauucuaggaagagucaauggcaugugcaaaggcaugaauaaagacagugaggcauguuuuggaaauguaacagcuugauucagcuuagcccauaggguaagcauagacaacagaggagacuugaggaaugagaacuagauggguacacuaucauaaagggacuugucuaucaugcug

SEQ ID NO: 13759 - RNA, 32372 nt, Homo sapiens
aaggaguuggggguaggcucuuuauuagacgguuauugcuguacuacagggucagagugcaguguaagcagugucagaggcccgcguucagcccaagaauguggauuuucucucccuauugaucacaguggguggguuucuucagaaaagccccagaggcagggaccagugagcuccaagguuagaaguggaacuggaaggcuucagucacaugcugcuuccacgcuuccaggcugggcagcaaggaggagaugcccaugacgugccaggucuccccaucugacaccagugaagucugguaggacagcagccgcacgccugccucugccaggaggccuggaaauagaagaaacuccugguuggcacaggggauaggggaaaaaggagcgagggauugggagcagaaucagaaguucaaagcuuuugugaucaaaggugcaaugagcggaugauggucucagaaucaaagagcugagaugggagagcaacagggcaucugcucagcuuccauggauauuccugacucucugggaacaccaugaccaucagcuguagcucuugacuuucugauugccaguuuuauccagccaacagcaagggagaaaagcagggaaguucccuugggcagccagaaagaauggugaaauuaggcccuucaggguuugaaggcacacccuccgccaaacauggacgugugccaaaaccccuagcagcccaagccccagcugacuggggcagguccaagacgccuaccauggcuggaggcuuuguagguuuugcugcagcugggcuggccaccagggacagccacagggccagcagguaggaguaagaaaccugcacucaaugucccugagcuccugggcuauggcuccacaagcugguccaguguaccuaacauggcaagcugaggauccacagcugggcaggaauagaggcuauggccccaccccugccaugcugcucugugacccuggauaaggcacuuucccucuuugaacugaguauccacucccugaagguucugaaaacuggcaucagacccucuguauggugcagauccagagacacccugggacaugaagaggggcuaaaggaagguggguagaguucaauuccagggcagaccccaccccagccucaaggacaccagccagcccuacagggcccuccucaccaaucaugguaggcagcauugcagggucagaggucugaguccggaauaggagcaggggcaggucccugcggagaggcacuucuggccugaagacagcuccauugagccccugcaguacaggcguagugccuuggaccaagcccacagccugguaaggggcgccugccagggccacggccaggaggcauuccccgaagccuugcuccccuggugcagcagggcugugggagguggugaccuguguggagaaggcaaggugacuguuacaccuccuggcugcaccacguccacccuccucucuuggccaaaucacccauugguaggauguagggcuccagccuggauaaugugcucaguaauucaggaccagaagggagagggcaaaugggccaagcugugugcccuucggcaucagcuuccuggaacagccaaugaucuccuuaaagggagggcaaagagaucugccaggcacaggcgaaggcuuggaggaaaacagggaggaaagaaaagcagggaggcagggcugugaggagacuccacucuggccccuccugcucugacacagccuccugcacggcaucaguggcaugacuggcaugcaggaguggaggggagcagaggggugaggacauggcagcucuacugccuaucccuucugccagcucccacuggcugagcaacaggcuuugaaacagacuuugaucuaaacagggaaccagaggggaaggcgccaacgggaagccgugcaaggcagcagggcuccuagagcuugcaagugaaucaagaacccgggugcuacggcaugaggagcccugaggggaguuaggcagagucaaacauggccuggcagccaugucgggcagagucaaacacacuagcucgucauuuucuuuggcugugaaauggggacacuucuacugccuccauucccacagcacucauacacaaagcagugccauuagcaacacucggggccaggcaguaucuucauuuugcaguugaagaaacugcagcuaccccucacagguagacaggccgaugcaaggcugggaccuaggccuccgcucagagaacgggcucuggaaaugugggggagaagacuagugcugacagggauggggaggcagcgugggggagaggggcgcacauugaggccagccucuuucaccagcagcuuagcguucaccaaguucacauccgccugcuuggaagccucuuucaggaggccgacaaugacugcggggcuuaggcaguucccagcauucuucagggauguuccuggggacagagagaagcuaccaugaggucacuguuuguugagcacuacaggagggggcaggaagccacuggcaccuagcucuggacuaugggcuccucgcugcccuggggaccccaaaggcagcuugcuccaggcagguccacucgcccuucagugggcucagaagaggcauaaucugggcccaagccaggaaacccaggauguuuuaaccacccugagaaacuccucuccaaaacucagcucaacuccacuccgcuccccaacccugcaccuggcuuggccauccuggccuaccuauuauucucccaggggacacaggaaaauucccuacucuuaccccuuccuggcacucagagccuugccagccucaggaaaucaaagcagaaagaaguaaccgaagcaacugcugcccagcucccugccuuguuuccuucggcgcuuggacacccaggccagugggacccccuggcucugcccuucccugguauugucaaugccuaggguuuagcugcccucucccugcaaucucugcccaacugugagacacccaagaguccauggggaaagauacacgucuacaggguuaaggaaacuggagcccuccuuggucacucaaccacauccgcacaguacuggauccacugcaaagguggccacagcccacucagcagcccgagggguggucagagggcacuguucucauucccacuccacggcugagcaaacucucucucgagggcugucagacggcccaagguaccaccuuaguaaguuacagagcacaaaguguccucaccgcuccuggcucaucugccccuaacucucacuuuacaagugaagaauccaagccucagaagggagagucacacagcagggaagagacagggccaaaaaccagaauccagcauccuguugcuuaauuagggccucccuccagccauccuacgaccucucgcaugaaacucucucucucguagagguuucucuugcacccaaaauaucuaggucuuaaaaaugcuacauaaacaugauuuaugaauauucaguacaucuuuccaacgacuuuuuuuaaccccucccuuuaccacccucccaccaguaguaagggagcuauacucagggcaggguccaaggcacccucacugccucucacuaacccuguguccugcagcaaauacacccagcagggcagaucccacacucccucauccccuccucccccucccucugcaagguccccagcucacccuguguuaucaccuggauggucccuuugggggacccagcccaggcucgcaucaguguccccagagcuucugccagaccaauccaaggcuugguguguggagagaaggcacugguaagggccugggcauucaccugcagaggauggaggagcggggcuguggucaggaagaggcauggcagauccugaaucaagaucuggcugccaagacccagcuccacaagaaagacaguauagggucacuccugccuuggugccuggugggugacaacuuccaucagccacuaacaacaggacaaggacuuguuccuacaaaugaagaaagcuguggagccagaaauggacacagaaugccacaaccacucaaaauugcuccuuucagcaaacugugucugccccagcccccuccaugggagacuuguuucugcacuggggaagggauuggacagcacaauaaaggugagucuuugacacaaaacauaugggagucgcagauaacuuggaugaggagugacgggucuucucuggcagucccaacuugccuucauuuuuauuuucuaucuugaauuuuuuuaaguguuuacauuguuacuaaacacuacgaucaauuaucacaaaguuuugaugaucgugcuucaaauaucaacgcaugcgaaguccacugugaggcauguugugacacugaggggacacaagccccauaucccccaaaaguuaugucuaggaccuggcuggcugcccccugccccacccaggggccugauaacagaaccagcuuguucugggccaaaauuucaauuccauuuugugguucaaaaugcucugguucugaguuaggcaucuggccacuuuuauugagauaacuuguaaagucaaccaucuuagaaagaugcaaaucaaacaggcagcuacaagauguaauuagaaggaaacacagaugcuucucuuucuguuuucauaaagauaucauuggaagaauuuuuuuuuuuuuaaacagagaaagaaucaugguaugggaaaugacugcugaggccgggcuucacgggagccucuccagugugggaggugacaggucugcaggcuucuugcugcauggcuccuggauccucuccaaggagucacagacaagaaggguggugggguggagcagcuagcugcugggaggagaucuggagcaccaugcugccacugccggggcugagggccugcagcagcagaggaaaguccaacuaagagggcccauaacgcaggcaccucggcacaucucucuguccucugugugggccugcagagcccaagcccggggagguguccaucacagggcucccaaguaaaaggaggauucucagucuucccugguggacaggugggagaauuccagggaggagucaggcacuuugggacaccaaccugacccuaauguuauucugugucugagguuagaacagaauugaacuggggaaaaugcagggaagaauuaggaaaauauauuucuuaugugacaaaaaugucucuuuuuccaaauggcuacucuaagacuauuugcugaugugggugaacaguucaauuugcuaaggguaguuauuuugaccaagagguuucaccuccuaagauggggacacugugugguccauuugauggaacucuguguccugcagcagauacacccagcagggcagagcccauacaccucucacccccuccuccccaucucucugcaaggucccccucccucccccacccccucgcucugccagagcuuauauucaggagucccuuucaggaaaagcucuggaaugucacugcuaccuaaugguaauggcaauaaauugcaaggcugcgauggggaaggcagacagcugcuuucugagaaggcugaaaggguaaaacccugaagcccagauuggcuggcaauggugaugagcucaaaccucagccugggaaacgagcagcaucuccugggaggaacgaaccugcucagaggccgaccaggugcaagaugagugaagugugcucugcccugaggagcccacacagcauagaggacagaggaugcagacaggucagagucucugcugaccuccucgcaugcugcuggucauagcccugcugacuuccauggacuguguggggcugcugggcagcaggaggcacccuucuuuccucaggauggagggggcagagaggccuggagggcugggcucucaauccagaggugggagggcagaaccaaaauccccgucucuccugccacagugcuguccucaccagcgaaaaucacccagcugagggucagccaggacaaccaagaacacccagcccauuuuccugacccuuugacuccauggccugggcccacccacacaagcugcagagaggcuuaagucauguuuuuuuguccucagggaacuuagaacuuagguuaaguagaaagauuagggaaaaaaaaaaacaccccauggaacugaaccuuaauaacaagaaagaacaugguucucagaauugagaaggggcuggaaaggccaagcaagacuucagaaggaggcagcaagccccuggaaggagagcuaugccucccucaugcacccgugucucccaagagcuaugacaaugucugguacccagugaaacuuaaggaauauccacagacugaaugaaugagacaggacuugaaguguaagucagguuaagcucguaggagacgcacaugccaggaagggcuugauggaagcaaagacaagaagugggggucuuaugccuugauuuggggaaagcaagggggucagccagcacagagggcucauuugggaguagguagggcaggcugucaaggcagggucuggggagcuuacagggugcaaauuucuacauggccguccccaaccacauccccaccugcugcggcugcguccagcuggcacccaagcagcacuccuucacucccacggcauguggagaacaaaggagccuuucucuagaggcugggccugggaagggccacaaucucugcagcaagacuacgauauaacaggccugagccgggcucucugcugccaaggccucugcuaucaaggcuggagacgggaggcucccgcccaccugcuccggagagugcugacucaagcagauuucccuuaucuucagcucccagggcugaaucuauucacccacgcugccaccagccccuacaagaugccuuccuuccucuccucccucugacuccuggcccccagccccagguggugauacuuacaacccccgugagagauuuccccuucaccauguccacgaacugaacagcaauuuccuccccacagcggcucugagccuccuuggugcuggcacccagguggggacagcugaugacauucucaugguccaccaaggcccggucccguggcggcuccugcccagaaagagauaccucuaaguuggcugccauggacuggccacacccucuugggccaccccaggcaacaggaaaguuggagggaaggcagucaggaguucuggugccuuccacuucuauuuugucaggguggucacuggacucaauaaugggcuuccacaugaauguuccaucucagcagaguggacacagcacaaagugugaaccagauucaaaucucaccuucaccacuuaaccaccuaggugccuugggggugaaccuugaucuaagccucaguuucuuuaucugugaaauggguugauccuaucucccucauaacauuacuguggggauuaugcaccuuuaacaugggaggcccuugaccaauaggagcuacuguuguuguuguuacugggcuuuuccccgaaacucaccccccugcauccaugcagcacuugcugucgaugugccuugcuggacuuuuagcacaguguccugcucuuccaagacacuccacgcagguaacugcaucuuggcucucaucaggacagguugcccaucuguggcaccuccaccccacccuccagugucuuuuccacccuucugcucacugagaagauugcccuuggguauguuauuuaggcaucuuccggccauucuccucagggcucuguuggucccauugaauuuugaccauuuaacccugugaguccuggccacauguaaccauguaauccugugagucccggccacauguaaccauguaaguaccaccagcaagugguucaaggaugcugaagagagcaggagaaggugcuguguuagggaggauggugauacaaagauggacaaggcuugcccugccuucagggagcuuaugaucuaagagcugagaaagaugaccaagguuacaaaccaaaaggcacugugugcccugggcugggaguacacagugagugcuacaggggcucagagagggccagugaccuuccaaggacacacagcuaguaaccugcgaaccacaacuaccuaauccaaaguccauguccuuuccccuuccucaccaggggaagcuccaauguuggggacaggaucuuucaggagaggagccaaaaggauucgagugcaaaugcacucuucccuacuggaucuggugugaggcugagccucugcuccagcugggaaagcagcccaccccgaggacccugagggaauacugccaguauccucgggcuucuguccacccagcaagagaagaagggaaaaagaaugcccauggacacugaaaaggacauuuucuuggcaaugggacugcauuuccaucagggucccucaacuauacacuaaagcccccucucuuccugcuccagacccucaacuucagaacugauuuguggcuuuaucuuugucaauauguuagcagucugagaagcccggaaccaggaacuggguccccuuuaaagcccgaguuuugcagaaaaccacauagcugccuccauaccaggcuccgcaaggacuccucaaaccacaaagguguguuuuuggcaacacaguuuucuccuuuuaccauggaugaaagagacaauaagcuagaggcuuucuguaaaacgccaggcuuucccugccaugggccucucugcucccuaucucucccguccuccugacgcugaggcugccaggcacuuacuuccguaaacacguccagugcagccccggcacacuggccagacugcagggcccggagcagggcgccuucguccacgaucccuccacgggcacaguucaccacacgcacccccuucuugcacugggcaaagguguugucauucagcaagccuggaagaaagcgaagcaucuuccugcuggggcagcaccaggauccccacgcucaucccuggcuuccagaggucuucccuuuccuugagccagcucuuucccagagccucucuccugcuggacggcagccucuuugcucucaucucuuccuccucagaugcucuggggcaggagucccuguuauggaucugggccagacucaguuuagaaacaucuuagaaauucuugagauauuacuguuucaagugggucugggaaucagaaagcccugcaggggcugcagaaagcauccaugggggucacugguugucccugugcccagcuuaccuagaccccaagcacuucuagcuggcucacccuccccuauccaacguaggggugucuaacaaaacaccagccucugcaggacccagguggaccucuccccacagcugguuaccacugucuggggaaggcccagauggagggcccauuuguuaacuggucuguggcuucugugaccaauccacaauguaaggacacaccuaccugucguggagggcaggagaggagugugcacagugaugaaaucacagagaggccagaucuccuccaggggcagcugcugaacaccaaaggaggccgagaccucuggggaaaugauggggucauacccuauagucugguuggaagcaagagagagggaggaagugucauucuuaauuauuaguauuguuauuauuaagaauggcaaacauuuuuugagcauuuaccauauacuaacuaccaugcucagcuuaauuaauucuccaguuaauuuaccauacacuaaguaccauguuccacauacuaaguacuauuuaccauauacuaaguaccaugaucagcuuaauuaauucucaugaccacacaaugaugcugggacuguucuugucugcuugagagcugagggaagcagggcuuccacaaugaggaggggcacagccagagcucaaaagaaggugcgucugccuccaugcugugaucacacacagaugcaacaauagcucauauaggucuggacaagguggagcuuggaaguccuuagaaagcagggaguccugagggagggagggcagucauguagggagcggacagccaggaaagggagaaggagaaauggcagcugcagcuggaggguccaguccaggaaacaggugcaucagguacuaaaacagagugagcagaagcgaaggaggaggacaacagggguacaaggcaggacccagagugggagcaagacugcaugcccucuaaaucaggaagccugaccuguguccucccccagucacugcccacuguguggaaagguacaggucaguuccccuggaccuggguccucaacccuaaauaaaggagcugggcagaugauugcagccaucucucacucucacauucaaucacugggaauuauuugaagagaaaucccccuuaaccccgagacagaauguaaagagugagcccaggauuagacaaaaacaaagaauacacagcauaguacuuuaacagcgguugucucuggguaguggaauuauuuuucuccuuuuugcuuuccugugcuuucaaguuuucuacuacauuauucauaaauuacuuuugaaauuagggauacaguauagauacuuuagaauauaaugggaaagaugggugccauugcucacaccuauaaucccagcacuuugggaggcugaggcaggaggaucauuugaccccaggagucagagacuagcuggagaaacauagucagaccccccccccuacaaaaaauuuaaaaaacuagccaaguuugguggcaugcaccugugccacccagaaggcugaggcaggaggaucacuugggccuaggagguugaggcugcagugagccaagauugugccacugcacuccagccugggugacagaacaagaugucucagaaaaaaaaaaaaaaauaaaacaaaauaaaaaagaacguaauaggaaagaggacuucaaauucaguaauucuagggcagaagcuaaaaugguuaugauuaaggugaagccucuggaucccuuuuuucaucauuagccuuguggaauaaggaaagccaaguggccccacaccaaccaucaggcagguuuuggggaaagaugcugccucucccacgcccuauaagaaccuccagcucagaacgcugguggucuuuuucagacacugcugcuccccucggcuguaaccuacucauuucugguggggaggagaaaguguccaggcgaggagaugggaucccugccaucguugucacaagucuucuucgucugcuggcccugaggccggccagaacaauggcccuguucaucucuaauccagauguauuuuuuuuucucauauggaguggggagaggaagggaacaccaauagagaucacaagguccagccugacugacgucuacuccaugcucaggagccaagaacaaccugggggcuggcaggaggaaggacccugcaggcugaaccuggcccccuccacagacaggugacuggggcuggagggaggggguuggggagaggagcaggugagcaucuuccucaggggugagcgaagcacugacucagcuuccuucuuucacagagaguaucucauuuaucugcagaugacugcagggaaggaaucuggcugagcaaaccucuguucucauuuuccauuugagauaaccagggcagagaagagcugaacucagcuggggguugggguuccgacacuaggagacaacacugaggggauggaaagggugacaacaggcccaggacacacgugccugucaggguccugguguguccuggaaagggucagauguccuaauauacagacauuggagcaccucuggguacccaccauucaaagacuacucccggagagaagccuuggggagaaacaugaagggguucccucaccucaaucccagccccagggcagacuccugauguugaggcaacagaggaagccucacuuucuaagcaggacuccagggcagcugguggcuccuaccugccugaggucacagaagacagcccugagaggcugguaugcuggcugcagggccuugcuggcucagcagagcaaagaggagagcaaggaggccucccaguuaaagaggcucugaagaagaacccucaccgucacgugcucucucugccccacagcugaauuuuuaguuuagcauuggaacucucccuaccacggcaaugaaaucuuaaacagagacccaaauauaaaaauaggucaauucaaagcugcagagguaaaggcucaaugugccaccaccugcugucucccugggccccuccuugcucccaccugugucccuaaggcaccuugccagaacccgaggcucuugaguuugagaaucacugcucugggcaguaagcauuccagguaacacacugagauaggagcugcccauccuggagaguaucugucuuuggaauagcuaagcauaccggcauggcacagggacuguuuaccuaaaauggaucaugaauaaaguuaagugguacugggcaaagaaugccagccuggaaggcugagccgaaauucaccaguucauaguugcauuaucuucagcauaucauagaaccuuccugggccucaguuuccuuaucuguaaaccugggauaauaauucugacccugcagagucauuucaagcacaggaaccgacacaguagaccucagcaaacauuagcuggaccugaaaaaaucggugauaacuggugccucagguucaacauccaacccucugggcuaaaguuggauucaucacaacgcuggcuacaaagaaacuguuaagagaugcuugucuguucccucaaggaaaaccuugaucauaaagcacaaggcucgcuucuugauugguuugugccucuuaacacauucuaaggaacacaccagcaugaaugagcugagucucugaggucacgaccugucauucagcaacacuauugagaaaaagucucucgcagacacaacaguauagagcguuaagaccuguaugacucagaccacagguaggcugcaggucaggccacagugugaggaaugucaccucccuugcuccggaagccauacuucuuuuaaugcugccaaaugucagguuaccuuuucuaucagcuaugccacugacaaccacacugcucuuuuguaaaccaaagcccugcucccccagaaaagcuuuugacaaaugcuucuacaucuaaaacuugucuagcugcuuuuuggacccacaaguagggugcagaaauguauucuagcuaaauuuccugugagggugcccaaccauucuagccuucauaugucuuuuuggaccugauucugcacccuuaaguauuaacuaccucuccuugcuuccugccauccacaaaugacacaugguucaggcuguugaugagaauggugggcaagguggagcacuauugcauacuaucucccuccaaacugagguggcccauuccacaacagcaccaagcacuaaucccuucaauagcaccaagcucaaggggcuccauccgaaccccgagggaaucaugaaagaugucuuaccaaaguccauaucuauacacaaucuaaauacccaucauugagagaauggccaaauaaaaagcaauuuaucugcacaauaaaauuccacacaacuguuuaaaaauaugcuagauuuaguuguucugagauaaacauguuuuuuucuuaacaucacaaacaauauucuauuguuugcagccaaagaauccauccacaggcauggaacuguaugcauucugugcaaaugcauagaaaagucucggaugacaugcuaaacugauguuuaccgugaggagacuaggguucagaugguaaucaaguauagccuuguccaaguuuuaauuuauaugagaaugcauuccuuuauuacaugauuaaaacauaacuuuaaauaguccggguaucugacaucuagggauuuccauacucuaccaguuuaauaaugguuuccaaaaagaggaugaggcuaguaugaaauaacuuguguuuaauaaacacuuauccucauuuccugucugggugcuuauacaucucuuucacaauauguucaagaaucuuccuuucccuuuagaaaaucuuguucuccaagaccgguagaacugaugagcucuccgcccuaagacaaaauucauccagacucaaaaguaugauaaugacgugguugagguaagcagcugagcacgagaagaggccacuuagacucuccggaaugaugagguccaggcagcuccggaggggcugaggugggagacggaaugauccaagccauguuucagggguuuacaaagagcauguucuggaagcaagacaguuaagaaugacccuccagagacaucuggacagaagaaaugcaaagugaaggcacuggcacccuccacaccaugcugggaaugggaauaaaacauucagugggugaccugcucugaggcacagauuaacacugaaaugagcaggccguagacaucucuuucaaucaaacacaugcacgagaggugucagccauuuccugacacugaugcucaaggucccagguacccaugcaccucuuggaagcaucccaggguagagaguugggcagugccagauggacagacaagcuuaccuagcaccucaaucauucaggaaugagguggggcuuuucaucugguugaagucgcugccgaagucuccaugaugaagaauauugccaggaauauugauguguaguggugccacggagaaggaagccuggggaaggggagucauggggaagaggacccccuggggaagggggcaggagccuuggaacggccacuggucuggagccugucucccaguuacugcuucaucaaugaaaugcucaccuauuuggcuaugagugcucuuaguuuuacuuaacuccugaccucugccuuuuauaucaaaauucuccauggacuaaaccuugacccuugaucccuuacaaaagaggauggaggagggagugcucuuuguggcuuauggcaucccaccaucccugcacagagggcaaggcugugguuuguuuacaugaucaaugauccugcugggcuacaucugccucucucaggaguccagggaucaagaauacaccuggcccuucucagugcagaggcuuaggaaagauaucuggcugacuuaaauaaauaagauggggaguggaggcaggagggagaggauaauauucaauguguacaaugggaugcucaccaggcucuaggcuacuguccauuugcuaugaguccuuaggcauaagcuuacaaauucuagaugucaauguaaaauuaaggguuaaucuauuaagaucccuucuaacucuaagaagguaggagggauguagaaaaagggagaguuccauagcagcucuauguaaacuuuucuagauuugacaugaucugguugucaaaacugaucuccuaauguuuaaagacuuccuggcugcaguuugaccccauaaucccuguaauucccuaaaacagaaagugaacagagagaugucccauaguagccuuaguggguucaucucuuuggccuaucugggaagcccugcagauccccucucuuagcugaauugccucucucauuugcaaggucuccuggauuagcccaaguggguggcacugcuacugauggcaaccagaggguugcaaucaggcuaagggaguagccagaagccuacugagcucccagaguaggaaaaggcagagaccugggggaagacaggaguuaggugugauuucugagaccggugugaggucuuccagccaccauaggcucuacaaucauaucauaguguacauacaagcacuuuuaaaucuuuucugaaauauggagggaaacuggaaggacagauggacaauggauguaaggcucuacugugaggccauaaacuuguuccuguuuucuaaauuaucacaggaaagcagacaaaacaaaagcaggaaggaaagaaagaaugggcaggacacaagcacccucccugugaggcaggauagguaaucaaggaagugcagcaaccuuggugauccuauagucaacacaauaagccucgguauucauauucuaacugagcucauucaagcaaagcuaucuucaguagggaacuucccaucuagacagccugugcacuuugauuuuuccuguccucaaacugacccccuggcucauuauaauaguaaaaaacacacuccuggguggagauuuaagaugcuaauaagacaugugccaaaugaacaagaauguacagcuacuacucaugugcacccagaggaccacccaaaacaugcuuacuaguaacagcucuucccaccuccuuaugaauaaucauguaaaacuccuauaaagggaguuucuccagcaauaaucaacacugccucauucguuuuuguuuuuguuucuguuuuuuaagacggagucucgcucugucgcccaggcuggagugcaguggcaugaucucggcucacugcaagcuccgccucccggguucacgccauucuccugccucagccucccaaguagcugggacuacaggcgcccgccaccacgcccggcuaauuuuuuuuuuuuuuuuuuuaguagcgaugcgguuucaccauguuauccaggauggucuugaucuccugaccucaugaucugccugccucggccucccaaagugcuggauuacaggcgugagccaccgcgcccggccaacacugccucacucuuaugagcagcccacccugaauucucucucucccgagguguacugucuacucugcacuuaacuuucaaaauauucuuuuuccuuugcaauaaacuccucaaugcugcaccgugucucuuguuuaaauucuuuuaaacuaagaagacaggaaccaaagucucaaaagagccaucaacaccugguucacugggacucagggcuauucacucaccagagagcuaaaggacccccaccaaguauuuccagcuuuugaguccagaucagcaggccaguguucucucccuccuugacuuuaacacuuauuuagaugggggcuccaagagagggucagacccuccuagaacaaagcuucuggcuucugcccagacaugcugccuuucccaaaauugcugcagaaagucccacaucacaggguuccagcaacaucuuaccuucaucccaaaggacugcauccggguagcuaccucucucccaauccugcccaggccaagaauucccagggucuuuccauucagcucuguucccaugaacugcaaccaaacaggcaaaaggaaagaagcugaagucagcaacaugaguggaccccgggcccugagcccagguggggcgagucaaggccgcugcucaccuucuuccgcucccauuugccguccuucaucgaagccgucgccuggggaaucugccugcaaggauagacacagguucagaggguccauucggacucccgccagcccaggaaggagaugcaacaucagguuugcacagucacugcccaugacagccacuuccccaagaacugggucuggggguucagguuuaggaacacugaugggggauaaagggaaaacagaagagagaaacccuuggcaagaucugacuuagaaagccugggauuucugugaccagccaggcaucugggaggagguauggauuccaccucagccacugaggcaucaaccagagugaguuuuuuacuuuaagcgaucgccaauccuccagggucuguagggauaacugagugggguacugggcaacucugaugacaucgaguacuccagaagcucaaggaauuauuuugaucuaccuaucucauccagcaccauaaccuaugacgucuucuacuauuaugaagaggacaccuaauuaccuaugcuuccuugagaguuucuuaaccccgagggucuuagacuagucuggacccuagaguggguggguggaugccaaagcccagacacuuccauucuguccugaaugcguggucccaacauuuuuaaacauccgcaccaccuuccugucccaccaccaccaacacacacacacacacacacacacacacacacacacacacacacacucuucacagccugucuccuccuauuaguccagauggaagucugagucuacaucuguguuuucuggaggagacagaggaaguggcaauuagggcaacauuagaggucaaagggcgauauauguccugugggcaugggucaucaacacaucucuggaggcaaaaaaggaagauuugagaaacaauguuuaaggagcacuuuauuuuagacauccuaaaagaaauguuuagacacacauuaacuccucuaacauucacagcugcacggagggaggcacuggagguuaaacaguucuccccagaucacccaacuggaggcacuugaacagauucaaagccagcaaagucaaccccagcacggccagccuccugaguacuuaaauguaggccuuuaaccugaugccaaaaaccucagagugagcgagcgugcaaaaagagaaaucucaagcugcuacuuccgugcuuucacuucacuaacuucuaacacaaaaacauucucucaucucuacacaucacuaggacauugaucuccaucugaggguaaggcugaagguggaaucuguccuccaucacagaggcgcacgaucuuauggguaaacucagaagaacuucaguaccaagccacaugggggacaagcugcauucaccucacugcucugacccaucaggcagguaauaaggacagggacuugccuugaggaacuguucacuucuugggaaagcuugccugauaaaaugccuuugaccuagugagacagagccccaccuggccccucucuccucucccucacauccuauuuucuucccaccagacuccacagugcuaucuaagauguaugcgugcggcaccacagaacacaagaaaucccuaacccuuuucucuggcugcugcucccagcugaucauggagccucuccagguuucaaugcuuuggaauccucaucaggccagacuggagaggacucuaaugugggcgaggguccucacaauaauuaaaugguugcuggccugacuuacuagaggaggagaugguaaagcaggcaaaaauggugaaaccuacauuuguugauucucuccuuccuuccuuucugugugcuguucuucugcaccucaggagcccccgccaucugcucaaagucccuacugugaggcccagccacgccugcucuccacccacauugcccaauccuguagagucuacauauaggcacccacacucuccuaccguccucccugcuaggaacagucugaugaaacgaacgcauuccuucccaauagggugugcguguuuccuaguuuugaugcaccuuugaugagugaggucauggugagcaguugacaauggggagcuucuuuuaaaccacagcauuucaccgauuccuuuaaacaaagcugguccuggaaaaggagggaaaguauugcuggcucccaauccuuuccuuccaccuccagaaaaaaagugagguaauuaaucagaaagccacauugagaucuuuucccuuacucaaaaaaaaaaaaaaaaaucccugaagguaauagcugaagugaaaccagggugccaggcuucuguacuucuccagggggagagacacucagccuagauguucugggagaacccggcugccagccugggggccccuucuaggcugagacccuacugcuguguaagcuaucccuguuucuccuuuccccccacugccuccuuucaccuaccagugaauaucagugaauaccagagagcucagauggaaacugcagggaggaguuagagcagagguaaauucccccagauccuccuccagcaggagggaaagcaggucucgccaugggaaaaguaauuucuuggucccggaagguuucaggccugaguagagaaacaaggaguccuugaugccuagguccgcugguuuagggaauccauggagcuucaaagggaccuagaacaacuuccuacccuguuuauugggagccuuguucuuccccuugaccacauaaaugcuugaauugccuguucaacagaagugcuccaugcaaucaguuuugccaaauuacuaaccaacacacugagacucaagcacauucugugccacaaccauuugauuucuaggcugccccauccacucaagaggccuggaacuccugcuagaagagcaagagucuugcccauuugaguuccauuguguuaugaacccacagaacacacaaggacccugaagcagguucuuacuccauucuauuacaauacagauuuguaagggcagugacagagauaagcccugagggccaggggaaucagugagggacauagccuagcuggaaaagccagagagcuucuuggauaaauuaauacugaagcuuaaucuugaaaaguaagcagaggguaccuagacacuguccauacccugcugccuggaacauccuuccuuguuaucuccaggcagcaggguauggagaacauuugcaagaguuggaggcuagagaaggcagauugucugcagcauggagaauagaacaugaguaaagagaagugcaccuuugugcacuagggaaccuguguaaugaauguugaauagaggaccugauggccuuaaagguucuuugcagucugcaugucgccuucuuagcagucugcaagucgcugagacgaaauguuucuaaguuuuucuggguccauuugcuuggcaagugguaauaauuggcauaucggagagacuagcuuugcugagaagucagggacuuaccuggccaggcacaugaucauuccacaagugaguucugcggcacugaggcuguucccauugggggugcuaaagaucaaagaaaagggggacaucaaugggcacagacccaguauucccacuccuuccccaagagaaagccuugagugcaggcuguguucucucacuccugcuccaugaacugaccacgccacuguccagaguucucugauguacucucgcccuaagccaagggcuggaaagaaacccccuuccccuggcuuuauguuucccugcagagggaccuccauuagagaaacauaucuggcuucucucuauccaaacacuccucccaaggcagagaagugucucacaugaucagauuugugugugguucagcccuuuucuuucuccuauuucaggaucuaccugccuccagaaagcacaaauucccugcugcuccuaccauugaucuuaccaaggucagagucucucgaauucagggcucaguccaaugccuacauaucuucaucaaguuacccaaccuggcuuuuuuuuuuuuuuuuugacaaggccucgcucugucacccaggcuggaguguacuggcaugaucacagcucacugcagccuugacuucccaggguucaagcaauccuuccagcucaaccuucucaguagcugagacuacaggcuggugccaacauaccuggcuuuucuuuccuucuuuuuuuuuuuuuguauuuuuguagagaugggggucucacuuuguugcccaggcuggucucaaacuccugggcccaagugauccucccaccuuggccuuccaaagugcugggauuacaggugugagcccccacacgcagccccaaccuagcuuuuauuaguaaucuccaccugucugacuacucuuccuaucucucaacaaguucugaacugagaaagccuccucacacccuaagucacagggcaauccagacccuucccauuuuauaaacaaaaaaauagagguggcaacccacaaaacuauuuuucuuuucuuaaaugcuuuuuagguuuuugaaagaauuucauauacguguucacccugauuauuccccuacugggucugucuuuuucaucucuggaaugaagguuaauaagguuacaagaagaaaaagucaagagauccuguauaagauaaacggacucucagagucugucugccugcaaaaccaccuggcuucucauccucccacagcaaacaggcuguaugggggcgcaaguagaggugcagagauuggggccuggcugccucuggguccaaggcaagaaugugggauggguuaucguuuaacauuucugcuguugaauauugacuucagucaggugaccaauuaaccucuacccuacagggggaagugcagugcaggggaggggaaaggucuuaaggacaaugaaguccccaagggaagagaaaagucuuaagaacaaagaggccuggggauggccuugccauaccaucuaagugacagaacggguacaguacagcacuggcgugcugaugaccucugccccuguguuucugcagaaacagcuuuaaaugggacccuucuccucuugcccuagagcacugaaagagaaacuagugucuuaguuccagaagguggcagggaaguggggagggcaaggauucuagucauuagucugcuagcaaagguugugccucuguacaagcacaguaaaguagagcugacaaaaaccugccacaaacagcauuaauagaggcagagggggcugggugggagcaggaaaugcagaugaacucacugaccuuccgauuccugaaccaggucacagaggugcaagcaacugcgcauggggugggcucgugaaacauuuugagauuaugcagggacucucaauuucaaaaacuguguaacacccugauggcauuggugauauaguggugagcauagcugccuuccaaaaaccuugaaaccacuaugcuguguguguugaccaugcaggcccuagaccaggcauccuccuggaagcccuuccaauggacucagcuuucucucaagugaguuuuuucucccuagguguggucagucuccgcacucaccccccuacccccaaaccgcccgcagccuccaugacuuacuucauaaccaagaugcccuuccuuguugcggccuccagauccacauuguccacaccugugccagcccugcccaccaccuggaguuucucagcugcguugaugacaucagcggucaccuugguggcagagcgaacaauaaggccuucacaguccugaagcagaaaaaacauuuggguccagaaagucauucugugagaacucguaaagccgcaggcacaucauugcuuacuccugaguaagagaugcauuuccggaaccuuaggaagucacugaugacugccaguucauagauaucuuugguauacucacuagggaaaugugggcuaggacucaugcugauuuuuacuuagaguggaggagacugugccucuaacacaccaaccgcuuuguuuggcaugcucaagaaagggcagcauuggcccaugggcucugggcaccuggcucaucucucuagacagcaccaugaugccugcagccuggauguccaucagacacaugcuggaagucaggggccaucuccuguuccucucuguauacccuaucauuccugcacauugcuugcucaaaaugggaguuccugccugcuggcugauuuugauauauccaaagaaagaaaggcaaugucaucuguccacacaucugauagguucugccauuggucaggccuggguucaaauccaaggccccugccuuccaagcuaugaaucagcuucggccuucucaagugugugaggaacaagcgagagagaacaggcacagcaccuagcacaguaucuggcgacgcuuaaugaacaucacuaccuccauuagacacugagcuacugagggcagaggugggaucaaauucuacuuuguaagccccugucccugauacagggaaggcacucaauaaauguugguuggccgaaugaguaaauaaugaaugaaacgaauguugaaagaaaaacauuuccuaaaagagagaccaaaggaagaggggcaggggaaaaaugagagcaauuaaauucaucuagacuugcucagacacccaggcaauauuagacuaaaaauauacauaugcaaaaaauaagacacugaauucaucauagccacuauacgugagcuaagucagauccccaagacaaucuuccuuaugcucacccagaauccugugguaugugguucuuuccagaauaagaauauucuugcucaaacacagaaugagaaucccuaagaaauggggcaggugagcaaguccacacucugucccaaaguggcagacaccaggccgguaagaaagcagcaaguaugcuuucaaaagcaccaagcugggaaccaggaagacagaguucuaauccuaggucugccaacaaugugugggucacugcgguaauucaccucacucuauaccccuagucucuaccuguaaaauaaaagagauggagcacauggcuccucagauccauuuuccccguagagcucucagcuggaucccaugaaaaccuucuuuuaccuucauucccacugcauggauucuggagauagagaaaggucaugagaaguuggcuucuaggguaagggcccacacuguguuuguugugcacgagccuagagcauaggagcaaauauggacaaaguaaauguaaggagagcaguggguaauuuuaucuccacuaagaagagaagaggaaugaugcuuaggcugcagcauagaauauuuaagccuuaagagcuucuaaacacuggaagaauuguucaagagcaauaguagaacgauuccucuggagguguuuaugcaucacacauccucacugcuugggggcugugccuaccagcagagagaaacaugcaggcggccuggaagacacuccaaauccuuuuaugucugagguucugaagcagaacgucagagugggagauuugaagaaauguucaccagcaucugguccaacuccauuuuacagaggaaaaacugaagcccaacaaaguuaagccugccuacuuucccuuccccuccccuguacuuuucuuccuucauuuuaucggaugcccgcuauguacguaucuggcauuaugcuaaacugauuaugaccuggguguauacaagucacaugggcacccagggcuuagaggaaucaaacagaagccaccucagugcugacugccccagugcugaggccaacaccaggugagcaccuggagguauucugauuuccccccauagcagccuaguuaaauaucagccaagccaggcagaaacaggauacuggcaucuuuuccacauucaaguccaccacacaggcuccaaagaaaaggauuucccugccuggacacacuuuacugacuuuucaaggugcaauaaaguuaucuuccaggaaacauuugccaacaacccugaacugucacucucccuacaccccaccauuuuuguugugaucaccaauauaauauguuucauaucuaguuguccucucuuagaccugcaguuuuggucuccuuaguuauauuuucuaugccuaaugcagggauuuuauauuaaaacuuuaucuacucuauaccauauauccauaguaccagccucaccagcacauaaaccauuuauugagcaccugcuggguacuaggcauuacaccaguugcuuuacauuauucucuucacaacuccaaggagaagggguauaaucauccccaguuuccagauaaagaaacagaggcuuugagagguaaccugcccaaggucacucuuacagaucaaaaaccagccaagaacuggaaagucauugccacuggcuaacucugagacuguaacugaagaagaguugguagaccugccaagaugucaagaagauagggccagagccaaggccauggccaguuaggugcaaaaaccaaacuguaaaaucccuuggagagauuuacuaguaacaauagcuaccauuuuuugagcaaguacuuuacauccagcacugugcuucacaacaauccuaagacagauauuacaauuaucccuauaguacagacaagcaaacugacacuuaaagaauuuagagaacuugcugaagucacauagcuaggauauggcagaagcuggaaucaaguccaaaucuguugaguuccaacuaccuuccaaauacagcauuuagacaccuaaaccaggagagacauugccagaaauccuguggcuucuccaagauggcagaagcucccuaacaaaggucccuggaucuucuggugaccugcuccucccagccagccugccuacugggggauaauagaaauaggcacaaaugccucugucgagaagagcaaguugccuguggccuguaggcaagcucacaguugauacuucacaaugaaguguuuuauacacuuccauugaauaaaugaauucagugaugagaggccgguagaaaccacccucaucagucccccauccucacaccuucacccucuuucccaaauaacuuuaacacuucacaugccugaaaauugcucaucagaaaucccuuccuuugacugugauaaggaggcauaaggucuacuucuaagagugcucaaggauuuucaaaaaucuuauuaaaagaaguugaaaaaaagcaggaaaaacguucagaaauugacaaaucagucaacagaacuaaauagacacuagacaaacagaauaugugagaauuuagaaaauaaaaagcagaacucaaauugaugcggaaaggaagaacuaaacaagaaauaauguuaugaaaauucaagaagaaaaauaauagauugcuaccucacuucagauuuuuaaaaauccagaugaauuaaagaauuuuuaaaaauauaagcauuaaaagaaaaugucaggggauauuuuuaugacucggauugggaaaaccuuucauaagcaaggcacaaaucuuagaaacucuggaagaaaauauugacaaauccaguuacauucaaauuuuaaacuucugcauggaaaaagaucccauaaacaaaagcaaguagugguccugauauguggagaaaacuccuuucaccauauguaacagaacaaggauucaucaccaaaagugauagaauuccuacaaaucaacuuuuuuuuuuuuuuuuuuuuuuuuuuuuugagacagaguuucacucuuauugcccaggcuggagugcaauggcgcgaucuuggcucacugcaaccuccgccucccggguucaagcgauucuccugcuucagccucccgaguagcugggauuauaggcaugcaccacaaauccacuuuuuuaaaggauaaagagcacaauaaaaaauagauaaauauauaaauaggcaaugcacagaagaacuacaaaguggucacuaguuucacuaguuuauagacucuucaacgcuagauaucaaggaaauauagauuuuuaaauaugauauuuuugggcaucauuuuggcagaaagaaaaugaauaauauucagcauuggugagcauggagggaaacaggaguguacacugcaugaccuuuuuggagggcaacugggcaguggguggguaagcacauuuuuaguggucauuucuuugcagccagcacugacaccuuagaaaauugguaacacacugaggaaacacaaccuccuuucaaguggucagcucaggaccaaaagucaaaguucaacugacaagaagcaggcauggagcaagaggagaagggaccacccagagucaucaucuuaucaccuugucucucuagcaucaaguuccagagcccacaucucaggcccaguccugcuccagaggcucuaccaaucacucccuugggccuuaaggguccauccuucuucaauguucucuccaaagcugccaaaaugcuccccaaaccuugcaaaccugcuccccacaggcaacacuagcuggagagcaugcagacuccccaaaguccacccauucuuguagccccugaacaagcacagaaacagcacuauuguuucuuucaugagcauggacucucuggauggaucucccuuguaaagauuuaugcuguagucucuucacuuuucccucaaaccagccuucuuuggugccagggaaacuaagaguccccagucagacuccuacagaugagcaucaggucucaccucucccaagggcagaaacugucacucaggagaccuuggucccacauuagaaccagacaucccacaucagucagaguuaaugagcuuccaaggccucuuacaaccucaacuacccacucuauccacucauucaaucagcacauauucacagacagccugaauccaaccuaccuccugcuggacccucaaagccccugcacccaagccccuucccuccucacgccacaacgcacccccuucaaagacuuugccccaagcugucugcuccuguccucuacuuauggaaaccacagcccuaaccaaaugcacccaucugcucacauccucugcaguuugcgauuaaaacuucuccaguguccagagauccuccccucucuuugucauuccuugggugaggaagcaagucucucucuacacagcaccaaauucugauguucacugcccucugcguguggcuucugugucugcacuguggcgggaacaggcacuucccacacuuccuacaaguccucccgcuccccuguccuuagcugcuguucagcuagaaaacugcuugauuuauggcuguucgagacaaacugcuaacucagcaaugggaauccauugccauuccucagguucacacaugcuuccuuucccaaggggacaagcuuggccuaggagguaauucuagcauugccaugccucugacuuaaaucauagggcaagacaaugaaacuauccaggucauguuccccagcuauagggaaggcaggucuacccuguuuugcacaagaugugugauccugauuaauuugaugguuauuuaacuuuugcaaacuaaauccuuguguaaaggcugggaacuuccuauuuuaaagaaauuugaaaagaaauuuggcauggaaagauuuauucccuucuuaaucuuucuucaaguacugauaugaagguauggaugugcuucaguaaauuaaauaccauuaccaguguuuaguuuagugguccugaccagcaaugcuacuuaaugaaacagaagaaaauaccagaaugcaucauauguaaaaagaguaaguauuauuucauaaaauuugugugugucuguguguacacauauguaugaguguuuaaguuaugacauaaaacaaauuucuuauugugggucacagucaaaguuuaaaagccacugauacaugguaauauuauuuaaauauuuuccggcauauuagguauauuuaagaugugaguuccaaacaagaugcuuuauuauuuuaagccaacguuuuccaaacuuuuuugacugagguucauuguaagaaacacaucuuuguugguggaggggugggacagggucuagcucuguugcccaggcuggauugcaguggcgagaucauggcuuacugcagccucaaacuccuaggcucaagcgauccucccacuagagcaccagguugggaagagugacagcaaccagggccucagcccuccaccccaucccccaguagcugagacuacaggcuugugcaagaugcuuagcuaauguucguauuuuuuguagagacaggguuuugccauguugcccagucuggucucaaccuccucaguucaaaugaucugccuccuuuggccccucccaaaguguugggauuacaggcgugagccaccgcgcccggccaagaaacacauuuuuaaguuguaauuucauacucacaugccacacacauacaacuacacaacauaaaugaaacaaaauucaugaaacaauacuuacaaccuuacuaucuaucugcauugcugucugauauuuccuacuuuguuuuuuaaaaugcucgucaugaccccuuaaacugaacuaugacuugcuccaagucugaaaagcaccacugaaagggcagggaggaaugauuguacuuccugaccagggggugagugagaggagaccgccugcccagaauacaaggcagugggaaccaaggccaggcccgguucuagcaacgcugccgaagcuuccuucagcauuaaagagacuucagugggggagggcaggagacacuaugccagacaccucuucaugcagaauaaaaaggcauaguguagaaaugaggacccuucagugggcugaccaaggagauuaauuggcauucugaaccaaauguguugcaaagacagacaagaaagcugagcccucccaaacaguccaaaaaugcccagcagucaaguuagccaacaaacacuccuccucuccugccaagaguuuucagcgccuuuaaaauguucuccaaguuucagcaccagacucccagcauccacccagcugauuccugacuucauggaacaaccccucauuauggaugaggccucccauuccucucaauucugcccucaucccucccuauccccacccccucacugggguaucagguuucuaauuuccuuuagagaggugaaagcacuugauugccacccucuucccaaccuggugcucugguggaggugagagucagaggcuguucugcaggacaccccacugccuuuccugguuguuccccagagccacugauacaauuucacacaagaaaggaggugacagaugugaggagccugccacccguccaauccuacucaaguccuaagcccuugcccaccaauucugugcaugaugauuggaccuuucucuggcuuuuccagaaggggaacacgcaaagguuagggagcuggauggucuaauucggggcuaugcucuugugucaucugcucaacugucuccugcguauuagccaugcucccuaaccagcuuacaaacuucuugaaggcagggaccaaauucuucugaguacagggcagagcuggauacuuggauauagugucaugccauggugacaagauccacgccagcagauacaaaggcagacaaagugagcgaggcaguuuccaggaccacgugguuguggcacaacuaaagcaacaacagcagccucugcggucuaagggguccucggaggaggagacggcugaaggugguggacagggcugaggcgggcagaaggcgguugugcgauuuggagggugggggagaauauacuggaucaggugagguagagacugggcagcugggucgacuacagaggucgaaagugcaggcacuggagugaagaguucacaaaauaaauauuccggacaaggccaccaggcccagcaggccuuuucaaacacgguggauaaagauuugaaguagauuaauuauauaucacaacaaaaggagauaaaaauuugcuaagacuauaaaucaucugggagcguuugggaucggauucuagucgagucuggucacucccaaccagcgauaaaccaaagguggggaggaggcuaaaucuggaccccagcgcuccccgcccgccucccuuuccuccgaaggcucccaggaggcagaggggcggcgaaagcacggagcagucuugcaucagacgaggggcggguacguguuugcugccuuacgagggcugccuuccccuccagcugccccagcagccaccagacugguugggucuccgccagcuuccccccgccccccgacccccccaaccccgccaccgccaaggcaggcuagaaucggcggggcggcccagaacuugguugggaagaaucgccagucccuggguuccccgcaaagaagccacuuuggggccccucucccgaucgccccgcgcggaggcgguuggggguugggggagaggcggcgcgaggcugccagaacaauugcgcgcuaaggcgcuggggcgccgcgcuggcaucccgcgcuggcauccgcgagcagccugcaggaccaguuggagcagcccgcacuuugcaaugcuagcggaggcaugccaacgugaaagacgcgguugcaaacuaaaagaaaaguuugcaucucgccgccguuuguucuucccucuuucugccuccucccgcccccguucuucucuaccccccaaucucaggaggccccggaacuaauugauacggggugcaugcgaggggggcgcgcuggccugggcgcagccagccuuuuuccauggagguugcccuagagaccucaauuuucucucucucgccuuaccugcagcuccgcuaucagcuccucuuugcuaagguucugcuuuuccaccaccugcagcccuccaucuugcaagaucuuccggcagcaaggguccaggcugucacugaugagcacuuuccgcagauuugcaaaagccauugcuggaguuggccucggaaucggccgcugugaguagaaguaccuaagccaagaagcugcgguucggccuggcgcgcuagaguaacugggcaguauucuccagcucccgcuccccagucaucuccuccuccuccuccucuuacagucuccuuuugauuggacggaaauacuca

SEQ ID NO: 13760 - RNA, 9579 nt, Homo sapiens
guuuuguuuguuuuuuaaucauuaagaguuuuuguacaaaaggugaugguuuuuuuucuucauuuuaaaacaccagggugugggggagggaugcaaacaaauaacaaaaaagaugcuuuuguaacauuauuuucccuguuuagaaagaaaaaaaucacuccaauaguauugaaaaguccaaagaugaaauaguuucauuuucuuuuccuaaggcuuauaaaaggcccccugccuguugauuccaucccucuuuuguguccaguggagccauguuacucuucaguggcccagggguucacuauuaaagaaagaucaguccagguuucugggcacauggccuaaacaggaagauggaagcaucagaggauuaaaaaccuuuccccacagaaaugugggcaagaagacacuucccugagccagcagaagggacaggugcagcagcauuccacacccagcgcagaggacagcagagcccucgaugucccacuucugcuuccguucccuuucuagaagauugaaaaaaaggucaaaaccacaugccuguggagaaagugcgacauguuuagaaauacugguagggaaccaggaguaagaaaagcuuuaccagcuuuuacuacaaauggaugaaagacaucaggaucccaccaccgcaagguaaagugacuucccuuuucuggaaccccuguggcacaggaguaccaauuuuccuuuccaacgaacuggauuucuggauaggcauuuuggcuguauguggacagauaagaccacaguccuuagcccaaucccagcuauacagucaccccaauuuccacaaaugaugugaugguaccguauaauccuguaauugggaaauuucacauuuuuccuguccuaaucucagaggugggagaagcaagucuagaacaucuccaggcucagacuaaacgagaguacuuggacugcaaccaaguaaucacugcaaaguaguuccaagcagcaagaaauaccagauucucauggaggcuacuauaggguacagaauaacaacaugaaagcaaucaacccuguauaaauaauguuucuuggcauuuuuuuuuuaauuaaagaaauccagugucucaaaaacuugugaaaauguguuuaaaaaacaaacggccagugagccugcuacaccauuuugcccauaugccuauuguaacuucugaugucaagagacaaugcaaaagccucuguuuucacaggcccuauuauauuaacucugacuuacaacuguaccucucuagagaaaaaacagaaaauaaggaacaaagggaaggcaguuuuacuagugagaagaugcaaaucaaaagcaaacuggaaagcaagagcaauaguaagggugagaugagggacuggaguugagacugcuugagaaaucuggcuguguagcuuugguuugggggacugaggaagaggcuggacauauaaagugcaaucuacauugguaauaaauggucaucccuuucuucugacuccucccccagcuggucaucccccacaccacgauaugcugcaggcacauuucgagguuuagaacggcagacaaagucacagccauccuguagggggaaaaaaaagaaggaaauaauucgcagcaucuaacuuuaggauaugagaaaguguacuuauggucuaggaauguggcaagaauugguuuucuauagggauaaugagaaaaccuaaaagaucugacaaucagccuaaauucaauuuggggcaacaggagaaaaaguuucuucuuauuaggccucaccuucuucccacccaggcccucuuaaaagcuaaaucagauuuagaagagcccaucuggucaacaguguugcucuuucagcaaugucuuaccaaggccagaaauggaugcugugccacuuacuacucuguacuagggcaacugucuuguuugcugggacuuuugugguuuuagcacucaauguccugugucccaggaacccccucagugugaacaaacgaggaugguuggucacccaaccuuguuugcaggcuacaaauucaaccagcugcccuguuacuuacugcuaccagguugccaagauccugccagaaggcuaaguggggaaacugcuccauuccuuuggcucccacuaccagucgcugguauaggaaccccccaacaacauaaacagcaaccagugaugcaaaccuguagagagagaaagacaucuauacuuaagaacugggaaauaguaaaaacucagauaggauaaccucugcauuuauugucagcuguuuccuaagauacauucccugaaaaggaaaaaugaguagugauacuaaaugaaaaagggggcugguaacucuuagaaaaccaguuagagugcugucaguccaagagaagcaaaggcccagacaaaaugugacagcgugugauucuauggccaagaauaaucaccauuaaguauaugauuccauuucucuagaaguucucauaaucuaaugaaauaauauaaaaauugccuaguccugcaguaggggaaaaaagcaccuccaaaugcaaaucuauaccggcaacuaaacauuaaaucucauuuuucaaaaacuugcagucagaauuuuuuuuuuuuuuuuuuuuagacggaguuuugcccuuguugcccaggcuggagugcaguggugcgaccucagcucacugcaaccuccaccucccagguucaagugauucuacugccucagccucccaaguagcugggauuacaggcaugugccacugugcuggcuaauuuuguauuuuuaguagagacggaguuucaucauguuggucagguuggucucaaacuccugaccuuaggugauccaucugccuuggcuucccaaagugcugggauuacaggcgugagcccuguguccuggcagaauuauuuuauagccagaggauuuaaaaaguuauccccaucaauuacagcauaauguacacauacaauuugugcuuauguaccaccauauaguuacugaccuuaaaaacaaaaggaaggaaggucuguucugauaaaggaaggcauacucacgugacaaguaagauggaacccacacugaggugggagaucucuggugaacaggccaggcugcuauccaucucaaagagguagaaacaaucuuggacuuugccacgcuccucagacacaggguuaaaauuguccugaugaugagauggcauaacacauucaggugguuaaguguuuugacuccuguccaacaaaauaaaaaacccaaaaaacaucugcuccuuccugguucagcagccuauuuuccauggaagaugcgugucugacacagagagaaacugagcuccuaguuuucuaauguccaucccaacguaucguguccccucuggauauucuccccaaccucaggucaguccuuucagucuccucccucggcuuauacaacacagggugccucaccgcuagggugugucgauugcaggagaucaucaccacugcacgacgcugcuccuugccacagugguugucauauucaucacccccuuuauagaucagcaugauccaauuaccugaggagggacaaggaaaauggagcuauggggugggggaaaagcagaggcagaucugggugguauggcagaguggaauugcguaauucauugcaauugguuauaacuaaacaacccucaucaguacgaacuugguauaccagaaaugccaagcuaaacuuguuugcuuacaaagacuuguguucccuuaagacaagaaucagauauucauuuaagaauaaucuuaauuuuuaacauuaaagguaggcaacugacaaugcaaaaccaauuaugauccauaccuuaacacugauucauuuucugaauaccuucuaaaagcaaaaaaagagguuccauacaauugcugagcagcagggguaagcccaucuaagauuucaacuuagccccagauaaauucagaguggauaucuaagauuggaaugcauaucucuucuuuaguauuuacuguguucaguucuuuugcaaaauaucauuugauucaguaauugugaggugaauaagguaaagauucugcuccuaguuuugcauaugagaaaacaaggucaaaaggugauacgacuuuccagucacaggauuaggaaacaggaggagaaccuggucacaugauccccagccccaaacccuuuuguuacuuuuuuauuguauuauuuaccaggaguaaauagcuaccuuguauaacuuauuuaucuguaugggagggaauuggaccauaggugcuuacaugguccucuccagcaauaugacuuuuaagaaauaucaccaccauagcacaaaaaucaguggguaaaguuuugcagacugaguaguuugcaaaaaaaaguuugagcucuuaaaauuuaacugguaaacuuugauuaauuugaugaaaaguggugguggugguugguauuuguaagucuagugugaaacucauuaaaaguauuugggugaauaaaaggacucuaggcuacagaauucuggcuagaguuggcugggcgcggugguucaugccuguaaucccagcaccuugggaggccaaggugggcagaucacgaggucaaagaucaagaccaucauggccaacauugugaaacccugucucugcuaaaaauacaaaaauuagcugggcaugauggcacacaccuguagucccagcuacucaggaggcugaggcuggagaaucgcuugaacccaagaggcugagguugcagugagccgagauugugccacugcacuccaggcugggugacagagagagacuccgucucaaaacaaaacaaaacaauucuggcuagagucuucauuuugcauaaguuuuucacugauuuuaaugcacaacuguccugagcuguggcuuacagaggagcuguggaauuaggcauccugugguauauuacagucucaggugugccgaaccacacguaugauaugcugaagacacuagaaacggccaagacauacaggauugucagagggauugacuugggaucaguuagucaaucgaugguaggaaggggaguuuucuuacuuccguugaagaugugagucucguugagucucccuaccacugucuccuucccauuacuuuuguugauuugcaccaggccugccccagaagugugguugccagcuucccggcacacccugaagauguagauguaugugucugaacccuggcccacagugcucucaaagcuguaaagagaagugggaagaaagaagaggagaguuacuagcuaucagccucaggaauaacagcaucccuuuccuuaauuaaaacaaaacaaacaacaugcucgauuuauuuauuugaggucauggcugagugaauauuuguuuaauuuuaagauauucauaaccuugacagaccauccuuauugcugaugaugaauuauuaaaacacacuugagcuaucuugauagcucaauauucuaguuauuuuuagaaugccuguuaguaaccauguuccaaugaauaagggcccauguucaucggauagucucguuucuuagggaccaacuucagauuuauauaucugaagguuccugacacuuauaaugacaugugucggccuaaauauguuuaucugauauuucuaaaguccuauuauauguaggugucaaauaauccuuaaauuucuacaagcuggucucuuggauccagucuuggaaauagcuacacuucugugaaagaugagaaaacugcacacagcaacuaaaaacugggcugagaauuugcucuaugucauaaaagagagcacauuaugaaauaaaaucaguaagaagaaaagacuuuaacauaaauauuuucucaagcucuuuaagguucuucucauuuaccuuuuauuaaacagugguuucagccucuucacuagagccaacucuuucucugacucuuuacccuuuucuccuaccaagucgcaaguuuuuucuucugucugccaggauucucucacugccacagccaggaguaguaguagcaguccaguccuccagcagcuguagaaagggaacauccuuugggagagaguguguguuggggagggcagguaggaucaggagagagaggaaagagauaaagcguaugaauguguaauaaaucgaugguauuuuaauuauccagaaaguacaagauucucuggcauaugcaacacauaguacauuuuaauaucucuguaacaagagcaucugcagcagaaaauucauuuauauguaacuuguagucuaauguauaggugagucuuucagaacaaacuacaaaguugggaagagggaaaugaaagaacuuaaaaaagaaugaugacagcuuggguggagccauccuugccucuuuacuguuugauggcuugauguagucuucugaaaccucuuuggccucuacaggucacaaaucucaaggguuucuagacuucccauaaguacaguugucuuuuacacuacaaaucaaugacaacaaauuggggaucaccaagccacuuuacaauugaguaaauucaaugcaccugcugcuuguacugcucuaggaaugaaaacacacagacagcucucuuucccaaacuuacuagacuggugcaaaggucauugugguuuuggcaaaaaaaccccaccaaaaccuaacauuuucuuuucucuuauccaucuucauacccaggacagacugacuuacccuugcaaaacacuuuacucugguaucuguuaaugaucccucaggccauugcuacuuguuuauuccaagaguaucacggacaauuuccugauuuaacucuucuaaacuuuucucacuuacaaaaaacgcugcaagucuggacuuugguuugaauauucuuuaaaguucucuaguucuuuuucaugcggguccacuuacuccaccucauuuuuaaaauauaaaacuugaaacaggcagaauuuucauggguacuaaugaguuugaagaugggaaaauggaagcuccaaccuuggccgugaaugcacuuuccccauuccccuaaacaaccuaacaucugaccuuccacuucccacaccccacuaaagcaaaaaaucccgggaaauugucuaccugacuuccuguaccccaaacaucaauucucuacuguaauauuaugguaguuuccauagaauaaucauagcuaaccaagagguccaaggcccucauaacacauuuaaugcacugaaaccacacaacagcaggaaacaacagacuacugccuugggccaggugcuguucaaagcacuuaacauauauuaauuaacuaauuaauccucacaaccuuaugaguaaauacaauuauuguugcuauuuuaccaguaagaaaacugagacacagcuaguggagugagccagagagucuagcuccagagcucauggucuguguugaacaacuacauguauauuuccacuaugugcauaacaauuuuuuggagaugagaguagacagccaaaacuguggguuuuuuuuuuuuucuacuaagaagugaaggggaagugauuccucacacaguugacugaauaggaggugaaauaaagaacucagaccuccaacucccaccuucccuaaguuaacccacugcucaacacacaacuugaccagcugacucacuaaaaagaaauaggagacuccuucuucuagacugacuuagccugccauuuuccuuuccagucucucaggaccuaauuaaaaacugacaguugauuucuuuuccuaaauuagaacaaggaaucucacaaaauuaggaagggaugaaagguuaaacaccucagccauuagcugaguugaacuaucuuucauuugcuuauuauucaaaaaguuaggauaauaaauuuauacuguauucuucuuuccugcuuaaggcuugucuuuaaauuuaagcugcuucucuuuaauucaguggcauaugcgcuaaauguuuucccuagauuauguucauucaucuucacaacccagaaaauagguauaauuuuucauacuucacagaugagaaaacugaugcuuuacagaauuacuuguuaaauuacuugcuguacauuacacagauauuaaaugugugugaaguuacuggggcaauuuagacgauucguggcauaaagauaacugcuggaaaacuuauaaacauaggggugcaacaaucaggaagagaaugaaauggaagggcccaguagcccccuuuuaauaugcuacaauuagauucucaagguacaagaguuugucuauauacuuuggaaauaaggagcaggauuuuaugaucuugaaaaaucuuucaguuuucuuauucucuaacgacagaucuauuuuauuuggcaaugcuaaaaauuauccuuuauuaggguggccaaugacuaagccagcaacugggaagcagcuuacaccacugggccucuguagcacucacuuccccaucuguuaagacagccauggccauuuaccaguggaauuucuacugucuucccgcuggcuccuuucugauguagcaguccuuaucccuuuuucuccagcagccuacauguuuagaaaagcagccucaauuggcuaaaaggccuaaugcugaaagaacucaagagagaaggagccucagacaaguagcggcuaugucccaagagcggaagcuccccacaacgaggaacacaagauaauccguccaucagccauucuuauccacaccacagucgcaucccccucaaagcucucccagggugccagaaauucucgcucugucuagugucccgacuuuccaagcgcuuguagccauacccucuccaaaugaugccacuugaccucccaccgugaugcaggccaaaauuccuccuacaaauaaauccaccaacaccuccaacggacuccauacuugggguauuuuccuuucccugcuuucuaaauaucguaaauccccucucuggucuuggaaguccuuucucccucacaccuuucggaacuccgugacucuccgcucucaugccuccgccuccauucuacccuuagggcuccucagccagaucuuuggcuagaaccauggucaagggagaaugcgauuccggcuccugucacagacgcuuaagugugagcgcaacccagcccgccuccuccuccacgccccucacacucacgugucgugggaaacuggaguagccaaagcucagaauccccagugaauacccuucuggggaugggagacggggccagcuaggggccggccgcagaccccggucccagagcuaguuucagaggccagcguucccccuagcgccucgcugugccccacucugggaaccggaaacaggaagcgccaagaggccgcugggcaaccgcuccucccaccagaccccgcggcaugugaccauagaaccauuucgccccuuuccccuucccgggcucccugauaaucuuaaacucugauuggccaguauucugggacuuuagcuccgcccucguuccaucagcuccaaucacuaucgagguugucguuucgccuuuucugguugccuuucuuucaauggggucccagagucccgcuuccagggccucucggcucgcgcaccccggucacgcggggucacgcgcc

SEQ ID NO: 13761 - RNA, 30366 nt, Homo sapiens
cggaacggacccggaaggggcaggucuugugggcggguccaaucggcugggagccucguggaggcugaggugaguccuggaggugcgugguuggggcggagagcauuaucugcggcuccgauuuugcagauucuggcugaggcguucgugaugucagcagcagccgagacgggcguguuaaaggccgguugcuagggcugggggaacucagguaacuacgggcguccccacagcaguacuuggaagccccucagcuacucggcgcgguugcgggugcugagcagagcugccugaccgugcgugugcacgggcuggccugaggaugauaugaccguguguucgguguguggaacccuccgucacccuccccugaccgaagacucguuuaggaauguguggcaggucuguugccacgguccaggccuucagugcaucuuggaaacaucguuuugggggcuguagguuaggaagcggagaucauggggucucggaagaagguuuggucgugaacugucagaaaggaggcgaaagcugugcacguggaacaaagugaacagugcaaguuguaugggagguaguuuaaauaucgaggcgaugaaaaaaggcugcuagaauugggcuuacucgaaaggaagugggccucagaagauaauauuaguuaaaagaaguagaggagaacauggauguuauucuaaguaaaacgaauaauaugaagaauacaaggucgcgggacgaggaaggaaacuagccagccugacaggaagguuuauucgagaaauacggggguuagauaggaugaguuuuuggaaacuggcaaacgauuuagccuuuucaaggcuuuaggauagggaaagcucauuugaaaagauuagucgguaguauuaugacguuuaaaugaaaagagugaaaaacauggaggcggaggugcuagguggaaaaucagugcaguaauccagugauaaagagcuggaacugaaagugcuggagagaaagggauccuguuucagaguaacagucagguggaauugacuaaagagaaagaggcaaagagaagcaguuuagcauagugguuaaaagcagaaauuuuggaguuagacuggcuggauugggaucuggcuuuggcaauuagcugcuaaaugacuuugaguuagcaauuugccaucucugggucugaguuccuugucuguaaaauagagauaggaagagugacuucccuugugguguuauuguggagaauuuguuuauuuauuuuuagagacagagucucacugucacccaggcuggagugcaguggcgugaucauagcucacugcaaccucgaacuucuggacucaagugaucuuucugccucagccuccccgagugcgucaccaugccugguuaauuuuuuaaaaaauguuuuguagagauagguucuugcuguguugccuauguuggucugaaacucuugacuccuaggccuuggccucccaaagugcuggcauuacaggcaugagccaccauaccagguccuuauggauaauuuuuuuaugcucauauuuacaaugugcuagaggcuuuucuaagugcuuugcauauguuagcucgguuucauuaauugcuguauguaauuaaacaauugcauaauguuaucaguuacuauagcguaagcacucucuaaaucuuggcugcuauaauaauauuuuuuuauuaauaauucaaagguuauuaaaugguuuugagccugaagagcugggaaaauugugucuuagugucagaagaaaagagagggguaccagaaguaagguaggcuugguuauagacauguuaaaugugaaacuauaagguauucaaguggagauguucaguaaauauuggaaacucuauaauuaguauucauguagguggaaaggacuggaaauagacagaugggagucccuggaccuaggcaugcuauaugaauucuccaaggaaaacacuguagaaggaggugguagauggccaaagacagacaaacauaaggaacaacuacagagucuggaggaauaagaggaauugggaaagaauuaaucaaauggccuaggcuaagagcauuaucaccauguuaauauuaucuuuccuugauuuuaaauuggcuuuauguugguuccugugagagaagcaaugaggccaguaagugauuauuaccagaaaauauuaucagagaguugagauugaauuuuuuuuguguuagacuaaaacagcauuugauaauuagaaagacccuguagaguuaagccaaccaaccaaagaaacaaaaaacaauagcaaaaagaaacagcuccucauaaaagacuguaacuucuuuauuuuuguguguuuuaaguugcauggguguuuuuuggggauacuuuuuacucuuccauguaaagaacagaugggacugauuuguuaucuccuucauucaccucuugucccuuuuauaaauaaccaguggauuauggauuuucagugaauuuaauaaaagugcagaaauuauggcaucuuuccaaaaauagugugccaaguugcucaaccauuuucuaugccaaggguaaguggcugcucugauuuugaaaugaaggacagacuuucauguacuaguaguucucaaagugugguccaagaacugcaauagcagcaucacuuggaaacuuguuagaaaugaaaaauucuaggcccuaccucagacuuaugaaaucagaaacaggugcugggagaagagaugagaugguguuuucuagcaauguuuucauaagcccuccaggugauuuggauguauacuagaguuagagaaccacuguacaagaagguaaguaccaugagguuagggauuuugccuuguuaauaguguauuuccagugucuagaauggugccugucuaauugguagguuuucaauagauauucauugaaaaauauguucagucucagacugccaaucucuguguaaaagcuuugaugcugguuuaaugggcagaaguaaaucaguuuagcugcauugagccuauaaugucagauaugcaugaggugggcaugacaacgugacuaauuuggaacuugaggaaugagggauuauauugagucaacacugaauaaaaaaugauguccagguauuuuaggucaaugauucauuuagaguaaauaaagauuaagaagucacaaguuacaugcuuuuaaugacaugaucaacaguugguguuguucuggcgcaguggcuaacaccuguaaucccagcacuuugggaggccguggcggauggaucacuugaggugaggcuuucgagacgagccuggccaauauggugaaaccccaucucuacuaaaaaaaaaaaaaaaaaaaaaauuagccggguaugguggcacaugccuguagucccagcuacucgggaggcugaggcaggagaaucgcuugaaccuaggagguggagucagcugugagccaggaucccaccacugcacuccagccugggcaacagagugagacucugucucaaaaacaaaaaaacaguugguguuuacuaaccuaguagaaccaaggcacccaaggagcugaguuuucuuuguuuauaugcacagauugcuucaccugugguaucagacaucacaacauggggcucaccaagcaguaccuacgcuauguugcuagugcggucuuuggcguuaucggcagccaaaaagguaauauugucuuugugacacuucguggugagaaaggacguuauguggcaguaccagcuugugaacacguuuucaucugggacuuaaggaaaggagagaaggugagccuaaaaugaccaguuugauacugauuuauugguauuugaggauggagagguaguagaagugggggggcucugauuuauuuaucaugaguuuuuuugugucugugcccuuagaagaaaaaucuuuuuccuuuaggucuagcuagccaagcaucaaguuccuuuguguucuucgccacugaauucugaaaaccacaaugaaauaggagcuuauuucuuagaugucuauuuguuggaauauuuacaggucauuauuugcaguaauuauuuauuccugauguauuuuuucucuaccaauucuauuuuucaagcucgacuuaugcuuauagcugguuauaaaauauuaggcauguaaaaggaagguuagucuauuuuggcagaaucuuuuucuaauauggauaaugcccaaguguuguuaaaguagacuuugauacuuugugugacugaauucccuaagccuaccacuuuugccaaaccaaauauaggcauuuugauauuguccauucauuuugugauucccaagagguuaguacuuugauucuuguugccaccaagaguccuuugugguuaaaaccacugcaguacucuguugccacacagauuauuuucuuauaaaaugggucucaguuaaaggaauuuauaaaccuuuauugaaaaucacguaguguuguucuaggguuaagaauuagauuaaagggauuaaauuuauuuuauugccuagggaguuuuuauauguauuacaacaacguagggcuuuggagaaaauaauuaagccuuuucuuaaauguuucauugccuaguacaaauacuaauuucuauauuaaaaaacuugaaauggauuguggaguuucauuuuuauucauaagaguaauuuggaauuauuggugcucuuaauuuuacugugccugaguauuccuaugcuuuucccuugaguucaugcuuaacucuucuacauuguuuuuaauuuuuaugauuucagauucuuauccuucaggggcuuaaacaagaaguuacuugcuuaugccccuccccagaugggcuacacuuagcuguuggguaugaggaugggucgauccgaaucuucagucuccugaguggggaaggaaaugugaccuucaauggucacaaagcagcuaucacuaccuugaaguaugaucagcuaggaggcagacuggcaucuggguccaaggugagccuuugaaucagcccaggcuuugaucuauuaaaggaauguaaggcuuaugcugaagcaaguuguugacaaaaauugucagguaaaacaaugggcugucaauauacaaaguaguauaaugauagagugaagaggaugggugugaauugggugguucauuuuguuuccuuuuguucauuuugucauauuuucugauaaaagccucuuaaguguaggaauaagaugaagagagccaugauaacucuuauuguggaagugcuacgcaaaacaguaaaauaaggaaagaaaacaaagacuggaaaagaagagacaaaauaauuauuugccauugacuucuguaaagucaguagaauuuccuguaucucacaagucaugaguuagaaaauauaaaagauuccauucacaacagauuaaguaacagacauaaaaauaccaugaaacuuuacugaagaauggaauagaagacuuuuauagagauauaauccauguucuugaaugggaagacaagguauugaaaagaugguaguguuuucuaauugauuuauauagcuaaagcuauguuuagacauauguuuauauagauacagauauauuuaaauagauaucuuaaagguuuuaguuguuacuuagaacuugaccuaauauggaaaagcaaaggaauuggaaacacuaaaauuugggaagaaaagaauaauaaaacagggguuuuagauauuaaaaugucauauaaacccauaauuuaagaaguaucauauugauacuucaaugcaaguaccaaugcaaaauagauuauugcaaccaaauggaaaucucagaaacacauccaugauuacauuccuaauuaguauauuuuaaagacgacauuuuaauaaguagaaaaaugauagauuacuuauaaaacaguccuuagacaauuggcuauuugagcgaaauuuuuaaauuaaagcuuuaccucaugcuauauaccaaaaugaaacaaagauuaaagacuuaacuauuaaaaaauagcauuuuaaaguaaacuagaaaauauguaaguaaauauccgauagcaagguagaaaaggacuuuauuagcaaagaaauaaauuaaaaaaggaaacuguugguagauuggaauacuugaaacauuuguacauuaaaaacaagucagaggacacugaaaaaguuaaaauauuuaauauuuucaauauaaaaagaaaggauuaguaucauucaucuauuaauaacuuacagucaaauaagagaugacacucuaagaaugauagacaaaagaaagucaugaauuggcaauucaaaagagauacuuuauggccaauaaucaccauaaagcauguaaaauauuucucauuuguauucauaaaaaauguaaauuaaaauaaauauuaagacugaacauuuuuuacuuaugauauuuguaguaguuuuugagaaaacuaauaauagaguuaaaugaauggggaacaggccuugucauacauaucccugcugguucuauagauuuacccaaccuggagaucauuuugauaguaugaauccaaaacuuuaaaaauaaacauaucauauaacccaagagcuuuucauuuuaguuuuuucuaaucagagauacauacagaaauuuguauauaagaauguucacuucugcauauuuauaacagcagaagguuggaaacuaaaugucugaaacagaaaaauuuuuaaauaaguugugcuauuacuuuagaauugauuauuaugugagcauuaaaaaugugaacacucuggaauaacauggaagaaauggaaauaauauuaaaugaauaaagaaaagguuguaaaaugauaugaauggcaugauuuuagucuucuaauaggaaaauaaccuggauuauacauaaagacuagagcaauaacaaugucuggggauuauuucugguuggugagaauaaggcugguguuuauuccccuguacuuuccccaugcuuuccaaauuuucuguaaggacuguguauugccuuuuuaauaauuaagucucauuguuugucaaguugggccauauaugguaaagaaaauuauuuuucaucuguauuauuugaucccuuuaggacacagauauuauuguaugggaugugaucaaugaaaguggucuguaccgucuaaaggggcacaaggaugccaucacacaagcauuguuucuacgagaaaagaaccugcuaguuacuagguaaagaaauaaugguuuaauuuccaguuauuuucuaggaagagagaauuugcuuuauuccuuacucauuucucucaugagcagugugcucaugcuuaugcauuaguuuucucuccuguucuccugcauuccuucuuuccauuucuucuaaguaguaucguagagcuauccaaagcuauauuauuuuuaaaaucauuuuucuaauuugucauucuuuuuucuugauaucaguuuuucuguguuucuuagccuuuugaaacucauuauagaaugagcuuugucuaccuucuagaucucuagaaagccaggaaucagaauauggagcagagggaagauaugaauaccagguguuaaauucggcuugccuuuugaggagagauguacuguacuucauaggccuucugaacaccuauuaggaugaaccauuugaaauuuuuauuuguguacauaaaaaaucaucaaauaucaacaauuuuauauuguucaaccuaauauaauaaugaauauuccuaaagaauggccaccuaggaaaagcugggauaccaagguuugccaggcauuaauuagaggaaccauaguaaugacucagaaaaagcugugagcacuaaaugcuuuaccaaugguggauuuguuucugugggauaggauacagguaaauuagugucuuguucagauaacacagguucuguaagagaaugauucuauaguucuaauagaaaaaauauauauuacagcuuagggaauauaaaggcaaagaaauaacacuguaaggugggguuauaugggacggacuuuguaaaucagguuuuugagcgguguuuuuuuccaguuugcucaugaaggaggauuauauuagauuuauguagugaggagguagggaagagguguuugagcaggaguaguagaggccauuggcugcgagagguuauauuuaggggguuaagaacaaauaaauaggaaauuuugagacugcugccaaugagccugacuuugauucuacagggaacauugagcuagugcaaauauuaaaaauuaagguuaucugacaguugcacauuggaugggaugagagaacagcaauggacaaagagaccaaaugagaagcuguuaaaauaauccagguaguaggacuuaaguucagguuaguguacagaaauggacuagaggaguuaauacuuagaaacuucacagaggaggcauuuucaggacaagagacuaacuggacaggaagacaagggagugggagcggucuaagauguuuccaugguagacugucugaggggaaugccagugcugugaugauggaaaugauaggaggaaggccugauggaucaaauucuguauucuuugguacucugcaucuaaagucauucuugugcuuauagguggaacauuuuauuuucugcacaggaauaacuacaaggaaaguuaggauucuuugcuuuucaaaaguaagaucagagagaaucggagcuuuagacauuauugaagcauauguuccuuuuaaagcaacagugaguuuuggaucucccuauucguugaaugaguuuuccuaaacaggcuauauauuuuuuuccuguuucuucuuuuagugggaaagauaccauggugaaauggugggaccuugauacucagcacugcuuuaaaacaaugguuggccaccggacugagguaaguguagggucaugggcccagggaaauaaugggaaggcaaaagggaaaaggugguggucuucucuuccccuuucauggcucuuuguuuuuagugcacacaguaauuaucauaugccaucuugagggacagugaggcugguaugauggaagcaaugccagccauuggagcagauacugcugcucugacauguaguaaaaauuggccuugcgugguuuuuaauuccugaguuucaucauuucuaaauaauaaguguccacuuuuaugaauguagggaaguuuaaugauauuauaugugcagcaccuagcuuauugacagguaagcagcacgugguagcuguuaaaauaguuacuugaacagagaucuauucaguugaguucagggacuguuuuuuauauaucuuugcauccucagugcuuuauucauaucaggcauucaggaagguaauaccuagaauuaaugacaagaagauuaaauucuuuguugauuugcaacaauauuauuuucauuauuuaauucccggauacuugaagcugaaaguuaugcaauggacauuaguggggcaccuuuuauuugcuagacacugcuaaaagcaaagaaauagaagacuuaaaaucaucauuugaguggauucuaguuaagauuuaugcugaacagccauuaucuuaauuugauuauacgagguuagagacaaacugcuaguaucacaaaaguaacaauuucaccgcaggccauuuuuuucucuguaaaagugagacuucucuuagugcauuuugaaaggguugucgauaugccuuuucuuugccuuuaaauugcuagacauuuuacuacgguguaacagacuuuuggaaugucauauuaugcuaccuggaaucucuugaaaaucguauuacucaaaucuuuuuauauucuauagguauggggguugguucuguugucagaagaaaagcgacucaucacuggggccucagacagugaacugaggguaugggacauagcuuaucugcaagagguaauuacuucuuaaaaucaugggcaauauguuuagaaguuucauaagcaccuuggauuuagaaucagauguaauuauucaguacuucacaucauauuagaaggaauucuaucacaccaauaaccugcaacacuuaaaaaagcuuuucuuccuuauaugcucauuauccuuauuuauuugagcucagguuagcuuuaggcuuacagcuucugguaauacuaauguuuuaguuuguggcacucuuaaucagauauucuuggaccuuuggguguccauggauggccuucagaauaucugugaaccuuuccccucaaauauauauguagaauuuuauguuuauaaauauguauauucugaaaagaucuauaacuuuuucuuagacauucaaagaauuuacauagaagaaaagcuugcagaccuuagguuuagcugaauuucggugugugcuggguccagcagccauuucgaugggaguuacauuaguaggcuagggguuaucuuuucuuuauuuaaggagaaaauguaucuaccugucuugcgaugcuuuugcaauuccuaaugccaauuugaauuuuuuguucuauaauauggucaaccuuucaccuaaauacagaaaauuuugaaguuagugaagaguggggucauuauuuuuucaccauugucacuaaacaguaguccuuaugcuauagaaaguuuuuggagauaguauaauaaguaauauuuuguuuguauauuauguagucaguuuuuaauaaguucugauaccugccuugcuacugaagagguuugauaagggagaucacugauuagaagcuguuauuggccauaagaaagauuucuaagucuucaggauuaagaguuaccuccugggccaggcacagugguucaugccuauaaucccaguacuuugggaggcugagauaggaagaucacuugaguccacacacacguuugaggccagccugggcaauauggcaagaaccugucucuacaaaaaauuuaaaaauuagucaagcacaguggugugugccugugguuucagcuauuugggaggcugaggugggaggauggcuugagcccaggagaucaaggcugcagugagaugugaucaugccauugcacuccagccugggcgacagaguaagacucugucuccgacaacaacaacaacaacaacaaaacaacaacaacaacaacaacaugccuccuggaacauacuauuucagcuuuuauuuucucauuuuuauaaaacagauugaagacccggaagaaccagaccccaagaaaaucaaaggaucuucuccuggaauacaagauacucuugaggcagaggauggugccuuugagacggaugaagccccugaggauguaauucauuuucauuucuuaaguuuaauuguguugaauaaugggaaaguaagaauugcagauuuuuagggaaucaucacuuuagggaauauuuuugucacuugcacuuauuagaauuauguuuuuuucagaaguucagcagaacuuacaucuaaccuucaucugcucuugcuucuucuguagcgaauccuuucaugcagaaaagcugguuccauaaugcgggaaggaagagacagaguuguaaaccuugcagucgacaagacaggcaggauucuugcuugccaugugaguaccauacuuaggagaaaauaacaaggacuaggcuguuccuuccaaacacucauucuuucauauucaauguaaagaugacuuuuucuugacucauguuaauaauucauuauaugguacuguguggaccuauaaucucuagcuuuauuagcauaacaacaaaaauauuaauaauuacuauuagguugguggaaaaguaauugugguuuuugccauuuaaaaaguaauaauugcaauuacuuuuguaccaguauuauuauuagcaaccauuuauuaaaugcuugcucuucuaagcaauuuaagagcauuuaacuucuuguucagccuucagagcaaugcuacaaguaggaaaugguauccucauuuuacagaugagauagcaaacccagagagauuaaguuguccaagguaaugcaacuacuaagggaagaaaaauaaauauuguuguuuacuuuuaauugagaauuagguaaauuacaaauuaccucuccuugacucacauuaaccuuuugccuuucuagggaacugacucugugcuagaauuguuuuguauccuuuccaaaaaggaaauucagaagaaaauggauaagaagaugaagaaagcuagaaagaaagcaaaguauguuuucuuaauacuuacauuaauaaugaaguauccuggguaggccccauguuacugaaaaaaaacuggcuucuuucauauuuacugucuuaucaauuaccauuaaaaguuaaagaacuugugagguaucgauaacccaaauuugucaagucucagagagacagaaaaucaucugauuuggcaaaucuuuugauaccuauucugguuuauuuaacaugguuggauuguuaagugcagguuaaugaguuuucuaaaaaguccugaaauuagaaaaauaaccggagacauuucaguggaauaguuggaauuacaaggaccuuguuacaagaaauuuuaugggcuauugcauucagaauccauuucuuaaggguaccuauuaagugaaauaauacuuuaugacauuguaguguacaaagcauuuccacuuauacuacauuguuuaauuaucaugguaauccugugugguuaagugacuuuuccagaauaacacaguuuguuggucaaggggccagauuuugaacucaaguaagagcaaagcugcuucuagaaaaauaagagcaugauauacuuuucuucuucccucuagauuacauucuagcaaaggagaggaggaagauccugagguuaauguugaaaugagucugcaagaugaaauccagcgggugacuaauauaaaaacuucugccaaaaucaagugaguaaaaauaaauuaucugaaguuauagaaauaguaagcuaccaaguauuauuggcuuuuucaugcuauuuguaagcugucuguaugaauuauauauguggagacgguggucaugagacaucugugucacacucugcuccuguuguccuaaucaugggcccacuuuuugucuuguauuuggauuauuauaguacccuuuuuagcuagucauuuacugucuuuuccugcagcuaauuuaagaaaaagaaaagugugucccacguucagaaaggauauaaggucacuuauaaagaauacauacacagaaccaaaguauguaucagaaccaggaucugagccuaguuuuuuuuuuuuuuuuuuuuuuuuacuuaaaagccuacucagcuacuacucaauacucggagcacucuuuuaauuuuuuuugagauggagucuugcucuguugcccaggcuggagugcaguggcaugaucucggcucagugcaaccuccaucucucagguucaagcgauucuccugccucacccuccgcaguaacugggauuacagacuugugccaccacacucagcuaauuuuuguauuuuuaauggagaugguguuucgccauguuggccaggcuggucucaaacuccugaccucaagugauccacccgccucggccucccaacaugcugggauuacaggcgugagccacugcacccagccucagggcacucuuacuugaaaaauuguuuauaguuauucaaacuuuauauagauagaggacauuguaaagccuuuuccuggaaaaaguaaaccuugugagcuaagaugguagcuagaacauuuaugauuauuuucuuguacagguccuuugacuugauucauucaccucacggagaguuaaaggcugucuuccugcugcagaacaaccugguggaauuguauucacugaauccauccuugccuacuccucagccugucaggacaagcagaaucacuauugggggucaucgcagugaugugcggacuuugucauucagcucagacaauauugcuguucuuucagcugcagcugauuccauuaaaauauggaacagguucgugaaaugauguuuuauauagcuguaguuaguaguauuucuuuuaauuuuuuuugguacucuuaaggguuaguuauuaacuccuuaaggcccuaaauacaauuaucuuuagugcauuugggccauuagccuguggagcuuagagaagaaaaaguugccuuuuaaaauguggugcaaaaaaaaaaaaaggcaagcuuauuccauguuuagagcuuguaacuguacuuggcuagagaaaaacacacaaccauacuaccuacucuuuaaacuuaauaaaaagcaggcuguuauugcugcccaguaauuguacccuaauuucucacccuucuuuuacuuucccagaugacuguuuuauaccuugcuucuguugucaaaucaaauaccuccaaaaccuugaagcuaaugaucauaucucccaccuuaaaggaaauaauaacccucucucaccccugcauugcucuccaguuacuaccccauucucugauuuguuuucuccauucugucuucaucugucucccaucaagcuuuuguccccacuguuucaccaaaacagucauugucaucagugaucuuguuuccaaauccauugagcuaaaagcuuuauuuuaugcuuuguccuugaauugaugacuuucugucuuugacacacucuuugacuuucauuauuuccccuucccuugcugucuguuuauucucaguccucgcuccaucuuucuuaucuuuaugacgucuaaguguuagagugcuuuagggcagagucuuuggaccuuuuguguaucuaaacucacuuuauguaaucugucauguagcuuucucuguaugaugacacauaaauuuauauccagcuuuaaccuccucccuaaacaucaaauucauauauacaaauacuuugugucaccacuuggaugucuaauuaagcauuucaaacuuuuaugugucccaaaccaaacuuacguuguucaugucuccaaaaaucuucccaccugcuauuccuucagacuucccuaucuuaauaaaugauuacuugcuaccaguuguagucuaaaccuuguagccauucuugauuuucuuuuauuuauuuauuuauuuugagacagaggcucgcucugucgcccaggcuggagugcauugaugugaucucgccucacugcaaccuccaccuccuggguucaagugguuuuccugugucagccucccgaguagcugggauuacaggcgugugccaccacgccuggcuaauuuuuguauuuuuaguagagacagaguuuuaccauguuggccucaaacuccugaccucaagugauccacccaucucggucucccaaagugcugggauuacaggcaugagccaccgcacccagcccauuguugauuuucguaucccauauucauccaaucuauuagcaaauccuaucagcucuaccuucaaaagugaucccaaauccagccucaucuuaccaccugcacugccacuaccccauucaaaccacugucaucucucaucuggguuauuguaaagcccccugacuggugucccugcuuucuugcuugccccucuauagucuguucucaacacaguagccaguguaaucuuuuuauaguggaaguuagaucacuuccaguaguuccaucucacucuaccuaccuuacacaccuuaucucuuacuacucuccuuuucugcuccacuagagccacacuggucuucuugcuauuccuucaacagaacaagaaugugccuuucuuauggcuguugugcucccuguucuuucugccugaauccaucuuccccauuuauccauaagcuuuuucugugucuuaucagaugacaguccuaucauucuuacccuacuccuugcacucuucauccucuucucccagcauuauguugcucuauagcaccuaacaccugauauaccaaauauuuagauauuuauuauucccaaagaauguuaaccuuuaugagauuaggaaccucugcuguuucauccacuguuguaucuccagcaccuagaacaguaccugguaauguagugggcauucaguaaauguuuguuaaguggacauuugauauauauuugauuaauuaauuaauguuugugguccuauaaaaaauguagggauauguaaugauguacuaauuugacuuguaauccuucagacucacucacuucuugguaauggcagauugggcuccguggagcccagcagacacuuuucuacucugcuuuugugugauuucuguuccuuaggauuuggaggccuuauaaaguaaacaaaguuuggugcuuuuuaguauuuucucccaugacuauaauugugugugagucaaggguuuuuaagacuuuuaucuucuuuuauguugaucugucuaagugcauugaaaccuacacacugaccucuaaaauggggaugcagauucucuuaacaugaguucuuuauuuuuucuuucucauaggucuacacugcaguguauucgcacaaugaccugugaauaugcacuuugcucauucuuuguaccuggugauagacagguagucauaggaacaaagguaaauggagacuuuuucugggauaucuggaucuuuucuacucaaaauucauaaaguuaagaaaucugguucuucuuuuuagcauauuggaaauggacuggagcuaaguaaucugggaggauguuaguuuauuacauauuuuguuuacugaaguuuuacuuuauuuuuuaaaaauuaugaagaagaaaauuaaaaucaugacccugagauaacuaccauuaacauuuuggugaucauccuuucaugugucuuuuuaugggcgcauauguaauuguguuuuaauuaaugauaaaauauauuaaggguaauaauuaaauauauuaaguaccuaauaucaugcuuggcagacagaagcauucaguaaagacaaacugaucaaguccuuauuccuaggugcuagucagauugggagacaaccauguggaaauaagcagauauggauuuggauuuaguuucugcccuuuagaaauagguaauuugggccgggcgcaguggcucacaccuguaaucccagcacuuugggaggccgaggcaggcggaucacaaggucaggagaucgagaccauccuggcuaacacggugaaacccugucucuacuaaaaauacaaaaaauuaggugggugugguggcgggcgccuguagucccagcuacucgggaggcugaggcaggagaauggcgugaacccgggagguggagcuugcagugagccgagauaguaccacugcacuccagccugggugacagagcaagacuccaucucaaaaaaaaaaaaaaaaaaaaaugaguaauuuggagcaagucacauaacugcucauaguguguuccuuuauauuaugggaugacgacacuugcuuuuugacagcagcuuucguaccagauggacugguaccagccucuggcacuuacuagcuaugugaccuuaacccuguuagccuugguguucucguggaaaaugacguuacugacccauuucacagagaugaaguauacaaaacucuuagcagagaaacuagccugcagcgaauagcuaaucgauaauagagcugguagcagacauagcaguagugauuguaccaguagugagaauaaaauggaacaaggucuauggaguguuuugaaaagugcuuugcaaguauuugucauuauuauucccauaaaacaaagccauauguacaugaguuuuauuacaaaauguauggaucacaauggauauuucuugcuucaacaaaaaaauguaggcuggagagauuuuaggaacaaugccaggaaacaguauucacaucucaaaacuuuccuuccuuuuucacucuuucaacaaauguccaucucugauuugccgucgggaaaguaguuuuuuaauugcuuaagacuacccauguggcuaaaaugcaauugucggcuuacuggcugugcuaggcaauuaauguacauuaucucauuuaauccugacaacaucuuugaaacauuggugauauaaauuucauuuuacagaugaaaaacuagguucauggggaugaauuuaccaaugggcacaaagcagaccugguacucaagucuuuuagcuuaugcugucuguaccaccuugugcagaagcucaucguaaaacaggcuuugccucuguguguguuacaugcugacaccaugacuauggcauauacagaccucuaaauaggaauuuuagagugauugcuuucuaugccauuaugauuuuuuuuuaaauucacugccuuccuuagugcuguagguagaucccauuucuuauugucaauguauugcagaggaggaaaccaaaagcagauggaaaagaggugguugcuuaagccaauaacuauagaggaucauccgcuuaaaggauuggcuaaacuuuaaaggcuuuuagguuugcauuugcuauuuuguuuauucugauuugccuauggucaugauauuuuccuugugaaguuguguaaccaaugaaaguaaugcauccaguacugcauggugguauuauuccauacuucuacacuaugguagcccugccaagguuaacccagcacaucaguaggggauuuaauaguauuuaaucagguaggaaauacagaacauggaaugugggauccauuuccuaagcaauggaucacauuuuugcagcuugguuaugaagucuuuucuaaauugugcagucaugaaucauggagguuguacguauguucauuggagcugugcucauuuugugucuucccagacagggaagcugcagcuuuaugacuuggcuucagggaaucugcuggagacaauagaugcacaugauggagcuuugugguccaugucccucucuccagaucagguaacuaaaccagauuuuaaagcccuggaguucagcccuguggcuacccugauuucucucaggguuucuuuaaagaaagccugagguuuuuuuuuuuuuuuggucuaaucuuuaguguuuguauaugaugccuucuuauaaaugaccaccugucauuaugaaaugaaaucuuguuuggcuacuuuugcuuaucagcagcgugacaucaaauugcuuaccaucaugauuuuuuugccaauguuuuguaauacuucuuaagggggaauauucucuugggcaacaugaugcagagaacugaauagacuuugcugcuccccuuuuuuccucaaacaaacaucuaugacuguauaagcuaaguaguuuuagcaaguaugucagcccuuacaagucaauaaauaugugcucaccuucagagcaguuccuggcaaaaguaugcuuauucuaauaauggugcuguugcuuagaaaaucuugagauuuuuuuuuuugacaacaccuuaagaaauuuuggcccauuuauuuaaauauucucaaugauagacaauuuucauccguugaaaguagaacuuaguuuuggaaaaaaucacugaaguuuagaguguuuaauaccacuugggguccaaacgaaacagcugugagucuaaaauaguaauaaaucuugcauuuguagaguguucuaucuuuuccauaaacuguguggucuuuuuuucaacaaaacuagggauuuacggaaagguuguuuccuguguuauaaaucuaugagggacagacacuugagauccaguguucuauguacuuuacacuaacacugccauguaaugagacuaauuuucuugauaacggaaaacagcuucaaaacuauuuuaaguagggacauugcaggacuaaauuuauauccuucugaggugaauacuuuaaacaaaucuagauuauccauucuauguauauuuuucaaacugguuuacugagaguuuuuguuucuucuugaugcuagauaauaguauaacuagaacuuuucauuaguuauuauuucugccuauguuagucgaugguaggaauuuucacauaagguuuguggcagcagacccaaaagaucagugaaaggggcuagggagaaccacguuuuucuuaauuuuuaucccaugacguuaaauaaaaauacuuucuuagacuuuuaaaauguaucuucauagcaaaguuuuuaugcuaaaauaguuuuuaauugaaauuucauuugauuuucagcguggcuuugugacagguggugcagauaaaucugucaaauucugggauuuugaguuagugaaagaugaaaauaguacccaaaagaggugaguagacauuuuuuguguccauuuuuuggagugaaaauggggagcuauggaauggccuuuugacgucuuauaucauuuguugugcucuaaagaguuaggauuugucugaauuuguauacucauuuauuuuuucuugauguuuuuuguggugcuagacuuucugugaagcaaacccgaacuuugcaacuagaugaagauguucugugugucaguuacucucccaaucaaaagcuauuggcugugucuuugcuggacuguacugugaaaauuuucuacguugauacuuuaaagguacagugguuaugccugcggauauuuucccuuucugacugacugaccuuaagaauuuggguugaggcuauaaagaaguggccuugacugugcccagcgauaguacauuucuaaaaaugugugugugaaucaaagcaauguaacuaugcuagggaagcuagcauuuuaaaauaauucuaugguucaugaauuuuguuuaaagcaaguuauauuucauauguucaaaaaaucuuguggacagaaaauucugucauacuaaguaguuauaagagcauugcuagguguccugggcagugauuucacacuuggcuauauauuaggaucaucuagguugcuuuuaaaaauauagauuacugagcccuauacccagagaguugauaggaccagguugggccugggaaauuuuuuugugaaacaaaugcccuggaaucuuuucagugaggagauacagagaucugacugaggcaguaagcuucugggggcuuccuugccuccacuauacugcaguauucuuggcaagcacauggagggucuguguaguggacacagguacuccugccaagcugucuuuuguggguugucuuugaaaauacagauauaaagcaauuuaaaaauguguuuaaaguuauauuuuagaccuacauguaauaaauuauacccauauuuuauagacagacauuaauuauguuuuuuugauguuuaguuuuuucugucacuguauggacacaaacugccuguuauaugcauggacaucucucauguaaguaguuuaaauagugucucaguaauauguugucuuuuuuacagcagauacuuucuuaauucuggcuugaugucuucaucuuagauuauuuguuuuuaucaucauucuguuauauaucuuucuccaaaaacagucucaaauuaauauauauuguaucuuauauauauuacuuuaauguuuucagaauaauuuugcaaauaucaucucaaucaauccuuauaaauauuaucucuuucccucuuguagcucucccaaauaguacuuuauuguuuaaaauacuauaauugguagaguacacuaaaauaugaaagacuuuaaaaaggcauuccuuuuuauucugaaggauaaugcugcugaggagcucggauuuauauuuggauaguuacgguauuuuacacuauguagacuuuuggucucuugaccaaaaucauuuauuucccaauaccuaguuuugauuaggaguggcaauguauauuaaaaacaaugucuauucugcagagugagacuccgucucaaaaaaaaaaaaaaagucuauucugugugaaaggaguugaccucauagcugucuguggucagugcacuaacaaaguuaaguuacaauguuaaauguauuucuuuuuuuuuuuuuuuuuauguugacaaccauuuggaccacgcauugaaauaggagagauaagagaaauacugauagggaaugugggcuacauaaacauucuaguagagucuuucucagcuucucuucuguuucuuucucccacuuucuuuccaaaucccaugccagagauuagaaaaucuuuuuccuaucuaacgaaguaaauagauaacccuaugucaaggcacagcacugcccugugacaguacgaaaguauuuaagccacagaguucgugcuuuuacuuaacaagcuuuuuaaguuccucuguagguaagagcaaagaauucaguguuuuuaguagagaugaaaaucaguuuuuuggcuucauuuuaauguguuugaaagaaauggguuaaauauucugguuagcuuuuuauucauauacggaauucaaaaaucaagguaguguuuuacuuuuauuucucauaggauggagcacucauagcaacuggcuccgcugauaggaaugugaaaaucugggguuuggacuuuggggacugccacaagucucucuuugcacaugaugacagguauguauagucuuuucaaaugucucccuuugagucaccuguaaguuaucacuuuccuugagcaucugugucuauuuuucaguguucucaggcagugauacaaguucuaaaauauagucagacacccuagaacuagcuagucaaaagcuauuuauguguguaaaacucuuuuuacuaaccuggaauuugaugacauuuuaauauuucugucacuuuucagugugauguaccuacaguuuguacccaagucucaccucuucuucacugccggaaaagaucauaagauuaaacagugggaugcagacaaauuugaacacauacagacucuggagguaaccacaugccuucugugcuugcuugguacuuaagaaauacuuuuaagaauauuuacauuacccacuaaguaguggucaaugaaugagguauucuuuauuuuuuuuuucuccuccagggucaucaccaggaaauaugguguuuggcuguaagccccaguggagacuauguuguaucaucgucccaugacaaaucucugagacuuugggagagaacaagggagccucuuauucuugaggaagaaagggagaugguaagaacuuuaggcuugguuacaaauaugccaguagguaucugacaggcuguccuaguugaaguuuucugucuagugcaguuacaccugaugcauugccaaguccaagaaccuucaggagaucuuuucaagaccauugucacccauuucagaagcuaggcagagauaaagaugccauuaggguauuauguugucaaaggagcagcuucucgcuuccucauuucucuucauauagagaccauguuuuuuucucucaaauuaauguauaucuaucucauggcaggaaagagaagcagaauaugaggagaguguggccaaagaagaccaaccagcaguaaguaaauuuuggggaccuugagauuaugccccauauauaguuaucuuauugaaauugacuauaauguccagaauuucuaauagaauuaaaauugaggcuagaaguugcagguaucaccagcugauaaagaaucuguguaauucuuucucuucaacuguauauccuaauuuugugguucaagugauugaccaaauuugcuacugaauaauuauucugucaauugagacuuuagggaauuauuuuauucacuguagcacaaaaauaaaaauuagaaaauuuggauauucucuuuuuaaacauuugcaggauguucuuacaauaauacauaugcuaaguucuguuacugguagcugauaacacuguuaguauuuucauaaaauaauaauagcuguucucauauggauguaagauuaauuuaucagcucuuuaacucaacagucaacaguguuauucaaggauuucuuuguuucuggcagguuccaggagagacucaaggugacaguuacuuuacuggaaagaaaacuauugaaacagugaaagcaguaaguugauauagaaugugguaucucguuuuuuaauaagaucucaacuuuuuaguaaaaguuuuauucuguaucaaccagaaagccauuuuuuuggcaaaaaguugaugagauuuaaagauggggauuauaaccuguuuccuucucuuguaaccaaagaugggaguaguccugaaucucuuugaucaauaugugcuccuuucagguguuccugggaccugcccuauucagagugucuagauaucaucccaccugaguccaugacacucagucucuucccuguacauuaaaaaauaagaaaaccaaaaaugucuuuaaaugcuuuuuggcacucuauucgcacgucuuuauuaaacagauugaagcuauuucauuuggcaaauuucuggucaguucuuccaguuucaguguccugggaugauggaguauguugugaugacuucuuuccuuucucauccucuguaggcugagaggauuauggaggcuauugaguuguaccgagaagaaacugcaaaaaugaaggaacacaaagccauuuguaaagcugcagggaaagagguaauaagagaguacaguaaguuacaguaucaauaaagggaauucccaaggagaaaaaccauuguuuugggauuuauuaacuaagaucaggauaugcaauaaauggaauagaaucuuuccaacucacuauauuagaagaaauugaggaagugugggaagaagggaacuuggucuuaaugaaagcgaaggaaaggaaauuacagauugaggugauuauugucuugaguagaaacccacguucuauguugguuugggaggcaggguaaccauuucagauuucuagauaaaauacauuguccaagcucauucaugaguacuauagaaacuaacagguuugauaauucuuuuacacucugucaguuuuuuagggucucuuuuuucccuuuucaaaauuauaaaauacaguuaccacucugucuauaacaagugcuaccuaagucucaguuuuuuuaaugacuugauuuaauaauuucuucauagguuccacuucccagcaaccccauccuaauggcuuauggcaguaucucagugaguaaaaugucuaacgguuuuccuuuguuuauuaaaagguuacuuacaaggacaagaaaggaaguagaggcauuaugauuuggggauggauuauugggaauacuuugucuucaaaagucucuuuugaaucuuggcauucucuaggauauuuuguauuucaaaaggaccacuuuagugugacuucccaagccagccuuuuugguuggacuggacuggcauucuucuguuuucuagugccuguuuauguucaguguccaaagcccucugaagauucuguuaaucuaaauuaacuuuugaaucagccuucagaaggaaaguugacagaaaucagucugaugagauaaagaagagagagaggggaagagugaugggagaauguauguuuaucuaguaaucucuaauuaguauuuuauugcaugucucaucacaguaauuuugugagucaggguaucuucaccuuauagauaaggaaucuggcuugacuuguagcauaguugguaaggggcagaguucaguugucaacccagaucugacugacucuaaacucaugcagaucuugccauuuuagaauacuuuuucugaaguaagaaggagggguuccuguuuuauaggagauagaaauuagagaacuuuaguagaaaccaaccaagaguaucacuaaugguauuaauccuuccuuuauagccuucagcuuauguauuagagauuuuuaaagggaucaagucgaggugagugaguccuugcgcacaauuuuuguaaucugucagcaaacauuuaugaagugcuuaucugaacgggaaauaaauagaaauuauaauugaugguuaucuuauagguuuaacuauaucaaaguuuugauggaaaauaauuuauaauguucuuuuugaagugcuagaacuaggaaguuccuucuaaaguaugaagagagaugcuuuuaaggacaaauaaaggggagugauuuauguuguaggcgaugaaauaauauauaauucaauuagaagcaccaauuguuaauuuguuuuauauuuuggcuucuuuucuauguacauacacaauuggaauauuauauaaaguuuuauauucuguucuuuuucacauauuuccugaacauuuguuuguuguucauauucuucaaaaaaaaaaaaucauuggauucagaauuauuccauuguaugaauaauuacucgauauugcauuuguuucuccuuuuuggcuauuaucaguggcuucacugaauauguuuacacauauaucuuugucaucauuauugauuauuuuucuuaagaguccuagcagccuaauaacugaccaguaggcauaagcuuuuaaaguuuuauauugccaaauuacuuuccagggugauuauacugauuuuuagcaggcuuuaaaaaauuuguugccagugugugagccaaaagguaauauuuuauuauuuucauuucuuuugacuauuaaugaaguuaacauuucagcauauuuguugaccauuuguauuuuguccugugaauuuuuaguuaccucuuuuugcucuuaaguauuauuuuacugguuuuuaaagaauucuugcugggcacaguggcucaugucuguaaucccaacauuuugggacacuugagaccaaaaguuugagaccagccugggcaccauacuuuauuuucuuugucauacauuuuugcaauaauuguuauauuauuugugauuuuccuuuugauuuuauuuaugaguuugaacuacugaaggcuaucauuuucauaaugaaccacaauaucuacauauauauuccuuacaagaaacaacacuugucuuaggauaaagaugaaacuucacuacaggaauguaaaagaaaauugauuaauguggagguuacaauacauuucaagauaggaagauucuguguuuuaaagauuuaacuuuuccuaauuaauagguuuguaaucccauuugauauccucuuaagauuuuaaauuggaauugaugaaauaauaauacuugagcuaguucuagagggaacuauuuucccagauuaaaaggcuacaaaauuagcaaaauuaaaauaguguagcauuggugucaggaucaaucaucaugucaggaucagucaucauaauagacucuaauggacucaauauaugguaaaagaauaucauaugaagauggaauauucaacaaaaggcuuuggagauauuguuuaucuggaaggaaaaaaaguuagauuuucccaucaugccauugaccaaaaugcauuccaaauagauuaagauauuaaauacaaaaaacaaagagagucaucuagcuuacagaugaauauuuaacucuaggcaagauguauccaaguauaaaaucaguagaaaaaauaauaaagggaaggauuuaaaaauugaccauguuaacaacguuaacaaauguggcauuuuuauauuuauuuuuucuuuuucagugagcuggaagaaucucuacuugugcugccuuucucuuaugucccagacauucuuaaacucuuuaacgaauucauucagcugggcucugauguugaacuuauaugccggugccucuucuuccuccuuagguaacauccuuuuccaaagaauaccaugucuguucagcagaacugcuucaguaguaccuuaacugaagcugucaacacuuugggauuaagaaauaguaugccgaacucgguggcucacacccguaaucccagcacuuugggaggcugagguggguggauugcuugagcccagaaguuugcuaccagcccaagcaaucagucuugccuuuaaaacaaggaucaugaugacccaccucuuuaaguaagaagucaugguaauacauugcucaggaaugcuuacucagucauaggccuccauguuacaaucuuaagauagcucugguucuagucaguuugccaaaagccaauuaugauuggccaguuugccucauuuguuguuucuuuuaagccaaccuuguccagccuguggcccgcaggccacauguggcccaguauggcuuugaauguggcccaacacaaauuuguaaacuuuauuaaaacauuaugauuuuuuugugauuucuuuguuguuguuguucaucagcuaucauuaguguauuuuauguguggcccgagacgguucuuccaguguggcccaggggagccaaaaggauggacauuccuguuuuaaaguguuuaguguaagcuaacagguuuugcuuuguccuuuaccaacauuuuaagaaagucaguuuauuucucuuggucucuacaggugcaaauggaaauguaggggcauauauagagguaaacuaaggaacauaaagcaaauauguucauuaggcuauauucuuacuuaugaagauucuguuaauagguaguugagaagaauauaugcacaaaggcuugauauucuucucaucucucacccucauucucaagcgguuacagcagagaacagggauggagacaaauugaacauuccuucaaauacuguuaugaagacaaaaacuggucagccaaugccaaauaguuaaacagguauauguagugaacugaccaaauagguauuuggugaauuggccugguuuuaugauucuuaacccuccauuucuuauacucuauccaggauaguagcaagagaagaagaauaauauguucuguugccauauucauaauuuggggcaacuuguaaagacauaaguucauauuuaaccauguuacuaacaauuuuuuuuuacugcuaugguauacgugcuauugaauuaggguugcugguucuacgaguaacacugugaauacuuauagcguaucagaggcuuauggauggguacuaccugacagguaugguagggucaucaaggauaucuugguacucuaggucagaguuugaaucucacgaaugucucuuuuuugcuguggcuuuauuagaaguauuaaugcaucuuuguuaaguuagcauuucuuagaaggcucauucugucuuugaguuuuccuuaaaguaccacugucaaaaucuguagccacuggcagguugcugggcuggaagaagagccuuugcaaaugaguugaaugugucauaagguuuaggacaguauuuuuuaaguugucaucaaauugaacugaauaguagagaaagaaacuucuuuggcuuuuuuuuuuuuuuuugcucgaaacauuucuauaauguauauuuuguuguugcuuugauauugugucuguuuacuguuucuagaaggguuaaguagggcuagaaccucucugcaacauggcuguguuuuguuuuucuaucaggauucacuuuggacagaucacuagcaaucaaaugcuugugccagugauagaaaaauuaagggaaacaacuauuucaaaagucagccaaguccggguaagugucuuuguauagagauaaaauaaugaggcaaauuccuagugugauuuagaaauaguauaguaugcugugcuuugucuuuagcaauacccaccaccgauaaauccauauuugagauaguuuuuguuagaauuaguaggaauagaaaaaacaaacaagaaaaguucuuaaugagggaaagauaaguaacaacaccugaagcuuugguuacccuaacucucauacgcugcuauaaugaauugaagugggagaaaauuuuuuaauauuucuuguauugcacuccaggauguuaucggcuucaauauggcuggucuugauuaucucaagagggaaugcgaggcaaaaagugaaguuauguuuuuugcugaugcuacuagccacuuggaagagaagaagaggaagaggaaaaagagggagaaguugauucuaacguugacuuagaacugaaaugugguaucuuuuuuuuuuucaacuuuuuccuuuaaaggacuccuaaacuaagcacagaagaguuggcgucaucuuaaaaauaccaaauaacagaagaucgcauugcagaugauaucaggaugugguuuccagcuuugccugagggaauuccaacaugagauuaugggcuggcuccauuucuuggacuuaaaaugcauuauuaguuuaaaaaucuuucugugcucucaaagcuugagccuugcagcucaagcuuguuguucccuuuauauucuagcagggaauaaauaauuguuuuaauuagguauuuguuucauuggaguugaaauuaacauuucaaaaguuuuucguauuuuuuuauggcagaugauuugucauuuauuuauauuagguuuuacugccuauugagacaaccaggugcauaauugauugcccuuuggccauaaaaaugcagugucauggaucuuagagcuaaaaaggacuguaaaaauuacccagaacagcguccucagacuuaaccuucugcaaguuaugucuguauauaagaagauucuaauugcuaacuguuuauacuuuucugaauaaaauaguuguuucuaauuaaaaaguagccaagcuaagaugcc

SEQ ID NO: 13762 - RNA, 42549 nt, Homo sapiens
ggcuuuguggaacuugggggacccagcgaaauggaagaaguuagguguccagagcacgguaaggggcuagggucucagcgucccggggccuguugauuuagcguggcguaaucguuguucacuuucuucucucuucagggacuuucugcuuucuuaagaccggcguccgcgauggcccgaauaaaggaaagagcuucuacgugugccgggcagacacgugcagcuucgugcgggccaccgaguaggucuggagcugggccccacucccuguggcugcccggggccucccgagaggagcuucccgcuccccgcugucgggcgucacagggccgaggagugguggggcccuaguuugcggugucaggacccuuuaagcaauuggugaucccagggcagcguggcguguucggaagacgcccagcuaauucuggcugugugacccgaggcugguuaccccccucucugggccgaugguuccccuaccuguaaaauugaggauccgguguuuuccagcucuggguuucuauucacuugacaggccuuaaccacucccuucuccugcccagacagucccucccccuuuaaaggaguaaggacacacagcagacauaguggaaaauaauuugucccuguuuugcacuaguuuuaggcccgacgguuuuuuuuaaauguuugagcuuaaaacacucuagugauuaguuguuagccuucuuauuuuuaaguaggauucucugcaucuaaauggugaaauugauaauucaaagaaauuagcgcuggaagaaacaacggagggccuggcgcggugugugacgccuguaaucccagcacuuugggaggcgaaggcgagcgaaucgcuugagcccagggguucgaaaccagccugggcaacauggugaaaucccgucucuacgaaaaauuaaaaaaaauugucuaggcaugguaucacacgccuguagucccagcuacucgugaggcugaggugggaggagagagucagaaauguuaagcaucuucucuaaagugaggaaaguuaauaguuugucaaguguuaauguuuucacaguaccaagugucuacauuuucuaugugaauuuuaaaacuaucaucacaucauuaaacaucuccugcucucuauucagcaaaacuugguagagaaaaguuauuuuucuccgugucagauguagaguacauaauggauaucaguauuagaaaagugcccuuucaacauguauacuaacuucccauguuucuguuucaugaguuagaugauuuacacugagccucucagauauaguacccaggucaaguuuugugagauagaagcauuuuuaccuuugcaggaauucaacauuaaugguggcauaagauuugguuuuacauuaagagaaacacucuuauuuaggaucccaucuacacaaaugcuuugcuauacaaacuagcacagugguauuugaagacaauuauuugauaaacuugauuuauuuggacuauaucugauaaccaauauacaggccaaaaaaagugccacagguuuaggagaguacuuuaaaccuucacucaaaccuguuuacucucaaauguuauauauauuuaaauuuuuucauaauaaguuggaagggagugauuaaaaacuuacacaaaacaagaagcauauagggcguauuguuagagguaggcgugugaauaacacuaagugacagcucucagcuuguuagagggaaaggaugaagggaagagccuggggaaaauucauacagggccucacagccagcccuaauuaugucauucguagggggaucccaguguagagauuacacagugcagugugguuuuaaacuuuugagucaucaagaaacaguuaugcuuuauuugagaaaguggguaaagaugaaagcuagggacuucuuccccaaaggaaugcccauagcugugauaaugugugggaauuacaaacccaguagagguuauacauagauucuugguguaaaaacccauaguuuugauuugacuuuaggauauugaucucuguuccugaccuaaaaauguuuucaacuuuuuucuuuucucuagcauuccuguuucccauugcuuauugcaugaggacuuugugguagagcuucaggguuugcuucugccacaggacaagaaagaauacagguaaggguccaaaaggaacaucuaaguguauuugcuuuuuuuuuuuuuucucccugaaagaguuguagccagguauguauuaggauuguucuuuaaaagucauuuuaaaaaacaaaauuuguauauguauuaagugucuuuuggcugucacuaccuaaauaccaagcagcuaguuaaucugagaagucugauuucuaguaauuuucacguaaauggcuccacaaucaucccucuccaacugucagguagccuauaaugacagcugaccauuggccacuaacuugcccuuaacuugucaaucuucuaauucugguaauagaacaagguagugaguaaaaauggcuaaacauauuuaguccucaauaaauguuaguuucuuuuccuuuauaugggaauuugggaagggcagagaagucuauagagcugggagauauuugucacgaguauucaaagauaaaguaggaauucccuaaguguuagagagaggucauauuuaauggacuaauauauugcauuagaguacuaaggcaugaauuaacauggcauuuucagggaaaauuugauuuguuaauaguuuaacauaucuuuaaacagagacuuuaggcgauaaggcuggccaggaagguaggggucaggaugugauagauggucuuugugugauauucuaugcacuucauaauuuauauauucuagauccccccacccaauuaaaggcauuugaguaccaccuacaauuuuuauauaccugaguacuguucauacuucuauuuuucuuaauuuaguuauauguauaguaagauacacaagucuuaagauuucaaccaguugaguuuugagaaugcauguaccugcucauaaaaccaagauccgagucaaaauauuaccccaauaagugccaucaguccccuucaaguuaauuucaccccucccaucuccaccccugucagcaaucacuguucugauuuuuaucucuuuagauguguuuugauuguucuugaacguuauauaaaugaaauccuacugcauguacucuucugugucugacuucuuuuacuuaacaguaugugaaauguauauaauauguaucaguaauucauucauuuuuauuguggaguugaauuucauuuauaaaugcaccacuuuguuuggugugccuauuugccaucagaaaaucucgacguuaucuguuuaaauauuuuauccuuuuuuuugcauugaaauuuuuaucaaguaguuuuagauucacauacaguuguaaggaauaauacagaguuauccccuguagacuuuauccaguuucccccaaugguaacguuugcaaggcuuagaaauauaucacaaacaggauauuaauauugguacaacccaccaguuuuauugguaaagguaguuuuacuugaacuaauuuauguguguguguauauucuauacaauuuuauccugucgagucauguaucuaccacuacagucaagguacugaagaguuccaucacaggaucucucuguugcccuuucuauaaccauacccccuucccucccuucugcccucuucacuccggcaaucaggaauuugcuuuucauuucuaaaauuuugucauugcacaauuguuacauaaguggaaucauaaaguauaacuuuggagaucuuugccuguuuuaaaauuuuugucuuuuuuuaaaacugaguugguagaguucuuuguaaauucucuauacaaguuaggccaggcaugguggcucaugccuguaaucccagcacuuugggaggcugaagugggcagaucacuugagauuaggaguuugagaccagccuggccaaccaacauggugaaaccccaucucuacuaaauaaaaaaaagugaaaaaacaaaaaaaaauuagcugggccugguggcacacuccugaagucucagcuacucgggaggcucaucauuuuuguaugguuugugcuuuuugucugaucuccaagaaaucuuugccuaccccaauaucacaaauauuuccaagaauugucuagaagcuuuauaguuuuauuuuuguuuguuuguuuguuuguuuuugagagagagaguuucacucugucuuccaggcuggagugccgugguacaaucuuggcucacugcaaccaccaucuccuggguucaagcaauucuuaugccucagccucccaaguagucccaaguagcugggacuacaggugugcaccaauaauuuuuuuguauuuuaguagaaacggaguuucaccauguugcccaggcuggucccgaacuccugagcucaggcaaucuacacaucuuggccucccaaggugcuaggauuacaggugugagcuacugcaccuggccuguuuuuuuuuuuucuucuucuuuuuuuuuuuaguagcuuuuucauauaggucuauuaucuauaucuuaaauuacuuuuguguaguauaucagguaggguagagguucauuuauuuuugcauauguuaccaauuguuuuagcaucauguuuugaagauuuuccuuuucccauugaaaugcuuggcgucuuuguaaaaauucaauugauccaauauauguaagucuauuucugggguugcuaaucuguuccauugauccauuugccuaucuuuacauaauuaaucagauaaaauagugugagucuucugacuuuauucuuuuucaagauugcguuggcugcucuaggaucuuugcauuuccauauaaaauguagaaucagcuuuuaaaaauuuccacagaaaacccuguugggauugcauugaaucuauauagaucaauuuggagagaauugucaauauugaggcuuccaauccaugaauguagugcauuuauuuaugacuuuaaaaaugucagcugggcgcggcaauccuagcacuuugggaggccaaggcgggcggaucacgaggucaggagaucgagaccaucauggcuaacaaggugaaaccccaucucuacuaaaaauacuaaaaauuagccgggcaugguggaaggcgccuguagucccagcuacucaggaggcugaggcaggagaauggcgugaacccggaggcagagcuuacagugagccgggaucgcgccaccgcacuccagcuugggugacagagcgagacucugucucaaaaaaaaaaugucucugagcauuguuuaauacuuuucauuacagaguuccuaugcaucuuuuguuaaauuuauuucucaguguuuguguuuuuuagugcuguuguaaauggaauuuuuuuuaauuuuguuuuuggauuguuuucugcugguauaguagggcugguaagccuuuauugcaugaaguuauauucuacugauacuuaaaaccauuuacauacuacuggaggaccuuuaccauacagacauacugugguaguuguuaggaagccacugaaggauuuuugacccaauuugcauuaaaagaagaacuauggaggacagauuagaaagugaaaauagggcaaagagaccacugaaauaauagcuaccauugaaagcccacuauauaccuuuuuuuuuuuuuuuuuuuuuuuuuuuuuguagagacacggucucacuguauuacccagccuggucucaaucuccugggcucaagcaauccuccuaccucagccucccaaaguacugggauuacaggugugggccacugcacccagccuguucauuaucuuuuaccuucauauaauuuguugugauagauuucaauauccguguuuaccagaaagauggagaaacuaccauugaaacaggucagaaagggaaucugaggacccaugguuaugaaguggcauugcugggauuuaaacccagguccaacugauuccagacacaccaacuuucucuuaagugagaggugaugggccugaauugaaguagcagcaguggaauuggguccaaguagaaugaaaacuugcugaaagagcacugaugagauguauuuccugguagggcauauaaacguguuccuuccuccauuuuuucaucuggaauauugcucacauggcccuaacuucccuggguuggaggacuuggagagagaacgugugugauggccucggucugguguuuggcacauugucagugcucaguagggaaacgguugcuaagguggggcuucuggguaauguguuuacguuaagcaggacaaggaagaaagguaauguuggucgaguauugggauguguggcaaacacauacagcuuuggacuaaucaugucuuuuuuuuuuuuuuuuuuuuuuuaaaagacagagucuugcucugucaaccaggcuggaguacaguggcacaaucucagcucacugcgaccucugccucccagguucaggugauucucgugucucagccucccgaguagcugggauuacaggugugugucacgacgcccagcuaauuuuuguauuuuuaguagacaugggcuuuugccauguuggccaggcuggucucaaacuccuagccucaaguggucugccugccucagccucccagaguacugggauuacaggcaugagccaccucaccuggccaaauugugucuuauuuucaugugaaaccagcuagaaaaaugagugugcagcucugaagaaaggccugacugaggucagaauuuugagaacuugcuguuaacguucuuuguacuagauggauaagacugagaaggguuuauuauuuuaaaauagaacaaaaaaguauguuacauguauuucucuuagccuaaauucagagcacuauuacuaggaaguacuuacuggagcuuuaaaaagcuugucuuagggccaggcauggugguucacaccuguaaucucagcauuuugggaggccaaggccggcggaucacuugaggccaggaguucaagaccagccuggccaucauggugaaacucucucuacuaaaaauacaaaaaauagccgggcaugguggcgugugccuguaaucccagcuacucaguaggcaggagaaucacuuugagccggggaagcggagguugcagugagccaagaucacaucauuacacuccaaccuggaugacagagcaagacucagucucaaaaaaaaaaaaaaaaaaaaaaaaguugucuuaggacaaauaaaaguaaaaggcaguucuuaacacacaacacauuaaaaaacaauaacaacagaaaaccagguacucugauagguagcauagacugggaauuuaaacagaaauagauaagucuauauauggaugauggcuuccuuagugaacauuaaggguguucagccagaaccccuggagagugaccuaugagaguacagccuuucccucacauacucuggguuuucuuuuuaauaacuuaaauauuuuacauccucuaauuaauacuauuauguuuggcugaauguagucaggagacaggugcaacagaguaauagaagggagguguaaacugaggcgaagaugcccauuuuucaucucuugcaguguagcugcauuugugugcagaucucuaacugaaacaccagauggcaccacugaccagcauuugacuagccauucggccauggcccucuguguacaggcaguaaagaaaacugauaaucucaguagaaccagggggaagaaaucuugccuugacaugaacgaugugguacacccugguauacaaauuuugggcauugucacugagcuccugaguucauauuuuccuuucucucuguuucucacagaacuuucacucaaggauacagggucaaaauaaauggaaauauuucuuugcuuagacguggguauaacaaguuuuaguucuuuaaauaauugguugugguauccuucugagcaaacuaucacaaggacagaaaaccaaacaccgcauguucuuacucauaggugggagcuuaaccaugagaacacuuggacauagggcguggaacaucacauacuggggccuguugugggguugggggagaggggagggauagcauuaggagauauacuuaauguaaaugacgaguuaaugggcgcaacacaccaacauggcacaugcauacauguguaacaaaccugcacauugugcacauguacccuagaacuuaaaguguaauaaaaaaaaaaaaaagaaaaauauucaccuccaaaaaaaaauuaauugguugugguagauguucaaaauauuuuacuuuuaauaacccuugaaacuucacaugucuagaaaacuccucguguuguuggcuauugggugaaauugaccugcagauuaucuagcccuaguauagugagcaggauggugauagagaggcaaccaggcaugcgccagacccagccagaaccucaggccccaccagcugugaaggaccacugaauaaagccauacuugugaggcgguguacaguaccaugcacugcacugugcagugcgagcaaucccuuuguauaaaguauaguaacccuuugugauaugugugguaguuacguuuucccaguuugcuuuuugucuuacaauuuugcuuaugguauuuucaucauaugguaguguaaacuuuuaaaaauuacuaaauucuuuauuucucagcuucagaguuuuaucccaggcuuagaaaagccuucuucacuuuaggacuacaagaauauucauaucuguuuuuuuuccuagaacauuuacaauuuuguuuuuuacuuuuacauuuuuuuccaucuugaaaguucguguaaaagaaugagguagacauucggcuuuauguuuuuccagagcuggaccauguaaagaugugaacucauaaucccuaaggagccuuugacacagcuggaauaagaguuagauguacugagauuggggugcagucuccucugcacauuagagcgcuaaauugaagacguucagaugcgagaugguucugugacucuaagacauacaguucagggcuaggaagguuacagagaaaguagaggaguugagacuugaaguuguccuugaaugaccuugacaauuuugauggaggaaaggacaaggaaguguugaggcagaacagcuucagcagaaguguggauguaggaauaagcagagugaucagccagugugagcuuggcauugcuguugucuuuuaagaccuugguauguaucaggcuuugcucugauuguauuuugucuucaucaugaccguaugagguauggacuauaucauuuugccauuuuacagaacaggaaacugccacagggggcagucaauuaaggugucugauguuucagaacuaauuaggugguagggcugggauuugaaccaagggagaauaguucuggagccugagagaacuguagccuugcuaaagugaaugcacuuggcagugugauguugaguuggacauuaccuuuaggaaaaugggaggauuuguguuuuggugaagaagucaggauugaagaggucuggcuucuucuagcuggucccuucaucguuauugccuauaaccucuguccuggaaaacaauuaauaaacauacugcagaaauuaaugcuuuucuuauaguggaauugauauuugcuuucucugcgaaaauauauuuccacugcauucuuuguugauuuacaauauaauaaaacguaacaaacaaacuuauuauccuaaaaucagaaaagcucauccagauugauuuuaauuaaaaauguaagggaaagcauuuuuagcacugugccuagcacauagcagauguucaguguguuucuuuccuuaguucugcaaaucuugcccuucuccugaaagucuacauggcaugaguuuuaaaguagacacuacagucaugagucauuuaacaaugggggcauauucugagaaaugcgucauuaggagauuucauuuuugugugaacgucacugugugaacuuacacaaaccuacuugguauagccuaauacauaccuagguuacagaacuguacaguguguuacuuuacugaauacugcaggcauuuguaacacagugcuaaguauuuguauaucuaaacaaagaaaauguacaguaaaaauacaguauuaucucaugggaccacaguuguaugugccauccacuguugacugaaacaucaucaugcagcacgggacuguacuuaugaaauauucuuucaguaaagauuucaaguacuugauaugcuuuaaacaacagcaggaguuuguucuugauuuauuucuguaaguaguagcacccacugauggcagcuguuacuuugaauuuuaugcauucaaagcauuucagaaauuguauuacauauguuuaauauaauauccuauugcaaugagaaaaauuaaagaaaccaguaagauuuuaaaaauugugaacuuggaugggaaaauuguguuuguacaagagggaggggcuggaccuauuuucuuuuuagcuuaacuuuuauggacaacuuguccauuugggcuuguucaucuuuguuuauguguccuggugaaguaguggcaucaagggaccaggaccugcucaggaccccugaauuaggaugcagacuguugugauucauguuguacaucaugggacuaauuuaggaaguuagaaaaagaacaauaaauuaaacugaaggaaagcagaaggaaggaauuaauguugguaaaaauugcauuuaaugaguuagaaagcagcauauagauaacuaauaaagaaaaucagaggcuaaccuggucaagaagaacagcacaaauacauaacaugagaaauaaggagcugcaccacagauguauugaaauguacaugaaaugacauaugcacaguuucacuccuugugccacugcuuuuaauaguaaaggauaagaaacagcugaaccgcccaccaagaggguucugguuaaaaauaaugcaacaucccauacaguggaaaaccacaacuggaaaaaaauaauaaaaacaaggaucuuccuuacauauauguuauuauagaaaaauuuucaagguauuagguaaaaaaagaaaggcaagguauucagcaguauguauguuaugcuacccauuuguguagaggaggaagaaagaauguauauugacuugaauaugcauuuaaaaaucucuggaaagguaaacaaaaaacuaaugagcaguuacauguugggagagaagugaacugggcagauaggguaugagggggcuucucacuguguuuuuaauacuuauugauugaauacuuuaccuauuucagcagacaaaauauauauuuuuaaagcucuuauuuaaucaauuaaaaguuuuugaggaguuauuuuagguaauuacauaaaucaguucuauuuuaugcagcaauacuuaauuacguacaacaggcaagucauaguugggaauaaagagaucauguaugguuuuugcccucuaguagcugaaaauauaccuggacagucagcuauauuuuauagcuggacagucagcuuuauuagguugguguaaauguaauuguguuuuuugccauuaaaaguaauggcacagaggcaguucauggauuaaacagggaagggaauguggggaaaccuugccaagcagguacgacuuaagaugggccuugagggaccaguaggacuuccguagcuggagaugggggagaugguagacagauugggaugaugaggauauccuuuggauggagaguaguacccaugcaaagucuaguagacuggagggugcauggcuuaguucggcaguggaacagcuuagacaccucuggauagcuggaguaugggcuguguuugugugugcaggaacuuucuugcacugggauguuaaaucuguauucagccuucuuuuuuugguggaagaguguaaauauauacagaaguaagauaggguacuguagcaugagcuucaacaauugccagcucauggcuacucuuguucuauauguauccuauccacuucaccccguaacuccugcccuauuuugaaaaaaaucccagauaacauuauuucaucugucaauauuuuaguauguagcuuuaaaagauacggacuuuuuuuuuuuuuuuuuuuuugagacagagucucacugugucgccaggcuggagugcaguggugcaaucucggcucacugcaaccuacgccucccggguucaagcgauucuccugccucagccuccugaguagcugggacuacaggcaugugccaccacgccgggcuaauuuuuguauuuuuaguagagacgggauuucaccauguuggccaggauggucucgaucucuugaucucgugauccgcccaccucagccucccgaagugcugggauuacaggugugagccaccgcacccggccaagauaugaacuauuuuuuaaaaaauauuuguauguuuuagagaagggagucuugcuguguugcccagguuugagugcaguggcuauucacaggcacaaucuuagcacauugcagccucuggccucaaaugauccuccugucucaggccccugaguagaggggacuauaggugugugccacugcauccagcugcacucuuuuaacauaccaguugguuuacauauuuucaguggacucauaaaugucauaguuuuuuuuuaguaguuuuaauuuguuuaaaucaggauccaaauaagguucacaaauuggaauugauuaauaugucuuuuaagucucugaaguuuucccuucaucuuuuuuucucccucguaacuuauuuguggaagggaucagguuguuuguccuauagcguuucccacugccaagauuuugaagguuauauucuccacaguauaguuuuacgccuucuucuguuguuucuauuuccuauaaauugguaauuggaucuagagguuaguuuuuuguuuguuuuggcuucguuguuuugggguuuuuuuuggggcaacauugcuuuguagcuaguguugugaccccccuucagggacacacagugucuggcugucucucauuucucugauuuuaguagccauugcugaucaguguuucuauuucagucauucguuacagacuaaaaagaauaaaccugugugcauucucuggcuaccaugccauauuuauucuuggacuuccuagcccuuauaaauguucugugcaguaaauaauuuuuaaauguguauauaaaaguaauugguuucaagugaccucccaaagccagguucaaauaguugcaagauguuuucuuggauuaaaaauaagcuuaucucuuguucuaauggauuuucauagccuugauuauuuguguuuuauacuucauuagauuguucuuccgaugcauuagaaguaaggcagaggggaaacgcugguguggaaguauuccauggcagguaggaauuauucaucuguuuucaaaccugcuguguuaagacuuuuaauaugcagcaucaccugaaaauaccuugaaguucacguaaaugaguuggucuucaucagacugucuccgaaagauaguuuucuuuaagcaagguaggcccuguugggacuuuuauucaaaggaucauuuagucguaaucaagauuaauuauuugcauccuauuucacuuaguaaauauuuuuugaggucuuaaauguagucaguauucuuuuacucaaggaaaaaaauagauuuccuugacuaacucuuguaucuuuuuauagaggaauuucuacuugauacugguauaagcuaaguauaagcauaagcuccuaguauguuagaacuaggaggagcaucuccuaauaggagaagcccuacagauauucaguacgugaggaacuagaaguagggaggugauaagacuuguuuuggcagagguguggcuugaacuuacgauucuagauuaccacaguaaaauccuccuaaagccaaaaucaaagcaaguguuuuaagacaauguuuagguuuggggaaaaguucaucuuaagagaauaguuuuuuuccugaaaaguauacacuguggccauugugauuguaaaagcacuuugguuugucacuacuuuuccuugaggccuggaaaagagugaucauggacagagaaggaaccaagcuucgaaaguaucgugaagaaaugaguccuuuguggguuuggcacgucaucuuuucuagacguggaaaugguaccaagaauguucaggaaauauuggacugcuuuuacuguguuuccauuucuucugcagaauaauccuaagugaauuaaugcaggaacagaaaaccaaauaucauauguucucacgagcaggagcuaaacauugagcacccauaaacaugggaacaauagauacugugaacuacuggagaggggaggagggcauggguuaagaaacuaucuauugggcacuaugcucacugccugagugcaauauacucauauaacaaagcugcauauguacccccuguauauaaaauaaaaguugagaugaaaaggaaaggcauucuagauacgaaguuuguauuaauauuuuauaugaagauuaauuauuuugucuuuaggauccugauuccaaagaacauucuguauccaauaagucucagcaugcaucugagacauuucaucauucuuccaacuggcugagaaauccauucaagguacuugacaagaaucaagaaccagcucucuggaaacagcucaucaaaggugaaggugaggaaaagaaggcugauaagaagcaaagagaaaagggagaucagcuuuucgaucaaaagaaagaacagaagccugaaaugauggagaaagaccucucaucuggccugguaccaaagaaaaaacaaucuguaguucaagagaagaagcaagaagagggagcagagauucagugugaggcagagacuggaggcacacacaaaagagacuuuucugaaauuaaaucucaacagugccaagguaaugagcuuacaagaccaucugcaucuucucaggagaaaucaagugguaagagucaagauguccaaagagaaucagaaccucugagagaaaagguuacccagcuuuugccucaaaauguucacagucacaacucaauaagcaagccccagaaagggggaccccucaacaaggaguacacgaacugggaggcuaaagaaacaaaggcaaaggauggcccuagcauacaggccacccagaaaagccugccucaggggcauuuccaagagcggccggagacccacagugugccugcuccuggaggaccagcggcucaggcugcaccagcagcaccagggcuuucccugggugagggccgugaagcugccacaagcagugacgacgaggaggaagaugauguuguuuuuguuuccucuaagccugggagcccccuacucuuugacucgacucuggacuuagagacgaaggaaaaccuccaauucccugaucgaagugugcaaagaaaggugucuccugccucagguguuuccaagaagguagaacccucagacccaguagcccggcgugucuaccuuacaacacaacugaaacaaaagaagguaacuauugacucguguuuuguuucugaggucagagcauugcuuguuaugggcagauaugagaucucauugcuacagaaggguuaaauauguucaugugaagguuuuauaggugcauguucaguuucugccuuuuccccuauuuauauuuucaagauugguaagccagcuggguuaaaauuuaaaaaagguucugguuuuugcacacauauuuaaaagaccauaauuucagaguuuggguguuucaggcuauuuuaaucugaaacuauucaucuaacagugugagaggagagauccauuugauggaaucuguuuuucagagcacacuggcaucagugaacauccaggcucuuccagacaagggucagaaguugaucaaacaaauccaggagcuggaggaaguacucaguggucuuacccuuuccccagagcaagguaaaguggcuuaugccucagaacuccggguuugcaucgacuuuacaagagacauucgggaagcccuuuuaauaaagaauguguugauucauucacuuuuccauuuuauuaucugcuucugagacuucuuucacauuacaccuaugguucauaaaaaacuuucuccuguuuccuguggacucuacuuucuuccccauuguuuaagcaacuguuaaaaugcuaccuucucuaggaauccuucaucggaauggugaugaucccucucucuugaccucaccuccacacauauggucccuucacuuaguuugcugaacuuuaaucugcucuucccuuguuuucugagcaggaacuaaugagaagaguaacagucaaguaccacagcagagucacuucaccaaaacuaccacuggcccuccccaccuggugccuccccaaccccuuccucgucgugguacccaaccuguggguucucuagaacuaaagucugccugccaggugacugcuggaggauccagucagugcuaucgagguaagacccaagggccugacccugcugugaauagccaccccugugaguuacgugccacccgguacaguagucaccucuuauccacacuuucaguuaaccuuagucaccugugguucaaaaaaaggugaguacaguacaguaagauauuuugagagagaaagagacagaaaccacauucacauaacuuuuauuacaguauauucuuauaauucuucuauuuuauuauuauuguuaaaugcuuucugucccuaauguauuaaaguuuaaaauagguauguacguauggggaaaaaaaaaagccaaaacauaguauguguaggguucaguaccauccaguuucaagcauccacugggggucuugcaacauacgcccuguggauaaggagggacuaccguagaugucuuugugcccacaugaggggagaagccauucuuaagucagaaguugcccauauaauaaagauugugcagcucaguagagcuuugcaucguguuacuuagcuuucugugagggcacagacugugucuaccuuguucaccacuguaugcugauuagucagcucaguggcuggcacauaggagucauccagucagcauuuguggaugaaaacucuagcucgcaucauuaugagguaggcagaccugcagauaugcucuuauucuuucguguguguguaaguguguguaagacugaggagagacaugagucaagacugaugacuaauagauccacagagagcaauaacacccuauuagcuaaguguuuccuuccugaacuuucuaggcaacuuugaauucagagguaacugcagaaugaagauuccaaguggagccugaaauguguaauaggaucaguugacaggagacugaucaggagauaggagcuuggagauuggguuggcuggcagugaccagaaaagcaaaagccacuuguuucccaacugagaacugcuagagacauggaaaguugaggagaguaguuaacaaggaggguaagaaacagauacagggccauuuguagcuaaguucacucuaaagggauaaagaaaacauacuugugacaucuuuuagguaacaccuauuuguaugcaggccauacaaaccaagaucacguucaugcaguguggaaaaucacaagugaagccaucggucaacugcaucgcucacuugagucauguccuggugagacgguuguggcagaagaucccgccgggcugaaggugagccagggaagacuccugguguaguccucuaugacagugcuccagcagccccaugaaacugcuggcagagagacuuucugagauaccuuuccuacagacagaugcuuaaauggcuucccuugcagcauccucuccuuuuaugcuuaacagugcaaacaauaacaacaaaaccccuuuuuuaaaaagucauaaaguuacuuauuucuguagcaguaaaggauccauuuguugaguugguaggugccacaagaaugugaaggaauuguugcuuguaaugaacuaguuggggugaaaauacauauacaauguaaauaaaacaauuagcaaaggcuuuaaggcagaaauaaggggugccuuguaauauacuauaaaguacaaaagggauucagaauaaaggaaacaucacucuaggucagugauuauuuguugucugccuacuuugugccuuaaagguugaaagccuuuagauagcagagaggaaaggaauaaaacgcugcaauuagagggaguggugacuagugggaagauaaagagauugguauucagaaguggugaucagcugucaucaguaccugagccagcaguagcaggugauguuacugaguaggagccuggcauugaugaaggauuagaucugaauaacucaagagauaguauggaaucgcuguagcauuuaagcagggaugacugaugaagauuaguuuuucuuaacagaguacaagauaaacuggaguacagaagacuagaagggggacucuggucaaagggcuauugaaauuuaugaccaguagugcagacugggacauuggcugcagaaaggagaggcaaauuuaagagauaaugaggaaauaaugaaaagccaauguaauggcugcugaaaauagggucagaggucuugguuaaaagcagagagcugggcauaguggcucacaccuauaaucccagcacuuucggaggccgaggcaggcagaucacuugaggccaggagcucaagacuagccuggccaacauggugaaaccccaucucuacuaaaaauaagaaaauuagcugggcaugguggcauacgcauguaauuccagcuagucgggaggcuaaggcaggagaauugcuugaaccugggaggcggaggcugcagugggcugagaucacgccacugcacucuagccugggcaacagagcgaggcugucucaaaaaaauaaaaauaaaaaaauaaaagcuguagagacugauuuugacugauuaagcagacaaaucaggacucucacuugggguguaggggggacucuuaauagaaaugcugaacauuagaugcaacccaaaacaaacaggggcagaccaggacaguaugguuacccuugagagagggugcuguuaaggacuucaaggugaaaugaacugucuacagaauacugagggaaucauuuguagaaaauaggagaguguagaguucguguagccaggcucggcauagccucucauuaggaauuuaugcuuagcauuugguuauuaccuuugucaggucccuuugcuacuacaccagaagcaggcauuggcuugguuacuauggcgagaaagucagaagccacaaggaggaauucuggguaagugugguauuauaagagucagccuuuauugaaugcuuaggcauugugcuaaacacguaguguuguuucauuuauuccucucaagaacucuaugaggcagguacuauuauuccucauuuuacagaugaugaaagugaagcauggaaguguuaagcaacuugcucaagaauacacaguuuaggaucaaagauguugguugccagcaguagaagcugacucuggcugauuaaagagaggaggaguuuauuuuuugguggcucccacaaucucuaggagauacggagugccaggcucgaggccaauuucaggagccauggcuagagccaacacacaaacagcagucuauugccucccucuuuuuuuuuuuuuuuuuugagauggaguuucgcucuugucacccaggcuggagugcuguggugcgaucucggcucacugcaaccuccgcuucccaaguucaagugauucuccugccucacccuccccaguagcugggauuacaggcagaugccaccacgccuggcuaauuuuuuguauuuuuaguagagaugggguuucgccauguuggacaggcuggucucuaacuccugaccucaggugcuccaccugccuuggccuucccaaagugcugggauuacaggcaugagccacuacaccuggccuaaaaguagucuauaaaaagcaucacagcuacuuugcuucaccaagugcuagaggcaaccagugccaccccaaagucaguuguuucuauagccacuguuuccugcagaaaggauuucauagggagucucuuucuaaagcugcuuauaccugaauuaaagauguuuaugaguacaucugauauauagagccaggucauauugccagugccuuagcugcaacagaaaccagaaagcaaguuuuccacucugcuuuggggacuugucaggcuaaaauuuucuaagguguucaauuuucagaaaccaugauagauguccacuauggcuaguaagugacugugucagugguccucaaaaccacccccagguucgaugauuugcuaguaagacacagcauauggucauacucacagcugugauuuauuacagugaaaggcuauagaucaaaaucaacaaaaggaaaagucacaggggcagaauccaggggaaaccagguacaagcuuccaguguccucccaguggagucacaugggauaugcuuaauucucccagcagggaguugugacaacaggcgucaaagguucccuaggaagcucauuagagauuuaaugcccaagguuuuuauugggggcugguuacuucagcugguuacacagguggcuucagccugguauauaccaaguuuuccuacuccuagaaggaaagcagguguucaacauaaaccauauugcuuguacaaaacaauuuaggcagagugagcaacucuuaccuuacauccgaguuuccagaggcaaccuuguaagcaggccuuucaaaggauagcaggcaggccuaugggccugcuauguuaauuauuuuucuggacaguagcagagccagaauuuaaaucagagcccaugcucugacauuccacuucuguuauggcagaaugauuauuuugaauggguuauaguagccucaauguugcagucuguuaaaaugaggauaaccguauucuguagaguauaaauaauaaauuagauaagcucagugauugguacaaugacaguacccaagaaauguucauuuauguccucuuuugaugaauaaguuaagggaauggaaggcuauuuuaacuccaggaauguucugguacugguaaaguaaguaguaggauauaucuacuggacauuuuuugcuuuuggagguaagggaucaucaaacuguaauagauaucagucagcacauugugcggguaauaacauaacauagggacuagaauaauauucaaauuguaaguuuuaaauuuuacaagagucauaguaaaugucuuggaccuagaucucaaaguaaagagcaagugcuaggguucugcugaauaaggaagauaaaggagccauuaagguaggcacagaguagugacggaguggcacugacagagaacaauggggaaaugucugccagugguuucuccucuugaacuaggguugauuauuugcccuaagcaauuaacucucuuaauuuugcuuuuauuuucuagcagaugauaugggcuuaggaaaaacccugacaaugauugcgcucauccugacccagaagaaucaagagaaaaaggaagaaaaggagaaaagcacagcuuugacguggcucuccaaagaugguagacagaagugccuuaauagccugccauucccuacgucauuugagccacccaagaggggaacgucuucagcuaaaaaaggacaccuuuggucauauuuaauuacucuacuggaaaaccaguauuagauuacucaccuaucauaucauuucugaugcugaguaugcuaauuauaagugaucauuuuuuccguauaaauuugccuauaaacuaggcagaauuuuauggagaaagcugaggcucuagaacacuuaauuuaagcauaauaauaauucuuauuuuuugagacagggucucgcucuguugcucaggcuggagugcagugcaugaacacagcuuacugcagccuaaaccuccuuggcucaagcgauccucccaccucagccucccaaguagcugggaccacaaguuugcaccaccacacccagcuaauuuuuuaauuuuuuuguagagauaggaucucaccauguugccuggcuggucucaaacaacugggcucaagcaaucauccugccucagccuuccaaagugcugggauuauaggugugacccaccaugccuggccaauaauuauuauuuuuggaaauauuggggaaauaacuacaggguagauucaaauuaauuuuuuuaaaggaagaucugucacaaauucacauuuuagucacuauaguggaagcuauuuuccauguuucugaaauucuagaaguuccuagauuauagacacuuucuaucuuaacauauguuuuuaaaauguaguaacuuuagccaggcacagugguaugcaccuguagucccaauugagggaggagaggcaggagaaucacuugagccugggagcuugaggccaacugggcaagaaagcaagacacugucucuuaaaaaaaauuaaauaaaaaguaauaacuuuauaaguacuuuaaagauugaauauguuauguauagacaacacuacauguaaguugccauguauucaaguacagcucucaguugcuuagauagauuaaaaaucugugggccgggcaugguggcucacgccuguaaucccagcacuuugggaggcugaggugggcggauaacaaggucaggagaccgagaccauccugacuaauacggugaaaccccgucucuacuaaaaauacaaaaaauuagccaagcaugguggcaggcgccuguagucccagcuacucaggaggcugaggcaggagaauggcaugaaccugggaggcagagcuugcagugagccgagaucgugccacugcacuccagccugggugacagagcgagacuccgucucaaaaaaaaaaaaaaaaaaaaaaucuguggcaucugcucucagggccucuaaugagcacuguugcagcuggguccuauaucccuuuguguguacuagcaguauguguaaguagcacaggcacacacacgcagagaugaggggccaugguauaaacaaaccaucacuaauugguuccaaaccaauguuugcuuauuuuuuaaaaaagguuucuguacuuaauuuuaagguagaaguacauuaaguuaugcuuuucagaaaguauaacaauacuccauacgccucuauaaugaaucaacucaagaggaguuaggaaaugauccagcuuucacuuccagccacucugugaaagcacauugcuuuuucacacugaggucaugugccacccacuuuccucccccuguuuagccucucuuucugccuguacuuuuaguggagaaaauaaguaaucaaguguuucaguuuaaaagaccauuucuuccauuuccuacuucacuauaggcucuguauagaaauaagagcaaugguuaaacauauuaauugaaggaguaaagucagucaagaggaagagguaaugccuuuaaguuaaaggccggucaaacacgaugacucacaccuguaauuccacugugggaggcuaaggcaggaggaucacuugagccuaggaguuugagacagccuggguaacacagcaagaccgugucuccauauauuaaaaaagaaaaguuaaaagccauuuggugaauguaacuaggcacugauuuuuuucccuucucaagacucuugugacuuuacuucccauggaacacuaaucaucuguccugccucccugauccaucauuggaaaaaugagguggagaaacgggugaacagcaacaaacuaagagucuaucucuaccaugggccaaaccgggauucacgugccagaguguaagugcaggaauacgcaguugugggggcguucagcaccucugcccaagggcccacgggccuuugcucccaucccugagauuucacuuaaucaggacgcguauuugugaaagccaaagacagaucuuuagucucgucaccauacagccuuugcguuguauccugaggucuacuggugaucuuuugcuguguccuugucauuguccucaaugaaagcugcccugugaggaggccugagaugccggagcugccauucaggugacagcagcauuccccuagucaaggagaugugucgcaaggcccucauggcugcuggaguucugauuccagguguacauagugugaauggaaccagcccaguucuacagagcaucuugauagaaugcuaaugauuaguugcuauagguugauuauauuuuuaugacuuuuuaauauaugaaccaucuaagaugcuuuagacucaauaauuuaggacgauuagaguuaacuauaaauucuugaagagggaugcucaggaaggagggaagaaaaugcuuccccacauggcaaucuuaguccuagucuuugucuuuugguuuuaaaggaauuguuuucuguucuuaauugcggagugaagaucuagauugaauacuggcugcuguagucaaggaugagaacaaaguuauuucugccucuaaguaauuucucuccccagccuccaauuuggauauuuuaucuccuaaagaacggggcggcagucuuucaggaguaaguuguuagauuggugccccucugucuuaugacaggccaguucucaugacugagagucgcuucugcaggcaaaaggcaucaggguggcaguggcaggccugcaggccuucccuggcauagauuacugugaguugucugccuuugugcuaaauuuuuauuuagaaauaaauugaaucucacuugauuuguacuuugagccuaacuuguuugguauuuagaauguacuaguugaccgauuagaaucauucugaauuauacuucuuuauaugauaguaggguaacuuguagacacugcugccucucugaauuaggcauaucauuuuuaucaaaaguauuuauugagguucucuuggggcugggcaugguggcucaugccuauaauccgagcacuuugggaggccgaggcaggcagaucacuugagcucaggaguucgagaccagccuaggcaacauggugaaacccaucucuaccaaaaauacaaaaauuagcugggugugguggugugcacuuguagugccauuuacuugggaggcugaggugggagaaucgcuugagccuggaagguggagguugcagugagccaagaucacaccccuacacuccagucuggaugaccaggguagguuacucaccuauuauuaucauuucugaugcugaguaugcuaauuauaagugauaauuuuucccuuuuaauauaaacuuggcuugaucuaugauuagcagaauuuuacuuuauuucaauaaauacuuuauuuuauuuuauuauuuuauuuacuuuugagacaggauagagugagacccuaccuugucucaaaaaauaaauaaauaaaauaaaguauuuauugaaguucucacaauauuaagcuucacuggaaaaagauuuguguuucucauuaauaaucuuuauauguaaggaguauaagcaagauacacugaaagcuuacagcauguauuuuuauaucuuaaugucaaacuagaucagugaauuuucacaaauccauuauagaguggugggaggaaagcaccauugauacaaggugaacaguguuuugaaguuaucuuucuccccugggacuuuggugucauccaucucaaaucauuauuaaauguuaauucccaacucuauccuacuuucuguuauuucccaacucuauccuacuuucuguucuggccagaucauauuaagcauuauauuaucccagccagagaauuuucuuucugacucacuggaugguaagagggaggcugugguagcuauagugagcagacgguaaaugaucagagguaagagauagggaaacccaaguggguaaaauuuaccuccaaaaugugugugugugugugugugugugcguguguguguuaaggacacaaguuaaugaguucugcuguuuguccuuccauuuguaggcauuuuuauugaaagaucaacucugccucucucauugucccucuauagugggaccauuuauugauuucuuuguuaugucuacgcagccucucuacauaugacaucgugaucacuaccuauagccucguggccaaggagauucccacaaacaagcaagaggcagagaucccaggugcaaaccucaauguggaggugaggcuggggggcagccagggaaguggaguuggagccacagaugguuuaaugggagucuuucucagccuccacgauagcaagaggaccucccuggaggucaggaaugcuguaaaugauccgcauguggaaaggaauuguucuuuccucuaucccaucacccuuauuccagacaaccaccucagugauaaagaucaaccuaugccacaggauucagcugccuuuuagaaugaaagaugacugcauuguauuuguggggguaauaaucaccugaauauauaaaagccuuacuuguugcuauuuuuauuuuagaguauuugggguauauacucaugauauuuuuaauauuuauugugcagacuaguauuuuacuacuaguauuuugauuuuaagccaucuuucccugccucccuuuacuucccagaaaaaaaaaaaggguugcaaauaauaaggccagaggcuaagugacaauugugaauacgugauggucuucuaggguguccagggcagccucaguuaugugauguagaggcuuuaucauguaauuauacucugaaaauacaguauuaucccaagaacucauuuuucuauauguuauccuuuuagcccaacgggauauucacagguuucuguauuuggagagaucucuagaacauuucuccagcuuauaaccaacucugacuuauagaugaugaacuuuucagauugcucacugguuuuccauugcuuuugggauaaacccuaaauuucuuuucaugauguauuaggcuucauuuauuuauuuauuugaggcagaaucucacucugucgcccaggauggagugcauggugcgaucuuggcucacugcaaccucugcaucccggguucaagcgauucuccugccucagcuucccaaguagcugggauaacaggugcccgccacuaugcucggcuaauuuuuuguauuuuuaguagagaugggguuucgccauguuggccaggcuggucucgaauuccugaccucaagugauccacccgccucggccucccaaagugcugggauuauaggcaugagccaccaugccuggccauauuaggcucuuuaugaucuugcccuaccuguaugucgcucaucucuugaugacacccugccccucccuggggcaccucuugcucagucauaccaagggaucuguaguucccaccaugcucugucacaguguugugucuguucucccuccgaaugaaacgcuuugccuccacuccuucucccagguuaauuuuuuuaaaccugcuucaagaaucuuuucuggaccacucccuucccaccuucccccgguuugguugaaugccucugccagcaccuugugcuuacauaaguuauagcacuuuguuucuucagcagacguugaguauccacuaugggucaggugcuguuucgucaagagcagccagauucccacuucagguauugaacuagccagugggacuuacuauaucuauaucguauuguaauuaucuuuacacuuguuuuucuccccugcuagauuuugagcucuugcagguaggaacuguuuuuuauaucugguuuagcaucucacaucuaaaaguagacuuuuggaaaauuguuaguaaauuuaguaaaauuuaguaaauguuuuauugagugagugaauuugcagguucaaugccugguguagucauggucuacagccauugcuuaaguguguauuuaaagaauaaaagaaaagucggcugggcgcgguggcucaugccuguaaucccagcacuuuggaaggccgaggcggguggaucacgaggucaggagaucgagaccauccuggcuaacacgaugaaaccccgacucuacuaaaaauacaaaaaauuagccgggugugguggcgggcgccuguggucccggcugcucgggaggcugaggcaggagaauggcgugaagcccggaggcggagcuugcagugagccgagaucucgccacugcacuccagccugggcgacggagcgagacucccaucucaaaaaaaaaaaggaaacccaaauuugaaaacauuuuacucuuagacaucuuauguucaaagacugagacucucaaauaacuuauuugaaccaguugagacguuuuacucuuggguuucuuaauucuuauuucaguguaccugagcuaagcaaauuuaaagguaaauguggguccuccaugcuugccugcuauuuccccuuguguccuuaaggacauguacauuuucccauauuguggcuggauuucacuugugauucuuccagggcaccucaacaccuuugcuucgaauagccugggcucgaaucauauuggaugaagcucacaauguuaagaauccccgagugcagacuuccauagcuguguguaagcuacaagccugugcccguugggcugucacuggaacccccauucaaaacaacuuauuggauauguauucgcugcugaagugaguaacuucucgugauuguguaaauaugaacccugucuguaucccuucaucauuauuucaugucucauaauaaagccuuaguaugugccagauuaucuuguuuaggagauggcaggccugucaaccuuuaaaggacaaaagaauaaauauuuaugagaaaauagcuguugauugguugauauaggacuuugauuacauucagcccuuauauauauaugcaaaaauauaggacuuuauauaugcaaaauauaugcaaaauauaugcaaauauaugcuauauauauauauauaugcaaaaauuauucuuaaguccagugaauguuuucggcuacuucugcuuuaaaacauauggucuagggcuagcacuacaauuuauuugaagcaaacaaaaaagaauguugauuuuaaaauauuuccauuuggcugagugcagugggucauaccuguaaucuccacacuuuggaaggcugaugugggaggauugcuugaagccaggaguucaagauuagccaggggaguaaaaugagaccccaccucuacaaaaaauuaaaaaauuagccaggcacagggguguacaccuguggucccagcugcucgagaggcugaggcaggaggaucgcuugagcccaggaguucaaggcugcagugagcuaugauuaugccacugcacuccagccugggugacagagcaagaccucagucucuaaagaaaaaaauuaaaaauaaaauacuuauuuuuauucgagucagccauaagaggaugugaaauuucuuucuuagcuccuguagcuuuaggaacaaauucuagcuguugguuauaugucuuguugugacagcguaggcaucguuaauaggaaaacucacauuuuuauaaugugguuuuguuauugacuuacauccuuuugaucuguccagcaaagguuugcuaugaaauucacuuuuaaaagugauuggaugacagguguaacagaaaaucugauuugucaucuuauaucuuacuuugaaccuuuauuccauucucccugacuuuuccuucccuacucugugcccuucuuccucaacaaaaaagguuucuccguugcucuccauuugaugaguucaaucuguggaggagucagguugacaauggcucaaagaaaggaggagaacgguuaaguauuuuaaccaagagccuuuugcugaggagaacaaaagaccagcuggacucuacuggcagaccuuugguaaucaaguuuguaccugucccugggggaggccagggaaggaacaugacuguguccuugucuuggguugaacagccaucugcuuugcuucaggagccucugaguuucccauccuccugugaggaggccccaggguugcaguuccaugccuagugucauagcaauccaguuguacuguauguuggagcaguccugugucuaagaaaggguggaagcugcauuccaggguugacuagauaugcagugucaguauggggaauuuguucuauaauaggcaguuaauuuguauagcuucaugccagcuuuuuuuuuuauucuuccaggugauacugccccagcguaaauuucaguugcaccauuuaaagcuuucugaagaugaagagacuguuuacaauguguuuuuugcaagaucaagguguguguauuaaagaagcaccuucucacacacauuguuuuauuccugucuuuucuugggagugaguugaaggucaaauuuccacaaacuuuauggcauuauugauuaguuggaugucuguauucccuuuuuuuuuuuaccccauuuuucuccuucuccccuccccagcuuaccucugucucauacacacauggaaggcaaaauuuugaaccuacucuucauuggcuuccuugcauagaagucauaggguguggucaccauauacugaaucugucugguccucauggggcuguacugaauaauaauaucucuuugacauuugaccugucauccagcaucucaccggaacuuuaagaagaugacuuuguaauccuuugugucaucuguucuuugcacuuucucuugaacucuuaucuuucccugaauuccagauuuacuguuuccuauuugguaccucucauuuacauuucuaauguaaauauauuuuuucuucuuuuacaccuuauauuuguuagcuuauuuuaaaaaaagauugguuuuuuaaaauaacuguuucuuuugcauuaccuuuggccauugcuucuuaugagcuuggcaucauuuaacaagucuucuauaauuugucaagaucccacugcaggcacaguuaagcaggucuuagugaccauuauacaugcauuuuuuuucuuuuuaaucugaggcaggucagcucugcaauccuaucuaaaaagacaugaaaguagaggcaaccaaucuggaagaagcccuaauaauccauucaguagagguaagcuguaggacucucauaaauacauaugacuggugaaaauggggauuuggauucaguaaaacacagaaaugugagguuaugaauccuugguaucagagauuuggcguuaacuaagacccucaaaccagaguaaaaucuacugauugcaaacacgagaucugguguuuauuuagcuucuuuuuaauuguuuccuaaaucugcuuuauuaaaaugcagguaguucuauaaggaaaaaccgauauuucauuuggccuaauugaaguggccuauagaagugaguuguaacuauauuauugagucugagaucaaacaugguuaaaguagccccauguaguuccuggcucucuccguauuucucuuuuaaauccuguaccauccuguggcuugucuucccucuuggaaguggcacuggaguuugggucugaggagccuagacacucggaggcagcagacucaccgagauccagcaccguccacauacugucccaguugcugagacuccgccaguguugcugucaucuuucuuuacugaagucgguaagaaaagcccucagccugcugucauauagugcuccagaggggccaccugagaagucaauuucacucuccuccaacuggaauccagucugcuugaucaaaggaaaugcuguuucgguuuuucuauuuuuguuuuuugguggguuggagaaaagggggcuuauuuauuuugcuuuauuucauauuaaucuugauaauuccuauggcaucaagaauaguguauuucuauuguuuauuuuguuuuagauuaacuguuuaagaaaagaaaaugauauuuuguuuaaaaagaagccauuugugaaugcucugguacuucagaaugucauaaagcuaauuuaguucuugggguuuucugcuuucaggcaguuuugggguuuuggguuccaguuauaaaaacucagauaguuauacagacugaaaaguugccccuaccuuggauagaggcacauccaaaauuaagaggaguauucuauucauuuaaggagcuguaauaauguauucugauuaucaacaucucaauuauauucuagcuuggaaaaaauagaaugauuaugucaucugccuggcaagucuuuaaaaaguuccaucauuugguuuaucuuuaauguggugaaaaaacuugcaagaucacacuuuaaucaaggugucuugaggaguuacugaugacaaauuacaagauauuuugcucugugaagugguaaacaaucaaaacaucaucaacaaguaacaagguuugcucccuugacucccagcugcuccuguccuuuuuugucuguucaggcccuggauccaauggaacugaagggugaaggucuuguccuuucccuggaagaacagcucagugcuuugaccuugucagaacuccgugacucagagccaucuuccacuguuucccuuaacggcaccuucuucaagauggagcuuuuugaaggcaugcgagagagcaccaagguacuuuuugucuccucuguaguagucgagagacuucgauuccucacacauuuuccugugugacagcacuucauuuguccaagugggaacagccauuugccagcagagcuagagccguuaaauucuagcugaucagauucucccuccagucuuaaagcuucauuuauuucacagauaacacuaaagccuuacuacauaggggacuuugagagaguaauuugggacaaccccagcauugcacugaaguggguuuucugucaugggucacuggggagcuugccagguuugugcuagggacggggccuaugcaagugagcaauuuguuuagagaaagcuuaaaaggaaaacaaaggcuugacucuagagacugugucauacaugcgagcgccaauugcucugacuuugaaaggcuuccacaugugaguaguguuuccuacauagccuucugucuucauuagucauucugcucuguuuucgucagagcuuuuuaaggcagaaacauucugcuggaggaaggcuuagauaugccguaaccugaauccugccugucugcuggcucggaaugugcuucaucauccugccugucuugaaagugaggcuuguuucucucuuagcaucucaagcugccguucuugggcucaaccucucuucaaaggcuuuuuuugaaaaaguguauuaauaacuagaaaggucacuuccaggggaauggcauuauuuuuuaaaaggaaugcugccuuuuaauuaaaauuugaaaacauuuaccuaggucuuuaccacugauagcugagagaaacauaagaagagcaucccauguggccagaacacacaugcuagugccuucagagugagcuauugggcuaaaauuuaaauuccuaaucauuuguguuccuuguuuaauuaaaugcagguaauauuuauucacaaguuuucuuaacauauguccauuaauaguucaaaccacauacgguuguuucaaguagggaaggaggcuucuuacuggaauuugaccccggcucgugggccauaaauccagcccuccugcugcaguuuucucaaaacaccauggcuagcuuuuucaugugggagucacagcgccuuccacaaucucaaguugccaagacaccaggcacaucagugucucuguucuauuguuaacuaaauaacagauguagcugcuuuucugucugcuaauuugaaugguacaguucugugacucacuuccugccuaggcaccagaauguuuguuaagauuggaaagcagccccauguggugaccacuguaaugacauccuagaaugugggagcucagggcaccucagaauuuaucuggccuaaguccuucuuuucacugaugaggaaucugagucccaaagugguccagccauaugaggacagaggaagaacuucuguauauuugucuccugauugacuuacagcccaguuuucuuccuucuccagcauucugggggugaacucuggggcccuuagaggcucuugaaagguuuuucacaugagcagcugggaagaaugagcccagcugcacuccaaagucaugccccacguguucuuacugacagcuccccuguggacucaagugcacccuaaggguucuuggggaauacccagggagccuguucggaagcuuuaacaaugguuccuccgucuggacagguccuuuucaacaacauuuggagcaggccauaaaguggguaaagcucuuucacuuucuucuucagcaaacauuaggagaguaucuucucuguuuuggccauguguguacucacagccccucacacauggccgaaacagagaaguuacuuuccuaauauuugccuccuuggagugucucaaguccuggaagcaagagauaauaagcaauuaauauacaguaugacaaggaccgugauaauagaaacaaaaggugcuaugauaguacuugggcagugggcaccuaaccuguacuuuggggguugggaggaccuccaagaagaagugacauuaagcugacacaaaaggguguucuaggcagagggagcagaauggacaagauggccagugugugauuuaugggaagaauuuuggugugcuugcugugucguuugaggagggcauggugagaaacgaacccagagaagcagaggcuggagcagcaagaauccggcaagcugccuugaggagcuuggccuuuauccucagugggaagcuauggaagggcuuuagccagaggggugaagugacaaacucacauuuuagaaagagcuuucuggcugcagagaggaggguggaauaaagacaggugaggccagagcacagacgccauguaggaggcugcuucgcauggcaggugaggggagauggagaaaagugaauugcuuaaacauacaauguugauguaaccuuuucccagauuucaucucuguuggcagaauuggaggcaauucaaagaaauucagcaucccaaaagagguaacugcguuuucucauuauccaaguauuggucauaauuaugugagaaaauuugauauugccaagaguuauaaaucaaggacugugagucaugcucagcagaaagcacugagguuauagcacacauucccugugauuucuaauuaaaauauuugugguacaaauugaaaaggagaucccuagaggaucaggguaagcgaagcaucugaaaaaguguuuaaaaguagagaagcauauaaagaaaagcaagcgagugaggaggcuccagcagugcugauaacguucuuaagcugaguacuuggauacaaggacucauuuguuauaccugacauaugugcuauacaccugcauuauuuauaaaauaauucaauauaaaaauuuagaacucgaauuaagacagcgugggggcagggaggagccuguuguucuggcuggcacaagaaggguggucagugugucccuuuugugcaggaccacagauuucuggaugagcacuaggaccccaaaugaaagaaggcuggagucaucacuuuacucuagcuaccauuuuuuucugacuucauuuagcacuaaauaaauuguagaaaggaccuagaaauaacuggaagcauuauaaucuucagauaugaccuaaaugugugccuucucccuuagguagcagaaggccuuuccuugucaacauuugauagcuaaccuuaagaaugaugagggcauuaaagcccugcagaugagucuguuuaaucuauguuaggguauuuuuuuauuuuauucuucuuuccagugucauugucucucaguggaccaacaugcugaaaguuguagcauugcaccugaagaagcauggacugacuuaugccaccaucgauggcucugucaaucccaagcagagaauggacuugguagaggcauuuaaccacuccagaggcccucagguacaagcuggucacaucagagccgcauaauuaacuguucugaguuauacaaagagaauucuuuuuguuugguugguuuuuguuuuugucuuuuugagacggaguuuugcucuuguugcccaggcuggacugcaauagugcuaucuuggcucaccgcaaccuccgccucccggguucaagcgauucuccugccucagccuuucaaguagcugggauuacaggcuccugccaccaagcuuggcuaauuuuuguauuuucaguagagaugagguuucaccauguuggccaggcuggucuugaacuccugaccucaggugauccaccugccuuggccucccaaagugcugggguuacaggcguaagccaccgugcccagccauauaaagagaauucugauauggcaacuuaaaaauauuuacagccuugauuccuccgaguguuuagaauuuauuagacauguauugggauacuuuuaaagagcacaaauauucuaaaaagaaucaaauaugaggacuaaaaggagauuaacagcagagcugguuagguugaggggaaucuuugcagaggaggcaagcuuugaaggauaggugggguuuugguaugaggaaauauggaaggaaaugaaagaacacaggcaucuaauuauagauaauaaagauuuggaaagcauuaguagaaugauaggcaggagaauuauuguagcaauggagggguagggacugaugaaauaaacauaaucugguuaauugaaaguuuauugagcugaccauccccaggguucuaaauuacaguauuuauauauuuuggcaagcacucaguuaauuuuuugagguugacucacacacacacaaaaugugaugugagaauuuucucaaaagugagacaugggagauagcauuauaauguuaaaaaaaaaaacaauuuauaacagcagaaggaaauuugauaggaacacagugcuuaucuguauugauuguggacuuaaaccugagaccgagauguguuacgagaccaagucuguuuaaaguuaauguuguguuuccuuuugaagguaaugcuaaucucucucuuggccggagguguuggucuaaaccugacuggaggaaaucaccucuuucuuuuggacaugcacugguaaugauuccggauuuguccuggguugucacagcacaucaaggaggccagugggcuacaggggcagcaagaacugacuucuuauguugauugcuguguucguauugcagagaugccuugcuuuguaugugucuauagauacagaucuaagcaggguauagggcuagcugacuccccugaauuccugagcuagcaagccuucaaaugacuacucaaaauaguucauucacguuauuguuagucuaacaucuguuuccauggaaacggggagcauagcuuuuccucauggcuaagaguuaaccuugcucaguuuuaccucuucuccagaauacuguauuccagacacacuuguugggguccaaggaaauuucaaccuuugaaaagagggagaagcauuacuccaaaaagaaaaggaauagggauuuucuaauuauguuagaaauacacuuaauaccucacccuuggauucauuguauguaguguuaauaccaggaguacaaccacaucuuucguggcuacagaaugaaugaguuaguguguugcuaacagaaaaucucauaaugaguaccaguuucugguuuuccaguuaugccaaucaaggauugcugcuggggauugucauugguccaauucuccagacagcccagauggguacaaauaggucaaccuguuaucaucuuccaggagaacggguuuaguucuuacuugggacuccucuguacacgugagugaggaaagcauacuaggaaucaugcuuuuuuuuuuuuuucagagauagagaaauguuauccaagauuuuaaagagguaagaugagaaacuaauuuggaguuacaaugggaaucaauaaagaaggaaacaaauuaagucuccuuaaucgaaucacagaauauucaaguugaaaaaggcagcuagucaagaucauuagcuggcccuucaauuuccaaguagcaaucugaagccuagaggacugagguuaaauaacuugcccaaggacaucuagcuaccuagagaccagaccugaguuuugguuucaccucuguuacuuaagaguugucaacugaugauagugcuaagagcuauuauuaacagucugacccuaguuucucacuagaaacuaggcaagaagguaucuggcaccagcuugucuuaggccaguauagcuuaggacagggaucgacagauuuuuuuucuuugaggcuuuucaggccacauaguucucugucacaugauguguguguuuuguuuugcuuugcuuucuuuucuuaaaucccuuuaaaacuguaacaauaauuuuuagcuacaaaaacaagcugugggcuggauuuggcccauggcccauaguuugccauuucugaucuaguaugucaguuccuuugagcuuuagcugucuucuaacaggaauccaucacuugaagaucaagcuugugaccgaauuuaccgaguagggcagcagaaagauguugucauacacagguaaguaaugguccccaggacccaggacccuucucaacuuguacuuugugaaagucuuucuuucuuagguaguguuuucauagaauuuaaaguauuuggugaugacuuuacugaugaugccccugaggcauaccuucaggcaaaccacagucaggagaaaaacgagcaauuugggguaagcuugaaguuggucacugcaaaagaagagcaaauuuguguauauggugagggcaguccaugaaaggaugcuccuaucuuuuauuuuucuuuuuaacuuuuauuuugacauaauuucagacauacagaaaacguacaagaauaguaccaaaaaguucccauauauuauggugugcauguggguagaaacauuuuucuggaccacuugagaacaaguuguagaccugaugcuccuuugucccuaaguacuuaaguguacauuucuuaaaauuaagggaauucucuuacguaaccccaauaaaaucaucaaaaucagguuauuaaaauuaauaaaacacuauuaucugaucuacagaucuuuucaaucucacuugucucagugauguccuucacagcaaaaaagaaucccagauccugguagcacgcaguuuucauaaguuugucuccuuugaucuggaacaguacccagucuuuguguuuuaugacauugacauuuugaugagcaugagccaguuauuuugcaaaauguccucuguuuuggacccccuugucuuuaaaaacaacaaaaccugccuuaaugcugccaauccccucucacaauggcccucuuuuuugccuuccuuuucaugaccagguuuccugaagaauuaggaaucacugccuaucuuuacuugauuacuucccauucauuccucagccuuuacaaacuggcuuuuacuccuguugcugcacugaaauugcucuuguuaaggggcaccaaugacuuccagacuuugcuaaauauagugauuaugauagucuuccuaugcucucuucucugcucauucuguacauuccuuccuucacaaauucugugcacuccaguaaguccaaaauuuguaucuuuaguuccaaggucuccuaaacuucagaccuaucgcagucccugcuaaauaucugaauccgaguguccacauacucaucuguuauuccuucuuuuauucauuguucuuuugagcauucagcccauaaaacauaccuuuugagcacccacuauguagcaaguauaauuacauguuucagguacucaaauguuacaaauagaaauugauuuucucuuccuauuaucucaaaucugcuauucuucuguagucauugucuuugugaauaguaucacucuuuaucuaauuaucuagccagaacuagacuccuaccuuucucgcuuuuccacuuaccaaguccuuuaguuauauuuucuaaauguuucugauaaccauuucuuccuucccaugcccacugccagguccccccuucccacucugcugaauccuguucucuccaucaccaccgaagggcucuuccuagcuaauccaucugauugugucauccacuucucauauucuucaguagcucucaccuccuauaggaucaaaucaaaaugucuuagcaugacaugcaccaccacccgugaucuggcccuaccagccucuugagcuuuugccauuguggacaacauggucaaugugaacuuccuccaauacaccaugcucugaaacucagccaugguuuugcacguguucccauucccuggggugcucuccucacugcucuuucuggcaaacccuugcccaacauacaagucucauauuaagaguuaacuguuuaauggggcccucccugacuacccuggacacauuuccuucuccuccuuuugcacacggcacauacuuccauuauagcacuuaccaggucauauuauuguuuauuuucauguuugucucgcuuuuguucugcuuuggagcaagacuauauucaucucuccauccccacaccuagcauaguguagugagugcuuaaucaauacuuuugaaugagugaaugaaugacaacagugccauuuacuugguuugaaaacccuguuuuuauugugaauucacuaagaaauacucuacuuaaacuagcagaaauuugauaaccuuugaggccuuauggacuuaccaagguagaacuuuuuggguaaaagcuggaucucuauacuuuuuuggauugggauaucuuuugcuuauuuugaguuuguuucaauuaccuuagcuucagaaaguauuaaaaugccaaugugggucacauccuuuuaaagggauauauaucuagucaagguuguuuggauuccucagacaggguucuuaacuggaccuaagaagacuuaaaggaagaaaucucauuaaaaaugaaagcauaauaaaaguuugaauauauuauuagaugugcugcuuaggguuuuugauaguuugcuuauuuuuuguuuuuguuuuuuagauuuguuugugagggaacaguagaagaaaagaucuuacagcuccaagaaaaaaagaaagauuuggccaaacaaguucuaucagggucuggagaaucugucaccaagcucaccuuggcugaccucagaguccuuuuuggcaucuaaccuccuguggauaagggcucagaauagcaccauugcugguuuguauuaggaucugggaauaacaaccuaaccaugagccuugaacucuguucuuugcauuucaauuucaccgucaagccuuucaccuuccucaaaaugaggcauaaucuuauccccagaauugaggagggguuguguuaaccaauuaguuaaccaauuauguuaauaauuuauuuaaugagugguauggaaaccaauugauuuuuuuagauaaaagaauauguuuuagaguuggaugauuuuggaaaacaacucuggcagaauuguauauaagcuucaguaaaguucaaaaagcgggccaggugugguggcucaugccuguaaucccgacacuuugggaggccaaggcaggaggauggcuugaagccaguaguucaagaccagccugggcaacauaguaagaccccaucucuaugaagaauaaaaaaaugagcuaggcgugguagugcacaccuguaguccuagcuacuugggaggcugaggcaggaggaucccuugaguccaggagguugaggcugcagugagcugugauugugccacuguuuuccagccugggcaauacagugagacccugucucaaaaaaaggaaaaaaaagcucaaaaaguucuguguugccuuucucuucuuagcugaugaugggagaaccaguuacuaccuucucuaacacaggcuccauccuaucucuucaucucuucuugccagugauguugcaccuguaaccaucuuuuuauggguggagcagagagucaaucccugcagccacccugcagccagccaucucugcaguucucucagugcaggcaguucuuccucucaggcugaagaucaaggagaugcuuuguacaugaacagaugcugaguaucuguuaucauuguauuguuuagugucaguguaucauuuaguauuuguaucacuguaccauuuaguguuguauaucacucagucauuuaauauugguuaucaccauacaguuuaauauuuguaucauuugguucauuguaucguuuaguauuucuauuauaacauuucuauuuguaguauuuguauaauauuugugucauuuuuaauaguauuuguauuuuuacaaauuugcaguauuuguagcauuuaguaucauuguuucauuuaguauuugguacaaucuaauaaauacuaauccaguccaauacuaauccaauccaauacuaauaauacuauugguacaauccaauacuaauaauacuauugguacaauccaauacuaauaauacuaacaguaguauugauacaaucuaauaaauaauguguuugacaguguagc

SEQ ID NO: 13763 - RNA, 2021 nt, Homo sapiens
ugcaucauugcagucuaugcuuccuucuagccacgggccuucaaauguacucagauaagaccgggggagaauaacuguagucaagcagggucauuggaagaggggucagauaggauguggagcagagggaugguaaagaauucaaaaccuaacuuuaucauugcucaccauuucaaaaaacaaaacuaaauuuaggaugaaggauacaaaugagaucagagaaaauccaggccaugaaccucugcugcucuuugccagccccauucagagcugccagccuaauguucagugaugaucuguacuuuguauagcaugauggcagccaucccuggguucccauguguggaauguacucaugcaauugauucauucaucaggcuccauugagacccugugaacaaagaguugaggaagauaaaaagacacacaagacacaggcccuacccucaaggagcucacagugcaggaggugagcgaaugucuagauucuuucuugacuaucaucaaagagauguucuuuaacauguaggauucgucggcaaugccaaaaauggaauucuugcagcaggagguuggucaaaaugaccucuaaaccucuuucaucucuaagcauccauaaucccaugaauccuguagcuuaaccuuugaagaagaaauugcuuaugucauuacaauuuuccaguaaaagcacagcuacaguuagcauugaauauuucagaacagcccugauuucagauaucaugucauaaauaaauguaauuggaagacuacauuuaguaauuggucucuuuaagcaugugucuuucugcuucaauagacuguuuccugaaaccugugguguuugcaguccucugggccuuugcuuuccuggccguguggccaggagccacuuuggggcugcuugugcgugcucugcguguguaucugcugauugauagugcuucccggcggacugcagcugcgggaugaucauaugcuucagcaugccuuuauauaguaucuuuugcccaugugguugcagucaauccaauuuaauucagaucagcaaaaguuacugagcacaugugcuaggcacuguaggggauauagaaacaaauggcacuaucagacauacucaaguaacuauagugaacaaaggagacgaguaaaagggaauuaaagaggccuaaacaaagggcugagugagaacgggauggaagagaagaacugugccugcagcaagguaggaagagcugagagaguaggaagugugauggagcuaggccagaaggaccuagaggcucagaugcauggagcaugucaggugguggccacagccagagcaacacaggaaaggagugggagggagggggccggggaaggaggagacccacagggagggccaggcuugggucagcggggguaggggcuucuuauugugggugugauuguuuuauaaggacagugcagagugcagggcagaguguguguguaugugugugugagaaagagugugugccuguguguuggaggagcagcagugggaauaacucaguuaaaaauucaggacuggcaacacuguugagaacgaggguugaauuauagauaucuuuucugaagaaagaagauuaaaggagagguuuucuuuuuuguuuuguuuuucauuuuggcuguuaguuuuaaguaggucauuggaaccuccagugguuggaaaucgcagggcaaggggcuguugcauuagaagagccuguuccaggagcucucuucccccagugcucuguccugugcuccucaugauuucaggggcccacugcuauuuggccccauuauuuuuacauauacuugccuauaacaauaaaucccaggaguguuuguaauugacuaguacaaauaaguuggagaugaauuacucucuuguuucucccuucguugcagagcccacgcuuccuuccaggaucugcuccucggccccuuuacucuauuuccuguucaucugucccuucguccugcuccuccuucugcucaucucccuccucugcuua

SEQ ID NO: 13764 - RNA, 2984 nt, Homo sapiens
gaaauuaaacucaccaugccacuuuaagaagaacauggagaaggcaggcagaagugaccuuggagaacaguaucugagccagaaggcaggaggucagcgggggagucuugagugggaaacucaaggguagccugacuguccuugucacagguuuagcugggcacuguuaguuccccccuuugucaguuugugggaaucugggcaucagggaucuguuucagcccuucacauuuguguuugggugugcucagcuuaaaacgauagcagccugcaggagcuuagcucugccuccauuuauggagggaagagaaacuaaggaaugccccuuggggugguguuggggagcagcuacaugggaaauugaagggugcagcaccaguaaaaaggugcucccaggacucccucccaccagcgcucagaccaaggaagaagcauuuaauuucagccagauuucuagaugguugcuuuuauuuguuuucaucugaauuugugccaaggauucaacuuuuccugcucauuuuauuaaaaacuucauacacagcauuaauaaauagauauaaaacugccauauaaaugacaaacagaggggcuaaaugaaauucccaagggucagcuguugaauaaguaacaaaagcacaucuuggcaugaucaaauucccauauaugcaaauuagggacagugcuuuaccacagaguguuuuaauuaauauuuauaaaucacaaagcgccuuugaaagggccaguaagcuguuuauauuauuaucaugucacacaaauaacaaacccuuuggagauugcuggcuacuuugcauuuuggucugagaaguaaguaagcauguuguguguguuucucucccucguagguguggugucagcacagcggcaggucaccguucaggaaggacccuuguaccgcacggagggcucccacaucacuaucuggugcaaugugaguggcuaccagggaccuucugagcagaauuuccagugguccauuuaccugccuucgucgccagagcgagaggugcagaucgucagcaccauggacucuuccuuccccuaugccaucuacacccagcgcguccgcggagggaagaucuucauagaaagaguccaggggaacucaacccuauugcacaucacagaucuucaggcccgggaugccggggaguaugaaugccacacacccagcacugauaagcaauacuuugggaguuacagugcaaagaugaaccuaguggguaaggagaagcugucuucacguugccagcgucuggccugacucaguucuuuaguagcguaauuuugcuuuaugccaugcauuugacuuuaaaaaaaaucccaaaacucccaacauauuuuaggggucaacagauagcacaaggaaacuaaauuucuguguucacuucuaaauaauaggugguugagggugaaacuuuaaaaaggucuaaugcagauguuaagaauuucauaaguuaacuaacccuguaacuggugaaaagggauaugaaaauauaaggcaaggauguuugugguugaugaucugaaugacaaggaagaugagacguaugacaucaguuggaagagaggagaaaccucucagaaggauaggccuuugggcagcucugagacccacggggcacugcugaagcaggaagcacauguggcuguggguccuugcucagaccuuguacauugaagguccuuuggcuccaugcguaaggaacuaugaacuggcugucucccuuguugcuccuuaaugcugaaggaaacaugaggaagagggaugcaggagcuuccauugugggcagcacuggucauaguguuugccagugucaaaggguuaaccauuaucaaggcuguucuguuuuucugccuaucuuaauguccaguuuuuauuaucacaacuaagcaguggguguugcuaguucuuuuauuaauacacauacuaucauuuguuuauuuuuacuuucucuaacuagucugugucccagcaggagaccuuuuuuuuuucguguguguguguguguguguauguguguaugugugauggagcuucgcucuuguugcccaggcuggagugcaauggugcgaucuuggcucacugcaaccuccaccucccggguucaagcaauucuucugccucagccucccgaguagcugggauuacaggcaugcacuaccaugccuggcuaauuuuguauuuuuaguagagacgggguuucuccauguuggucaggcuggucucgaacucccgaccucaggugauccgccucccucacccucccaaaguguugggauuauaggugugagccaccgcacuuggccguucccagcaggagacccguaagacccaagccuugggugagaacagggagaaaacacauacuaguugugacuaggguacucucaucagacagaaagguggugcuauuuaaucuccagaaaggugcaagcaaggaucaggguaugauucugaccaagggaucacggagaaaaucucuucucuugccugaaucucuccagacuguggcuuccuuccagugaggaccccuuugaucgaugaauuaugcgaaaauuaaacccacuaaaaauaggguaugaugauuauuuuuucuaccaaaaaugguuuuuuaaaaaaaucaucuuccuagggcugcauugcugaaguaaguuacaggauggggaugugggaaggaaagaaaggauguuguauagaaauguaaaacuaaaaguuccaggaggcauuuccauuacaggaucagucagaagugaaguuaaaguaucucagagaagugccagaaucaacagcaaauguuauuugaccuauaagacaauuguuuaaagacaguauuuucagggaguuuauuuauuauguaauaugaaauacaccccauguuuuauccaaguguuauuaaaauaccagacagguaaguguaagcaccaaaauaaugcauuuccaaauccaaacagaaaacuuucug

SEQ ID NO: 13765 - RNA, 2984 nt, Homo sapiens
cagaaaguuuucuguuuggauuuggaaaugcauuauuuuggugcuuacacuuaccugucugguauuuuaauaacacuuggauaaaacaugggguguauuucauauuacauaauaaauaaacucccugaaaauacugucuuuaaacaauugucuuauaggucaaauaacauuugcuguugauucuggcacuucucugagauacuuuaacuucacuucugacugauccuguaauggaaaugccuccuggaacuuuuaguuuuacauuucuauacaacauccuuucuuuccuucccacauccccauccuguaacuuacuucagcaaugcagcccuaggaagaugauuuuuuuaaaaaaccauuuuugguagaaaaaauaaucaucauacccuauuuuuaguggguuuaauuuucgcauaauucaucgaucaaagggguccucacuggaaggaagccacagucuggagagauucaggcaagagaagagauuuucuccgugaucccuuggucagaaucauacccugauccuugcuugcaccuuucuggagauuaaauagcaccaccuuucugucugaugagaguacccuagucacaacuaguauguguuuucucccuguucucacccaaggcuugggucuuacgggucuccugcugggaacggccaagugcgguggcucacaccuauaaucccaacacuuugggagggugagggaggcggaucaccugaggucgggaguucgagaccagccugaccaacauggagaaaccccgucucuacuaaaaauacaaaauuagccaggcaugguagugcaugccuguaaucccagcuacucgggaggcugaggcagaagaauugcuugaacccgggagguggagguugcagugagccaagaucgcaccauugcacuccagccugggcaacaagagcgaagcuccaucacacauacacacauacacacacacacacacacacgaaaaaaaaaaggucuccugcugggacacagacuaguuagagaaaguaaaaauaaacaaaugauaguauguguauuaauaaaagaacuagcaacacccacugcuuaguugugauaauaaaaacuggacauuaagauaggcagaaaaacagaacagccuugauaaugguuaacccuuugacacuggcaaacacuaugaccagugcugcccacaauggaagcuccugcaucccucuuccucauguuuccuucagcauuaaggagcaacaagggagacagccaguucauaguuccuuacgcauggagccaaaggaccuucaauguacaaggucugagcaaggacccacagccacaugugcuuccugcuucagcagugccccgugggucucagagcugcccaaaggccuauccuucugagagguuucuccucucuuccaacugaugucauacgucucaucuuccuugucauucagaucaucaaccacaaacauccuugccuuauauuuucauaucccuuuucaccaguuacaggguuaguuaacuuaugaaauucuuaacaucugcauuagaccuuuuuaaaguuucacccucaaccaccuauuauuuagaagugaacacagaaauuuaguuuccuugugcuaucuguugaccccuaaaauauguugggaguuuugggauuuuuuuuaaagucaaaugcauggcauaaagcaaaauuacgcuacuaaagaacugagucaggccagacgcuggcaacgugaagacagcuucuccuuacccacuagguucaucuuugcacuguaacucccaaaguauugcuuaucagugcuggguguguggcauucauacuccccggcaucccgggccugaagaucugugaugugcaauaggguugaguuccccuggacucuuucuaugaagaucuucccuccgcggacgcgcuggguguagauggcauaggggaaggaagaguccauggugcugacgaucugcaccucucgcucuggcgacgaaggcagguaaauggaccacuggaaauucugcucagaaggucccugguagccacucacauugcaccagauagugaugugggagcccuccgugcgguacaaggguccuuccugaacggugaccugccgcugugcugacaccacaccuacgagggagagaaacacacacaacaugcuuacuuacuucucagaccaaaaugcaaaguagccagcaaucuccaaaggguuuguuauuugugugacaugauaauaauauaaacagcuuacuggcccuuucaaaggcgcuuugugauuuauaaauauuaauuaaaacacucugugguaaagcacugucccuaauuugcauauaugggaauuugaucaugccaagaugugcuuuuguuacuuauucaacagcugacccuugggaauuucauuuagccccucuguuugucauuuauauggcaguuuuauaucuauuuauuaaugcuguguaugaaguuuuuaauaaaaugagcaggaaaaguugaauccuuggcacaaauucagaugaaaacaaauaaaagcaaccaucuagaaaucuggcugaaauuaaaugcuucuuccuuggucugagcgcuggugggagggaguccugggagcaccuuuuuacuggugcugcacccuucaauuucccauguagcugcuccccaacaccaccccaaggggcauuccuuaguuucucuucccuccauaaauggaggcagagcuaagcuccugcaggcugcuaucguuuuaagcugagcacacccaaacacaaaugugaagggcugaaacagaucccugaugcccagauucccacaaacugacaaaggggggaacuaacagugcccagcuaaaccugugacaaggacagucaggcuacccuugaguuucccacucaagacucccccgcugaccuccugccuucuggcucagauacuguucuccaaggucacuucugccugccuucuccauguucuucuuaaaguggcauggugaguuuaauuuc

SEQ ID NO: 13766 - RNA, 94215 nt, Homo sapiens
cuuggacacagaucucagcaacucuuugaaugccucgccaagauccacucauagaacauuaaugaacaguggagaaucuccugacaguuucaugagggagagagaagaaggacuccacagcaaauaauuaaagaaaaaaaaaagaccuacuagacauacauguucugcaaauuccuccacugcuggacagccaccaaguguuucuuuaucaacccacaauacaguuuaaauaaaggcccacuccucccccagcacaguuuauagggcccacacuccuuacgaugacaauugagguuauaaauaaagcaccuuguuguuuuugcacacacauagcaauaaacauagggcuuaauagcucccaacauggccccagcuaugucuccuuggccccaucacuuugcucucuggccucuguuucucauucuguaacacaagaggcagaaguggguccauuuggguuaaucccauccaccauccaguucucaauuuggacuuuacauaguggagagugguuuccacccuaagcagagggguuuuccuucugcaaagaacaaaaugaaagaacuagggaugaagaagccacuauauaaccuaggcauuugggcaaguggggguggggaagcuggagaggagggaggcggggcagggucccaguggcagggagggugagcugagcacuggcugccccuccgcgggauacgcagugaugaggccugccgaaugcagagcauggaggagaaaugguuuugucugugcagccacccacgcucugacugcaguaagggucacaccgggcugaugaugacuuuuugauggaguggacgcagcacccugcaggggccagcagucuuuggaagagaagcgcucagcagaaagcacauccagcucaccagucugcucuucccucuucugcuuucuuucucuccccacccucaaaccccaucugggcucacugcaaccucugccucccagguucaaguaauucuccugccucaaccucccaaguagcugggauuacaggugugugacaccacacccggcuaauuuuuguauuuuuaguaaacaugggguuucacuauguuggccaggcuggucuugaacugcugaccucaugauccgccugccuuggccucccaaagugcugggauuacaggcaugagccaccacgcccggccuucuccucucuuuuuaaagugucucuucugggugccguuuucauucuaagcuaucuauagcgccucaguaagggagaaggggggaaauccaacaacagccgcagccacguggccagcuucugugggaacaccuguggaugugugcuguucugggcaagaacagaacaaaguugcuuuuauguccuucuuucuaaaagccuugugugcuuuagaagcugguuauuauugcauuauuaaagccucagugagccgaggccaaggcgaggguacucuacagcugucccaggcggcuucagccagugcauacuucucauccugugaccuagccugacuccugguugucaucccauuacaccccagugagaggggagcacugggggaggacagagaugccagucccuaauugaaggugcccugggcuucucaccaaacugguccauccaguucuuaggaauuauucugagcauaauccauuuugccaauauuguguuucuuaaagcaccagcagcguaaagugaggaaaaacuguugcauaaggaaauuucugaaaccggauuucccuggguuucagcaagcacuuguucaggagagguugggaggaccaaauguucagcuuugugugugucaugguugggggccguagacuggggacagccuagggcauuguuugcuaagggcaaguuugcuccaguuaguuacagauuccuagucacaacaccgugagcuuugucaucuaucccaaccucaacuuucacagaggaggagaggaaacgcacagaggcaaggugacuggucgaagguugcacaguggauugguguccugcucagauaaccgcagccuagacacaugcugagcacacguggcauuccuucuccaggucuguaagcacagaugcccuucaaauggcagugccaguuuaaggcuaguguuuggaaagacaggcccccagaaggcauggacuguauuuuucccugguccuuaugggacacuucagcaagguucaagcacacuuagaaacuuauaccuacagacaaaccccagaaaaaaguaaucagagucacauucucuaaccagcuccaguacacuuauuuucaugcaaauguggagaaacagcccagccuaagagggagcagcauaacagaacagcagaaugaaugccaccauagaaguuugugcagcccauggaauccauaaaaggccuggcugcggggcccaccaggggcugaaauccggccugcccuccacuaacugggcacugcccaggcaaaaugcuccucauguuucuggucucaggucaaguuuacccuugaguaguaaagcuucccucuuuacuggccuuccucugcacuuccccuucuaccucauuccuguccuaucuucuaaaagcgucccuuaaaaaaaaauuauguuuuucuguuuuacuuuuuaagcuauaaccaccaaaguagugaugagcccuucaugcacugcaguguuugaagccacugagcacaucuucaggucuauuucaccucuaaacauggucuucccauagugcaucuggcuaccucugaucacaugccacuuccuccaggaagccuucccugacccuuccccccucccccacacaucccaccccaguaagugaggacuaucccccaccgcaaccuaggcuaggcaugcccuaugggagcucugaauauguuguugcaaaaugaucuauuuauaaguucaucuuccccuuagaucugcccuguucaaugugguagccacugaccacgcaugccuacugagcacuugaacugugucuagucugaauagggauguguuguaaauaucagauacauacuacaugugaaauaguaugaaagagauaauauaaaauaccucaaugaucauguuucucuugaucauaugguggaauaauauuauaggcugggugugguggcucacaccuguuaugauagcacuuugggaggccuaggugcaggaggaucacuuggaguuugagaccagccuggcgcaacacaaggagacccuguaucuaaaaaaaauuuuuuuuaauuagcugggcaucauggcaggugccuauaguccuagcuccucaggaggcugaggcaggaggauugccugagcccagaagguugaggcugcagugaacgaugacugagccacugcacuccaaccuggguaacagagugagacgcuguccccaaaauaagcaaauaaauaaauaaauacauauuuuuaaaaauuuaaaaaagagaaacagaaaaaauaaaaauuaaacaagauaauauuagagaaauauugaguuaaauauaugauuaaaauuaauuucuucuauuucuuuuuuuaaugugacuacuagaaaaauguaaauuaccuguaugguuuguaucauauuucuauuggauaucugcuuagacuauaagccucuagaggucagggaucauaucuuacucaucuuugcccuuccagcaucuaauacagacacacauuuggguucuaagacagcauauguaacaauacaggugucaccuuguguugucacucuugcugcccaccugucugucucuaccaggaugcuuuccgcaccuuggcacaaagacugugccucaccuaucaagugcuuggcaagaggcaggugcagaauacauguuagagaaugaagguaaaguaaguaucugaucuaaauauucagggagaaaaaaacuuaugauuauuauuuuuaauagagauggggucuugcuauauugcccaggcuguucucaaacuccugaccccaggugaucccaaagugcugggauuacaagcacgacccgcaguaccuggccaauuuuuuaaaaacuuaaucuugcuuuaauuguacuugggaaccauagaugugauauugauaucuuacagauagaagaacaaaguggcuguaauacccugggugggaucuuuccaaguuaagacaaaggaagcgccaguacaucaggagacagaguggcuggguuccaaggccagcaggcuguuacgcaagggggaaaacuucacacacagucaauaauuagaaaaaugauucugggcuguggaaacaaacacaggacaaaguauauagaauacagagacuaauauucacaacaauaucaauuaauagcuuaucauacccucuugaguacugaucaauuugaugugaauuucaacuuuaaaaaaucuuaauuuuauuuucugaauauagaaauaaaacuggcucguuguuuaaaaaaaaaaggcccuaaucucacaauuauauagaaauguuuaaagcaaaaaaaguccuuugugauaccacuccaaaugauaauucaauaaccacuaguaauagguugguguucuuccuucuagguuuuuccuuuauaaaaauucuuuucucuuuauuuuuauauaaaaauaagguuauauccuaaguaucauccugcaacuuaacuuuugaaacauaugaauauauugucaacaucauccuauguuaguaccuauagcccuaucucuucuuuuagcuggagcauagcauuccacuuagggaaauacucccauuauugcuggacaucagcaauaaagacaggcacuuuuuuguuauuauaaacagacugcaaccaacauccucggacaugucuuugcagcuuuuauguuuccauaggaacaaaaauaguuucauuaugcccuaaugaagacagugaagcagaucagaauuggaucaccuauauuaaaaaaagaaaaaacagauugcagugggaagggagaaagggguucgugaagauaaugguagauauuugggcuuugcacauuuuuauaauaaugaaagaaaaguccacuuagcuugcaucucaccuucuaccuccauaauucuaaaguauuuuuuuaauuuaauuggaauuaauuucaucuaaaaaucucaauuuuggauuaaccuaugugaaguucaagaacauucucuuaccuguaugcugguaagaacugcaauuggauauauccuucugucuggcauccucugggucaguuuccacuuuuuccuauugagggacuuacagguucuuuaguuacacagguaacugugguuugaaauuuaaaacaacaguaugucuuucauaauucuccugagaaagaaaaauuccaacaguaaacaacgccacugggguuucuccucccccaccagcugcaucaaaaugcuguccuggcuuugucuuauacuaacaggguagaccagucacuaaucucucugaacacacgucucccaaccuguaaaaugguugcuaccugcuuugauucauaacugucaaaauuagagauaauguauguaaaguacuagaacaaaguacauguucuaauaaugggagcuauuauuuucaauggaaacuacuaggauuaaauagccagagaaagagauaaaagcaaaaggugguaaggagaaaggaaaauccgaagaacguuuguaguaaauuucaacauuuuuauugcaguaacuuugauacguguuuucuaugaugcugggaacuaacaucucuuaagcgagcauuaucugccugcuucuguacuagguauuuuacauauguugucuuaauucuaacaacaaauuuguaaggcaaguaguagugucuucccauauuauagaugaaaaaacugagacucagaauguguaaguggccuucucagauucaucaaugugguaaguaacaaaauugguauuaaaacucaaaucaguuccaaaccugugcuugucuacuuaucaggcugugacuacugcagcaggccucaugaugccuucacgguuucuuaucuccugcacauuuuucuccaccuggucucacucugaucacaauggcagauccagggccucccucuuccacugacagaaaaucagugcaaacugacucacgcacaccaaggacaaaauguguucauggucaugacaagucuaaagguagacuuuggccucaggcuuggcugcacucaggggcucuaucuuccccaucuuucagugcaacuuuccucugaguucugacuggcuuuaauuucacagggcucucuccucuggauagaaaccuuacgacccaugaccccggggguagggagaggagcacccuuucuuucucccagggucuauuuuaaccauaucaaaucuuagugaaaauccacaugccuauuucucaaccaaucacuguggcuugaggggugccacguccugcuggccaggccucccucuccagcccacuccugugacagguucagccuuaccugaaucacaaggaaugaugccccguagaacagagcaaaaaggaagagcaaaagaaguccucaauagaacaaagccacagauaaccucugcagaguucuuguugcuuuuuacucagcaacaccucucauaaacccagacuuuugccuuagaaaagcuccuacuuuagcuccauagggacugauuucauaacugcuucuuuuuugcauguauuucuuccaucauuauguacuaucucuaugugaugucuaaaaauaccaaguggacaugguauauccugcuccuucuuccugcccaaguuagcaaaauagcucuguaauuuucaaugcuuuuggcuacaauuuacagaaaauguaaauuuucauuuacaaaugaaaaugaucaaaauggcuucgacaaugaggaaaaugucauuuuacacacguuaagaagucccaagguagagcagcuccaggguugacugagucuccgugauugaggcucuuuccauuuuuccucucugccauccucauuguggcagcauuguccucagugugcuccccucaagacugcaggauggacacagcguccugggcaccaccgcuagccugcaguggucaggggagagccagugaagcuggcaaggaagggagaaccuaaucaaggccaguucagaggauuuaaguggcaacaaaguauaggguggacuaggggagcgagauccggauucugagagcuugauuaaaaggcuguuguaauagggcagaaaugcaaauauggagacugaagaaagaauggaaagcaggagacacagaugggacucauugcccuaagagucugaguucuauagagagucaaacaccgaacugacuugauuaaaaaaucagauuucagaauacuuaaaaaaaaacuuuuuauuacuuuucuucaagcucauaucguaaaacacaccauuaggauaaauuggaaacgggaccccaggacaauggcuguccgugugggaucugaaccaccaugagaauuuuacuuuuauuuguauuuauuuauuuauuuuugagauggagucucgcucugucaccaggcuagugcucaguggcaccaucucaggucacugcaaccucugccucccggauucaagugauucuccugccucagccuccugaguagcugagauuacagacacgcaccacuaugccugacacauuuuuguauuuuuaguagagaugggguuucacuauguuggccaggcuggucuugaaguccaccucggccucccaaagugcugggauuacaggugugagccaccacaucuggcugagaauuuuacuuuuaauaagauguucucucuuuguucaccagacugucucuaauauuaguugauguguacagaacauaaauauuuguuaggaugcaauaguccaaauuuagaugcaaauauuauguuuaaauuguaacaaagugauugcuuuuuagugacaucauuucaaggaauugguaacuugguuuuucauuggugucuuggcccaugaaggaugagcuucaguggacagaagacaugaugacacccaguuagcaccacaaggcccucucucccaggcaguccaauguagcaggacgccuacucuagugcacgcuacugcaguuaccucugcuggaaacugcuggugaaaccacugaccugaccuggacuaagcaccugagacuucuugcuucucaguuuauccagacaacagccucaacucugcccuugcaguugcaugcuacauucuguccagaauguugagagcuauagcucuuucucuuccauggacuagagaccucccuuucaccaugaggucaaugaagcuuaaccucaggaccugucccuugcauuggccccuuccagggcccuggaggagucuugccaauguguuuacauggucaccugucacuguaaaauuugcaaagcugauaaggcuuugcgauuuagaaugcggccucuuucacucggauucccacucccucacauaacucuuuggguggggcagcauuggagggggcugcaggcauuucuggaaugcaguuaagggaaagaugaaugagugacaaguuuagcuuguguucaugaagauauauauuuguguaggucacagccaccucuacgcauaguuauguuacugccagccauuccagagcacaaauggcuuucugaaauacucccugucaccgcugugcugacgcacccacugcuuaguaucagaugcgaggcuggaggucauggggaaaugagaacguguccuucagcucccagcaccgguuacagauggaaaguggaggagaaauaaagucugaaauguaucaagccaaagauuguauauagagaauucuuucaaacagcagauguggaaaguuguaaguggaagauucaguucucacaacaccucaucagacugcaaacucucucuuaucauaaagaugccugaaaauguaguguauacaauuacaaaaaaauuagccccuuuugcuguuauuuugaaugagaguuuugagaaauaguuuaugagaauuccuacguuuguagcacaugugcucugagcagaauggcagaguacaugcccuauaaaccuguguaccuacauauauggaacaguuaauauaugacaaaaaugauagacuuuuuuucaaauuugaaaacaaucauaaaaauuuucggccaggcgcgguggcucacgccuguaaucccagcacuuugggaggccgaggcgggcggaucacaaggucaggagauggagaccauccuggcuaacacggugaaaccccgucucuacuaaaaauacaaaaaaauuagccaggcgugguggcgggcgccuguagucccagcuacucuggaggcugaggcaggagaauggugugaacccgggaggcggagcuugcagugagccgagaucgcgccacugcacuccagccugggggacagagcgagacuccgucccaaaaaaaaaaaaaaaaaauuuuuuucaugacauucccaauuacaaguuggaaagcuaaaagacaauuuuuuagaaguaucaguaauaaaaaaaauuugugaucaaccauuccagagaaaauguuaaauuaucuuucucuucucuuuagguagugacaucucaaaauuauaauaaagaaguaaucaaagaguuugcaacccaaagauguuuuuuaaaaagguuuuuggagcaguggcagggagcuaauaaaaauauuucgcuauuuuucuggauuugugauauuugugccaacacguuaaaauuuuuaauuucuugugauucucucaaucuaauaaggccagauaugguggcucaauacccauaaucccagcacuuugggaggcugaggcaggagaauugcuugaggccaggaguucaagacaagccugggcaacauagcaagacccugucucuacaaaaacauuuaaaauuagcaaagcaugguggcacaugccuguggacucagcaucuuggaaggcugaaguguaggauccguugagcccaggaauuugaggcugcagugagcucugauugugcuacugcacucgaaccugggagacagaaggagaccgucucuuaaaaaaaaaaaauuaaaacagauaaacauucauauuuguaccuaauucuuaacuuauaauuuugguucuuuuuuugacagaggaaacuccaaauuuaaaaagcuucaggcccccaauaaaaccuggauccacuguuggucgagggagaaagggaggcaauauucaaguucucauaacuggugagucuguguuucuguagaaguucccguuacaaggaaacaggaauuaguccuucagaacugaaaaacugaucuuuaaucaagccaacaaaggagucagccugaaugguggcagacacgaauuuuugguuuuuuuuuguuuuuccagcagauugagagaacuuggacaaguuauuuauccuugaaaaucagucucaucacugguaaaacgagguuuugggguuagaugaacugaaaguucccuuuuagugcuauguuuuuuauuuucacagcuaaguguugcuaugucaagguauuccauuacuuacuauggagaacacagaagaaugacucaugaauuuuuaauuuguaaaugacugcugcuaaguuuaugaaacccuaucauucucauaaguagguuauacauauuccucauauauuauuucacaucauucaauuauuuaacaaauccuuuuuuucauaacagggcaaagguacacuuuugugcugcuuccucuaaguagucgggaacucugcagcaguggaauccaaagcaauuaagcuucccuguuacaacuguaccaccaccuucauuucugcaugccucuuaauuuuugagcuaccuuauuauauaugugauccuauuuuaucuccaccacauucuuaggcgguaaauggagcagggauaauaaucucuauuuaauggauuucaaaacagaugaaaaagcguuaaaugaguuuucuaugaguuuuaguuggguagaaacaaaaacaauuggaauaugggucuucagaugcccacucccacuaugaaggucagcauauagaaaugugucuagcauggaaaggugaacacucugguuaucaccaguuacuggcaaauauuagcuaaagcccuaggacuacaugaaauggggaaauaggugggagcauaacgcacaggaaagaugaggaccccauucagccauugcugggaacagaucugaaauucauguucaauauuaaaagaaagccaauugagaguggccagucccugcaggaaaaugaaaccugguccugucagcuccugccagcuucagugcacagcuaaaugugcuugcugagugacuaguaaccaccagcuagcccagagacuauggagcacagauaacacaucuaggcaaagacuggcuggcuagugucgccucagccacacugaucuguucuccaaugaauguuugcuauugggcaguuuauuccaaguauaguuagagaggccagaggggccaugggaagaggccacaugcacauccgcaccugugccucucagugugucccugccugcgcaggagccuguucaaauauugaucaaaagcagcuuugucacaggcgcuggaaaugggagcuccuucugaaacacggacccacuuaaccagaaaaggagugguguuucuaagaacugucacuuugagaauucagcuuggaagguaggacagcucacagauguuguauaagauccuugaauaugaauuuggugacuagcugucuugcaauauuugccagcuauuuccuuucauauacauauuuauuucuuuucuuuuauauauuuauuucagauauauuuuccuuucauaugcauauauacauacacagauauacacauaugcucacguauauauacacgcacacauaaauauguuugaaaccucacugagagaaacauccagaacacauuuuagacauaaggugacauggcauucagcucugagcccaaguauaugucagcugaggccugcuauggucaggacucccuugcugaugaggucuguccagcauagcaguccacacuguccuccacaacgacaccagaccaccagagacacuugaagucaccagugcaaucaaaauuucaguccucauuagcacaauaaaauucaaauguaguuaaagugaaaacuacagcauccaauugcugauucugacuucucagagauuuuaauggagaaaaacacaucuugguuuuauuaucugcccgaaaacugauuuuuaaagucucuuccugccuuacauuuaacaccucugguaaaauuauauuguuuagaguuccuugcacaucuaugcuauuucaugcccuuugccaaagauaauuuacaacuaugagaaagggauggaguaggaagagaugacucccgcuuaaugaaugcugucugaaugccagggucuguacaaugcaugugucuuuuauaccuccaauauuagaaugcccacuucccagaugaauaaacugagaauccuaaagguuaagcaauucaccugaaguuacacagggaguuaauucuugucugcucaaccccuaagacuuaucuccaagggccaaaucugugagcuguguuuaugacaacuaacaauuugucaaacccuggggguucuuuggcccuuugcaagcgaaaucagucugcauuugcagguugcucaaauguucacaaguccgacauuucaccacagaaggcagacucauaaaauauuuuaugcaguaaaacugcugauaaaggcuuaucuucuagauaggacccaaagaacagacaguucauuauuuuucuaacuguuccuuuauguuaaugaaccuuggucaauguuccaguaguggcauaaaaaaucugggaauguaaauaaaagacuuggcccuuuuccuugauuguagguuugucauuuaacuuugcuauguucuacuuuccuugucuauaaaacagguacaauaaucaugcugaagguaugaugagacuauauauaugaaagcucuuagaaaaugguauucaggcuauucagguaucuuggcuuucaucuacuaaauacagacauggugugaaauagacacauacuuguacaauaauagcugauguugacauugacuguuuacuguguacagacgcugugcuaagugccuacagucaccauuucauuucauccuuucaacacugugggauagguauugguguuauucccauuucacaagugggaaaaagcaaggcauggaaagauaaguaacucuccaagucauacagugggaaaagguggagucagguggaauuucaacccaggaggcuucuuuucagagccugugcuguuaacugcuaucuuauacugccucccauauauaaguacagucauaugucacuuaacgcuggggauacauucugagaaauguguacugaagcaauuuaguccuugaacaaacaucauagaguguacuuacacaaacauagaugguauauauguuuuuauuuauauauguuuucauauggaaaaccaaaugucccagcacaauugcugaauaucagucauuuccccugcuugagcugcaaugccaguaucaagucccauauaucagauuucuacauaugcucccuuauaaucuuaugggaccaucauauauauauauauauauauauauauguguguguguguguguguguguguguguguauauguauauauguguauauauauacauauauguauauauauacacacacacacacauauauauauauagugcaugacuguauaauaaaaugacacuggacuuuaggaggcugaggcaagcagauugccugagcucaggaguuucagaccagccugggcaacauggcaaaaccccguuucuacuaaaauacaaaagaaauuagcugggcaugguggcacgccuguaaucccaacuacucgggaggcugaggcaggagaauugcuugagcccaggaggcagagguugcagugagcugagauggugccacugcgcacuagucuggugacagagcgagacucagucucuacauaaaaaaaaaaagauauuggaaggcuuauauaaacaauuagguuuauuaucaaaagauaagcauuuagccuacacacuccagccagaagaguccaauacaaacaaauagcucacuauguuggcacccuggaagagagccucauuaguccccagcaccaauggauaaugucucaguucuugguguuuccugaccagucucuuccuauugcuucuccugaaccaccaucacgcucuggccuuuccuucugcugaaauucagugacuuucaauaccuauucacauugcucuuccugccugacugccaggaagccuucucaaacuccaaggcuggccugccuuuccacuuugcucuggcccuuagaacacccugagcuucccucugucccaggagaaccccuuuacuccuggaucuguuuccugucauaugcaccucaagggcuguacugcguuuuccucaucuuuguaucaucaggauuucaugaggcccacauuuaaguuucucaaguaguaagucucuaaaaauugcuagacaauggcaucuuggauugaauccaggaacagaugaaggacauucuuguggaaaaacagguaaaaucugaauaaaaucugaaguuuaguuaauaguauugugccagcauugaucuccuaguuuugauaaauguaccauaguuauguaaguuguuaacauuagaggaagcugaaugaagaguauaugaaaacuuucuguaucaucuuugcaacguuucugucaaucuacaacuauuuugaaauaaaaaguucaaaaguccaucauuagacagcuuuguagcacagugguuaaggccaucuuuuuggagucaggcagaccuaagucaccuacuacacguacuguguggucugaggcaaagcaaagcauacaguaucucccaaccucauuguuaaauggccugacacaguagaaacauucaguaauugguaauugcuuuuguuaaaauaaauguuauauucauaauaauauaguauuauuucuauaauaauuuagcgaggauauggucugaucuuucuuuuuuaaacuuagcucacacugcacaccagcaucccacaucugccucucugcucaacagauagcauucucaaugugcuaggcucuauuccgacacuggaaguacaacagugaacaaagcacaaaaaaucccugcuguaaacagcuuaccuucuaguggaaagagacaggcaauagacauaaaauuuauaauacacugguucucaaagugaguucccagaccagcagcaucagaaucaccugggaacuuuuuagaaaugcaaauucuugggccuaacccuagaucuacugaaucagaaaucuggggaugggcucagcagacuguuuuaauaagcccucuaggugauucugauaaguacucagguuuaagaaacacugauacagugucagugauaaucacuauuuuggagagaacuaaagcaggaaauggguggagugcuggggugaggagacagauuguggcuuucaacagggugaucagaaaagccuuacuucaaagguaacaccugcuugaaaacaucaagaugaggaagugggccuccaaaauaucaagggaagaguguuucugggaaaggaauaucaaacgcaaaggcacugagucaggagcaggccugagcuguucaaagaagagcagcuguccugggagaggugguggggcuccagguugcguagggacugguaagccauugcccaagagugugacagucacacagucaaucaugguucugccaaaaacacucugccuuuuccuguauggcuccaggcccuccucuacccccaaauccacccacccugccuacccuucguggcucuagccaguuccuucucuuccuugggcuucuccauccccaacuucugauaaauaauuugauaaauaguuugcuuguuuuugcccuguuggacugcuuagucugaaagagaaacucagucuuuucccuucuuucuucacacugccuaucacaaugccugugcauugugucugccccauaaauauuuacuaagcuucucuuaaggugccaggauagaaaccaacacauauuggcacacaauaaacauuauuaaugcugccaauaauuuugaaauuuccucugucacagggcacacagguucauucucaaagccaaaguauuuuggauucaguugaaggauuaacccagagugugacuuacaaccgggagaggcacucccuauucccagcugcucucccuuugugccugaauaguucugguuggcuacagcucugaguauugacaaagagcaucaucaauguacugcuaaccuugggccaaaauacaccaagcagacagguagcaugaaaaaaaaaaaauggguauuaugaucagucagagcuggguuugaauucaagcccaaccacccauaggggaucuuacccuuuuuuuuuuuuuuuuucuaauauuguaaaucccuuuagcaacugagauugaagcguauggaccauuucccaguaugaggcuuuuaaaugcauaaaauaaaguguauaagauuacagaguagauaauuuuuauugagauauaauaauguuaaaagcuaucagaacacuuauaaaaauugugcuauaguaauauuucuaccucauuauuggugcauuaaguaauaagauuuagaggcagguuuaauaaguaccaaaauguugauguaauacugaguguaaaugauauuucaagauacuuagaguguaugauguuguuagagguagguggaagaaaaaaagauuuuuuucaucuuguaucauccugaauucucugcaaagaccuguuaauaaccccauauuauaacuugggacaaacuacuuugcuucucuaaguuucaauauccuuaccuguaaaaugaugcucaauagauggcagguauuauuauuauuauuuucagcagcaguguuaguaguuaaggauaccccauaaauauccuguaacauacucugugucacuucuugguuauuagcagggucaguucuguaaguugacucaguaggaggucauccuuuugaggauuuuuacuccccaaaugucccauauuggccugaaauuuuaucuuuagaaaagaaugcauagcuuugguaaugaaagacuuucaauugcaagagaccccuaauaaaaaauaagaauuccugacaaucacccuaaacccuagucacaccccacauaguccuaaguuggaaagugaaauauuugcuaacccaggagaaaagaugaauggcuuuaaaauaaaaaagaugauauauacuugggacaaucugcccccaauucacucuuuucccagaggacacuuuaaggagauguaauuguuugccaaacaagaucauaccuugucuauagucauggucucaaagaggauuuuccuaaaguucagugguguauuugguuauaauuugccugugccuauauaacccauauauaccaguucauucuucaacuaaauuccaucuuaaaaucauaucuugacuaucucuaagugacauuaaguugguuuucaagcacuugagagaaaaguccuuuccugaggaccaccauuccaaaauugcucucuucaugcuccaugcaguuucuucaagcugugugauacaaugccccccaaacuucagugugccucagaaucaccuggagaaaccauucagauugcuggaggaacccacagagauucucauucagaggccugggagaaggccugaaaauuugcauuuuuaauaagcucccugguuucuuuaccucuaugagcccaguuuccuuauuauuaaaccaggauaaugauaccuuuuuuacaggauuaaugagcagaugagaaaaagauaagauauguaaauauauucaaaauacuaaguccccagcagaaaugcaauaacuauuaauucccaugaugggacaucguuagagagagaaggggauaugucagagaaagcauuaaagaggacacgagagcagucuugaagcaauggaaauuaguaaaagagaagaaagcgaaggguguucccagaauuuaaaaaaacaaaacaaaaccguaugcagaggcuguguguacaaaaaaaaauagcuaacucagaaagcugccaaagcuacccuuggcugaagcaagugcauggaucauaugaacauacucagggucuugaugacaagggcccuuugugccaugcuaaaaaguuucaauucaauucugaaggagauaggaaugguugacguuuuuuaaacaggucaguaacaugaaauggggacaaaggaagaggaagggcucuaggcugaugccuaaguuucugucuugaguuuacauguaugugaugaugaugaugaugcaacccaccagaagaagugccacagaagaaaaaccuaguuggggaagaagguaaugaguuaaauucucgaugucuaauucaaggcaccuagaagacacccacauagagcuaacaagggguagugagacaugugaaucuauaugucuuagagaaaucuugaagccugagucuagaagaccucagcauauagguggaaguuacauccacaggaauagaugaaaucgcccauggaggauguaguacgagagacgccuuaaggacagaacucuggaggacaacguuuaagagcaauuuccaauggaguugaagucaagguucaugacagagggcaggucccccuguuuaccagucugauaauaucuacacacagugaauucugguuuaaauggacaucaaggucagccuuggucagugguacucacaaaauccaacacaacacuuaggugguagaagcaaugcaaggaaacaucacuaauaggccauagacaggaauaugcuugccgguaauaauugggggugagugugauccccagcacugccccuccaaauuccucaguugccacaguuccuagaugagggagucccaaagcaauuaccccgauugcucaucuuguagagagagucucuucauuaauuuuugcaugagugagaucccaagauuuaucauagcucagaaauaauccacaggaagaaagacaucauccgccacaagucaucaaaaacuaaaugcuguccacuuuccucuuccuuaggauaaacaagacacugacauggcacugacauggauccuguucauacugccaaggcuaucaucuguguuuggccaaaccaccacaaacaagcaggaucccacaccaggcagccccagggcacucgcuguuccugccacaggcuucagaagcaucucacccacaagggcaccauucagaagcaggcugugugagcccgggguagaguaagacaaacaauggcagaaaaguagaagggagucugggcucauucucugugggacaggacaagagaggagcaaugggggcauucacagggagaaggaaaugcucugccuucagggguggugaguugggggcgucacgauuagaccagaaggaaacucaauguuuauaaaaauccaaaccuacagauuaauuagggagcaauuucaaaaguaguuuuuuuccuccccuuaaagaaugaauuuaugcacucaugcaugaaaauacuuucucauuucagggaguauaucaugcaaaagaugaggcacaccugcaucugggccuggggaucuccaaguaauuaacaauccguuguuaucuucaaagauguuuucuuaggaagaaaaccugggcccuaagccuugagagaacguagccccuauccugauuucacaagaauuggggcuaagggcuggaggcuugagaaccggaccgaggcuuugacaggauugucacaggcuaggaaaacacaggaaauguuuaaucagaaggaaugaaaacacaguguacaaagagaaaucugaucuccauagccuaucuuuauuauggcuaagcgguguggggaggggagaagugaaucuaaaaccaccagacuguugaaacagaacuguuaauggggcaaaaagccugccucaagacaaaaauggguuguccagcucucgguaaacaccugugccagcugggagccgugguauucaggcucguaaguaccucagacuggaacauacuauucucacagucugcaccugugaacuuucuagagggauuuguuccaguuugugauuacuccuuggaaugugaagccuuucacucuggaccuauacaggccaucucccaagguagugucccauuaaaaaagaagggagagaaaagccuaacuggccugugagcucuggagagggugggagggagugggauaggaguucaagcugaauccugccccuccaagcucauugcuggccccugaagugacuugggugagcaugaucacccaucugccaaucaaaggcugaacuucagggcccaggcaaaugguaagaaacucuucuuuaacuugugcuauuuaaaaaauauaaaucuucacagaggggaggauuccuuuuaugagguccuguagguccugcuuauggaagugaaaaagguguugcucuccucaggaguagaugcugguuaaauauuucuuggcugagucaggugagaaugcacuuccaugggguuggaagaguuguuuaguagaagcaauacaaggaaacaucaccaacaggucauaggguguuagaaggaaaagugcuugcugauguagugugagagaagaccuaaggauagaauucuggagaauagcuuuuaagaaagagcaauuuccaaugaaguucaagucaagguuuuauuuguuugccaaaggacauuuuccccaagaaaaccuagagaggugcaaugcagaaaauuacagccucucaggcugcaucagaaggcgguucuagugaccuucccugcucagcaucuccugcuccuucugaguccuccucugggacaucuugcaagacccuggacaccuuugagcucaguuuggaaacacagaauuaaucaauaucacuaagugucuacucccagcucccauuugcaccuacaauuaaguggccgacuucucagcagagccuugcacgcuucagccgauuugucagagcacaucuacugcuccguggugccuuagaaaggcguugguagaaggcugcaaaucagcccuuuaggaaauuggcaguucccauuccaggacaggccuaccauugggucucugggcaucugcauuguacaagcccuaagcuaguaaaagccucacugggcuauguccuuggacuuccucuaauauucauugucagcaaauaugaauaaugccuaaauuucagaauuaccacugggcuaaauuaaucuucucuagaacgaaugcaucuuuaauacuuccaucaaaaacuacuuugagaaaaagagagaaggguuaccuuauuuccaggcaucuugugucaacaauccacuuuagguuccauacuugccacucuugaauaauuaaaagucaaggucgcacaugucacugaagaaaccuguaaugaacauuuaagcauaaguauuagacucucuaaauuaccucagacuguucuuuaaaggguauuaagagagacagagagaucuuggccuaauuuuuauuugggaaaacagcuuuuugugauuucauaacuuuugcuuacauaaaaagauuuaaaaauuuaagguaaacucucacugacuagaugacacagccuucuucuagaugaauauuguaagguuuugagacagcagugauguccugauccacauggcagaugguggaaguaauuucagauauccucaaauccuacacccacauucuacaaguaagcgaauugagguccagguggguaaagaaauuuucuucauacacuaaagcuagcuagcaggcagacagaaacaagaaucuuguguuuauggcuccaaaugcagugcuuuuccuacuacaucauguaacaaaugcagaacaauuaguaaacaucucucagagcugcuguuuugcuuccagcgcaauucaaauuguguucaucagacucauuuauaugccgcuaacaagaaugccugcaucaguuaugucuugcacacauuuguuauaaagagaaugaccuuuagaccuucaaaugugucuuucauuuguuggggcucuguggacaagcuggaaggauugggauguuucugaaaagccaaagagugugcagauggcuggaacacagggcuucuccugccgguaaugggaaggaggaaguauagugagccucgugauucucaagccuggauccauuagaaucauucagagagguauuuuuacaguacagugccaaccuacauagccagaguuuuuuauuuauuuggccugggguggguccagagcacugguguuuuccaagcuuccuuuggugaugugcauaggcagauaggguugagaaucaccuuaucucaagguuuagguaucagaacuggguuugauaaaagcaagguuuugguaucagaacuggguuugauaagagcaagguuuugguaucagaacugggcuuaaaauccccaacccugacacauacaccuauucucucugaguuuccuucauguguuuuuaaaaaauuuuuuuaucccauuggguuauuguagauuagcauaugaaguauauagcaguuucucaauaaguuuaacucuucuuccuacauuuagguggcaauagcaaagaaguagccugaagucaucuagugaaggaagaauaaaaggaaagauaauuaugguauuugugaaaaaguguuuaguacaggauccauacaacugaauccuuccuggcuucugcucucucccuucuugcuggaauaaauauucauguaaaucaauggcugggcacccauaaucccccaggaugugguucuaucuguucaauguuuugcaucauuuuguucgguugagaaguuucugugugccuucauuuguauaaaguuuuuccuaugugcaucaagccaucagaagaaucucuuagggaauagggugaaggcuggcagagacaucucugcucucugucagacauaccuugcguuacuucuaccugcaugacaugauucucugacaaccuagcccucauaaaaugccucagaugauugcacaaauaagucaacacaguccuucccaggggcaucagauaccauuuccauucucaucucuguacagaaagcauauggaaaauucuggugccacagggaucagggcauggagcuggaguaaguaaauagcaacaauugaugccuuuggugccuacagucaccccagugaaaaaagcaaaaccagauuugcuuuuucuuuauuccucuuguauuuucuuuagcccaugcaucggaguugaacucagaauucccaacccuggcccugaucucgggcaucagucuguguccaguggugacacagggaucccucccagucaagggggucuccaguccacuguagggcauguguggcccucugcucuugugcuuuccuuuguguagagcuccugcccaggcccugagugagcucccgcucccugguaucuggcucuuuuccaugacccacacucuucaaugacuacauuucucacacuggaggacuagauuucccaauguucgggcugcaagaaucuaccuugcgcaggaagcuuuguccccuacaugucacaguucagcuccaguaggagguaccaacagaagcaagguguauggaggcagugguguacuuuggugcagcccacagcuucauuacacaguugccuagggaacuuccaggccaccauccagcugccuccagcugccuccugcugcuguuucuguuggacaacucccuccauugcugccuagagcauuuaaauggcaagaugacucaagauacccugccccagggguuccuggcuucucuuccuuccucucccagcaccucccagcccuuuucccugcagucaucacacacaggcaccauucaagugugcaacuauuuuuacuaaagugugaaggauucucagggcacaaacuauacuuagcagagguuaaaguucacauuaugcaauaaggcauaaguuuaaaucauuaaacagccuguccuaugcucuuucuguccucacuccucuacaaauggacuuuuucaguccuaacgcuucucuuuuuaauucagccuauguauaacucaaggccuuuguucucugcaaggaagagagaccauuucuuuuuaggcuucaaaucacucccucagucucagauagagauuuucuuaugaccaucagaaccucugauuuagaaggaagcuaugaagaaauguuaaaaggaaucuucccaauguugaaaaaucuagccuagaaauuuuaaaaaauguauccaccaaggggcuugaacugacgcuaguugacaacugcaguuggcuuuucaggcccagguagugagaaggaauuauguuugaggguguuaauuucagcauaagaaugaagaggagggcucaaacuagcucaucugcuagaggaaagaccgggguccacacugcgugugugccaggauguuucaccacauggucccucugguacugaaagcccuguuacuaacagucguagcugccugcucuggacaggaagugccucagugaugagaguccccuugcucaaggucacagccccuuccuggggcagccugcauccaaugacugggcagaguuuguuauaaaggcucagcccucuuccccugagcucaggaaaacucuaaggcggcaucccuccuucagagacugcaucacaguuccacggcuuccucugccucuuucacagagaagaacucuaccuaauacguccccacgugcuaaucuccaucucagaguaagcuucccagggaaccaaccugagacaaugaucagaagagcuuaguaacauuucuuaaacaacguaacauucccagguuuguuuuuuguauucucuuuuaaaccacugccacuaucaguaaagcucuuaaaauacaaaugauaaaugcucuuguauagccucuguccuagcuccugaaugugcugacagcaggcuuagcagcaucaauaucacgggugaguguaucugaaaugcagaccuucaguucccaacccagacuaacuaaaucagagugcauuuuaauaaaauccucagaugauuccauaugcauauuaauguuugauaagcacuggccuacaugacaauuggguaagaaauaauuaagcaggaauguuuacugguagcacagaagcauccuggccuccuuuuucucugcccaaugaggguuaucuguuuuucuuaauaaaaggaguuuaaaaacccauuauuuuuggcauagaccaaucauaaacaaaagggcagaaaacagaggcagauggucagacaacacacugcucagguuaggaaaccaagcagcaauauuaagcaaacagggaaaaacauuaagggaaaaauauguaaaauaaggaucagcacuucugagaguauaaaggaaaagaugaaaagcuguccuugcaauacaauagauggacuuugaacaugagcagugacuuacagcguucccaaaaaacaauaaggaaccuccucguauaagaacgcuuucucaaaguucaggcacacacggagacgugaacaagaggacaagcucacaccugagcaaacuccauucucuuagccacaccaucaaaagauuuccaccacucuucagugaggaggaacuaguuuauauuagaaaggcaacaguuuguuguagguaacaugcuuacauguuaaaguguaacgaauccuuccaugcuucuaauucguagggaggauucugucauucccagaagauccacuuguuguucauaaaaugcugcauuacgcugucuggauuucuuuauagacggauagcuagacagaguuugaccucuauguggcuuuuccaauaaaaguccuagaacacaagguaggcaggaacagguaaguggcacugauaaagagugcugcucugucacgauugauuuauguugggcuguggccuguuuaaguucauuuaagggcagcaagaaaagagggagcuguggugaggccaugacacagccugcccugauagaacagaaccccuaagggaaaauguguuagcagccacuaagaggagaggcaggggcaagcacauuccacccucauugcaacaauaaaaucugaacagaacacauggcgugccuaucugaggacucugaaaaguaaaugguagcagauggauuaagaaagaagaccagaacucaaacugucagugaaucaacagugaguguucccuuucugcuccguagccccuagccuggguuugcgguagcccaaaauucagaagugagcaccagguguggauagaaagggugccaucuuguucuggcucaaggugcagguaaugcugagugagugugggggaaaucccaucuuuccgucuuuucuuucucuucuucauucuuucacacuccaccccaggcaauccuguggcacccacagcaguggcagugacagcagcagugguggggucccacagagaaccguuccacucugauuggaggagcucuggugucaaggggauggggaacccccauuccuuucuuuucccucucucuuuguucucguacuacuuggcccaaauguggccacguucauaggaagcaugcagcccagcaggguaaacagagcacuggcuuccuggccagaggauauuaaagaggagccacagagaacugaaagguacuagcgagaacccaaaaagggaauaacucaggaaaguggccacauacaguuguuuauaaacuccugggcucaauccuguacuggguaugugucgaucugauccuaaacagcacaccaaaggcuaugaggaaugacuuuggcaaaaacaggagaaagaucugaguagcuacaaaggcuugaacaacagaauugacauugaacuacaacccacagaaggcuggcaaaauguuccaccugaauccaccuagguugaauugcuuguuaaaacauuaauaucaauagucacaaaguacauaaacaaaaccaauagucucauaacauaacagccaggauacaaugcaaaguuacucggcacguuaguuuucuauugcugaaacaaaugaccacaaacuuaguggucguuuacguuuuaagccaguuaguggcuucaaacaacacagcguuuuaaauguuaaaguucugcuggucgaaaguccaaaaucagucucacuggacuaaguucaggugucagcagggcagguucccucuggaggcacucagggagaaucugucccuucccuuuucugcuucuaggggcugcccacauuccuuggcuuauggaccccuuucuucgucuucaaagucagcaauguaacaucucucugaucuuucuucugcugucacaacccuuucuaaacacagccaggaaauguuuucugcguuuaaggaugcuugugauuauauuuggccuaccuggauaauccaguauacucuccucuccucaaggucgguagacaagcaaccauaauugcauuugcaaccuuaaugcguugcaaccugaaauccuuuaugucauguaacauagcauauucacagguuugaggaaguaagacauggacaucuuugaugagacuuuauucugccuacagcccucaaaauaaaaugaaccaucaaaucucaacccacaugaaaaaagacaaccaacagaugccaaugcugaggugaugcagaugugggaauuuucugacagacuuuaaaggggcuauuauaaaaaaaaucuaagaaguaaggaagaggacucuugagauuaauggaaagauagaaagucucaguagagaagcagaagguauaaagaagauccaaauguacauuuuagaacuaaaaacauaaaaccuaaaauuuuuaaacuuacuagauuaaccaguagaaauuauccaauauaaacaacaaagaaaaauagaauugggggaaaaaaaaugaacaaauccucagggaccagugagugaaucaauaucaaaaucucgaacaguugugucauuagggucccagagcagaggaaaaauacuggaaaaaucauggcuaaaaacuucccaaaucuggcaaaagacauaaaccuauggauucaagaagcucagugagcuacaaacaggauaaacccaaaaaauuaugcccagucaugcuguaauccaaaugcuagaaacuaggaugaacaaaacuuuggaaaguagccagaaaguugacauacuacuuauaggagaauaauucaaauaucuguagauugcucaucagaaaucaaaaauacgcaaauauagacaaauugaaaaucuuugcccaucaaaucagcaauuuaaaauucuuacuaucuggugucaggauaugagaauguugcugggaagacaaaucagaacauuugugaagggcaauuagucauuaccuaucaaaauuuuauuuuauuauuauuauuuugagacagagucuugcucuaucacccaggcuagagugcaauggugcaaucucagcucacugcaaccuccgccucccggguuaaagcgauucuccugccucagccuccuggauagcuggaauuacaggcauccgccaccaugcccagauaauuuuuguauuuuuaguagagaugggguuuugccauguuggccaggcuggucuugaacuccugaccucacgugaucugcccaccuuguaucuaucaaaauuuuaaaucuacacaccucucacccucaauuccacuuuuaggaauuuauccuaaagaaauauuuguacaugugcucaaagaugcuugacugugcauuguguauaauggcaaauaaauauauuaauuaguaaaacauuaugaauuauuacagguaagguaauauauaaauaaauuauggagcaccacaguaugagauauaauguaccuuuaaaacaauuacauuggagucaagucuacuggcaugggaaggaguuaugauauauuguuaaaugaaaaaaaauugucaaacagcacacccacacgucaaauuuuauaauugugugugugugugugauuauaauugauggggaaaagaucuggaaggauaaaacccaaaguaauagagcaguugcuucugaguagucagaccagaagagaagaaagguacuugcucuuucuaucuuauauaucuguguguguauuuuuuacaaagaacaguauuauuuuugacacuuuugaaaaaugguaaaagaccuaucuauguaaguuugauaacauuguccuucaguguucugaguuuagaaauucacuagucuuucacuguuuucugggaccuuagcauuuuauucacuucccuuuaggaaauccaaccaucucauucagcaucuccuaguauauaugauauuuuacuguguaaccaauuaucucaggauuuaccagccacaacaauagaaauauauuaucucaugucauuucugggggucaggacaccaagagugacuuaguggggugcucgggucaggguuucuuaugagguucagucaaaauguuggccgaggcugcagucaucugaaggcuggaccagauuggaagauccaccaccaaguuccucacacagcuguuagcaugaggccucuguuucuugcuggcuaguggucagaggccuuagcuccucacuacaugggccucucuccagaaugcucauaaggcagcugccuuccuuuagagugacuggucaaaaaaagagguagagcaaucaagauggaagcugcgaugauuucuaucaccuaaucuuggaaaugacauaccaucacuucugcuauggucuauuggucacacaggcuggccuuaguaaagugcaggaggggacuacacaagagugugaauaccagaagacagggaucauugagggccauuucaaagaugcuacaacuaaauuuuucuccacucucuuucucuucucccuuuugaaguucgcagauguucuaaaaacaacucuauccauacaguaucacugauucguuuagggguccuagagcauucaaucuuucaucaaaagaaaaccuuauggacuaauaaggaacuccaguuuguguagcuccaaccuuucuccaugaacaaggguauuuugauuuuccuauagugugaugauggaggguagggaaaaguacaaguguaaauaauugaccaaagagaaaaacauagggaauaaccaggugccucaaugagaaucccuucaauagggggucacgucauucacaccuacccugcagccccaccuuuaauccucacaagucaggacaggcaucucuucuccuaaguggaauuucccauaagccaugcagacaaaguagaaaugcuugccagcucacacaucaacaauaaaggcuacuagaaucaucuguuacuuagaaaauguuagaaggcaacaaauaaaaacugaggguuaaaggauaccuaugccucugcacuaaaacaauaugaaguacucaaagguaggguauaacugagcauuuggaagaaacuauccugacaugugaaugcaccugauugcaaaagauaugugucaucuaacugggaguauaacacaguguuauacuguauaccuuagguucagccaagcauuugauuaaggcuuucauaauaugccuguagguauguuggagaaauacaaguaagagucgauucaucauagguugagcaaucuaugcaaagaguguugauugacucauuguugucagcuugaaagagauaauauaccucagggcuuugaauuuggccuuguuucauugaaaauuuuuauaaacuauuuggacaaagacaaagaaaaugcacucauuagauuuucaaguauuauauagucaggaaaguaaagaagcugaacaauaaaaucagaaucccuccaaaggucuccaacaggcugaaauuauaggucagaaccccugaaaaugaguaagaagcagcauaaaauccuguacaaaaugggagagaccuaguugaugcagaaaagcuugaaguuaaccaaaaauuuaauaugucagcaguucgccaagccugccaaaaaggcaaugcaaaacuuuagucugcguugugaugaauauagugcuuagaaucagggauaucuaguugugaugaaccccacacuaaauauguggcuuccuagaaugacugagagguuccucuaugaccauauguaccuucuaacaccaagauucuaccauccucugcuuauaacaguccucuuugugaccaaucuaguaauuuuaucaaaaaaaaaugaguuuguuuuauuauuuuuguaugcauucaagcaauauuuaucaggaaaaaaaagugagccaguuacuauucuggaaucuagggacacaaagaugacugggacacagacccugaggguuagagucuggggaauaaggacgcuauggucugaaugaguuccccgaaauucauguuaaacccccaaugcaauaguauuaagagauagggccuucaggaggugauuagguugugagagcuccacccucacaaaugggaucagugcccaucuaaaagaggccuaagggagcucacucaucccuucugccauguaaagacucagggagaaggugccaucuauaaagcagagagcaggcacucgccagacaccgaaucuacuggugucuugacucggacuucccagcuuccggaacuaugcaaauaaauuucuguuguuuauaaauuauccagucuaaaauagccuguuauagcagucugaaugggcuaagacaagaaguauagaggaugugguaggcagaauucucagauggccuuucaagauucucagccuugguguacauauauuuucucccacuuauucagccaaacacaaauauuagugcugcugugaauaauuuugucaauggaaugggguuccagguuaguugaccuugaaauaaggagauuaucuggauggaccuaaccuuaucacaugaacucuuuaaaagcagaguuuucuggcaacaguugagaaagucagagguucauagcaugagaaggauucaaugcaucauugcuggcuugaagauggagggagccaugggguaaggaaugcaggcacugcaggagcugagaguggccccaguugauagcuuacaaggaaacagagaccucaguccuaucaccacaagaaauaaauucugccaauaacaagaaugagccugggccaggugugauggcucacaccuguaaucccagcacuuugggaggcugacgcagcauaacugcuugaucccaaaguuugagaccagccuagaccucaucucuaaaagacaaaaaaaaaaaaaaaaagaaauuagcuggguguaguggcacaucccuguggucccagcuacucgggaggcugaggugggaggaucacuugagcccaggaggucaaggcugcagugaaccaugaccacacuacugcacuccagccugggugacagagugagaucuugacucaaaaaauaaaagaaugagcauguaagaagaccacaagccucagaugagaacugcauccccagccaacaccuugauuucagucuagcaagaugcuagcagagcauccagccacacuaugcccagacuucuaaccuacagaaauugugggauaguaacucuguguuguuucacagcaugaaguuuguggcaauuuauuacacaguaguagaaagcuaauaaaagggaugaauaagcaguggccauacaaggagauaaauggcuacgauggagcaaaguugcaguguacauuguugguugauguuucagaaucuagugccacucuccuaggcaaguuucgauuuugcucagguagcugcuccucacucauauauucauggccacgagcuguacucccauaugagugcaggacuaauuaguccaaaacagggcuucucagcuuuggcacuauugauauuuugaccuggauaauucuuuguuguggagggauguccuguacagugcacuguaggaugcuuagaaguguccccggccccuauccucuagagcuagugacauaccuuuucucuguuccccugcugugaaaaacaaacugucuccagauauugccaaauauaccagguucggggcaaauagaggcaggaagcaaaaacaucccccguugggaaccauugauccaaagguaacucauuaccuugcugaugauugguucaggaauagguaugugaucacuuugggaaauagagcugucaaaagagguuucacugggauuucugagaaaaccuuccuuacucuucaggguaugcuacuggaagucacccuguuucucuuucuccagauguucugaugcacagauuucaguccuagcacugcugcagccaugucaaacccagcuugaggguggagccaauacacaaaagaguacacagccaagaguauugcagggaccugggccucuggccccuggcugaagccaauccugaagucuacucuaccuauagacuucugguuauaggagccuauuaauuuccuuauuguucaagauaguuuaagggauagcugguuuuggcauaccacagcagcuaauuggcaccacucuguaaaggugcuagggaagcccagagaaagacacaccucaugaagcugagucaagaaauaaaaaaggacagaagauagguccggaagucuacagucgacaggcugcuuucccaugacaccuugaauccuaacacuagccuggaaaaauggacuauuauccucauuguaugucucagaagaguucaugguuuguccauggucacaaggcaaggaagagucaagauugaaacccaggccuuccagugccacaucgcaugauuucccccauauucuccugaaccaggacuucuuuucugucauccuuuugcucaaaaauauuuaacauacgcccuugucucuggagcauguucaaacuuucuagcugaggauuugaaguuuuccgcaaagccgcucuacuccaaaagauuuaagcucaucauuccagcucauuccuccaauuggaccuucgcuuagacuucccuuaucuguacuuucuugccauuucuucuccauguguuugaguucauucuuuaauaaaguucaaauugauuccugagcuuaugcaaaauugcccuaguucuuggugagguuucuuccucuuaacuccuagaguauaaaacuaagcacauguuacccagauggccucagguuucaccagauggagcccuaauaguagucacuauauuuagaacguuuacgacuuugguucccaccuuacuuuguagaccccaucaccaucaacuucuacuaagcccuccucacugagggccuccucuugggauacuuugcccccauccauguaccccccucucacugugagaaugccagggcgugaugcccugagccuucaaccuuccaguugcagaguggacagauguggucauccaugcagaaaaaaaaggacauuucuccuaguccaggucacuuuugggcaccuggaggcugaagcagcuuugcuucugcucagcuccuuuauccucauccaaaagacagagcuucuuccauuuccaccuguugcccuuccugauguggcuuaguuggaauggacacagacccccaugcugcuaccaaucucucuucuuuguuuauuuccagaaaugguaucagccaccaggucuugacugcuuucucugggccaggaauuauguuaagcaccuuacaagucacuuuauuuaaucuguuuauuuaacagccaaaguaagugcccuuauuauacccaguuuacaaagaggucucuuauaaauaaagguuuagguaacuugcccaagguucacugaagaauccagauuccacaaaaguccuugcucaaucaacacagcaccaaagucacaaguuucuacccugucuuggccagucaaaauggaaagcccuuuaaaaaugagcucaugcacaucagcagcucuagcacccacucaccuguucugcagaugcacgcagacaugcuacacaugauaucauaaauaaucauuaacauguauugagugcuuacuaugugccaggcacuauucuaagcauuuugcauuauuaaugcauuuccucuucaaaauaacccuguuagguaaguacuaucauuauccccacacugcaguuaagaggcagagcugagaugaggaugaaagaaaccuggugccugagcacacacucuuaccacucuguuacagauuauugggcauccucuaugucccagauaccagccugggucaucugcauacauuuucucuaaucuuuacaauauuccuauaagaaaguuauguccccaauuuuacagccaaggaaccugaaugucacagagagucaaucaacuugcccaagaucuugguuaguaaauguaauguccagauuucaccaggucaaugcugucuuguaaaguuauuugccuuuucauacacauguuuuuuuccauagcaugaaccaggcucccaacuuuauccucccaggaccucucugagagcuguagcccaggucuguguucugggcauggguaggaggaggagggagagaaaaaaaggugguggcugccagcugcugcuucaaacaaaauauaucuacauauacaaaggcaccggggcugguugccuagcaacaucuuucugccuccccaaccugcuucacuccauccuuacccaacacauuaugcacaccccuuggccugcaaugcccuucugagacaucccccuucauggcugccuuuguucaucuuaaccugauuugcuaggcaaaggcuuguagcuugcagcuugcagggaguccaggaagcacacgauuuguaucacagauggcccugggacaggcaaaacagagcuauccacccugcauagcccauaccuuggcacucacaggguaucuaaugcugcaggaaggagggggucucauuucaggagcuuugucauaucgcuaaagguuuaaaaaaagaguuuuguuuuucacauaugucagguccuuuaaauaguucuuuaaaauaaaaguuugauugggauagaauuaaagcaggcugucuggauuucuuuuuucaucuuaucucccauguuggaaguuagagccucuuaaauuuaaaguuaucuucaguucaaccaguccaaaaggccuuagggauauauuuguccuggaaucuuaaagagaggcagaacaaggcagaauacacaguucucuuaguucuucaagcauaacugaaaggguacaacaguaguggagcccccaacccaguccagagcuucugacuucauggcgagaaggugaugcugaacugagagccagggcuacauuaucgcuuucauggacccuaggcaauuuugccuucaugggcccauuccuccauaaaaagaaagaaaaaauauuaaaaauuauuuuuuaugacugugcugguauaaagacaacuauaauccagacuguauucauuuauauauauauuuauuauuuucauuauguaauauucauuuuuccugauuuuaaaaaaaacaaagaaacuaaaauauauuuaugcacccuugagaguauuguagguccaagccuacugugcccaguggauaagauggcccugcugaggguaugucagcacacagcaaauguuauucagacauuggugcucagccaaugcucagaacugugggguaaggaaugcuguggcuuaaggaaagcacaaugcucugugcccagaauugugggguaagaaaaaaaguaagguguggcaccuguacucaaaggcuucgagccuaacugcagaaaaaaacaaagcagaaaccuacaaucacugagccacaaaaacucggcuuggcaaccacuaaggaaaucauugaaacccuuuucuugcuuaguuguauuaucaccugaacaaauaauacauguuuaaaacaccacauacugagaaagggccaaagagguaagagaugacgcuggcaaguguagugauggauuggauauugagguuaaaaaagagucaagaaagauuucugaguuugggccugggugaucaucuacauagacagaaaauaaagaaagaggaauaaguuggaggaggagacaaugggcccaguguuaggcagauucguuugaaaugccucuggggaguaaaaggcagagaccaagacugcuuuacuccccacuaaagucucaucuccuaguauaaaaccugacacuucuucuguauuaaauaaauauuuguggaauuaauuagauacaaguagauaagucuagugauugauuaguuguuuuuaugggccuaauacccagaacaaagaccugggguguuguggcagaugcuggcggcugacauucacucucuauuccaagucugcuuaugugaacaacugcaacucccugccuuguccuggccucaggaauagauuuggauuaaguacaggacaagcuggaaucuccagagacuuaaugccuagaagcaaccucaaacagugauugacagggaguuaaccuauaaauaacccaucuccugcgaaaauaacucugaggcacagucuaugcaaucuucuagaauucuccagugagauuaaguuucuagagcccuaacugaggcuggaaauauccuggccacaccugcuuugagugagagguuucuuuggaugaaagggcuguguagccagcagcagaacugugugcauguggaaagcaaaggcugauauuccuaacagaugaucauccacuucuacgugaugauauauuugcucauguaaagagagcuuucuauuaaucucuaauuuuauuccauguggcuggagaacauacuuuguauaaucucaguucuuuuaaauuuauuauggcuuguuuuaugguucagcauuuagucuaucguagagaauauuucaugugcucuugagaagaauguguauucuguguauuuugcacuuguuuggugcagcaaucucuuacauuuaguugguuuauaauguuaaagucauacguaucuuguuuauugucugccuagcuguucuaucuauuacugaaagugaaguauuaaaguuuccagcuauuucuguuugauugccuauuucucuuuucaauucuguugguuuuugcuuuauauauuuuggggcucuguuguuaugcgcauacauuauuaugauuguuauguuuuccugauggauugacucauuuuuauuauaaaauguccuucuguaaucacaaaggaaauuagaaaauagagacaaaugacaaugaaaacauacuauaccaaaacuuacacaacacugcaaaaguagugcuauugauagcuauaaaugcuuacaauaaaaugagccagguaugguauaguggcacacaccuuuaguccuaguuacuugggagacuaaggcaggacaguugcuugaggccagaaauuuggggcugcagugagcucuaauugcaccauugcacagcagccuggucaaaagaaugugauucuguugaagaaaggaaauaaagagaaagaaagaaagaaagaaggaaggaaggaaagaaggaagaaaggaaggggaagggaaggagggaggaaggagggaaggaaggaaggaaggggaagggaaggaaggaaggaagggaggaaagaagaaagaaagagaaagaaagagagaaagaaggaagagauugagagagggagggaagaaggaaggaaggaaggaaggaaggaaggaauucaaaucaauaaccuaacuuuacaacuuaaggagcuuaaaaaaaaaaaggaauaaacuaaaccccaaagcuaguagaaggaaauaauaaauauuagaacagagauuaauaaaauagagaauaaaaaacagagaaaauuaacaaaaacaaaaguugguuuuugaaaagauuaacaaaauugacaaaccagauagaccaagaaaaaagaaagaagauucaaauuucuaaaaucagaaauaaaaauggagacauuacuaccaauucuauagaaaugaaaaggauuauaagagaaaauuauaaauaauuguaugccaacaaauuggacaaccuagauaaaaugaauucuuagaaacacaaaaccuacuccauccauuuguauuguauaauaaaauacuugagacuggguaauuuauaaauaacagaaauuuauuuucucacaguauuagaggcuggaaaaucuaucauggcucuggcagguucagugucuggugagggcccuggucuuugcuuucaaguuggcaccuugaaugcugugucuucacauggcagaagacuagaagagcaaaaggguaugagaauggugaacuugcuuccucaaucccuucuauaaggcacugaccccauccaugaagacagggcccucauggccuaaucaccucuuaaaggccccaccucuugguacuguacccuuguggauuaaguuucaacacgaauuuugguagagacacaaacauucaaagcauagcacccaaaaacuguacuuucaggaaucauuucuauaguuuguuucaaaccacagcaccuaccaaagcuaauucacaaaggaagagaaaaucagaguagaccuauaacuagguauaacuagguaaagagaucgaaucaguaaucaaaaaaucuucugaccaagaaagcccugggccuaaugacuucacuagugaauuauacuacacauuuaaagagaacuaguagcaauucauuucaaacuuuuccgaaaagaaaaaaaaaaaaaacugaagagcagggaacauuuccuagcccauuuuaugaggccagcauuacgcuaauacaaaagccagacaaagaugccacaagaaaagaaaacgaugaaccaauauuccuuaugaacacugaugcaaaaauuuucaacaaaauacuagcaaauuaaauuuaacagacauauuaaaagcauauaauagaucauugccaaguaggauuuauuccuggaaugcaaggaugauucagcauaaacaaucaaucaaugcaauacaccacauuaacauaaugaagugaaaaaaaaaccacaucauuaucucaauugaggcagaaaaugcauuugacaaaauucaacauucuuucaugauaaaaacacugaacaaacuaagcauagaaggaaauuauguccacauaguuaaaaccauacaugagaaaccugcaacaaacaucacacuuaauggugaaagacugaaagcuuuuccucuaagaucagagacaagacaaggaugcucacuuuuggguauaauacuggauguuguaaccagagaaguuaggcaagaaaaagaaauacacauccaaguuggaaaggaagaagucaaauuaucucuguuugcagaugauaugaccuuauauguagaaaacccuuaaaauucaaacaaacuguuagagcuaauaaaugaauucauuuguguuuugcaaaguagcaaaauacaaauucaacacauaaaaauuaguugcauuuuuauacacuaacaauggauaaucugagaaagaaauuauaaaaauaauuucauuuauaauaacaucaaaaagaauaaaauacuuaauaacuaacuuaaccaaaaagacaaaagccuaauacaauaaaaacuacaaaacauuaagaaguuaaaggagacauaaaaaaauggaaacacaucucauguucauggauuaaaagaugucaauaccacccaaagcaauguacaaauucaaugcuauugaaaauuauuaaggugucaauacuacccaaagcaauguacagauucaaugcaauugaaaauuguuaagguaucaauaucacccaaagcaauguacagauugaaugcaaucccugucaaaauaucaaugauguuuuuugcagaaauaggaaaaccccauguaaaaacucauauggcaucucaagggaccaugaauagcugaaacaaucuuaaggaaaaagaacagagcuggaggaaucauacuuucugauuucaaaacuacuacaaagcuacaguaaucaaagcaacgugauauugacacaagacagacauauagaccaaugaaaaaaaauaaagagcccagaaauaaacucuugaauaaaugguuaaauuacuuuugacaaugccaagaccauucaauggggaaaguacagucuuuucaacaaaugcugccagggaaacuggauauccaaauacaaaaaagaaaagaaaagaaaagaaacuggaccauuacuugacaucauaucaaaaaguuaauucaaaguggaucaaagaccuaaauuuaagaccuaaaacuauaaaacucuuagaaaacacaaauggcaaaacuucacaacauuggauuuggcaaugaauucuugaauaugacaccaaaggcacaaauaacagaagaaaaaauagacaaauagaacuucauaaaauuuuuuaaaauuuauacucaaaagagaauaucaacagggugaaaaggaaagccacagaaugggagaaaauauuugcaaauuguguaucugauaaggguuuaauauucagaaaacuccuaaaacucaauaacaacaaaaauaugacaaauauaguaaaaaacucaaccaaaauuaggcaaaggacuuauauaagcauuucauauacaaauggauaauaaucauaugaaaagaugcucaaaucacuaauuaucaggaaaaaguaaaucaaaacuacagugagauaccaccucacauccauuaugaugacuacuauuaaaagaaacaaaaaguaacaaguguugguaaagauauggagaaacuggaaauuaugugcacuauugguaggaauauaaaaugaugauacagcacuguggaaaacaguauggcaguuccacagaaaauuaaaaauagaauuacuauaugauucguuaauuucacuucuggcuauauauccaagagaacugaaagcagggucugaaagagacauucguacauccauguaacagcugauuuacucacaauagcuaaaacguggaagcaacccaaguguccaucgauagaaaaguaaaaugugguauauacauacaaugagauauuuuucaacuuuaaaaaggaaggcaagucugacacaugcuacagcaugaaugaaacuugagguuauuuugcugaguaacucagucacaaaaagacaaauacuuuaugauuucauuuaaaugugauauuuaaaguagucaaaauaguagaaacagaaaguagaaucauguugccaggcgccugugggagagagagaaugaggaguuauuguuuaauagauaugaaguuucaguuuugcaagaugaagaguuuugcaagauggauguuggugacggcugcacaacaaugugaaugugcuuaacaacaccuaaccauucacuuaaaaagcguuaccagccuggauaacacagugagacugugucucuacaaaaagaaaaacccagcuggauguggugguacacaccuguagugucagcuacuugggagucugaagugggaggauugcuucagccugggagauccaggcugcagugagcugugaucuuaccacuguuuuccagccugagcaaccaagaaagacccugucucauuaauuaaagaaaaaaaaauguuuuaaugguuacuaugguaguuuuuuuuuuuuuuuuuuuugacacagaguuucacuuuugucgccuaggcuggagugcaauggcaugaucucggcucacugcuaccucugccucucugguucgagagauuuuccugccucagccucccgaguagcugggauuauaggcaugcaccaccaugcccagcuaauuuuguauuuuuaguagagacaggguuucacuauguuggucaggcuggucucaaacuccugaccucaggugauccgcccuccucggccucccaaagugcugggauuacaggccacuaugcccggccuggccuucgaauauaaaaagucaugauauuuccccuuauccuucuuuccaggugaaccauuccagugaccauuaacuauuucuuugaaugacaugauuuuaaauuuucaucauccuggacuuccuacucuccccgccuuaaagaugaugcaauaguaaucacuguaugacaguaauaaauacuuacugaaugcuugcucugugucaagcaccgugccaaccuuuguacauaaauuguuucauuaauuauuauaacaaacccgugagauagauguuauuaacugcauuauguguagaugaggaaacugaggcauagagugguaaaagaacuugccacgaucuuacagcuaaugaguggcagagccagaauacaaacacaaagagucugguuucggagccuucuuucuuagucaucuccuaaaaaaacacaccuauuccauuaaauucaagaaaaguuuguuuuaauaauuuaauagaaaaaaacacauauuguaugauaccauugugcaaaaucauuucucucucauuaccucucuguuugugccugucaaugugcauuuuaaaaauaucuagaauguccaggugugguggcucaugccuguaaucccagcacuuugggagccugaggcgaguggaucaccagaggucaggagauugacaucagccugggccaacauggugaagccccaucucuacuaaaaauacaaaaauuagcugggcguggugacagacaccuguaaucccagcuacucgggaggcugaggcaggagaauugcuugaaccugggagacagagguugcagugagcugagaucacaccacugcacuccaaccuggguagcagagugagacuugaucuuuaaaaaaaauaauaauaauuuaaaaaauuaaaaagauauauauauauagagagagacacauagauauauagauauuccuuaaauauugauauugaucauggcuauuucuggguaauagaauuuggggcauuuuguuuguuuauauuuccuuuguuuuuuuuguuuguuuucuuugcuuaacuuuuuauguugcuugaguuuuuaugaugaacaugugcuauuuuuuucuaacgucuuuauuaagauauaauuuauauaccauaaaauucacucauuucaaguguaugguucaaugaauuuuaguauauugacagcugugcaacuaucacuacaaucuaacuucagacauuuccaucacccuaaaaagauacuuugcucccauuucaauuacuucccuuuccuaccccagcccuaggcaaacacuugucuacuuucuguguccacauacuuuccuauuuuggacauuugauauaaaugaaauaaugcaacaugcggcauuuugugucuagcuuauuacacugaauagauugcuuuugaaauucacccauauuauaguacauguaucagcacucuguuccuuuuuauugucaaauaguauccuguuguguggauauauacauuauuuauucauucgucaguugaugggcauugaguuguuuccauuuuggggguguuguaaauaaugcugcaaguuuuugugugaacguguuuucauuucuuagauaccuaggaggcuaagauugcugagccauaugguaagucuauguucaauuuuucaagaaccugccaaauuguuuuuccaaaguggcugcaccauuuuacaguuccaccagcaagguauguaucuuuccauugcuucacauuguuggcgacgcuuguuauuacccaucuuucuuauuauguuuauucuacugggugugaagugguauuucauuaagguuuugauuugcauuuccuaauaaccaaugauauugagcaucuuuucaugugcuuauuggucauuuguguaucuuuuucaacauguguuauuuuuauaaccaaaacgauuauuuuugaacagauuuugaugucuacuauuggacuuauaauccagaugacacucgaccagcacagaguacaguuaaaugugguugccugugauuugcucucugcacuuccacugaugcagccgaaauacugagcuaauuuuuuuagcagacacauaccauuggcucaacuuaagccugcagucaacuaaacaccccggauccuuuucucacugacaauuguagagccagaauucucucauucucuauuugggcuauugauuuuauugaauuuaaaugcuggagcuaauauuuaucccugucgaauuuuaucuugucacuuuagguccauauugucaucuguacaaguaauauuuuaucuuaauucugucaucucauuuuaccuaccuugaaacuuccuuuuggaugucaaaauaacuaagaagguggauuuuuaaccauuauauuuuuaguuuucuguuuauuuuauuuuguuuuguuuuauuuuuugagacagaguguuacucugucaccuaggcugaagugcaguggcacaaacacagcucacuucagccacgaccuccugggcccaagcaauccucccgcuucagccucccaaguagcagggacuacagaugcacaccaccauguccagcuaauuuuuauauuuuuuguagagacgggguuucgcuauguugcccaagcuggucuugaacaccugagcucaagugaucugccaaccucugccucccaaagugcuggaauuacaggugugagccaccacacucagccuuguguguuuucugaaucaaaaugaauguauacuuuuccauaagcaacacaaggacucaauuacaaugcaugaguuuguucauggcuaggcacaguggcucaugccuauaauuuuagcacuuugggaaggugaggcagguggauagcuugagcccaggaguuugagacuaaccugggcaacauggcaaaaccccaucucuacaaaauacgcaaaaaauuagcuggguaugguggagcaugccuauaaucccaccuuccugagaggcugaggugggaggaucaccugggccugggagguggagguuguagugagccaauaucauugcuacacuccagccugggcuacagcgugagacucugucucgaaagaaagaaaggaaggaaggaaggaaggaaggaaggaaggaaggaaggaaggaaggaaggaaggaaggaaggaaggaaggaaagacagagagagagagagagggagggagggagggaggaaggaaggaagguuguuaaaaauaagcacgucaagaauaaaacuaaaguagaagacuuauaagacuauauuuucauuuuucauaaucaacauauguaucucuaauacacacaugaaaaguucuuaaaaguaagcacugccacucagcuuugcaucauaguaguagccacuuuuaauagauuucuguuuuaaaagaacaagauugaugagaaaagaaaguauauacaauguuacugaaaaauguagacaugucuauguaggauuuucuauugcauuuugauucuuucuaauuucacucucagugagacauuuauucuggacauucuggacguuauuaaccaucaucuuuauguacuaauuacuuuacccauaacuauucauauuccaacucuuuuuugaaaagccuuuuggauauucccaaaccacucugaccuuuccccuccugggaaguuuccaugcaguacugaaucacucauucucuuagguccacgucauauccuuccuauuuugugcagggccccuuuuuguuuuauuuucuccuuuucacccuacagccucaguucucacuucucucccuucuccagcacccacucuacuguauuuaauguguguccuuccaguccaaauugcaaauguuuguuuagauaaauguauaccauaagaaagucuuuauaugucuuugcuuuuaaauuacauaaauuacauugugcuagaaaucuuacuugauuucuaacuuuaauuccuucaacaucguguuuuugagagauaucuguguguuacaugucgaucuaauuuaauacuucugccugcugcacccuuuucugucaaaugcacacaccaaacaucaucuauguacuucaggauggacccucauccugaaaaacucuuucaugaaccuccuugcaaauuuacuguacuuacuguuuuauaugaggaucagggaaacuguccauagagagaaauuuucuuuucuuuuuuugagacagggucuugcucugucacccaggcuggagcacagcggugugaucuuggcucacugccaccucugccucccagguuuaagcuauucucccaccucagccucccaaguagcugggacuacaggcaugugccaccauguccagcuaguuguuucuauucuaguagugacaguguuucgccauguuggccaggcuggucuccuggccucaagugauccauccaccucaguuuccacuauggacaguuucucugaggcauguacucagaaaggagauugcugagucauaggaucaugcauacaagauuucuauaaaaauugcuauauugcuuucuggaagagcuauaguaauuuaccuucccacaccagcagggcaaagguuuuguuccaacuuauacucaauagcccuugguguugucugauuguguagauuuugccaaucugauggauuugaaguaccaucucaauagugcucuguugugcuguucucugauugaugguuagguugaguaucuaugucuucaggagauuauaaaccacucaggauuccccuucugugaauugccuauccgcaucgucuuuuuuucuaucacuuuuuucuaucuuuauuauugcugaccugcauuaaucucugguacauucuagcuauugauaccuuuaaaguuuuaggcauugcaaagacuucuagaaugucaccagucacuugucacuguuaacuuuguucacgaugcccuucauugaacacaagucuuucauuuuugauuaguguacaauucgucaauuuauuucuugacagcuugagcauaugaggcuuuauuuaauaauuuuucuaccacccaagggcaaacagauauuccccuacauuuucuucuauucacuuuacagguuuccuuucacauuuugaaauuacuccauuuugagcuuuuuuuuuaaaugggucaauauagggauucaacuguauuuuucucccuauaguaauacuuuucucugaaguauuuucuaaauuggccuuuucuuuugcuaugcacuugucaagcuguccccaucauuacuuauuuuucacagaugcacaguuugauuuggggacuuuucauuuuucccuuucgucucuuugcuuauucugcaccuaaacuuuauaacaucaguuacuaugucuuucucaaaucucauuuucuaguaaaaugguucuauucuuuuguucuuuuucaaaauugcuuaguuacucaagagccuuuaugcuuucuuauaaaauuuaaaaucaguuuaccauaauuucagaaauuccuacugugauuuugauuggaauugucaugaaauacauaaaacaaucuggagacaaaugacauaauagcaacaauaaauugcccuagucauuuauuuaggucuuuucuuuuuucuuuuaauagagcaauagagcuaaaauguuuuucucaguaaaaauucauacauucuuuauuacuauaauaccagacacucuuguugcuucaguaaauuauaucuuuauauauaauuuuauaaauucaugcuauauuugauauuuguacccuguggugucuucagggcugcauaugagaagagggagccaacaccugagggauaugcccucuuguuuguaaucauauuuaauaucuauauauucaugcacauauucaacaucuuguuccauugguaacuaguggucccaauaaaacuggaaucuucauuaagaugauuaccugaauacuaaauuucauauuacuuuccuaaagacuuaguucagugcuauauacacauagacaggagacagcuauagccugagagguacacagcugaacugaaaucaaaagacuugagugaaaucuuuucuguaccucugacucugagccaggccauaaucccucugaaucucagcuuccucauuccuaacacaugauuaaugagguugucacaaaaauucaaagagaaaauagauuuaucaugcacagaauuugacauguggaaccaaugcccugcuauuugaaucuaaaggcaagaaaugcuuaaaucagcuacagccaaagaagaguaauggcaggaaagcauuauaacuucaaaaacuguuuuccagugguuaaacauuauuaccaaaguuacuucagucaaagacaucaaagaaaauuuauaaucuugucuccagauaacauguacguucaucaguugcggcugaaaagaaaaguucccaccacccugaagaccaucacuggcccuggacuuccuaaagcagcccaagaaacauuuucucuggaaaucuggucuuuugugugagagugaaagcuacuguggguguugcaauacuuuuccucugcaaagagaugauuuuagcagaaucccaaauagcacaauagaauuaucuguauucauaugcaaauaagcacauuuuaaaauauaguugaaacaaauaggaaucccuuuuauuuccaaucucaucucauguuuccauaauggagauacugggauuaaagaugauuauaaagugaauguagauuugugagaaguaggcuaucaugagaaaugcuggggguguggagcccuugcaaacacuucccaggauccgaaagcagaaaggauagaggaaaggcauuagacuaagccaugagagucauggcaggaagaggauuugaagaaugaagcuugcagcacucuuguugaaagacugaagguaaaugacugggcaccucuucaauagcagcccucacugaccacacuaacaaaaauauuccccacacagccccaccuccucccuaguuacucuaucauaccaccaccaccugcuucaugguucucuuugagcugauaacuauguuguauuaucuugcuuauuuguuuguuuguuuguuuccuuugcuguuauuuauuucuuccacuaggcuggaaacucuggaggaacagggacauggccuaucuuguucaugugccucgaucagugcuaagcacagaauggacauucaauaaaugcuauuugaaugcaaaaagggaguccagaucuaucagaaaugagguaauagcuguuucuugauuuuuuuacaucacacaugggcauuagaggaucuuugugguaggaaguaaaaugagaggauagaaacuuacuauaaggugcuuuuguggaacaaacaacuguucagguaagugccaucucaagcagugcuuugaauugaucugccuguaacccuaggaaaaaaaaaaaggaugaccauacauuggcccugaccugugaaucuacacauuccuggguuuaucuuucagauaauuacuguggaguaauaugagacauagagucuauggcaauggccuugaauaaaugaguaaugcaacaaguuauaaaguucuuaaaagaaagccugaguauaucuccucauucuuuugugcuucucuagccuauuuccuuuacauaugguggcuggaguugugaggggugaauuucuauaaaguaauaaucgauuguucuguuuuuccuuugcucauaccccucucacuuuauuuuuugagggagagaacaaagagaauaggacgggaaaaaugucagacuucuaaugaaauuacaauuaaaaaaaaaagaaagugauaacacuaaaaccauaaggcaaaccagcaggggguguuaaagauaaaauuaccacucagaagucaauggaaauguaguuacaggcaauuauugcauguucucugagucucuuauaagugaauugaccuuuaaaaauaaaauugcucuugauuguuuuuuaaaucucauuuucugugcuucugagauuauuuccaacugauguccauauacuuuuaaaaucuccaaauggauuauuauaaauaauaguuaaucaaaauuucuuagauuauuaaccuucccuuaaauuuaaaaaauauuuauguuguguaucucacaaucaauaaacaaaucauggcagugccauaaagcaggcugucacacagucaugaaauaaucuguuuuaagcacuauuuuaagauacacaggaauguucauuauauaaucuuaaucauuguauaaacagguauaaaaccacacauagagaaugucuuuguguuuucuuguguuuaaaauuauuauggaauuaugagugugauuaugagugaguuuuguuuucauauauaacuauuucucuguaauuucugaguucucuuuaguaaacaugucagacuaaaaaucagaaaaaaaauucauaauaaugcucagauaccuuugaacagaauuuaauuuaucuguaagguauuuguuucuauagguaaagaauagacacuauucuucuuuuuuaaauggaaauacugaggcaucaugaaaugcccugcuucuaaucauauaauucauggcaaagaacuggaaucagaaauagaaaccaaccuccuggauuggcaggauuuauccuccucuuuacuuacauaaaccuggugagaaaugugcagggacagucuuucccuggggccucuggguggcuggcccugcgggacugccuuccucucugcacugggugucucuagaggaggcccagugugugagugagcccaaggcuuuccuuccguggaucggcucucuccaaccuucuacuaagggaagggaggaauccuggaauauagcugcagauuuucaaaacuuuuaaacaauuggaucuaucugguugagauaauuucagauacaaaugcuacugucagcaaagggcaauguuucuauguugcuaaauugcuggaagccuaacuucagaaucacuguguucuugucucccugaacaaugcuugagaacagggacuaugccuauuuuuuuccaaagacuccuaaaccaguccccaguacagagacauuaugcucaucaugaaaucuuuguaaauauguauuaacucacuggucauuagccuucgaacauugcacccaggggcacuaguucaugugcugguggacagcacgugccacaugcccugucucaccaccauaugagauggcgcguucaucaaaugugggaucucugaauuuccaucuggagaaucaguaaaucuuuucacuuacuuucaaguggcucuuuuaauuuuuuaaagugccaaaugacaacuaugucuuucuuuugguccuggcucuuaauaaacaacaacaaaaaaauugguuauuuguccccacccauagagauuuggcuuuaacuggucccaaaugaugugcaggcauugguauuugaaaaaauauuuuuugacgauccuaaggcucagccaggguugagaacuacugauuuaaacugugaaucuuugugaaucuuugccucuaugacauauuuaguaucugugauuuaucugaugccaagucuuuggucaagaaugcaacauccaauuauaacacagaucccacggguaagaccaguuuuaggauuuuccaugugguuuccagaaauguacugcaguauuguuggauauuuuauacuuggccgaugcuccaauacccucaaaaaaaguaccuaggagagaccuguuuccuugauguuuguagagauugugggagugcccaagaaaaaaucacaauaugggucuccuacaaaagccuaaucuuuuauuaucagugagacaugguaagaagaguagccugaacaaggaaaaugaaguuacccaaggaaucucugaugccuauguugaaagaggggaguugugcugcuaagacaacagccccugucccuaggguacugggacuccaggucccuccagcuucccugcaucccuauccagcaaggggaccuagaaucaguacuuuccccaccacugcucuauuccaaagcacgaggaaucugauuuuuuugaacucuaagcaaagauucagaugugagaagauggagucuuaccugauuaaagccaggagaagagacuauucuacauaaaggcagagauguggauagauggaugccauggcaucagugagagaagcaagagugggccaaggaaccaagagaguugagauaauguccauuuggcaagaaggaggagaaugaagagacaauaacgucucagaggcuuaaaauguuagugauucaagaucgauauuggaagagucuuauuggacagaaauuaguuuugaggaggaaguucaugaacuuaaaugccugaggacaggauauuguggauaaaauaauauuauggcaccuuuucaaauuuaggcaaguggucauuuauuggauuaagaaaggagaucaugaggcugagugagccugcugggaguugguccaggcuacgugaggcugcguuagccucacuccccauccccaguaucugcucaggccugcuccaccugcacaccaggcccaggcccccaagcagcugcccucccuguccucaucagaauuuuucuguaggauccuccuguucuccuuagcuucuacgggagccaagauggccauggaguggagcugagcaacaucacccagcagccugaggagccccugugcaggugugaugcaggguccaggggacugucauuggaaggagaaguggcuucccaggaaagaagcugagggagcuaauccugagccugggaacccuguaaaaaaauuuuaauuuaaccuuaccuugacaagaccgggcacgguggcucacaccuguaaucccagcacuuugggaagccgaggcgggcagaucacuugaggccacgaguuugagaccagccuggccaacauggcaaaaccccaucucuacuaaaaauacaaacauuagcuaggugugguggcacaugccuguaaucccagcuacucgggaggcugaggcacaagccgagaucaggccauugcacuccagccugggugauagggcaagacucugucucaaaaaaaauaauaauaauaaaauaauaauaauaacaauaauuuuaccgugacucaauuuuguuaaaaggaagaugcuuccguggauucucucaacuugaaaacaguuugugugugucugucuguguguguguguuugugugacacauaaguacacagggcaucauggaaaauucuguuuuaaaggagcuggucuuuuaaauuacauguuuuggauaagccucauuuuuuuuguuuagaagcaaaauauuucugcucucagaauugauucuuuucuaguggccccuaacgcuaaggaaacagcauggugcaguggaaagagaaggggcuggggaucucacuuugacauuaagcagcagcucugugacccuggagaaagcacauguacccacucagcaucaaucccacccuguaaaagaggaggggaaauuucuggcauagaauucucauuccauaagcucagugcuguuuguaaaacccaaccuacuugugaacaagagcucuauccuaugcauaucuacccucucaauucacgaauccaauguugccugagcaaagcucccacuugcgcucaauucuguugcagacauuucagacacaugggaaauggacucagaggacuugcucaagaccacccaaguucauagcaguucuguuuuaugcuauaucuuguccuagccaacccuuucucuugacaucagcucugucugugcacauagauggacagcaucauuggcccagaccgcucuggcuggggaggugcauauuugacuuaauaaaugagagucugaggugggggaacaggacggcacuuccacaaaccguucaugcugcaugauuaugccuccccuggaggaacaggaguaaacuggcaaugaagaaagcagcagagaaggguaggauuuggcauccaaaccugagguagauccuugacaucucucccaggcugcccacuccucucuccacuauuggaggagcuggaaacucucagccuccugaguccucuaggagagcaaggugauuuaagucacacauauuucugugacaugaauguccaaacaggaagccaaagggaacuggcuuugcaguuuuuuuaaggcagcauguggcuaggaauggacaugaccaaucauuacugcuauaauuugacaugucuccagccuaagaaaucuaccaugcauugagguaaccugauauaaaaccgcuuucacuauuuugaaauuaagguuucuccacugcucauggaaugugagccuguguuuagaagucaaugcagggccuuagcugacacuuccauaccugccaagagccgcugaugugaaccagguggccugcuucaagcagaauucaauuacccagauggcaacuguuucuuaauucaaaacuuuaacagcguuuuuuuuuccauuaugaaaaaugagaggggaaaaagaauacauugagcuugagcacuucugguuuaugagauuagaggcaggggagggaacugggucccuggccucugccagcucccugcagcuccagccugcagcacuguaucugccugacucggcugcuuauuccuggagcaggagugacgguccugaaacucagccuccucuuggguuuguucuuaggaagcuagaauaacucucucucacuaauuagugauugcauuagcagaugguaucuuuuuuuuuuuuuuaaguaaaaaggaaaaagaagaaaagguuuuaaagguuuuaaauugcauuuagagacaaugcuuucuuucuccugaggaagcccgugcagucuagauccuggauauucaggcuucuuauucugaaggugaaaaucaaucagcugggcuacggcucugacguuuuaguggacuuauuuuccugguccucgccugaaguuugguaauaaccagaccaguucagacagguggagugcugacugaccucuaccacccaacugggugcacuuggcuggcugugucucaguagacugguucuuuguuggauaaaggagauugacgugggaaaaggugagccagcauaaaguaaauucuguucucauucucuccuccuguagacaaauuuuguagcugccuucauucuuccuuggaccuuauaucucccaggcuaaguaggaauuuggaaucaagacgagauaauugcuuacccucuuugaacaguuacuacauggcaggcaauguucuagugcuuuaaguauaucaugucaauuguuucucauagcagcccacugguagaguuacuaaguuagauaguuuuucuagauaaaaagcuucaugcuuacauacauuguuugaagaagguauuugguuagaauccugucaugugaucagcuauuuuggguccaccaccuccaucaccaccaucccauuaccuccuaccaucacuuucauuaccaccaccaccaucucugucuccacuguuaacucuuaacacuguguccaugaccagacgucaaauguuaacagggacuugucaaaaaagcaaaaagcugagauguguuaggcagggacaucuuuaacuugagcuauuuggacaacuuuuuuuuuuuuuuuuuuuuuuuuuuuuuugagguaggucccacuauaucacucaggcuggucuugaaucauuggucucaagugacccucucaccucaguauuuggacaauugaagcuaaauuuuucauuaacuugguuucuuccuucuuuucuuuaucuucuauaauuucggucuucaaaugugagauugcuuaccaggcagcuuaacauuucuuuagucaguggaguugcaucaagcacuggacucugagagaacuggaaaccaacaaaguccuuggccuauuuggaauucaccuuagcaaaaaacacuaggaaaucagauaaaaugccugagccauccccgcaaauugaacuaucuucugagggcuagggaguuguauguugaccaauuguuaaaauuauguccuaauuccaguuuuucaucauauccagcaauucaaaagcuucuguucaagagaaguaguagauaauagggaugguaaugggaguuaaggcaugcugccugugugugcacaagaaaaggaagaaaauaaaauuagcauacuaugacaaaaauauacaaggagauauagguaucuugagauucugaauucaauaaugugaucagagaagcuuucauaaaugugcuggcuaugaaggcauaucuacuggagaaaucuuuccaaagcacaaaucugaucaugcccugccccugcuuagaaccccacagugucucccuauggcccauaggauaaaguccaagcccuuugauggcauccaaguccuccacaaucuggacucugcucaccucuccaagcuuacuuccugccgccauuccucucacaaccuaggcucucgccauuuuaaucuucuggccaguccuccaacacucaguuuguuucuguccugaagaccuuacccaugugcuacuuuugcuugcauccuccugguccugccuaacaugcugccauuccgugaacuccuaaccaucuuucacaaucccagccagggaagccuuucccacucugcagacagagcuggccacuuccuccuucaugcccccaugaaggccugcauauaugcagcaccucucacuguguuacuaauaucucuuugcaugucuuuuuuuuaugccagauggugagcuauuugaggguagagaaugugucuuaguuaucuuuauacaacagcaacaagcacugugcuaggcucagaguagauauucaauaauguuuauucugauuuuuugcaugaacuaguucuuacuucuguuaaauacuauacacuaccagaguuaaggauuggaguaugcucuuuauaagagggggaaaaaagggggaacccuucuuaggggcuuauuuguaagaguccacauguagaggucaccaucgccaaaauggaagccuccagaguaaaacauaagcuguuaaaaaugaauugagcugguuacuauuuuugcaccugaccuacuuuuugguuacuucugcuguugcaaaaacuuccauucuuauaaaugaaccaaaccacuuuuugaugguuuuguauucucuccucuuaagguagcuuuuuacugaaacaaaaaucugcacagucucugaaacccagcuuuaaugcaaaggcaucuauggaagaguauuauucccaguaggaccaacuuccaaagaacucucucaauuguuuuuccauggaagaguuuaaggccaagaauagcaaaucuauccaccacgaugauggcacuuauuuccuuagugcuugugguugugcccccuggagagcaggaaggguuagaugccaguuaccucccgccaccucuucccagcuuugggcuugcccuuucugagcuguaaggcugccugaagcugugucucugcugguuggaugaagaugggacucuggcaguggaauauuuuucaguccagaucccuucuuuguuaccauuugauuuucuuuuuuuuuuuuuuuuuuuuuuguugcaaugccucgguaguuguugauuugcagaaaacaauuggugaguuuuuaaauguaggauauuguaacaucacauaguguugugaacuaggguaaggggaguagaacuguauuggcagagagugcuaaaggagaaggcagaauccuggcucaggaucugguauaaaacacacaggaaacaacuaaagaauccuuuauuacugcuuuauuuacgaagaccgcuauuaauaacagcaaauuauuuaaagggcagcuggguuaaaaggaugcugaguaaaacaccaaggacuugauucuguugugguuggugauaaccuacaauaguuaccaaguaaaugcagacucuuucaaauuucccaguuucccagaggcacaaccugaagucuucaaccaccacuaacaggagaaaauauguuuaaaagaauacuaaggagcuuucaaaaggauuaagaaauggcucgggggccgggcgcgguggcucacaccugcaaucccagcacuuugggaggcagaggcgggcaggucacgaggucagcagaucgagaccauccuggcuaacacggugaaacccagucucuacuaaaaauacaaaaaauuagccaggugugguggcaggcgccuguagucccagcuacuaaggaagcugaggcaggagaaucgcuugaaccaggaggcggaguuugcagugagccgagaucgcgccacugcacuccauucuggggcgauagagcgagacuccgucucaaaacaaagaaaaaaaaaaagaaagaaagaaauggcucggcugcgcuccauucuggggcgauagagcgagacuccgucucaaaacaaagaaaaaaaaaaagaaagaaagaaauggcucggcgugguggcucacaccuguaaucccagcacuuugggaggcugaggcaggcagaucacuugaugucaggaauucgagaacagccuggccaacauagugaaacccugucucuacuaaaaauacaaaaauuagccuggcacgguggugcgugccuguaauccaagcuacucaggaggcugagguacaagaauuccuugaacccgagaggcagagguuguagcgagccgagauuacaccaccgcacuucagccuggacaaaagaguaagacuccaucucaaaaaaaacaaaccaaaaaaaagguaagaauggagagucugggaggaaaaguuauaggagucagaauuauuugcugacagauuuugauagucagcaaugcacccagaacugugcuuuuaaagacaggugauaugucugcugcugaacagaagaaaaggaaauagauuugcaauggaggcacagagauuugcaauggaggcacagauaauggcuagggggaacuuugaaugaugaagacaguugacuuuaaagcagcaagaguggcuuucuggguaacguggaaaauucuggauaaugugggaaauagguaaaggauaaagaugcaugcuuaugacuguuuccaugcuaacucgggagcacacaaagccaaagaaaauucuguccuuccagaucucuagcucauagauccccaaaauuuuuguguccuauggaaaaugcuaaguuggugugggcuccaacucauauuuuaaagccuuuaauugcaaugauguguuuauucaauucagcaaauacucaaagugcuagcguucuuggcucaaaaaacugacuugcaucauauuuuucauacaucugcugacucuauucacaaugacuggagcaaccauccacaguugugaucaaauucuccucgaagcuauccauacuuggcagccuuaaggucuauaaaugcugagucuccaggccaaucaguuuaacugugccccaaguuagaagcuugaaaagaguugauaggauaagcagcagacagaauagagagccuuugcuuucuucacccucucuucuagaauccaaauuuguccccugcacuggaguuagaaaagcuaccugaaagucuugccacuauucuuggaauauucaauaccaauuacucccugggccucaguuucuucaucauaaaaugagggagcuugauguuucaucuauaagguuucauuucauucagaagccacucuuccaagggaagaaaagaaggcuuuuucuuaaaaaaaaaaaaaaaaaaggacuuuuccuccuuugcuuacccauuuuccaaggugucucucucauaucugagauuuccuucugcgccucagacuuggucaugccuuaccuuuuucuuuaccucaaagacuugugagaauucaagggcacugugcaucugaaauuacuguguggcaucaaaagcaaaauacagauuuaagauaauguuucuuauauuuuuugcccuuucuucacaccggaacacagcuagaacucugggauccuccugaaaggaccuucagcaauuuucaguugccaaauaaauagcucuagauacaaagggaagugccuugaucuaucaggguuauuuuguugagugaaugaaugagaauuuuacuuaugaggggagaaaaaggagaucagcuggcaggagaaaucuacguuguuccgacccgugcuuuauauauuuaguuguugccgcggcacuuuucccauucagaccagggcccaaggaguaauuaaucuuuguuuuuauuuuuauuuauuuauuuuuuugagauggauccucacucugucaccaggcuggagugcaguggcgccaucucagcucacugcaaccuccgauucugugguucaagcgaaucucccgccucagucucccgaguagcugggauuacaggcaugugccacuacgcccagcuaguuuuuuuuuguauuuuuaguggagacgggguuucaccagguuggccaggauggucuugaucuccugaccucaugauccgcccgcuucggccucccaaagugcugggauuacaggcgugagccacagugccuggcccaggaguaauuaaucuuaaacaagcuaucuuuagcaagcaaaagcaucuuacaaaguacaguaacugaggcuaucaagcauguaaagaaagcauuuucuagaagcuuagagauggauccccgaacacucuguaacccucuguuaacagucuaaggaauucuguucugaauuugggggcucuucuccaggcagucaggguuuugaauucuauuuacaauuccucugcucucuauggccuagaaugauugaaccaagucucuagaucacuguaggagacaucaaccuuuaacaauacauucuugaggagaagagacucguguaagaaacuaucuuguaagaagggaugagaauuacccuaaugauguaacugacaacacaguuucuaguuuuuccuuucuuuccuuccuucuccauuuuuuccaguuucauauccuuguuuguucaugcuacaugaauacuugaaguugauagaguuggcuuuaacuuaggaaccuuugcuuagaaagucaauauccuggccuuucccagaguacuugacuuccugcaaaccuuguuaauaauacuuuguuuuuuaaaauguuggagaacuucagccauugcagccucuugcuaagaagcaaaagcuauaaugacagagaagccccaaagugcaguggaaccagggaucuccggggagaguggugguuuccugggcccccccagagaacccaaggcugugcuggagaugcugccgugacagguggaggcguggagaggcaccuggcaaguccucaaacgccucccccuugauuuagcuccucuagcuaaggauacgcauuccuuuggguuucagguuuuucuucccuaaaaagagaauccccaaacuggacaagcagguuacauucacacaauagcgugaaugaauucgcuggucgcccuucagauucucauuuuggaaucucgaagaaagagagguggugggaggagggcgcuugaaacuucuggcgaugccaguucagaucgauuccagcuaugacggagcgggaaguggauaaagaggaccccaagucacaggaggcacucugagagcaccaagcgcccggggaggccauccgcaggugggcgcggggccuggauuccacagaggggcggagucccucagucaggcgcuggcugcaaucacacccgagcgccagcccccuccagcaucccugagucccagaggagaucgccgaagcgcuggaaaagccguuccgcccacgacuucuggugccgggucggcggcgacugggggagcccaguuccgagaccguaccgcacccacugcggaccuccugggcccuacauaguaggcgggucaugcagggcagcgggaggaggggcgugggagggccaaggccgccgaguccccgcuguucagccagcaggagcgccccgcagcccucccgggacacgguggacacgcuugucccagaccugggcgcccuccugccgggagccaggacuggccgcagcaggcgcuguccgggcccgugggcgggguuucgggagggggcggagccaggcccacggccggugucagguugcuccgguaacggugacguuucgcggcgugggcggggccagcacgcagguugcauauuuuaggaagugaggaggaggcgcgggcuggagcugcggcggggucuggggcgcagagcagcggcgggaggaggcggacacguggcaacagcgguagcagcccgggcggcggcagcaacagcggcggcggcaucggcccgagccgccggccgcccucccacccucccgccccgcggcagcccuagcucccuccacuuggcuccccuggucccgcucgcucggccgggagcugcucugugcuuuucucucugauucuccagcgacaggacccggcgccgggcacugagcaccgccaccauggggaagggggugaguguccggcgcgcccggggagggggcucggggagcccucgaggggaagaggaggaagucgggagggcgaccgcggccagcgggaggcggcggaggaggaagcggcgccgcguggagugggcuggcagagccgcgcggcuuaaaagacgacgcaguuuggaaauggagggagcgcaguaacggggggcgggggaagggagcgccgaggggcuggagcgcggcauugcuuaggggggugggcggacccugggcgggggcugcgcgccccggaggccgagcgggccgggggcuccgagaggcggugcuugggaagccucggggccgggaggagggggcuugcagcagcgggggcggccccgggacugagccggcaucccugagccuggcuccccucccugcgaccgccgucaccuccuucuccuuccuuuucccuccgcccuccgugcccugaggaaaggcgcgcuccuccccuuccccuggggcgcuccgccggggccuccucccgggccuccguucccgccgcggccccgguuccggcgggggcagccuccggguucggggcuccuucuccuggggacgcuggggcuuagcuugcuccgcgcagaggcggccgcccucccccaaagaaaaaacuggcugcuucuaagugcgaagccggcugggcgggcuggugccagaaagggugugucuucacugcccuaagauggccuuuaagguauacuuuugagggcuuucuugggccacuuuccguaaacacaggaugcaccgauggcaacuggaguugucauccgaugguggggagaggcgugcagauuuuuuuugaagggacgagcccugaaggaggauaggcagacccaccagggccucaggguacaagaaacccgaaaaaggacuggaggcugcaggcaauacggugguaggaaucucugccgguuuccagcgucgcggaagcaccaaagggcggucccugaaggaaacgaggggucuuggggcuggagagcggcgcggagcguggugggaauaucgucacaacgccgcuguccuacauuucuguagcgaagacuugauuaccccuagcuauuacccgugcaggagacugggcccuggaccccaaaugagccaaagucuaguugagaaaaauuuacacagaauaaccucggaguucauggggugaaagugaccaugucaugagaauacaaaugggagagaauccacuucguugucuccaggguuuagcacagugcagacacugaguaggucuuugaaggcccugaggcuucuggguguagacagagugucgggagcagagggaggcugcacuccuuggggacucuaagggaguuuuaaaggagguaauugaaaggcuuggaccugguggggagaacaggcacaaguggaaaugcacaacucgccucgcuuuuaaaagcaugcagcguggagggcugguccaggucagguggcaucaaagagcggaguacagggccucuccauuccccugauggagucuggguuaguggccugugcuuuuaccacaccgucaaacccuugaucauuucuguaaacaugcacuuuaaagcucauucuuugucucuccugccuuaaaagaaaaagaaaaaaguuuacuuccugagcuaauuuugggggguuuagacaucacagaugugugccccaagccuaggaaggugaagugacuugcucaaggucaaacgguuggcuagugacagacuaggcgucccugauucuugaacagccuguggccucaagccugaacaugcauuuacucuuuaacauugaguucuuuauacagaacucagaacuucggaugaaacgggguauuugugauguugaauuaauaggccauggagaugguuuggguaacuaaguuauguccauuuaucuagaugucuccuuuauaaccacacacaggcacacaugcacaguagugaugcggugguaacccaccugaauaguuaguagagcuuaaacccagaugucuuacaacaaaauguauaguggcuagcaaacacaagauuaaauuacagcugcgaacacugggaugaugagcugcuuggcugcugggugguaguuagcauuuugaguauucugauacauuaaacauuaguuuacuuguguguguguuuguguguguguuuguccugugacuuauugugagcguccaaauguucagaagaauauuucauguugggauuuuuccacauggggauuaaaauguggguggagagugacuaaagcccugcugauaauuggcuaacaaggaagccugugccggcagcuaauuuuuaaggucauuguaaauuucuuccccuccucuccucaguacccuuuguggccuagcuuuugaugauauuucaggugauuuuauauguccuuaaaagucuaguuccuaagcauuugguaagaaaaugaaagaacagcucuugcugaaucauuccuggaugaaauaggauuuugucccuuuuuuucuuucuggguuuuauugccagugacuuggcuuaaaccgucagcuaggccuaccaccggcaacuguuucacucaccaaagguacacgccauaacuguuuagaaaugugggaaaguuugucuucucaaguguguaaaagaugaggagggggggucucaccaggucuuucacugcauuccggauuuaguuugaauauuauuuaccgaaaaaauaaaucauagcuuaugaguagugauuuaaggaagggcagggaaaaaagguuccagugaagguggcaggggggaugcacaugucagcagaaauccugguuguaugguaauguuaucagcugcccuuuuggagcucagcuugaaagugugacuaaagcuccucuggcugcuauaaagcuaguacuuuagacuuaaagcauuguaaggcagaugccucagaguggaaaguugcccgggccuggccgggagcuaguggagcaaguuacaggaagaacuagugccuagagcugggggguggagagagcacuugugccucacccuuugccugucaguuguucagcguguaacaguucccugcuucuuagguucuuucuguacccuuuuauaaggguguauccccuuuugguaacuuacuguuuguuaauuuguaguguucccugccaguaagcuuguaacacucuagugacucaccuucgggugggaggguaggaaagggagaggccugccuccuaaaccugggaagauggggagagagugguaaaccugagagcccaaaaaacaaaccaaaacaaaaaaacaaaaaaaaagaugccuuuaaaaauucaguuagauguuugcccagaugagggcuaacacuuaaaauauacagauuccugggaauguuauuccuaaauugcauucaaaaauaaaagugaacucaacaucuuauagcacaauaggcuuggcacucauccaugcuccaugccaguacccucagucauuguuuucggauuauuuuagcaacaaaugaacagauaagugacuuuccauucaaaucaggcuauguucuuuuaaauauaucuaaacuuaagaauaagaaaggcuuuaacuaaaauagcuuugaaggauuuuguaugguaaaguaaaauugguuucuucacuuaaaaacaaacagguuuaaaaguaaaauaaaauaaaagcccugaagcuucaguuucucaucuggcuuuuggauagaaugcucauccuggggaucaagugaaguaaucuauguucuguuuauggaaggagugcugugccagccugaguuguggcuauuguuauugggcuuacauagguacaguaauuagagccaagagaagaucaaaucuuuacagacuggguuuguuguucgucaguaagucauuagcccuugcaaaauuagagagcaguuuuucuuucaccaugagaacauauuaagguuugaaaauaaugggaaauacuguuaauugcccuucauaggaaagucaaguagaggugucaauugacauuauugcaacuguuaucuucgcucaacaagcaaaucuccuguuuaauagcaucuuucugucuacuuucacuucucaggugaaggacuuuguucgcgguugaugaucauuuuuacguuuuugaagucuugcaaaauaaaaugggcuuuucggccuucugugaugagagggagccugaacauuugugcugugcugacuucuucuagcugccgagggcucucugccagccaacaggcuagaagaagaaacccgagugucagaucagaugggcucacaguaaucagaguggcuggguuuggacggcaaagcaccaggcaaaauguuucccaucccugccagagcuguccaauucuagauuacacugaaaguacauguccaguacaugauaaugugcaguagagagaacuguaaaaccuacucacucauuuuaaaacucuccauuuauauauuuugggggagggauguggaaccuagucaggucugaacuuucucacguugcuaugaauugaguguaugagaggaaguguguauucuuuggcuggagucauagagagacuguucuuagcauaugacucaccucauuaguugugcugaaaucuguugucaggaauccacaagaaguucuucauauuuauuuuguguuucggauagcagauucuguuacgaaagaaguacccuucacccuacacuuucucuuugguuugguuuuuauuugcauccugagcaaagggauuuuugaucaauagaccucauuccuuuguuccuuugugacuuuacagugaaucucuuuaucugguuuuagaccucacuuacuaguuccuuugugaguuaugaugaaauauaucugcacgugaucucuuuccaguuuuauucaaacccuauuuaguaaugacuauuggcugucucagugauuugauaaguugauucaugauaguucgugcuuuguccuugggacuuguauuguuugggagccugauaaucaguguaagauuuugugacucagugggccuugcuguguagaucggugagcugugauugcucuuucuagucuguuaccauguaggggcaggucccuaaugcacuuugggguuauccucuuguguguuucuuuuaucuuccacaugaugcuuccauggcaccauauuuguuuuauuauuucaauucaugugacauuucuuuagggccuuggacagccuuuauccucuucagccuggcagucauuuuccuuccuagccuaggcuucaggguacuaauugaggagugaucaggacuuacugggaguugaucugguccucucauaacgcauaugcugauuauuaaucaguugucucuaaccagagcaaucugguaaaaugaaaaaaaggaggguaagguggucagcagaaagggggaguuaaggaauaaguagaaaguuuuaacccuucauaacccaugcaccuaauguagagguagaauuuuccauugaagaaacugaaguuuuugucugauuguucuuaauaacuguaaaagcaaaaauauaucuaaagugcacugauucuuuacaccuuuuagaauuuuuauuuuuugaaugaucauggauguacacuacugcagguaggguaggcugucaggcucauuaagaauugacaugcaggcagauuggggaggaagguuaagucauguucuuuuggguugagggaaccugcuggcuagaacugucgcuguucuuugacccuugcuggcugcugggcugcccaaguuuggauauacuaaacugggcucacaaagggaucuacugcuuuggccuugguaaauuauauucuccaggaugcauauuugggugggcaagagaaggaauaugaaggcaugguggccccucaggcucaccuccucugcagagaacugcugcuccugcagugaugugcugcugcuggggcuggauagcagccaugguacuaugacaguguccucccucaaccccggccaucccuuagcccuccagucccuggcuagacaauuccuugcacauaaacuaaacuacuuagucauuuaggagcaaauggagauguaauaaacugggcuagaucauuucuugacuguuauuuucuuuaaguuuucacuguuaagaucaaaugaaaaauaaugccaaaggaguuuuuucuucaaagguuugaaaagaauuuucauagaaagcgaaaaauggcaguaauguauauguuaauuaagaccaaguuauaauaauagccuuuguguagugcuuugagaauacuuuuacauacacaauuguguuggaugauuuaauaauguaucgaccaggaaaaugagaaagcaccccucccccuuaccuuuuacauugaagguagcccagacuuggcagccucuagggaaccagcaaggucagaguccaucacacaacuuuccugcuaaagugguauuugccaaaucauguccagagguguuguuucuacaaucuucuuggcaacuccgaaaugggcugcauuuggggcacuuccuuuugccauccuucuggcccuucuugcccgucaaaagcuuuugucugugggcuuuggaaauaguccaguuuuuaagguguuuuauuuuucagaguuaaugguuucuugacuaaucagacuaugaaaaugccuucucuagguucuuuaauaguuauaccaaguguuauucccauuuuaggaaugaagaaacuaaggcugacaggcaaaggucauguagccagcauguggcaacacuagaauaaauuggcagacucaacaccauuagcagaccugucuggagggaauggugggucuugaacuuucaaguacccucuaaacuuuuucagcaggaauuucagaagucucaagaauucugagcucccugcuggccaugggacauugugcugauauggugggaaaaaugcagguugagaaagccuucgcauccugcccuguuggaggcugguguuugggauggguaugaaggccuuuggcgguggcuauagcuuaugcagaccugaagcaauauaccucugggauggaagauccugcuuauuuugggauaauuucuaaaucugucauaucuauccccaacccuguccccauuaaauggcuaauugccaaaaaagaggaagcaacaucuucagcucuagcaagucucggggaugucucacucauugugaggacugugaggauucgguauauauuuuuaagugagugaaccuuguuacauguuuuaaccuugguuccuccugucaagaauuuuaucuucucaugucuugggcaccuuuucccucuacccagaucaaauagcaaaaugcuuaguuaaucuuugagaggauagaauccaugggaagcacaggaugaaaugaugacgcugugcuaagcugugucaccguggguaagccccugcccuugcugugacuuuccacuuccuaaauuagaauggaagggggaaaaaaaaaaaccauaacccaacuucauuuuuaugaguggcccuuuagaaaauaguguaauccguugaguuuccauuguaccuuuccucagagaugcucaaaggggcgggggugcccuuacauggaacaugaugagagugaggauuaaucacucccaguccucugggaggggggaagugaccugaacuuucuaauugaaaaaguaggaagugugugcccaaugcccagaugagugggaagauuacuguaguugauugaggaaaugccguauuuaucauucacccuucccaugaccuuuguuuuucccuaaugccuuaaaaaauaauaaggaaacauuguccuaccugauucuaccacuguucaucucacgcagugugcacucccugacucugaauuuugcagcuuugagacugagguaauugagacugauagggauuuaaggauauuugguucccacaagaauaagcuaauauuaaguuauuauuuuacuuguggagaagaacuaaauuguauaagcugccugguucuucuagacacacauugccuagugaaaaaauuaaaauuuugaagaaaaagcaguuuuacuuguuaauacuugccaugugucucacccacaaauagccucauuuaaaacuuugccuuaccuagcaugaauggauaaagaaaaaggagaguuauuagggaaucuaaauucccaacuaacuuuagcacugauaguggugaagcuaugggcaagacauuuauuuuguaaguggggguaaaacuuuggaacguguucaaagccuagcugcucuaguaauccucucuccucuucuggaguggaagauauuggaagucugagaauaagcaaagcaugcagauuaugaagcugagggguuauaacuauuucauuuauugaaauauauuucaaugauauucaacuugcucagagagaauccgugagcuguauuuuaaaaaucaauacaggcugggcacgguggcucacgccuguaaucccagcacuuugggaggccgagguggguggaucaugagguaaggaguucaagaccagccuggccaagauggugaaaccccgucucuacuaaaaauacaaaaauuagccaggcgugguggcgagcgccuauaaucccagcuacucaggaggcugaagcagggaauugcuugaacccuugggcggagguugcagugagcuuagauugcgccacugcacuccagccugggcgacagagugagacuccauccccaaaaaaaagaaaauuaauacaaaguggucacauaaaucuuuuagagauccuuagucaaugucuuuaaaauguuuuuuaaguguugugcuuucucauuaaagguaugauauaccuuuaauuaaagcuaaagauauaccacuuuagcugugguuccuuucugguagaugaccugccuuuuccuuuuuguuuuauuuguccacuuguauguguuacuauuuuucauuuaaacucuggcaccaagagcuguaccgaaagaggcaccaacaaaugugguugcuccauaauggagagaaugucaagaauguugacuaucuuuagaccugcuucauuaauagauaagauagaaacuaaagaacccacccaguuggaagaaguuauuagucaaguagugcugcacacgugaccacagaaguuaaaaagguaaauaaugugucucuacauguggcccacuccagugaauuuggagaaggauuucuccuuggagucuuaagaggauauuuuuaaauuuaagugaacaauguauuuuauuugcaacuauuaguuaugacugaaacacacauaauacguuuugauuuucuuuuuucauuucagcacagugaaauuauaaucuggacacgaguuccuaauuauugcuuuaguagcugguaaugcacuuaggaaaguuagaaaugaguaaaggagaaccacaaaauaauaguaauagcaccauaugucaugcauuuuaagaaaauugcuaaugucuacuuuuuggccuuaaguuguaguugugggaggcugcuucagggggaggugucuggaacaaggggcucuucugcuccgcuaagcuuuggagcaccaaguucaggcuuuguguagauaagcucaaggauuuuucaacaggggugggggaguggaacaaucuaaauuuaaacuauagaaucaacauuuucuuuaaaaauuguuccaguuuucaagaggcguagguggauccugugaauuaugugauaaugcacacgcuuuuccuacauccugcuuaugucaaaacauuuccagagacuuucauuuuggagguuuuauuuucaggcuacagaaugggcugggcgcucccuuuuuuaucucuuaugcaaagaauuuuaaggagucuuaggcugacuuuuuaauaugggaagcugguaaaggucaguguucuuaugugagcacuaaagauauuuaaauuugauauguaauaaugucuuugcaaagcaaagaauauaaacaguauaaaaguacuagcauuuagauguauuguaucauuuaauccuuaaaaacaugaaaugagguuggcacuauucuuuaucuccacgcuguggaagaggaaauugaaauguagaaguuaguaacuugccuaaggauacacugcugguaagugguaaagcccaggauuuuaacucaaggcugucugauugagaaugcggacucauaagcacaauauugcacucuaaguuaauaauguaaaguuaguuucauucuuucaguagggaagauggaaggcugcagaauagggauuuugauagcaaaaaucuccucauuaaccccaaaaggaaguggcacuggcagggccauucugaagccuaccgguagcuucaguauuguucuuaaugcucuuggauggagagaauguaucuugagccaauguauuaauaguagauugcuuugcuuauguaguaggcaauauauggguauacauuuuccugacuauuaucuuaaugacuauuccaaauuaugacuaccuuaaaaacuaccaaaauccccugcuccagaauuuucaguuucagaugagguucauaauucauggccucacuuuucccacauucuccuacagguuggacgugauaaguaugagccugcagcuguuucagaacaaggugauaaaaagggcaaaaagggcaaaaaagacagggacauggaugaacugaagaaagaaguuucuaugguaaguacuaggaggaauauuguauuccauccuuauuaaaaauccaugauuuuuaaucccccaggccucacuguauucuucaaagaacugcuauauauuaaaagagaucauagcagcuguacagaucucaucuagucguagagguuaauguugaacauauacuuuuuaaaagcuguuagaggguaggaaaaguuauucagucacucuggcauaaccagagauaacagaaggaacuuagguugauaccaugagucuuugcuuuucucuguauuauaucaaacauugggaaauucagccucuccaggcgauggaagcuuccauagacuuaaccugucuagaaucgaccuggucaucagagaaggcagauaagguuuuacuagaucccugagagcugcuggguuucucugaaguguuauggcaaauaguaaugggccacggucacucagcuuuagccauucuccagugaagagcugucaaugauaacugugugguugcaaagccacaaagcgauggugaaaauuguaccaacuuaugcacugaagaaaacaucugcacuuuguuuaauaagcuuaaugauaguaaugaauaaugcuauuuuuucugucauuuuuuuauacuacacuguuuaacuauuuucuuuguuucuguuuucccuuaggaugaucauaaacuuagccuugaugaacuucaucguaaauauggaacagacuugagccggguauguucuaguuugaaagcuguuguacaaaauccuaguuuuccguauuauauuuuccccuguauuacauacaggucuaaccucaggggcucuaguaagaaaaugacagacaccaucugcguaucuaccaugugacaugcacagaauuugggcauuuauaugcuaccguuucuuuucccugaaacuuuuugaaaguagauguuauuuucuuuucccuauuuuauagcaguugagagccaguaagugggaacaccaggacuugcaguuggcuucaaagccaugcuuaugccuugaccuuuugaugauaaauuuucccuuuauuuuucuacauuuguuaaauagaguugaaucuuucaccuaguugaaucuucaacaauucccauuuuugcacuuuucccagcuagcccauugcaguguguuaugguuauacuaucauuuguuuaguuauucuaucauuuaguuggaaauuguuuuguacaaaaauuaaagaaaccuuuucauaaaauaggcguuauguauccuuguuauguagaggauuuugauauuaaauguguaacaaauguuauaaaaguaaauagucuagggaugucuuauuuccagauaaucacugaaaugucugggaauaacuugaauagcaagccaauauguagcauuuuuucaguaaggcaucaagagacauggguacugugguauucugauauauauugguuuuuguccacaguuccugguucauaacucccauagcccuuauuacagucguuuguuauaauguuggguguguuagaccucaguggcaggcuucaagaaacaggaucucucuccugcccuccuuuucaccugucgcaaggcaggacucuaaucuuguuccacuuuucugauuuuccagguagauaguguuggaauugaauuggaggaaaccuuggugguggggagaaaccgccacaccuuugcucacagaagucaucuucuguguugauuguugggguguaagaguagagaagaggccgggugcgguggcucaugccuguaaucucagcacuuugggaggcugagacugguggaucaccugaggucaggaguucgacaccagccugaccaacauggagaaaccccgucucuacuaaaaauacaaaauuagccuggcaugguggugcaugccuguaaucccagcuacucgggaggcugaggcaggagaacugcuuaaaccugggagguggagguugcagugagccaagguugugccauugcacuccagccuggacaacaagagugaaacuccaucucaaaaaaaaaaaaaaaaaaaaaaaaaaaaaaaggagagaagaacaagguugagagcguuuuucuugacacaagcacuuuaagcuccaagaggaggccucgagucagcucagaacaacaugccaacagugacucugugcuuacuuugugccaggcagucucuagccacuucacaucucacuuaaguuuuuauuagagucuuaaugaagugugcucucuccgaccuaugcccauuacucaaaugcugcgggucuauuucuuuacuuauaaaaugagguuaauaaugccuaaaaaaggauugucaugagaauuaaacaaguuaauuaaagcacugaauucaguuccuggcauguagauagcacucaaauguuugguaacaugagcacaaaacacagauaaauagauacuuuagacaaaaauauuuuauuuuuuuuuugacuuguuauuuugagaguauaaaagugaucauauuuuccucucuuaaugagagcuuauauguaauugccugcugucagugaaucuuggguuuaaggcccauuagaaaaauagcaggcuuuaguagagugguuuuuuccagugaguacuuuucagucaacagguuuauugggagguggcuaaaaugcacauggaggugagcccuucccugccagacaagcaaagaaucaagcuguauauuuaaaacuuggcuguuaacccaaaggauuucuacaggaaguuuuuuucuccuuugauguuuguagagggguuuuuuuuccccucccgacaaaaucaauacacagaaaacccaaagcucuuaauuugcaaaacugaauggauuugugaaaauagauaccuuuuuggcagaaaugcaauuuggcauuaaucccuugaucuaaaacuuagaagaaaccaggcugaauucaaauuuauugauggaucaauuuaaagaguuuuaaucuggguguuaugaguuccuugggccuauuguuugccugaacccuguggggacuggcucaucagcagaauuauucauggaggaauuugcuagguuuuaccuuggcucucuagcuugggacauuuuguuucuuccuuaaauccuuauugcaaccguccagcuaccagguagguauauugccuuguaagugcugguacaguuugccuuauuuauauuccacugcuucucagggauuaacaucugcucgugcagcugagauccuggcgcgagauggucccaacgcccucacucccccucccacuacuccugaauggaucaaguuuugucggcagcucuuugggggguucucaauguuacuguggauuggagcgauucuuuguuucuuggcuuauagcauccaagcugcuacagaagaggaaccucaaaacgauaaugugaguucuguaauucagcauauggauuuguaguacacaucagauaucuucuccgucuuugucucccacuucuucucaauuaccacucauuacuuaaugguuaugaacucauuacuuaaugguuaugaacagcuguugccuucaaggcucauccauucuuccuucguuuccauuuccucucucuaccacccacguuguagaugcucuuacaagugggaugcccaccugcaugugcugcugugagcaggcagcucugcucaggccccggccgccacccacuggauggcagagcacagcgauucauguuggcacauccaccuguccagaaaugcuugguggccauucuucaaaauccacaaguugguugaaaaacaaucuuuguuuuauaaagcaggagaaacugaugcaucuagaaccuuuccaaacguccaguuagugaucaaguguuggugugccugacuccauuucugacccuuccuguguggucuuuagaaggauaaauaagaaaacaugaguucuauauuucugaaaucuugguuucucuauuaaaaaucuguuuuuuauucagucaaaaaauuaauugaaugucccuaauuauuguguagagccacgggcccuaacuugucuuuucccuuccagcuguaccuggguguggugcuaucagccguuguaaucauaacugguugcuucuccuacuaucaagaagcuaaaaguucaaagaucauggaauccuucaaaaacauggucccucagguaccagacgcuuuguccuuccccaguggaugacuugacagccccaagcaugucagccugugaauuagugugaaguuaagguuuuccaaguauuacaugacucaucagagagauggaugucuucuaccccacccaaaaccaaccuauuuuccuucuauccaaaaagugguagccuuucuuuugaauguaaacucugaauacaggcacaccauguaacagcaauaucucuuaaacuggcgagcaagcuuuuguaacuuguguaaauaaaaaagugaauaauaucuuuguuuuguauucagguaauuaggauuaugacuauuuuuauuuucuuguuuuggacacuaccuucucuuuguugguauacuaacgguguaaauuguuucuuuuccaaagcaagcccuugugauucgaaauggugagaaaaugagcauaaaugcggaggaaguugugguuggggaucugguggaaguaaaaggaggagaccgaauuccugcugaccucagaaucauaucugcaaauggcugcaagguagcucuuuuauuuuaacaaaccucauagcuagcucugcuguucgggcagcuugauuugagggguacaguagcccaugauaaggcugguguauucacaugacauuuuucuucuuuuccucacauauagguggauaacuccucgcucacuggugaaucagaaccccagacuaggucuccagauuucacaaaugaaaacccccuggagacgaggaacauugccuucuuuucaaccaauuguguugaagguaggccauuuuugggcacuuugagcauggcgugguauuucucuugggcauuaacaaaaucaaaaccauaggcacaaucucuuguuuuauuggcuccauuucugagaacuugugucaagcacagagcagagguguuuuccuagcuggcaggaaaccuuguggcaguuucccuucccuccaccuccacccugccucuucugucaacaacaccagucuggcauggguguuggagcugcuguccugcuacuggagagaagucccuuugccaaacagcauguacagccaaagagcuggcccuuaaaaagugcuuuuaucaacucuuuuuguuuuuuuagucauccuauguaauuguguaaaauccguggcuuccuucagguuagauacaauuagguacaguucucccuccccuucuuuuuaaggcaccgcacgugguauuguugucuacacuggggaucgcacugugaugggaagaauugccacacuugcuucugggcuggaaggaggccagacccccauugcugcagaaauugaacauuuuauccacaucaucacggguguggcuguguuccugggugugucuuucuucauccuuucucucauccuugaguacaccuggcuugaggcugucaucuuccucaucgguaucaucguagccaaugugccggaagguuugcuggccacugucacgguaagaggcaggugauggucacccugacucagaucagcuugcacgaauguuacacucuuccgcuauccuauucuaagguauugccaacuuauguuuuauucuggauguuugauauaguucuucuugagagccacaucacguggugaauuuugacagugagaaaaccucagcauuuguuuauacguaagauaaccccaaagcauacauuuugcuuuuaaauuaucacgugguccugaacagugcaguggagaaaggagaagaacuugggaucaaguagggggauagaauaugguagaauccuguuauuauuuuucuuaauagauugcuuuucuggaaggaaggggaagccucauguauggguuccccuuauuauuucuucaaacuucagaagaagguuggagagauuuaauuuuagacaaauuucuuccacauuaggauauagcaagaaucuguauagaauuccagccugguugagugaaguaauaaucuuccuaauauuuuuuaggucugucugacacuuacugccaaacgcauggcaaggaaaaacugcuuagugaagaacuuagaagcuguggagaccuugggguccacguccaccaucugcucugauaaaacuggaacucugacucagaaccggaugacaguggcccacaugugguuugacaaucaaauccaugaagcugauacgacagagaaucagagugguaaggccaggguuaccacacaccucagccaccugcugacuucgcuugguuuuuuuucuuuuaagaaauugcaugaaauuucuuuuuuuuuuuuaagcucauggcagcuuuuucuuucuuuuuuguuuuuuuuuuuuuuaucauuuagugaagagucaaggguaugggauauugauuuuuugcaugucaguagaaacuuuaaauugcccuacaaacgugacugaagaaugccuaaaaugugauugguuucauuaauugggaaaugagauguaucacugcagauuucuaugggacuuuaauaggagaacugagaacacagccuuugaaguuaaugcauuguuguucuguuguguuuucuugccuccaucaggugucucuuuugacaagacuucagcuaccuggcuugcucuguccagaauugcaggucuuuguaacagggcaguguuucaggcuaaccaggaaaaccuaccuauucuuaagguaugcucaagaguuaacuaauggagggauguagacagcacaugagaacugccauuugaguguuaaaaguagcaaauuaccuuuguggucugugugacuguucacuguagaacaccuggaguggucugugcaguacuuugcuguguguaacuuacauuguguugccuguagauccugauguauuauaggacccccugcuccauauagguugauuaaaaagggaagaugcaguaaaaaucugaccaaagugggaggggaggagacggaagacagucuuuauuggugaaaaaccuaauucaucugcuuuuacuacucuugaguuuauauguuaucaccuaaccuaguggacagugagagcugagggcugcagugacuccauaaucguauuugcauauuaggauacaguagauuccaguaacuccuuuaagccauuuauuuuccugaaauagcucagcuuaucuuaucuuauugguucuuagcuuguuuacuaaugauguaaaaauaagcuccaggccaaaauaagcccagccuuagccuguggaauucugaugcaguuugaaaugauugagauuuuacuaugcugcccaagugaagaugcagucucagaaggaucaugaauuguacaaaguccuguaggagaagaaagcuaugugaggcucucugggucccacauucucugugaagcugccuguaguaguuguggguauaaacuaaguugccaaagggaauauggcuuggauguaacucagaugccuucugugaugaggauaggguucauuuauucugcaaaggagauuuucuuggcauugaauugauguugauuugaggauaauguuguguaucuugaggauaaaacuugagauaaauguuucauguuuuucuuuaccucaaaguggaaauguucuaggcuuugagcaucaggucccacaaguaucaaaucuuuccugauuaaaaaaccccagaaagguagcagaagcuguauuccaaguauuucuggaguucggccauguugauggcauuauuacuaaaaagcggggagggagaagcagcccuauucugcuuuuauuaaaaauggcuuuuauuaaaauaaguggcuuuuauuuaaaaugucccccacuuauuuuguguuucuuuccaaacccagccaacuuucuugcucuguggagcugcuauacuucugagcauugaucuguucaucugcauaugcagccuuacauguuaagguucuaaaagguuuaccuauauaaaauuuguuuacaacugaaaaugcuuucaguaugucaaaauauaagugugucaucauguaucauagaaaauaugugugucacugaagcaugggcuuuaacuaaaauguuacgugguucgauuuuauuacuguuggaguugguaauagcuuucaguucacauccuucaggcccaguuaauuuugcacaguuaugauuagaaugcacagucuucuacuuugcccuugacacaggcagcuuguccccaguccugagaccuuaagcauuuucuuacgaauucuacgguaaugaaaggugcuauaaauguuuaaucucucacuugguauuuucagauaaguaaccagaaguagguaguugggaauagcauuggcuuugagacuuuucaguaggccaggggaagauagaaauagacugcaguagguuggaaggguguguuaauaccucuucuagggaaggugacaccuucccacacccuucuuucacuagaagcugcugugggguggggaaggacguugggguuugagucugaagcacugugaacagcaguggucggggcuagagggacuccugucccacuuaacaccgcugcuuccuucuugcccauccucugcuaccucugacaagauuggaaugugucuugaguuauuuuuccuguuuuuuagugaugccucagugaaauuuuuuggagauaauuuacagaugaugucucuguucacagcgggcaguugcaggagaugccucugagucagcacucuuaaagugcauagagcugugcugugguuccgugaaggagaugagagaaagauacgccaaaaucgucgagauacccuucaacuccaccaacaaguaccaggucugaagaucgauggguacacggagggcgagggcaagcugggggacaaagaggggagguacaugagcaggaagaggaaauauucucccuuuggaguuuuauaagcuuuagcuuuaaauuuugcccuugauuaccauagaaugccauaauuuaguugaauaucagcaggauaaaugaagccucuugcaaaacacuguugagcccuuuugaauacuugugguuuggggugggugugggcauguggggagguggcuggagguauguguacacaaguguuccccaaucccuguguucugaaauuucguauguucuuuuuuaaugugaacaaaugucaggaauuuaugaauauaucauagugcucauuuuuuuuuuuuucuguagcauucaaaguauguuacagguguaagauacuucagaguucagaaagaagggaucuugggucuuuuauagcaaauacuaaauaguaagugaagcuuuguuuuccaccauggacugccacacauccaaccauccaauguuuaugucucaacaauccuucacaguugucuauucauaagaaccccaacacaucggagccccaacaccuguuggugaugaagggcgccccagaaaggauccuagaccguugcagcucuauccuccuccacggcaaggagcagccccuggaugaggagcugaaagacgccuuucagaacgccuauuuggagcuggggggccucggagaacgaguccuagguaugcagauaaccugguaacagagugccugggcacguuuuuauccaguaaccuagucugguagacaguuaacaagugauccuaugaaccucuaugucuuguugaccuuccucuacaucuuuuaggggcaauccuccuauuuguuuauuugcccccuauuauuuugaaaacaauaagugcugaagaaauguucagcguauugggcugugagaaacaacguccugaugguuugcuucugacuuguacuuagaccuuuggucucaugcuagucaguucuguuuguuuaaaaaaaaaaaugguggaagaauaucuuucuuaucuaaccuuuguugcuguggacaugacuuauaagccuaauuaaaguuaauuaauucuuagugugucuaaguuagacauacuauuuccugacugccuuggaaugggugugaauuuacaugagcacuuaugugcucagcuuagaaacuagacuaacgguaaacuuuuagucuaagaugcuaccuauuuuuuucuacccugacagcuacugaggcugagaaguucacuuuacccauugucuaauguauuugggaaaguggcauuuauaauacuuuguagguugacagauacuacauucauuauuuauauaaugcuuccuauucuucuuaacuuggguaaaucuaacucaugguaucuuucguaugugucuauccaaccgaaggauugcuaucuucucuuuaaguguuuuucacuucccuacuuccaccaccccaaaguggaagcagucucucuucuuuugaguccacauggcacguuaaagaucauuguaacgucauacaacauugaaaagaaugucuuacauuaucuugauucuuguauuuacuauacuagaugauaaacccccugggcagaaugcaucugaucuguacuuauccucaaaaguagcuagcaugaugucccacauuggugcucaguaauauguuucaguuaaaugaacaagagagcagagguauggccuugauguuuccagagaaggcagcugaggcagauaauuccaugauuugccaaauccaaauaacuuaaugucaucaucagugggcaagucuagaacccuaauauccuggugcucaaaauuaguguuaucaauucagucuucuccacauuaaacaauuuccaauuccuuugaggccuggugugauggauucugucuuucaaaugcuuuuuuucuuucagugacucuaucguucauaaauguuaaauaaaacccucacucuguuauaaaaauauagacuuuaaaaauuuuccaaaguaaacacuccagagaaagguaggcgggcugaauaggcugcuguuguccuucuuacugcccagcgucacugaaauuuucaaaggcuccuguccuccucgcagguuucugccaccucuuucugccagaugaacaguuuccugaaggguuccaguuugacacugacgaugugaauuucccuaucgauaaucugugcuuuguugggcucaucuccaugauugacccuccacgggcggccguuccugaugccgugggcaaaugucgaagugcuggaauuaagguagugcccaggcgccuccuuggcuucaucucuuagugccuugggacacccuacucagugaauguugccuuuugagguccagauggccagcuguucuaucucaccuggaguauuaauuucucaucuccaaagcuuuacuuccacccagaaaagaccagauaguauuaaaauaugaugguguaaacacacgaggaauuaaaaauuuuuuggaaagcaauuguguaaaaaagaaauguaagcaaaguaaaaacagcaaaagacuugaaguuuuaaaauacuugcauuauucuaaguuaauguaccuuaugcaaugaauggcauaucuucuguguuuucaguuaacuguuuguuaaugaguguuugguguccucuguguaucugucuuuuuuuaaguagcugaauauuacucaagugcacuaauauccuguugcuggguauuugguuucuguuuuuuacucucaggauuuuauuuuauuuauuuuuugagacagagucuugcucuauugcccaggcuggaaugucauagcacgaucucggcucacugcaaccuccgccucccagguucaagcaauucuccugccccagccucccaaguagcuggaauuacaggcacccgcuaccacgcccagcuaauuuuuguauuuuuaaguaaagauaggguuucgccacguuggccaggcuggucucaaacuccugaccucaggugaucugcccaccucagccucccaaagugcugggguuacaagcgugagccaccacacccggccuacucucaggauuaauacugcccugaaaagcuuuguagaaguuauuuccucaccauuccgacugcuucuuuuuaaaguauauucuaaguauaaucacugcaucaaaaaauaacaauuuugaauucuugucacauguugcuuuuccuccaaguugugccaauuugagaaugcuagccaguagcauguggugucuucacagucccaccagcaucagauuuuuauccuuuuuuuuuuuuuuuuuuuuugcugguuuuaguaauuuucaaguauuuuuauguaacucuguagaaggaaaaauagacauuguguaugcuagugauuguauaccaagauaaaaccugaguauugccuuuguguuuccuuucuguggauauauauguuuauauuuuuggcuaaucgauguuuauuaguuuuauauuugcauuccuuuccuuuugauagucuaagccgaaucauccuuaguauuuacucuugccuacuggauauaagacuuuaaggucauuuacuuggcaguugcauucaacacauugucuuguuuauuacaggucaucauggucacaggagaccauccaaucacagcuaaagcuauugccaaaggugugggcaucaucucagaaggcaaugagaccguggaagacauugcugcccgccucaacaucccagucagccaggugaaccccagguaaggcaggaagcucaaaucacagucugcugugaacaagcaaauagugaugguuuaaaaucuucagcgugguucuauaaugguuugcaucuaggcuugcucugaguaggaaauguaccugcacugccagaaagcaaccuugucauuccuaagaaggguuuuaaguaagagcaagucauaauaauuagcacuuagaugguauuuacuguucuaagagcuugauauggugaccuauuauuugcagagcagggaagguaaggauucaagaggcuuuugaaguaccucagaacuggugaaaucaugcaguaaauucagcagucuagcuucugauuucaugcuguuaaccacugagcucuacugccuagcaccuagcaucuugacacuuuccagguccacacuaacaaaauaaaauaaggaagggacaauuacuuaggccauucaggcaaacacaggagacauuuggcaaugaaguaaaacagauaauagcaaauugguuuuguuuuaagguuuagggcccuuucacccuauguuacgguuagaggaggguuuggucuuguaucagcucugccacuuucuaaaacuugguuauauuucuuuuuuucuuugauggagucucgcucugucaucccgguuggagugcagugucaugaucuuggcucacugcaaccuccaccuccugaguucaagugauucuccugccucagccucccaaguagcugggauuacaggccccaaccaccaugcccggcuaauuuuugaauuuuuagaccaccauuuuggcaagcuggucucgaacuccugaccucaagugauccacucaccucagccucccaaagugcugggauuacaggcaugagccacacacccagcuaaaacuugguuauauuucagcaugucuaauaaagauagggaaaggaagaauacagacaggccugccuuagagaucaucaugagccucaaaugagauaaaauauaugaaaaugcucuguaaccuguaaaguacugaacacuuaauagcuuuuaugugcuggggaaaauuccuucuuuguuuuguuuacaaagugaucugcauaagaauauccccucuugaggugauggacacaugcuggugaugugaugcgugacuuuuuuuuuuuuuuuguccuaauucuagggaugccaaggccugcguaguacacggcagugaucuaaaggacaugaccuccgagcagcuggaugacauuuugaaguaccacacugagauaguguuugccaggaccuccccucagcagaagcucaucauuguggaaggcugccaaagacaggucagccagcacaaggaucaggcugcuuugggcacuauuggcuuuagggauuggaguuccaguggaaacagagcaacggugauggauggaugcauaccucgcuguauuagacucaguauaaauaggccaguaggaagcucauaggcauagagagggugacuuguuaaugguuuagcagugacagaagcacuuuaaaguccagguguccacugugucccagagccugaccgcuccguggagucaucugauaugggguccuaguauuugcaauagagaugugaguggucagacuacagggcgugcauacaggaauggcauuuucuggagugccacccaccagagucauuacuuugaguagcucuuguuaaugcugggggcuauguuuguugucacuucucaguucuguuauuugguguagggccugugugaauacuugccugugacgguucucaggcuucauaaauagucucaauaggaaaggagcagugucuguaaugagugcucagugggggcaugcaucgcacuauuuccaucgcuaggaaaagugauugguauuaacccguuuucccuuuucugggguagggugcuaucguggcugugacuggugacggugugaaugacucuccagcuuugaagaaagcagacauugggguugcuauggggauugcuggcucagauguguccaagcaagcugcugacaugauucuucuggaugacaacuuugccucaauugugacuggaguagaggaaggugagagcuauuuaagguguacaccaagaucuuauucagauacugcccauuagcauccauuucuguauacuucuuggauauguucaguuuccagugugcuugucucauaagcuaacaguaaaaaaucuugguuuucauaggucgucugaucuuugauaacuugaagaaauccauugcuuauaccuuaaccaguaacauucccgagaucaccccguuccugauauuuauuauugcaaacauuccacuaccacuggggacugucaccauccucugcauugacuugggcacugacauggugagugucacaacagucacagaucgauaguagugaggugugagcugugucuucauucacuggcacuaugcucccagcauccaugaggcuggcguugggaaaagaaauucucaggaccaguauccagugugugucccaaucccggcuucacagaaucaguauuaccacucuucaaggcagcaguuaacauuuguuuaucagaugggaaucuuuauuuuuguauacuucaccuaaaagauuuuuaaaugggagggcaagaauuuuauaacaaaagguucacaauauuagcuuccuuauuuuuaguaacuaaauuccuucuccccaccccuucccagguuccugccaucucccuggcuuaugagcaggcugagagugacaucaugaagagacagcccagaaaucccaaaacagacaaacuugugaaugagcggcugaucagcauggccuaugggcagauugguaagcugcagccuggagugggaagcuggcacaucuaaggcaucugaggugaugguguccaccucagguugagguugauuucagagacugcaaauccaggcgacuuucaggucuaggaugagcccuaacggagugagccuguggaguuucucugaacucucuuccaugugagaauacaucuguugcuguuugcccaguuaccuuuuguggaaacugguuuucuauacugagcaccuuggaacugggcucaacucugccugagaaaugaggauguccuuccucacugagccuugcggaacaggaggcaugguucuaaggaauuguguguacugacgcacaggcugcuuucccuggagauacacacuuaucugucacucacuuggauggaguuaggcauuggagaaaguauauguguuugagaguuuggcugguaggucaccaccaaagggugauccuccauccaccucacacuggacuucugcccccacagugcagcaugacuagcuaacaggugauccagguggugggcaaucagcaugccauuuguuuuuaaauccucugccuaggguuccuucaagagaaccuggcaaagccaccauggaugucuuauucuccuggauuaaugggucacauaacugugaacgcuuggauaaagaagaacagauuagauagaauauuguggaaauuauggcaaagauucauuagacaguuguuggcaacaaaguaauuggcugguggcccauccugaccuucuccaaggaggccugcuuuugagaggaaggaagacuaggucucuggugguuuaggaugaaacccugcccugaggaacuuggagcagcgugguuaaauuggaugccagggggaggaggguccugaagguggggaggagagucagaaagugccacaguggcuagaaaaauggcagcauguaggaauuuugaaagauggaaaagaaguuaucauuugucagagauuaaaaaguagggaaguggauuuccccuaaaggucauacccuuagaagcagcuggucaaguaacaggugggcauuuugagagcaaggcacaugugucuuuguguaggcuccaaaaagugacucaaaaagcagagggcccugagauuggaguguaugccugggguccuccaucccaucccucauagccugugagugaccaggcaauucuuuccugugcuuuuaucaaccagggggaaacacuccuccauaugugcucucccaggccugcugcaguaaucagcugaaggcuauacagguacccuugugugugagguucuaguaauuggguuguuuucccaacuuaggaaugauccaggcccugggaggcuucuuuacuuacuuugugauucuggcugagaacggcuuccucccaauucaccuguugggccuccgaguggacugggaugaccgcuggaucaacgauguggaagacagcuacgggcagcagugggugagugggcaccucugaccugaccagugucagagcuccucaagccccagaagacugaggccacacugccaccagccaugcaggugaagagccagagcucaucuucugucuucugcauuucagaccuaugagcagaggaaaaucguggaguucaccugccacacagccuucuucgucaguaucgugguggugcagugggccgacuuggucaucuguaagaccaggaggaauucggucuuccagcaggggaugaaguaaguaaugaaggacaugucaaggccuuggcucaaagaaggggacuggugauuuguaaacccuuugccaaaaacuaaacauaugacacauauagccagguuucuggaaucucuaguuuauagagcaaauuuaggaagcaagaaauguagcuuucuaguuuuuucaucugaccuccaaguuuucaaguacagcuaauacauaaagauguugaucugccauuuuaaugcauagcauuagaagauaaaccuuuauuugcaccuuuuaaguuuuuucuccccuacuuugauuuuaggaacaagaucuugauauuuggccucuuugaagagacagcccuggcugcuuuccuuuccuacugcccuggaauggguguugcucuuaggauguauccccucaaguaaguugauccucugguagcuccaaaaaguaugaaauaguauguguggcuuuuccccccauuacuugugguaauaguuguuauuuucagaauuuugagugguauguacaaaaauuccuauggguuggaaaacugugaaagcuugacaugucaguaaaucagacuaacaaauccugaggcuuccaugauagcagcuaguguuuaggauuuggcccaagauaagauaaagccacacaggcucuagcuccauggaacugcucaacagcgaacugcauugagcacucaggucugccacagcuguaguccaguugucuuuagaggccaacuggggguaugcuggagcguaggcgcccaggcucaaaucuugauuugcuugcuuagucacugucccauuacaagucauccaccuuucugagacucugaauacucugcucucaaagaaagaagguuggagaaacagaucugaggucccuuuuacuuuauaaucagucauggguagaguugaucaaaggaagcauacugcuagucuuuggccuuaaacacagugaaugacucugcauuucagauaaacuugaauuuucaaagaggguuuaucacaaacuccguuaguuuuuugcaacauugaguauguuuggugauaccugguugagguuaagcaacugcaacuugauuaaaacgugcaaagccacagauugugggacccauuuacaaguuccuuugaagcuuuugauuuaaagcauuagucuccuuugaauuccugcuguccucauccuugcucagacccgucuggaccaucucucaauccccuguugccagcacuuccuucagcucaucuuaucccuaaaguaaccaaaacccaucagccucauucacuuccuguggguuaugugcagacaucgucuguggugcaagaugagacuggcauccagagucagucucauugucccaaccugucuuuauagcuuucucuuguaccccuuacccauccaagcucauguuaggugaauucggcuuucuuccucugccuuuguguuugguaagauccuuccuccccacaucccuccuucuguucccucuuacccugccaauccugauagucccuucagggccgguuuccuuggagcuugucccuccagggccugugcacuugcaccucuucucuggcauuacuuguugcuugucauuucaccucccugcuagguuuuaaucuagaaggcaugggccacagugucuuucuucucugugcauccccagcucccuacacaaagcugguguacagcaggggccagccaucuccaaauugaauucugucagcuugggccauuauguaucaagauggggcuuggagaggucacagagcuuuccaaaaaggcugguggaaaauuacacugaaaagggggcauuuccaucuucuggguccuucccugguuuuuuugccaccaccaaagagauuguucugacagguucugcccaauuuuggaaggugguucaguuauucggugacugagucaaaugagaucaucucucuuagcugccuugucagacacacaggaagaagaggagaccaccggaguccugcccagggacagccuuucucacaccauagcagggagcuggugaucacggaggcugccuggagccugucagcaggcuagagacuguguggcucagccuccaggccccuuggaagccuucgggcucagcuuuuuucaguccccaggaccaggccucagaacacagagcugauaucccaaaugcuguugucagagaucaaauuuggggaaugcauaaacugguuuugacccacacuggcaggucuuuaucuucaaaaugcugggauauuaggcagauggucuuaaaaagcuucuuaaacacuuuagaaaugaaagaaagaaaauguucaguugcucugggaugguuaacagaaaaguacucugcucauccuauaaaccaagucuuaugaaauccaaacugaagaugaguagggauuccauuacaaagucugcagacugauuuccucugcgucucuaggcccugggcacauggaguagcaaucuguuuuaagacauuuuuauuuguucuguuaaugacucaguaguuaacugugacuguacuuggcuucuccuuucaggcugauuauuucauugucacuggugaugugcaauuucucuuucuuuauuugaacuguguucgugugcauauaaauugguaccuuacucuauuuccagaccuaccuggugguucugugccuuccccuacucucuucucaucuucguauaugacgaagucagaaaacucaucaucaggcgacgcccuggcgguaauuaugggcauucugacuuugguuggaggaggagugggaggggcuauaguucuauugguuuuuuguuucccucaaggugucuaggcucccucaguggucagucugauuagcuaaggugacuggaccagcaaacugaccauagucacaucuucagaauguagaucucaguuacaguuugaggacuggucauguuuuagacuuuaaaauacaaaccaaguaugauuuagugaaaacuugucagaaucuaaaccaucuuuccagguaacuugguauuccuaaaaacauguaaauaaguacaguugaggucccauguuuggauuuuaacacacccgacccccaucauccuccgguugguuuucaucccuguuucccucuguaaugcuggagcgaggaagacucacuguagugugucuugucugucucuuugccacccacaggcuggguggagaaggaaaccuacuauuagccccccguccugcacgccguggagcaucaggccacacacucugcauccgacacccacccccucuuuguguacuucagucuuggaguuuggaacucuacccugguaggaaagcaccgcagcauguggggaagcaagacguccuggaaugaagcauguagcucuauggggggaggggggagggcugccugaaaaccauccaucuguggaaaugacagcggggaagguuuuuaugugccuuuuuguuuuuguaaaaaaggaacacccggaaagacugaaagaauacauuuuauaucuggauuuuuacaaauaaagauggcuauuauaauggaauuug

SEQ ID NO: 13767 - RNA, 1063 nt, Homo sapiens
agaagagcaauucuuauuuuauuuauaaugaaauacgaccacaagguuacauaguaguaaauucacaguagugauuuuuuuguuuuucaguaacaaauccguaaaucacaaacacuacccagaaauacuuaaaucacuuuacaaucgcagggucucugcugcaggacuauuuaaauaaauaugcuaacauuucugugcuacuguaaguaaccuaucacuuuuuaaaaauaaagcccaauuuuuaaguuaccuuaagaaauaucuaguaaggcuuccaggguagugaaguuugagcaguaauuuucuuagagcuugaccuuuguuuguuuguuucuugcuguuuucagaguccuaaagcaagaaagaguuuaauggacuugccugcaggacagcaggcuccccagaagacagugcugugcuaaagccauuuacucuagcgggagaagccagugucagugagggaaaggaauaaagcaggggagggaaaagucacugguuuagagcgaccucucaaaacacaggguuauuaagucaucucucaaacacaggggacugcagaaacacagacacccucacacacucagcuauauacacaaugacacguaucugcugagcuacacaccugcuacagauaacacagauguuaagaugucugacauauaaaugugcuauccgucugguaauacacucagagaaaugcucacauauauggaaauaaaaacgcacaaacaaauaugcauccccacuuagggauacuuacacagcaggacccagauuggaagguaaaccaaggacucacuuuuguugguuucacugaguggcuggagcacucacucaguacguagguuggaguggcaagguaaucaauuucugucaguccaauaugcugguagcaucccacagagcuacagcccuuagguaaauacaugcacucgaaagugauuaugaggcaaaaugagagagaaaucuaccaccaacuacuguagagagggcaggggugagcacuuuaucccuauccaacacacaccugcacagcuagucucuccauuaaaaaaggaguccc

SEQ ID NO: 13768 - RNA, 1063 nt, Homo sapiens
gggacuccuuuuuuaauggagagacuagcugugcagguguguguuggauagggauaaagugcucaccccugcccucucuacaguaguuggugguagauuucucucucauuuugccucauaaucacuuucgagugcauguauuuaccuaagggcuguagcucugugggaugcuaccagcauauuggacugacagaaauugauuaccuugccacuccaaccuacguacugagugagugcuccagccacucagugaaaccaacaaaagugaguccuugguuuaccuuccaaucuggguccugcuguguaaguaucccuaaguggggaugcauauuuguuugugcguuuuuauuuccauauaugugagcauuucucugaguguauuaccagacggauagcacauuuauaugucagacaucuuaacaucuguguuaucuguagcagguguguagcucagcagauacgugucauuguguauauagcugagugugugagggugucuguguuucugcaguccccuguguuugagagaugacuuaauaacccuguguuuugagaggucgcucuaaaccagugacuuuucccuccccugcuuuauuccuuucccucacugacacuggcuucucccgcuagaguaaauggcuuuagcacagcacugucuucuggggagccugcuguccugcaggcaaguccauuaaacucuuucuugcuuuaggacucugaaaacagcaagaaacaaacaaacaaaggucaagcucuaagaaaauuacugcucaaacuucacuacccuggaagccuuacuagauauuucuuaagguaacuuaaaaauugggcuuuauuuuuaaaaagugauagguuacuuacaguagcacagaaauguuagcauauuuauuuaaauaguccugcagcagagacccugcgauuguaaagugauuuaaguauuucuggguaguguuugugauuuacggauuuguuacugaaaaacaaaaaaaucacuacugugaauuuacuacuauguaaccuuguggucguauuucauuauaaauaaaauaagaauugcucuucu

SEQ ID NO: 13769 - RNA, 9268 nt, Homo sapiens
uuuuuuaaaaauuaugcuucaaguucugggauacaugugcagaacgugcagguuuguuacauagguauacaugugccauacugguuuucugcacccaucaacccgucaucuacauuagguauuucuccuaaugcuaugccaccccuaguccuccaacccaccgacaggcccuggugugugauguuccccucccuguguccauguguucucauuguucaacucccacuuaugagugagaacaugcaguguuugguuuuccauuccuguguuaguuugacaagaaugaugguuuccagcuucauccaugacccugcaaaagacauaacucuuccuuuuuuauggcugcauaguauuccaugguguauaugugccacauuuucuuuauccagucuaucauugauggacauuuggguugguuccaagucuuugcucuugugaacagugcugcaauaaacacacaugugcauaugucuuuauaguagcaugauuuauaauccuucagguauauacccaguaaugggauggcugggucaaaugguauuucugguucuagauccuugaggaaucgccacacugucuuccacaugguugaacuaauuuacacucagaccaacagugcaaaagcauuccuauuucuccacauccuauccagcaucucuuguuuccugacuuuuuaaugaucgccauucuaacuggcaugagaugguaucucauugugguuuugauuugcauuucucuaaugaccagugaugaugagcuuuuuuuuauauguuuguuggcugcauaaaugucaucuuuugagaagugucuguucauauccuuuacccacuuuuugaugggauuguuuuuuucuuguaaauuuguuuaaguuccuuguaaauucgggauauuagcccuuugucagauggauagauugcaaaaauuuucucccauucuguagguugccuuuucacucugaugguaguuucuuucgcugugcagaagcucuuuaguuuaaucagaucccauuugugaauuuuggcuuuuguugccauugcuguugguauuuuagucaugaagucuuucccaugccuauguccugaaugguauugccuagguuuucuucuaugauuuuuauggguuuaggucuuacguuuaaaucuuuaauccaccuugaguuaauuuuuguauaagguguaaggaagggguccaguuucaguuuucugcauauggcuagccaguuuucccaacaucauuuauuaaauagugaauccuuuccccauugcuuguuuuugucagguuugucaaagaucagaggguuguacaugugugguguuauuucugaggccucuguucuguuccauuggucuauauaucuguuuugguacuaguaccaugcuguuuugguuacuguagguagccuuguaguauaguuugaagucagguagcaugaugccuccagcuuuuugcuuaggauugucuuggcuauaugggcucuuuuuugguuccaugugaaauuuaaaguaguucuuucuaauucugugaagaaagucaaugguagcuugauggggauagcauuaaaucuacaaauuacuuugggcaguauggccauuuucacaauauugauucuucuuauccaugagcaugaauguuuuuacauuuguuuguguucucucuuauuuccuugagcagugguuuauacuucuccuugaaaagguucuucacaucccuuguaaguuguauucuuagguauuuauucucuuuguagcaacugugaaugggaguucacucaugguuuggcucucgguuuuucuguuuuuggcguauaggaaugcuugugauuuuugcacauugauuuuguauccugagacuuugcugaaguugcuuaucaguuuaaggagauuuugggcugagaugaugggguuuucuaaauauacaaucaugucaucugcaaacagagacaauuugacuuccucucuuccuauuugaauacccuuuauuucuuucucuugccuaauuguccuggccagaacuuccaauacuauguugaauaggaguagugagagagaacauccuugucuugugccaguuuucaaagggaaugcuuccagcuuuugcccauucaguaugauauuggcuguggguuugucauaaauagcucuuauuauuuugagauauguuccaucaauaccuaguuuauugagaguuuuuagcauaaagggguguugaauuuuaucaaaggccuuuucugcaucuauugagauaaucaugugguuuuugucauugguucuguuuaugugauggauuauguuuauugauuugcauauguugaaccagccuugcauuccagggauaaagccaacuggaucaugguggauaagcuuuuccaugugcugcuggauuugguuugccaguaauuuauugaagauuuucgcauugcuguucaucagggauauuggccugaaaucuucuuuuuuuauuguguuucugccacguuuugguaucaggaugaugccagccucauaaaaugaguuagggaggagucccucuuuuucuauuguuuggaauaguuucagaaggaaugguaccagcuccucuuuguaccucugguagaauuuggcugugaauacguccagucccaggcuuuuuuuaggugguaggcuauuaauuacugccuuaauuucagaacuuguuauugaucuauucagggauucaaauucuuccugguuuagucuugggagcauguaugugucaaggaauuugcccauuucuucuagauuuucuaguuuauuuguguagagguguuuacaguauucucugaugguaguuuguauuucugugggaugagugaugauauccccuuuaucauuuauuauugugucuaguugauucuucucuauuuucuuccuuauuagucuggcuagcagucuaucuauuuuguuaaucuuuucaaaaaaaaaacagcucuugguuuaauugauuuuugaaggguuuuucaugucucuaucuccuucaguucugcucugaucuuaguuauuucuugccuucugcuagcuuuugaauuuguuugcuugcuucuuuaguuccuuuaacugugauguuaggguaucaauuuuagaucuuuccugcuuucuccuuugggcauuuagugcuaaaaauuuuccucuaaacacugcuuuagcugugucccagagauucugguaccuuuugucuuuguucucauugguuucaaauaacuuauuuauuucugccuuaauuucauuauuuacccaguagucauucaggagcagguuguucaguuuccauguaguugugcaguuuugagugaguuucuuaauccugaguucuaauuugauuguacuguggucugagaaacuguuaugauuuccauucuuuugcauuugcugaggaguguuuuacuuccaauuauguggucaauuuuagaauaagugugauguggugcugagaagaauguauauucuguugauuugggguggaaaguucuauagaugucuauuaggucugcuugguccaaagcugaguucaaguccugaauauccuuguuaauuuucugucucauugauuuaucuaauauugacagugggguguuaaagucucccacuauuuuugugugggagucuaacucucuuuguaggucucuaagaacuugcuuuaugaaucugggugccccuguauugggugcauauauauuuaagaucguuagcccuucuuguugcauugaucccuuuaucaucauguaauacccuucuuugucuuuuuugaucuuuguugguuuaaagucuguuuuaucagagacuaggauugcaauucugcuuuuuuuuguuuuccauuugcuugguaaauauuccuccaucccuuuauuuugagccuaugugugucuuugcacaugagauuggucuccugaauacagcacaccgaugggucuugacucuuuauccaauuugccagucugugucuuuuaauuggggcauuuagcccauuuacauuuaagguuaauauuguucugugugaauuugaucauguuauuaugaugcuagcuggcuauuuugcccauuaguugaugcaguuucuucauagugucaauggucuuuacaauuugguauguuuuugcaguggcuggguacugguuuuuccuuuccauauuuagugguuccuucaggagcucuuguaagguaggccuguuggugacaaaauagcucagcauuugcuugucuguaaaggauuuuauuucuccuuagcuuacgaagcuuaguuuggcuggauaugaaauucugguuugaaaauucuuuucuuuaaguguguugaauauuggcauccacucucuucuggcuuguagcaguucugcagagagauccacugucagucugaugggcuuuccuuuguggguaacccaaccuuucucucuggcugcccuuaacauuuuuuuccuucauuccaaccuuggugaaucugaugauuaugugucuugggguugcucuucuugaggaguaucuuugugguguucccugcauuuccugaauuugaauguuggccugucuugcuaaguuggggaaguucuccuggauaauauccugaaaaguguuuuccaacuugguuccauucuccccgucacuuucagguacaacaaucaaacguagguuuggucuuuucacauagucccauauuucuuggaggcuuuguucauucccuuucauucuuuuucucuaaucuuguuuucacacuuuauuucauuaaguugaucuucaaucucugauauccuuucuuccgcuugauugauucagcuauugauacuuguguaugcuucacgaauuucucaugcuguguuuuucagcuccaucaggucauuuauguucuucucuaaacugguuauucuaguuagcaauuccuauaaccuuuuuucaagguucuuaacuuccucuuauuggguuagaacaugcuccuuuagcuuggaggaguuuguuauuacccaccuucugaagccuacuucugucaguuugucagacucauucuccauuccaguuuuguucccuugauggugaggaauugugauccuuugaaggagaagaggugcucugguuuuuggaauuuucagccuuuuugugcugguuuuuccucaucuuuguggauuuaucuaccuuuggucuuugauguuggugaccuugggauaagguuuuuguguggacgucuuuuuuguugauauugaugcuauucguuucuguucguuaguuuuccuuuuaauagucaggccccucugcuucaggucuuuuggacuuugcuggcgguccacuccaaaccguguuugcucgcguaucaccagcagaggcugcagaacagcaaagaacagccuguuccuuccucuggaagcuuugucccagaggggcaccugccggaugccagucagagcucuccuguaugaagugucugucgaccacugcugggaggugucucccagucaggaggcacaggggucagggacccacuugaggaaccauucugucccuuagcagagcucgaaugcugugcugggagaucugcuguucucuucggagcuggcaggcaagaacauuuaagucugcugaagcugcacccacagcugccccuuuccccaggugcucuaucccagggagaugggaguuuuaucuacaagccccugacuggaucugcugccuuucucugagauaugcccugcccagaguggaggaaucuagagagaaagucuggcuacaguggcuuuguggagcugcagugggcucugcucgguucaaacuucccaguggcuuucuuuacacugucaggggaaaaucaucuacucaagccucaguaauggcggaugccccuccccucaacaagcuccagcaucccaggucgacuucagacugcugugcuggcagcaagaauuucaagccaguggaucuuagcuuguugggcuccauggggguggaauccccugagcuagaccacuuggcuuccuggcuucagcccccauuccaggggagugagcaguuacgucucacuggcauuccaggagccacugagguaugaaagaaaccuucugcagguaucucagugucugcccaaauggccgcccaguuuugugcuugaaacccagggcucugguggcauaggcacccaagggacuuuccuggucuguuguuugugaagaccaugggaaaagcauaguaucugggcuggaauguacuguuccucacagcacagucccucaugguuucccuuggcuaggggagggaguuccccaaucccuugcgcucccugggugaggugacgccccacccugcuucagcucgcccucuguaggcugcacccacugucuaaccagucccaaugagauaagcuggguaccucagucggaaaugcagaaaucaccugccuucugcauugaucuugcugggagcugcauacuggagcuguuccuauucagccaucuugcccaggucccccggcauguuuuuuuuuuuuuuuuuuuaauugagauggagucucguuuugcccaggcuggagugcaguggcaugauaucagcucacugcaacaucugccuccuagguucaagcaauucuccugccucagccuccugaguagcugggauuacaggugccugccaccacgccuggcuaauuuuuuuauuuuuaguagagaugggguuucgccauguuggccaggcuggucuugaacgcaugaccccaagugaucugcccaucucagccucccaaaguguugggauuacaagcuucagccaccaagcccggccucuacauggcauuuaaaggugaauuuauuauuuuaaaauagguuauuugcaacuaccccucuuucccacaaaacaucaucugguaagguggcuagacauaagaaccuaagugaauuagaauuacuuucugaaaacucauugaagaucucuguguuaauuggagcuauucagguacaugacuagaauuggaaaucccuggccuguuugaacuuugaaaguucuacauuuuagagaugagagagacauguuuuuauaauguucuacauuucugacccugagugcugauuugggugaauagaccauuggcuuuacccauaggaaccuggcugccugagucagcaacaucugcucucuggagccuacugggaggcugggggugggggaggaagauggucuaggccacugaguggggcagcagagccuggggacuaggaguggugaaaaucagccacauugaacauaugggugucuucucaaggaaaugugacauaugcgagagaaaauggagucuagaagggaugaggaagaggugaucaagggagugagggguucuuggagccaagguucccugauuaaggcuagucagggugggccugcauuuccccaccccaaaugcccgcaauacuccuguagacaacucuuaggaaauucagcacuucauuauacacugcuuccacuggaaaauccugccacguaagcagcuuugggucccagcuagauuggagaugaucaguaaggaacccuaaugcuaccaacacaagacaacuaagaaaagugcaaauauucaugaaaaucguugccaacuguuuuguaauccucaccacaauccugcaagguggacagcagcauccucaccacuuuucagacagguaaacaaaggcucagaaaggaaacaguaccugguuggaaucagcacugaagcuucagcuaccugccugcagagaugugcucaucuagcaguuucuaggagacuaggcuggcggcagugccugcucugauaagggaggaggaggggagaggcuugcugugguggcuuguagggggugugugugugugugugugugugugugugugugugucuauuuguggggucauuuccagggcuacaugugaguuuaaguguguguauauggguugagauaugguguauauggauauuugucggucaguucuuggaaaguguguauaugaguguguguugagugggguugggggguuagucccugagccgugugaauauguggaugggggcacucgugagggcaaaugggcucggauuuugugcaugauugugugugugugugugugugugugagcuugagauuccaaguaugugggggagggagggggcggugucggagaucaaucccugggccauguguuuauagugugugugucugcccagaagagaguggguuacugggcugugcacgucuguguagggugaguguguguaugagggugaaugagugugggaggugucauucccugguccguguguaagagugugaccgcgcacgccuucgugugugucccggguguguggggucggggcggugacgaggugagggggacgccggccgagccccgcccuccgcugcaggugggccggccccgcggcggggccggcagcgcuagcuguucuuggcucgcggccgcgccgggcucgcagggcugggcucgggcugcggggcggcgccgggacaggaagcggaaagcagcagugcagcggcggcggcggcggggcucugccucuccaggagcccagcgcaggccgcagagccggggccgcugugagccgagaccgcgggccgcggagcucgggcggccggcgcggaggugagucccgcgagaggccgagcgcugcgcggcggcgguccccggggcagaccguuggcugggagacgcccccaccucggaccccgcgugccccugcgcccuccucccgcauucgccccgccggacuucgaccccggguggccggcucccgccucgggccgggggcucccuccccuccuccggagcgcuccggguagugcuuccucugacuccacucuucuccccaugcguugcgccccuccuggcccugccgugcgaucuccgccgcaccccacuccuuggggucccgggguucccugcucacaccucggacgucccuuucuccccgggcuggccuuuggagugcgccccuucggugcgcgugccggggcggcgggcaggccggcagggaguggccgagcguuggaggcaccgggcggcugcagcagccgugcagggcgggagccgggcgcgcaccgggguucccaccccuggcggggcucgacccgggcgccgccuggcccuucgccaggaaccgggacagagcuggucugugugcacaccucgcucacaaaaaauugagccggcccuggaggccuggggggcgaguccgguugcgccucggagagcgcaacaggcagguaggaguuuacuuucaaaaacgccgggguggagcagaggcg

SEQ ID NO: 13770 - RNA, 783 nt, Homo sapiens
agaugcaaauaauacggcacuccgaacagacacuaaaaacagcucucaucucaaagaacccagugcuuguaucacaguaugagaaauuaaaugcuggggaacaacguuuaaugaaugaagccuuccagccagccagugaucucuuuggacccauuaccuugcauucuccaucagauuggaucaccucccacccugaggcuccccaagacuuugaacaguucuucagugauccuuacagaaagacacccucuccaaacaaacgcagcauuuauauacaguccauugguaaauacugguaaugugcugguuuugguucaguuuugcaguggcgcucuugucaggaauaguccaggcuaugggucugauucagaugggccguuuuaggaucguuuuugauauucauugcggcgguacaaguuuuguagccaaacugacuuaaaagauaacauuuuguuucuuuuuguuucauagcaacaccaaugaaugauaaagguuauugaaaauuuagaguugguuuuguuucuaauuugaaucuucuuacucauagacuggguaaacacugaauaaucaucuuaaagucuguuuuuaaauguucuuccauauuguaggcucucuaggaaacaccagaauuaucagugaagaauauauuaaauggcucacgggcuacuguaaagcauauuucuauggcuugagaguaaaacuccuagaaccaguuccuguuucuguaacaagauguuccuuuagagucaaugagaacacacacaaccuacaaauucaugcagg

SEQ ID NO: 13771 - RNA, 10833 nt, Homo sapiens
guaaacgugcccggaaaugacgccuguaaugcugagacagacucccagaagaucugagcgagucgcguagcugagcccggcaggggcugggguggugcugcugcuaugagcugcaccaucgagaagauccugacagacgccaagacgcugcuggagaggcuacgggagcacgaugcggccgccgagucgcugguggaucagucggcggcgcugcaccggcggguagcagcuaugcgggaggcggggacagcgcuuccggaccaggucaggcagaggguaggaguccagugcucucggauucugggcacugaaggguggagagcgagguaaagugggaacucggccuggaauuuauucccggucucagagggcggcggugagaccauuuuccugggucggggcugagaauccugcccuggagcccuaacuucugccucuucaguugcaucugccgcuguucucuuuaaggcaugcuuagucugucucuauuuguccaguaucaagaggaugcauccgauaugaaggacauguccaaauacaaaccucacauucugcugucccaagagaacacacagauuagagacuugcaacaggaaaacagagguuagucaggccuuuucauaucugguaauaguuuaaaguuauugcaaaauugcccuaaacauuuacaaaaguguacauauauuuccaggucaguacuuuuaguaggagaguccuccugaucuggcccaguaacaauaaaguuuguuagauuacccuuuucaaggucaucugacuaauauugcagcagcuuaccaaagaggugcuguguagaguugguauuauugcaugguuuauuuuuaagcauccucagauguguaacaaaagaguucauagccucauggacuuaaaauuuaauguuuaaguauuaauauaaacacugaagguaagauuuaagguuuuguuuauguucuuguuugugcaaggugaagcagcagaauuuuauucuaaggguauauauucuuaggcuugauuaguacauuauuaaugauugugguauuaauaguuguuuaccagagggguuucacauauaucauucuacuguauucucauaucuucauuuuuaucuaccacaaugcaguuaagaaauaggcucagaagaagcuaaaugauuuacuuaugaguauuaaccaagcaaguuacagaacugaacucaaacacaugucuucugaugauacauccauuguuguuucugcaagacuuugcuucucugccuagaaaguuaccuuucacauagacuuuaacuguucaguuuugcggacuuaaacauugauuuacaacuuuagauucauauuaucuauauaguguuacaaaauuccaacuguuaagacuuuggauuugggaacugucucucagacaucacugccaaguucuuuuauuuuuugacagagcuauggauuuccuuggaggaacaccaggaugcuuuggaacuuaucaugagcaaauaucggaaacagauguuacaguuaaugguugcuaaaaaagcgguggaugcugaaccaguccugaaagcucaccagucucacucugcaguaagaaacuuugaauaaauucgaaaugaaccaaauugaaaucuugagauuguuuuagauugugugcuuguuuuuuugcuuugugagauagggucuggcucuugucgaccaggccgugguguaauggcacgaucucggcucacugcaaccucugccuccugggcucaagccaucgucucaccucugccuccggagcagcugggacuacaggugcacaccaccacgcccuguuaauuuuugugggguuguuuguuuguuuguuuguuuguuuguuuuuugguagagaugacauuucgccauguugcccaggcuggucugaaacuccugggcucaagcgauccacccacguuagccuuccaaagugcugggauuauaggcaugaaccacugcgccuggccaugugugcuuguuuuugaagaaaaguaagcucauuuuccuuucauguuuaucacauuuguuguuuauuuugccauggcuuuguaaagauaugaauagaaagaaggaggauaggggcugcucagauccuuuuauuugagugggacuaagguucccccucccucaccaagaucucuuuugaaaauguucauuaauucuuagcgcucccaccaaacauaaugccaguuaguguugaagcugccugguaaacacuugguugguuauuacuuauacauuuaacuuaagcuccuugcuuguaaggcgcaugaauucacauuuuauuccuaacauaguaccugacauacagcaggcagucaguaaaccuuuuauaaacugaaccacauaguaucauacuauguuguuaggggagagaaguaugguuuuuuaaaaaaacaaacauggcauaguuucuguucuuugcuaauuugggagacucaguaauuguucuuauguuuauaggugcuucaugguugucauuguacauucuuguguacuguaucauuuaauucuagauguauaggguuggagccuacuacuucugugagauguagugaaauauaagcuucaucuuaaauuccauugaaugcauuuuacugacuuaaaaguuuuaggaaacagauauuuuaaauauuugaauggcuuucaucuggaagagaaaaauagauuuucuucucguauggaggaaaaaacuugaaccuugaaagagacagaguuuacucagauagauaaacuuucuaagugauauguccaaagauggaauaaagcaccuuggaauguaguaagcuuccugccaguaaaaguauucaaauuuaaguuaaacagccacuuagagauaguauccaacauccaauggguaguuaaacuacaauugauuuuuuuuuuccauuucaaaucuuuuuauuggaguguggaccuacugggggauugaugcacuggacauagauaauuuucagaaaugaaaauaacauugcuugcaucgaaucagauuucacccacaaaaaugacuaaggccuuaccagaguuggcauuggaugaaaccuuaguccuuuauggaaagggaaucauguggccuucuauuucugaaauagacuaaagauuacucauuuauucucugcaauuacagccaucagauccuuugaaaucuuggaaggcaugagaugaugacaugaguguaacacaaauccauauugaagagcccaguauuuuaaaauuccccauguucacauaccaaaggguuacuuaugagcugaugcauaucacagauaaccauaugauuaucaacuugaugucugggcaaagagcgaaaacagaaaaugcauucuacucuucacuucuugguuuuaaauauaagaaacauuauauauauuuuaaaaaacuguauuccuuaguagugguaucaauagaacauauacaacuggaaugaggauccccuuaaggaggccuuuuuuuuguuuguuuuuuaaauaaguucuaggguacaugugcaaaacgugcagguuuguuaacauauguauacaugugccaugauggugugcugcacccauuaacucguccuuuacauuagguauuccuccuaaugcuauccguccccacucccccaacccuaugacaggccccggugugugauguuccccacccuguguccaaguguucucauuguucaauucccaccuaugagugagaacaugcgguguuugguuuucugucuuugugauaguuugcucagaaugaugguuuccagcuucauccaugucccuacaaaggacaugaacucauccuuuuuuauggcugcauaguauuccaugguauauaugugccacauuuucuuaauccagucuaucauugauggacauuuggguugguuccaagucuuugcuauugugaauagugccgcaauaaacaugugugcaugugucuuuauaguagcaugauuuacaauccuuuggguauauacccaguaaugggauugcugggucaaaugguauuucuaguucuagauccuugaggaaucaccacacugucuuccacaauugauuuuuugaaagaaaaaaaaaaaaauauccgugaauacaaggucacuuuacuauggcuucaugucugaggacuaaaauuguagggaaacuccauuguaacuucuguaucauagauuaaaugaacuuuuaaaaaucguaaugcacaugcuuuuacguucuuuauaucuacagaacaggugauuuuuccaccuuuguuuccuuaauaucuucacaggaaauugagagucagauugacagaaucugugaaaugggagaagugaugaggaaagcaguucagguggaugaugaccaguuuuguaagauucaggaaaaauuagcccaauuagagguaagauuguagcuaauuuagguucacaguauuucauaguuuuccgagucuggaagauaugccaucacuaucccaucacuguaauauauugauguuuucugugugcucaugauuuaaaauuaaaacuccuccuucauacccuuuuauacccuuuugaagaaaggaaauauaguaaacagcaaucaauggaaauaccaacuauguauuggcaagaacuugagguauuaucauaugggaagguagagggaguggaggggagaaguuauaugugagauaaaauccuucaucugccauaauaagaagugaaguagauaaugucuaaaauugaugaucaggaaauagcaguauaagcauauuauuuagaauuacagaauuaaauaccaaaagaaauagauaaaaguguuaaaagugguugcauuugggguacaaagccaaagaacugcuuguauaagccuuguagucuugauuucuuaaaagcuauguuuaugucauauuuugauuagaauaggaauauguuacaaaaaaaguucgggguauuagugugcucauaaaauuguuaaggaaaaacauuucaacuuugagaggcugagguaagugaauugcuugagcccaagaguucaagagcagcuugggcaacauggcggaacccugucuuuacaaaaaauacagaaaauuagccaggugugguggugcacaccuguaaucccagguacucagaggcugaggugugaggaucaccugaaccugggaagucaaggcugcagugagccacgaucaugcaugccacugcacuccaaccgagugacagagugagacccugucucaaaaaaaaaaaaaaaaaagcaaagcauuucagugaaugguuugaaugcugcuuauuacaaggugcuguccuggggccuuugagaaauaccagagagaaaaaaacagauaccugcccagagucuaguggaagggauaacccuaguauuauaugauauuaaauaauauguaaaugcuaggagacagauacaaauaccgaaggaagcacuucaugugguagaagauucgucgaccacaggcucuaaucucuuaguuacucuagcugggacuuccgcacaucuuggugaagcuaaaaaugcuuugguuuaccagaguuuucugcagaggauaaggaugaagagcagaagcuacccucucuagaaaucaaagguagugacaggucccaaguaggaauuaggagcuagugaaaugauagcaugaccuucuauuuauccccgauuuaccucacuuacggaaacagcccuaaggaaauguggggcaaauucuaccuuaauacuucaaguagaaaauacacgaccaccagauucagaccccagcaauaccacauccaaguugucugaauuuggacaacuuuuaggaauuuugugagccagaguauccucaucugaaauauauggauguaggcaaugauaccuacccuacagauuauugugagauaacauauacagggcacccaaguaguacccagcuacaugcucaauaaguaauuucuuucccccuuuccuuccauuucucuagaacuguaagauauccaggagaggagauuaaucagagugaaacgauuauuaggaauuuuuuaaauaaaagaaauaauaguaaaacugugggaaccaagaagaauauaacagugaauuccuuaaauggagaggaccuuguuuuuuguuucuccuuuguaauccuaacacuugguauauagaaauuacucaguaaauuacuacuacaaaagaguaucauugccuacauccuacauguaaauguuuguuaaaugaauaaaguaguauuuaaggaaauucucaacuaguggauuuuuuguuuccauaaauuuuuuaaaauuaaaauaauguuuucugcuccuggcucaaaauaauguguuguuguaaugcaguuggacaguaaaaauaccagaaauaaacaugccuuuuuuuuuccagcuugaaaauaaggaacuucgagaauuauuguccaucagcagugagucucuucaagccagaaaggaaaacucaauggacacugcuucccaagccaucaaauaacugaacucugaaugauggcuggagauugucuaucaaggaaggaaguuacugucuucccauucaaguacuguccauuaagugucuugccucagauuugauuuaaucuuaauuaaagguaucagguggcaauuuagaauuccagucaauauuggcuguccacaguucucagauguguuaaugugaauacuacaugcugaauuucaccauuccuuucucaaagagacuacuuuuaauuuucauuucugggaccuugauuuauauaaacuauguuuucaguucuuuguuauuuuucacaucucugaaacuuugagcauuuuuuauaagccagcaauuuauuuuacauagcauuguaaaauacacuucuaggaaauuuuaggaaagauuuaacuguuuaaaucuauuuggcauaaaccuugauuuuuuuuuuccauuugacaaaaauaauacaauuccacagaacuagaucagcagauucucugauuuguaaugucauucaccugugacauuuuaagucucucuggugcuaagaauuggcacuuuauagccuggugccuuuacuuuuaauuugagagaaccuacugcuagucccaggaaacacacuuggaaauaagucagcuauuuuuuuugcccagugaugcuauaguugucauauuguccaaaguucauauuguucaaagcugaggagcuuguccuguguaugugaaugcacacaugugcacuuaguucaaauacuaaaaguagcuuuuauuaaauauaaucagccaaaaacacacacaaaauaaaaaaaacaaauauaaguagucaguuuuucaauguuauccuacuaguucuacauucuauuuuaauuuuuauacaauuuccauuuuauaguuaagaaccaucacuuacuuggauuggaugucuuucauuccuagcacuaauaguuggcuuucuuuuuuuuuguuuacauagaagcaggguuuuuuuuuaucuuuuuucuuuuuuuuuguuuaagcuauauaaaaaggugaggaagcaguuuuguuaccuaaugaaaauuauuacacucauaaugcuguguaggcaacauugagauucaaaugcccaguggucaacuggguucacucaucaacucauucccgucccaguuuacucacauuucaaauuuauaaauuucuucauguuauacuauucuauuuagauuugcccagaauuaguugaaauaaugcuaaaccugucaauauuuuccaguaacauuaagcaccauacugcaugggagagacacaguacuaaaaagaguuguuagugcuuuaugugagugauauuucuuucguaaugcuauaaagaacuacaguuaaaauaacaaaauauuuuaaagauguccuaaaagcaucugaucccaguaauaacuaauggaugucaucuagagcaguggguguuaaugaauagguauaugucauuuaagaauuuuucaaauuucuguuugauauccugcauagaauuugacaaaaaaaacacuuccaagugugagcauuuuuuauuucauuucccaagaguaaguaaguaacuauuagcccagccaucugccucgaaguauaccuuaagugaccccauaaauccauucaagaggcagguacucuauaccauuuggcagccacggccaaaccuaccauggccagauuucagugaaaaugaugaaguaaucaaaucaagguauaauauggugucccuuuaugugcuuuauguuccuuuagagcuguuuauaaaguucuuuauaucucaaguguuaggauaaaucgacauacuaacuuuucccccugcaaaauuaaaagccugagguacaagucuaagaagcuuuuagugcucuacauaauauaaauucuggcugguguuaaugcuaugaagauaauauguaguuagaaaauugagucggggaggaaugcucuucauuuuaaguggauuuuaaaguuucuccuugaguggaugaagaacuugccugguuugcaaaaaucuuaguucaaaauuauauuuucuaacaaaaacugcauuuugagaagauaagcuaauuuuacucaguaguaagucaaaugaggaagugcagaggguuuuuuuacauauauauagcaaccuugucaagugguccucacaagagucauaaauacuuuguaauuagcacaguauauucagcaguguauaacucuacaaauaguaccuuauauuaguguaguauuauaucaauaucuuauguauaauucuuauauuaauaccuuaugcauaauuggauucaaacauugaaggucuauuuuaguguucuucaaaaugugcuucccugaccuacugaaauagaaacuuggugaugaaguucaagaauuuguauucuaaucaucucaaacaauuccuaaagacacugauuuuaaaauaucuagucuaggccccauuguguaauaguuagcacucuaaaagaugaaaaagaaaauagucuaugugccaaccacuucauuaguacuuaugaauuuaaaaaugaaaaagucugguacaggagacaaguauauauauaaaauuauaaugcagugugauaaauccauuauaguauguauaagauacagaagagggacuuuaaacuugagaauucaauagagauaauaaauggguaggagggaaauagaaaacuuuggugccacaaaagcaaaguauguaugguauugccaauaauagcuaccaucuauugagugcuuuacuaccugucagguacuguauuauauaaacuccauuuuaacuguaccucauuuugcagauacucaggcacaaggaggugguuauuuguccaaacuggaaccaagauucaaacccagacagagucuuaagcacauuuuuaaucacuaacuaacuugagaugccuaaaugccaaauacuguugggaguucaagugguucuugauuagcaaaaucuauuuuuauuagugcaaaagaaacaccacagcuuauaaaguauuaugaauucaauaaauggagucuuaacuaaugagauauuauuuucuagaaugguguagcugagaguaugugugauucaacugaaaggaauaauguuuaaucagugacucuuacuauauacaggaaaaggugcaguucugucuuucaaaucugccuccuuaccauauuggcuuacaucccucaugcuguuuucuuguguuugcuagaaaguuguugccaagccaaaugucauggccauguugaaggcaaggaagaaaaaauggaaauggccugugccagcuauauauaucgccuuuuaugagggaaagcaaagcuuucucagaaaucccaaauggauuuucccuugacuuaauugccugaccaguuaaauggccacugguaccugcaaagaaagcaggguacauagcugucccaaauaaaaucaguauuagcaagaagaaagaauauugagaaagcaauuaacagugucugugacugugacaugucugugacuuuauauugucaaguccuuuccccuugaauauaguuuuggaagaauuagcugaaggaguguguugacauugaauggccaagagaaugggcuguagcagacaucugucauuucucuuuuggcugcccaguauccuaacuccuguguuuaaggaaucccucaccuaaugaggcagagcauuucuuccuccuaaagaauuugaaaguaccagguaauguuuucucagccuccuuuugcagcuaaggaagaaacaucugccuucaauuuuaaaauuagugauacaaagaaggagggaaccaugcagauuccuuugaagauggugauuaacaacacuacugcauucaucuccacagagguacagcaaaagugauuuaguuagcgauaaccucuaauucuauuuuuuuauuuuuauuuuuugagacagucuugcucugucaaccaggcuggagugcaguagcacugucuuaacucacugcaaccuccaccuccuggguucaagcgauucuccugccucagccucccaagucgcugggauuacaagugcccaccaccaugcacagcuaauuuuuguguuuuuaguagaugggguuucuccauguuggccaggcuggucucgaacuuaugacuucaggugauccgcccgccuuggccucccaaagugcugggauuauaggcgugagccacugugccuggccuguaaccucuaauucuuguuugcuggcuguccuagagauccugagaauuacuuuuaauaaaaucauuuuuuugcuguuauuaaaacuaaccugaauugccuaaaaccaagaacucugcuugauaaaauaagcauaguuuuaggaacagccaugcagauauaaauuuuaucaacacuuuauacauaauuugggacuuauauuuaaauguaauauuugaugcuuauaaaaggguaaaug

SEQ ID NO: 13772 - RNA, 10833 nt, Homo sapiens
cauuuacccuuuuauaagcaucaaauauuacauuuaaauauaagucccaaauuauguauaaaguguugauaaaauuuauaucugcauggcuguuccuaaaacuaugcuuauuuuaucaagcagaguucuugguuuuaggcaauucagguuaguuuuaauaacagcaaaaaaaugauuuuauuaaaaguaauucucaggaucucuaggacagccagcaaacaagaauuagagguuacaggccaggcacaguggcucacgccuauaaucccagcacuuugggaggccaaggcgggcggaucaccugaagucauaaguucgagaccagccuggccaacauggagaaaccccaucuacuaaaaacacaaaaauuagcugugcaugguggugggcacuuguaaucccagcgacuugggaggcugaggcaggagaaucgcuugaacccaggagguggagguugcagugaguuaagacagugcuacugcacuccagccugguugacagagcaagacugucucaaaaaauaaaaauaaaaaaauagaauuagagguuaucgcuaacuaaaucacuuuugcuguaccucuguggagaugaaugcaguaguguuguuaaucaccaucuucaaaggaaucugcaugguucccuccuucuuuguaucacuaauuuuaaaauugaaggcagauguuucuuccuuagcugcaaaaggaggcugagaaaacauuaccugguacuuucaaauucuuuaggaggaagaaaugcucugccucauuaggugagggauuccuuaaacacaggaguuaggauacugggcagccaaaagagaaaugacagaugucugcuacagcccauucucuuggccauucaaugucaacacacuccuucagcuaauucuuccaaaacuauauucaaggggaaaggacuugacaauauaaagucacagacaugucacagucacagacacuguuaauugcuuucucaauauucuuucuucuugcuaauacugauuuuauuugggacagcuauguacccugcuuucuuugcagguaccaguggccauuuaacuggucaggcaauuaagucaagggaaaauccauuugggauuucugagaaagcuuugcuuucccucauaaaaggcgauauauauagcuggcacaggccauuuccauuuuuucuuccuugccuucaacauggccaugacauuuggcuuggcaacaacuuucuagcaaacacaagaaaacagcaugagggauguaagccaauaugguaaggaggcagauuugaaagacagaacugcaccuuuuccuguauauaguaagagucacugauuaaacauuauuccuuucaguugaaucacacauacucucagcuacaccauucuagaaaauaauaucucauuaguuaagacuccauuuauugaauucauaauacuuuauaagcugugguguuucuuuugcacuaauaaaaauagauuuugcuaaucaagaaccacuugaacucccaacaguauuuggcauuuaggcaucucaaguuaguuagugauuaaaaaugugcuuaagacucugucuggguuugaaucuugguuccaguuuggacaaauaaccaccuccuugugccugaguaucugcaaaaugagguacaguuaaaauggaguuuauauaauacaguaccugacagguaguaaagcacucaauagaugguagcuauuauuggcaauaccauacauacuuugcuuuuguggcaccaaaguuuucuauuucccuccuacccauuuauuaucucuauugaauucucaaguuuaaagucccucuucuguaucuuauacauacuauaauggauuuaucacacugcauuauaauuuuauauauauacuugucuccuguaccagacuuuuucauuuuuaaauucauaaguacuaaugaagugguuggcacauagacuauuuucuuuuucaucuuuuagagugcuaacuauuacacaauggggccuagacuagauauuuuaaaaucagugucuuuaggaauuguuugagaugauuagaauacaaauucuugaacuucaucaccaaguuucuauuucaguaggucagggaagcacauuuugaagaacacuaaaauagaccuucaauguuugaauccaauuaugcauaagguauuaauauaagaauuauacauaagauauugauauaauacuacacuaauauaagguacuauuuguagaguuauacacugcugaauauacugugcuaauuacaaaguauuuaugacucuugugaggaccacuugacaagguugcuauauauauguaaaaaaacccucugcacuuccucauuugacuuacuacugaguaaaauuagcuuaucuucucaaaaugcaguuuuuguuagaaaauauaauuuugaacuaagauuuuugcaaaccaggcaaguucuucauccacucaaggagaaacuuuaaaauccacuuaaaaugaagagcauuccuccccgacucaauuuucuaacuacauauuaucuucauagcauuaacaccagccagaauuuauauuauguagagcacuaaaagcuucuuagacuuguaccucaggcuuuuaauuuugcagggggaaaaguuaguaugucgauuuauccuaacacuugagauauaaagaacuuuauaaacagcucuaaaggaacauaaagcacauaaagggacaccauauuauaccuugauuugauuacuucaucauuuucacugaaaucuggccaugguagguuuggccguggcugccaaaugguauagaguaccugccucuugaauggauuuauggggucacuuaagguauacuucgaggcagauggcugggcuaauaguuacuuacuuacucuugggaaaugaaauaaaaaaugcucacacuuggaaguguuuuuuuugucaaauucuaugcaggauaucaaacagaaauuugaaaaauucuuaaaugacauauaccuauucauuaacacccacugcucuagaugacauccauuaguuauuacugggaucagaugcuuuuaggacaucuuuaaaauauuuuguuauuuuaacuguaguucuuuauagcauuacgaaagaaauaucacucacauaaagcacuaacaacucuuuuuaguacugugucucucccaugcaguauggugcuuaauguuacuggaaaauauugacagguuuagcauuauuucaacuaauucugggcaaaucuaaauagaauaguauaacaugaagaaauuuauaaauuugaaaugugaguaaacugggacgggaaugaguugaugagugaacccaguugaccacugggcauuugaaucucaauguugccuacacagcauuaugaguguaauaauuuucauuagguaacaaaacugcuuccucaccuuuuuauauagcuuaaacaaaaaaaaagaaaaaagauaaaaaaaaacccugcuucuauguaaacaaaaaaaaagaaagccaacuauuagugcuaggaaugaaagacauccaauccaaguaagugaugguucuuaacuauaaaauggaaauuguauaaaaauuaaaauagaauguagaacuaguaggauaacauugaaaaacugacuacuuauauuuguuuuuuuuauuuuguguguguuuuuggcugauuauauuuaauaaaagcuacuuuuaguauuugaacuaagugcacaugugugcauucacauacacaggacaagcuccucagcuuugaacaauaugaacuuuggacaauaugacaacuauagcaucacugggcaaaaaaaauagcugacuuauuuccaaguguguuuccugggacuagcaguagguucucucaaauuaaaaguaaaggcaccaggcuauaaagugccaauucuuagcaccagagagacuuaaaaugucacaggugaaugacauuacaaaucagagaaucugcugaucuaguucuguggaauuguauuauuuuugucaaauggaaaaaaaaaaucaagguuuaugccaaauagauuuaaacaguuaaaucuuuccuaaaauuuccuagaaguguauuuuacaaugcuauguaaaauaaauugcuggcuuauaaaaaaugcucaaaguuucagagaugugaaaaauaacaaagaacugaaaacauaguuuauauaaaucaaggucccagaaaugaaaauuaaaaguagucucuuugagaaaggaauggugaaauucagcauguaguauucacauuaacacaucugagaacuguggacagccaauauugacuggaauucuaaauugccaccugauaccuuuaauuaagauuaaaucaaaucugaggcaagacacuuaauggacaguacuugaaugggaagacaguaacuuccuuccuugauagacaaucuccagccaucauucagaguucaguuauuugauggcuugggaagcaguguccauugaguuuuccuuucuggcuugaagagacucacugcugauggacaauaauucucgaaguuccuuauuuucaagcuggaaaaaaaaaggcauguuuauuucugguauuuuuacuguccaacugcauuacaacaacacauuauuuugagccaggagcagaaaacauuauuuuaauuuuaaaaaauuuauggaaacaaaaaauccacuaguugagaauuuccuuaaauacuacuuuauucauuuaacaaacauuuacauguaggauguaggcaaugauacucuuuuguaguaguaauuuacugaguaauuucuauauaccaaguguuaggauuacaaaggagaaacaaaaaacaagguccucuccauuuaaggaauucacuguuauauucuucuugguucccacaguuuuacuauuauuucuuuuauuuaaaaaauuccuaauaaucguuucacucugauuaaucuccucuccuggauaucuuacaguucuagagaaauggaaggaaagggggaaagaaauuacuuauugagcauguagcuggguacuacuugggugcccuguauauguuaucucacaauaaucuguaggguagguaucauugccuacauccauauauuucagaugaggauacucuggcucacaaaauuccuaaaaguuguccaaauucagacaacuuggaugugguauugcuggggucugaaucugguggucguguauuuucuacuugaaguauuaagguagaauuugccccacauuuccuuagggcuguuuccguaagugagguaaaucggggauaaauagaaggucaugcuaucauuucacuagcuccuaauuccuacuugggaccugucacuaccuuugauuucuagagaggguagcuucugcucuucauccuuauccucugcagaaaacucugguaaaccaaagcauuuuuagcuucaccaagaugugcggaagucccagcuagaguaacuaagagauuagagccuguggucgacgaaucuucuaccacaugaagugcuuccuucgguauuuguaucugucuccuagcauuuacauauuauuuaauaucauauaauacuaggguuaucccuuccacuagacucugggcagguaucuguuuuuuucucucugguauuucucaaaggccccaggacagcaccuuguaauaagcagcauucaaaccauucacugaaaugcuuugcuuuuuuuuuuuuuuuuuugagacagggucucacucugucacucgguuggagugcaguggcaugcaugaucguggcucacugcagccuugacuucccagguucaggugauccucacaccucagccucugaguaccugggauuacaggugugcaccaccacaccuggcuaauuuucuguauuuuuuguaaagacaggguuccgccauguugcccaagcugcucuugaacucuugggcucaagcaauucacuuaccucagccucucaaaguugaaauguuuuuccuuaacaauuuuaugagcacacuaauaccccgaacuuuuuuuguaacauauuccuauucuaaucaaaauaugacauaaacauagcuuuuaagaaaucaagacuacaaggcuuauacaagcaguucuuuggcuuuguaccccaaaugcaaccacuuuuaacacuuuuaucuauuucuuuugguauuuaauucuguaauucuaaauaauaugcuuauacugcuauuuccugaucaucaauuuuagacauuaucuacuucacuucuuauuauggcagaugaaggauuuuaucucacauauaacuucuccccuccacucccucuaccuucccauaugauaauaccucaaguucuugccaauacauaguugguauuuccauugauugcuguuuacuauauuuccuuucuucaaaaggguauaaaaggguaugaaggaggaguuuuaauuuuaaaucaugagcacacagaaaacaucaauauauuacagugaugggauagugauggcauaucuuccagacucggaaaacuaugaaauacugugaaccuaaauuagcuacaaucuuaccucuaauugggcuaauuuuuccugaaucuuacaaaacuggucaucauccaccugaacugcuuuccucaucacuucucccauuucacagauucugucaaucugacucucaauuuccugugaagauauuaaggaaacaaagguggaaaaaucaccuguucuguagauauaaagaacguaaaagcaugugcauuacgauuuuuaaaaguucauuuaaucuaugauacagaaguuacaauggaguuucccuacaauuuuaguccucagacaugaagccauaguaaagugaccuuguauucacggauauuuuuuuuuuuuucuuucaaaaaaucaauuguggaagacaguguggugauuccucaaggaucuagaacuagaaauaccauuugacccagcaaucccauuacuggguauauacccaaaggauuguaaaucaugcuacuauaaagacacaugcacacauguuuauugcggcacuauucacaauagcaaagacuuggaaccaacccaaauguccaucaaugauagacuggauuaagaaaauguggcacauauauaccauggaauacuaugcagccauaaaaaaggaugaguucauguccuuuguagggacauggaugaagcuggaaaccaucauucugagcaaacuaucacaaagacagaaaaccaaacaccgcauguucucacucauaggugggaauugaacaaugagaacacuuggacacaggguggggaacaucacacaccggggccugucauaggguugggggaguggggacggauagcauuaggaggaauaccuaauguaaaggacgaguuaaugggugcagcacaccaucauggcacauguauacauauguuaacaaaccugcacguuuugcacauguacccuagaacuuauuuaaaaaacaaacaaaaaaaaggccuccuuaaggggauccucauuccaguuguauauguucuauugauaccacuacuaaggaauacaguuuuuuaaaauauauauaauguuucuuauauuuaaaaccaagaagugaagaguagaaugcauuuucuguuuucgcucuuugcccagacaucaaguugauaaucauaugguuaucugugauaugcaucagcucauaaguaacccuuugguaugugaacauggggaauuuuaaaauacugggcucuucaauauggauuuguguuacacucaugucaucaucucaugccuuccaagauuucaaaggaucugauggcuguaauugcagagaauaaaugaguaaucuuuagucuauuucagaaauagaaggccacaugauucccuuuccauaaaggacuaagguuucauccaaugccaacucugguaaggccuuagucauuuuugugggugaaaucugauucgaugcaagcaauguuauuuucauuucugaaaauuaucuauguccagugcaucaaucccccaguagguccacacuccaauaaaaagauuugaaauggaaaaaaaaaaucaauuguaguuuaacuacccauuggauguuggauacuaucucuaaguggcuguuuaacuuaaauuugaauacuuuuacuggcaggaagcuuacuacauuccaaggugcuuuauuccaucuuuggacauaucacuuagaaaguuuaucuaucugaguaaacucugucucuuucaagguucaaguuuuuuccuccauacgagaagaaaaucuauuuuucucuuccagaugaaagccauucaaauauuuaaaauaucuguuuccuaaaacuuuuaagucaguaaaaugcauucaauggaauuuaagaugaagcuuauauuucacuacaucucacagaaguaguaggcuccaacccuauacaucuagaauuaaaugauacaguacacaagaauguacaaugacaaccaugaagcaccuauaaacauaagaacaauuacugagucucccaaauuagcaaagaacagaaacuaugccauguuuguuuuuuuaaaaaaccauacuucucuccccuaacaacauaguaugauacuaugugguucaguuuauaaaagguuuacugacugccugcuguaugucagguacuauguuaggaauaaaaugugaauucaugcgccuuacaagcaaggagcuuaaguuaaauguauaaguaauaaccaaccaaguguuuaccaggcagcuucaacacuaacuggcauuauguuuggugggagcgcuaagaauuaaugaacauuuucaaaagagaucuuggugagggagggggaaccuuagucccacucaaauaaaaggaucugagcagccccuauccuccuucuuucuauucauaucuuuacaaagccauggcaaaauaaacaacaaaugugauaaacaugaaaggaaaaugagcuuacuuuucuucaaaaacaagcacacauggccaggcgcagugguucaugccuauaaucccagcacuuuggaaggcuaacguggguggaucgcuugagcccaggaguuucagaccagccugggcaacauggcgaaaugucaucucuaccaaaaaacaaacaaacaaacaaacaaacaaacaaccccacaaaaauuaacagggcgugguggugugcaccuguagucccagcugcuccggaggcagaggugagacgauggcuugagcccaggaggcagagguugcagugagccgagaucgugccauuacaccacggccuggucgacaagagccagacccuaucucacaaagcaaaaaaacaagcacacaaucuaaaacaaucucaagauuucaauuugguucauuucgaauuuauucaaaguuucuuacugcagagugagacuggugagcuuucaggacugguucagcauccaccgcuuuuuuagcaaccauuaacuguaacaucuguuuccgauauuugcucaugauaaguuccaaagcauccugguguuccuccaaggaaauccauagcucugucaaaaaauaaaagaacuuggcagugaugucugagagacaguucccaaauccaaagucuuaacaguuggaauuuuguaacacuauauagauaauaugaaucuaaaguuguaaaucaauguuuaaguccgcaaaacugaacaguuaaagucuaugugaaagguaacuuucuaggcagagaagcaaagucuugcagaaacaacaauggauguaucaucagaagacauguguuugaguucaguucuguaacuugcuugguuaauacucauaaguaaaucauuuagcuucuucugagccuauuucuuaacugcauugugguagauaaaaaugaagauaugagaauacaguagaaugauauaugugaaaccccucugguaaacaacuauuaauaccacaaucauuaauaauguacuaaucaagccuaagaauauauacccuuagaauaaaauucugcugcuucaccuugcacaaacaagaacauaaacaaaaccuuaaaucuuaccuucaguguuuauauuaauacuuaaacauuaaauuuuaaguccaugaggcuaugaacucuuuuguuacacaucugaggaugcuuaaaaauaaaccaugcaauaauaccaacucuacacagcaccucuuugguaagcugcugcaauauuagucagaugaccuugaaaaggguaaucuaacaaacuuuauuguuacugggccagaucaggaggacucuccuacuaaaaguacugaccuggaaauauauguacacuuuuguaaauguuuagggcaauuuugcaauaacuuuaaacuauuaccagauaugaaaaggccugacuaaccucuguuuuccuguugcaagucucuaaucuguguguucucuugggacagcagaaugugagguuuguauuuggacauguccuucauaucggaugcauccucuugauacuggacaaauagagacagacuaagcaugccuuaaagagaacagcggcagaugcaacugaagaggcagaaguuagggcuccagggcaggauucucagccccgacccaggaaaauggucucaccgccgcccucugagaccgggaauaaauuccaggccgaguucccacuuuaccucgcucuccacccuucagugcccagaauccgagagcacuggacuccuacccucugccugaccugguccggaagcgcuguccccgccucccgcauagcugcuacccgccggugcagcgccgccgacugauccaccagcgacucggcggccgcaucgugcucccguagccucuccagcagcgucuuggcgucugucaggaucuucucgauggugcagcucauagcagcagcaccaccccagccccugccgggcucagcuacgcgacucgcucagaucuucugggagucugucucagcauuacaggcgucauuuccgggcacguuuac

SEQ ID NO: 13773 - RNA, 12404 nt, Homo sapiens
cgggucugggugcggccugccgcaugacucgugguucggaggcccacguggccggggcggggacucaggcgccuggggcgccgacugauuacguagcgggcggggccggaagugccgcuccuuggugggggcuguucauggcgguuccggggucuccaacauuuuucccggcugugguccuaaaucuguccaaagcagaggcaguggagcuugagguaaguuuaucucaugcauaguguucggcuuugggcuguggaauguucaggcguuucacugaugccagaaauggagcagaaucuaucagcuggagacaaaggccuugggcggggguccuuccauuuggugccuacguggggagaucuuuggagacagaagggagaaugggaaggaguugcggccuggaggcuuccugcuagagcugagaagccuucggggaguaauaggaagggggauuuccauugcuuaggcugagggcggggcccaaggacuguugaaaaauagcuaaggauggggguugcuagaaaacuacuccagaagugugaggccgauauuaauccgguguuuuugcguucucuagucacuuuaagaaccaaauggaaggucacacuaggguuuucauuuccauugauuauagaaagcuuuaaaguacuguagauguggcucgccaauuaacccugauuacugguuuccaacagguucuugcuggugugaaaugacugaguacaaacugguggugguuggagcaggugguguugggaaaagcgcacugacaauccagcuaauccagaaccacuuuguagaugaauaugaucccaccauagaggugaggcccagugguagcccgcugaccugauccugucucucacuugucggaucaucuuuacccauauucuguauuaaaggaauaagaggagagaaaguaaaaaguuauuuuggguauacauucaguuaugcaauaagcuuaacguguuuauagagaacaguucauuuuuauuagcugcugaaguuucuaaaaccuguccaguuuuuaacaguucuguaaacuauugcaaacucaguguugaguucauucaugaguuucuucauauauaacagcucuauuacaugagaaacacaggccauaguagcgagacugucugauuguaugggagauaauaggauggagauaaaggauucagagaugaguguucuucaauauuuauuuauuagcuaguugaagcagcugagaccagaugauuggaguagcaagaacuugagauuuuuagucuuuaugccuaggauuuuggucccuguuugcaguuuauuuaguugugugauauugagcaacugaaucucucccaaccucauuuuccucauguuuuaaauuaccauaaacuuguccugccuaccacacagggauguuauggaaaguuaaauaauauauuuaaguuauuuaugaaugguaaagcacuauguaauaguacuuagggauucuauuguuauuaugagaguucaugguacagauugucuucaguaaguggcaccuaaggcucuuuaaauaaaggguuuugccggacacgguggcucacgccuguaaucccagcacuuugggaggcugaggcaggcggaucacaaggucaggaguucaagaccagccugaucaacauggugaaaccccgucucuacuaaaaauacaaaaauuagcugggugugguggcaggcaccuguaaucccagcuacucaggaggcugaggcaggagaaucgcuugaaccagaggcagagggugcagugagccgagaucacaccacagaccuccagccugggcaacagagcgagacuucgucucaaaaaauaaauaaauagauaaauaaauaaaggguuuuguaauuuuguucaguuuagaaaugccuaacuuuagagauuauuuuaaucaacaccuggccucccuaccaucuggcuacucguguuuaauugaugaaaacuaacucuaauguagccacuauaaaaaauugguugcuaacccuuggcaaaaucuuuauuuugagcuuaacagcuuuaauauuuuacaugaaauguuuaauauuuuaauuaaauauuuuuaaauguuugauuuauugagcaauuuacauaaguaaaauacauaaauuuuaugucuacagcccagugcuuuuugcguuucuauauagucauguagcuaccacccagauaacaguauagagcacuuccaguacuccagagaguucuccaagugugaugacauuaaaauacaaguaaaaguccuguugccauaaaaccaaaaugaaaguauuuuuuauaugaucuaugcauguuugucuuccugagaaauuaaacauaacuauaccuuguuuggaaccuuuaagaauuugauucaggaauauuucccaaagguacaucugucaugauaaaaaaaaaaccuucucugaaacaaagguauuuguauauuuagucauaaacacaaaugauguauauagggccagguuauaauugguggagguauguuuagauuucuuuaaguaaaauaaacagcacaaauaaaacaguccaguucauagcuuagugaaauacacuggguacuuaaucuguagccuccuggcugcaguagaguugucauuugaguuacuguguuuucuuaaucuuuuccaggaacacagugaccauauuucuuuucugcaggcauauagaauuugguggguuuucuuuuauguagggugauauuggauacuuuuuguuugugauuauauauuagcaauuugagggacaaaccagauaggcagaaaugggcuugaauaguuagaugcuuauuuaaccuuggcaauagcauugcauucccugugguuuuuaauaaaaauugaacuucccucccucccugcccccuuacccuccacacccccaggauucuuacagaaaacaagugguuauagauggugaaaccuguuuguuggacauacuggauacagcuggacaagaagaguacagugccaugagagaccaauacaugaggacaggcgaaggcuuccucuguguauuugccaucaauaauagcaagucauuugcggauauuaaccucuacagguacuaggagcauuauuuucucugaaaggaugaucuuuguguucugaaucuuuauggggaaaugagguuaccacacuagggaagauagagcuuuuuaauuaugggaagaguugguuuuagguuguuugacauugagaaucuaggguaauuacugaaaguuaauacuggaauuuauuuuacauaauauacuguuacuauaaaguuugauaauacauaagugaagcuugcuacugggaaugacuuggaaccagaguuguuguaauuagagaucacgaaggaauuucagagaggaaaacaucuccaagaaacaucuuucaguauguaauggaaaagauaggccaggcacaguggcucacaccuggaaugucagugcuuugggaggccaaggcgggaggaucacuuucagcccaggaguuggagaccagccugggcaacagagcaagacccugucucuacaaaaauaaaaauaaaaaaauuagucacacaugguggcagcuacucgggaggcagaggugggaggaucacgugagcucaggaggucgaggcaugcucacuccacugcacugcugcacuccagccuaaucaacagagcaagauucugucuccaaaaaaaauaaaaaauaaaaugauaggaguaagcaaauaggaaguccauaaagaugaaaacaaagcaagggaacauaaagauagacuuuguccauagaaccauaaaguuucaaagcuagauuggaccauaaaaauucuaguacaauauucuuauuuugcagaaucagaaacagaguucagaaugucguuuguuagguuuuggagucaggauuguuauuaguagcagagccaggaccaaaaacccaaagcuccuuuuucuuagcacaguguucuuaaacagaauaauauaaugguuaagaaugagaacucugccuggauugaaaccuagcucuguuuauuagcgacgugacucaggggcuauguggcuuuccuaaccuauaauauggaaauaauaauaccuaccucauagaguugugaagauuacaguuuuaauaaauacgcaaaucacucagaauagugccuggcacacaguaaaugcuacuuaaguguucugccuaaaggcuugagucuuggcuuauuuucuauccaugugaagaugucugcucucaaaagcagauugguccaacacugaauucaaguguucuuuuccuaaccuguuguacuucccauuuuuuuuuugucuaaaaguaauagcaguacuuaauaaaaugcccacacuuggcaugcaucuaauaaauguuuuuugaauuucuagaagucauuuuucuucuuucuuacaagaaauuuauucauuuuucuauaugccuuagcucaaaccaaagaguauuuaaaacaucuuaugaaaaugcauauaguagagcaagauaagauuaaugaaaaauaggcuuaagugagaccaaaaaaauaaggguaaaauaaacaaauuuaggagugagcauauucugugauugugcaugaaguuccaguggcuuucuaaagguggacuacaaauuuggucacuguugugaaaaggaaaguagccagcugaaagauucaguaucuguaugcugaaagccguuaaguugcucggacuagaaggaaauuuucccauggauccucaaagaggcuuguuuaauguaaaaaucaguaguaaccugacagugacaugguccagguacuuuaggcugucuuaucccuuaauguaggcuauuaccaucaagcacaguuuugcaaauagccaguggaauguaguucagauacaugacuuuguggguaauccagggguagagacuaaaacaguacugugcaguaugugguuauuuacaguuaauuaagauuaaauaaaauuuaaaaauuaguuccuugacuaccaaaugcucaauagccacuaguagguaccauguugaacaguacagauauagaccauuuccaucaucacauaaaguacuguuggauuguguuggucaagacaaucuaaagcaauuguuucccaggugugcuguguggugugccuuacaugucauugaaaggggugcugucaggaguucuagaugcuucagccucccuuuacuaagagcaguucuuauguuuucuauuuuaucgcuugggcuuccagauacaauguuuuguuuuagguuuguuuuuuuuguuuguuuguuuuuuuuuuuuugagacggaguuuugcucugguugcccaagcuggauggaguacgguggugcgaucgcggcucacugcaaccuccgccucccggguucgagagauucuccugccucagcuucccgaguagcuggaauuacaggcguccaccaccaugccugacuaauuuuuuuuguauuuuuaguagacuugggguuucaccauguuggccgggcugguuucaaacuccugaccucaggugauccacccgccucggccucccagagggcugggauuacaggugugaaccaccgugcccggccuguuuuaguuuuuuagagauggagucucccucuguugcccaagccagagugcgguggcaugacacucucaggguucaaccucucagggaucaagggauccucccaccucagcuuccugaguagcuggaaccacaggcacaugugccaccaugcccagcuaauuuuuguauuuuuuguagaagcaagguuucaccauguugcccaggcuggucucggacuccuaggucaagugauccucccaccucaaucuccuagagugcuaagacuauaggcgggagucaccaugcccagcuucaucuacaauuuauuugaagaaaauguuugagcaccacccaucuugaaaagugauagacugccuuccauuaaauacugucacaccuaguuauuuagcagcagugagcuucacuuuuuauacuuuagaccuuaaucuaaagggugauuucuaguugccaguuaaauccagagccaagcucuuuggagaauccaggagccucacuaggucauguaucaggauaaaauacccauccacucccauuagaaggugagcuuguacuuauggcuuccugauggcugcugcaacaagucuaaagcagucuccuuaguauacaaugucuucucuaagugguagaaaaaagcaaaaauacuacaaguuaauagggcuacauaaaauuugcuaguuucuuuuuugcccuagccauuuauuccuuccugaaaucuugucucucucucgcucucucuuucucucgcucucacuuucuuucucuuuuucuuuucucuuuucuuuucuuucuucccuuucuuuucuuucuuuuuuccuguugcccaggcuggagugcaguggaacaauuauggcucacugcagccuugaccuuucuggacccaggugauccucccaccucagucucccaauuagcugggacuacaggcaugcgccaccacacccagcuauaauauauauuguauauauauuuuuuauuuauaaauauauauaaauauauauuuauauguguaaauuauauauauuuauauauuauaaauuauauauaaauauauauuuauauauaauauauauaauauauauuuauuuuuauauauuuuauauauauuuuuugggggggguugggggggauggagucucacucugucgcccaggcuagaguguaguggcgugaucuuggcucacugcaaucuucgccucccagguucaagcgauucuccugccucagcuucccgaguagcugggacuauaggcgccugccaccacaccuggcuaauuuuuguauuuuuaguagagaugggguuucaccauauuggccaggcuggucuucaacuccugaccuugugaucugcccaccucaaccucccaaagugcugggaauacaggcaugagccacugcacccagccuaaucuuuguauuuuuuuguagagaccggguuuugccauguugcccaggcuaaucucaaacuccuggguucaagcagucugcccuccucagccucccaaagugcugagauugcaggcaugagccacuguacccagccuaaucuuguuuuucuuauguucugauaauauauucccguuuuuagggagcagauuaagcgaguaaaagacucggaugauguaccuauggugcuagugggaaacaagugugauuugccaacaaggacaguugauacaaaacaagcccacgaacuggccaagaguuacgggauuccauucauugaaaccucagccaagaccagacagguaugguacagcuuucagcauuugugcaagaguuugcaucaguugauuaacucugguagagaugugauccauauucauauucuuuguuguuaugcauuuuuuucauuuuuauuuuuuuauuuuuuauuuuuuuuuaggcagagucucacucuaucuucuaagcuggagugcaguggugugaucucagcucacugcagccucugucucuuggguucaagugauucuccugccucagccucccaaguagcugggacuacgggcacaucaucaugcccggcuaauuuuuguacuuuuaguagagacaggguuuuaccauguugcccaggcuggucucgaacuccuggccucaagcaauccucccaccugggccucccagagugcugggauuacaggugugagccaccacgcccagccuguuguuaggcauuuuuaguaguguucuuuuucuuaacgcuuguuuaaacccaaaaugaacuuacuaauauucuguuauggcauguuuacuccugcauuaacauccacaaauauuucuugggaagauccuugacuaaaaauauuuauaaacauuaguuauuucucugucaacaccagcccguuuauggcuuaagccuccugaauggagucuuuaguuuaauguaguuuuguuccguguuucucacauuacccuuuuccuuugcaugaauguuuauuuggcaaaaugugccauuuuuauaucagccuguucuugugauucaauaggaaugugaaauuuaguguucucuuccuuaaaucaccauauuuuauuuuaucagcuauucguuuaguaauuggaaucuuauguccacauaaagagauacaaaugcaagagagcuuauaauuuggauuguguccguugagcuagcucucucauuuuuuuucauuuuuuccuuuuauaggguguugaagaugcuuuuuacacacugguaagagaaauacgccaguaccgaaugaaaaaacucaacagcagugaugaugggacucaggguuguaugggauugccauguguggugauguaacaaggugagcauaugguuucuuggcauaauuacaaaucuuaguauauaguauugggcaauuuggaggagugcugguguuauugucuauauguuuuuugaguuucugccuauccucuucugcacauuuuccauaugacacccuuucugaaaguacugaggucuaaaguguuuaaaacauuugauuauuccacagguaucuuuauauuuuugguaacauuagaaauuauaagacauuauuuaugaaauguaggcauacccuauuccuggcaaugaccaggaauuugaaggaucacuacuuugaaacuaguuaauaaggacaugguuucuguucuuuuuuuacagauacuuuuaaaguuuugucagaaaagagccacuuucaagguaggacaaguuuggaaauguauucucauuccuguuaauuuuguauauuuguuuuucuuauacucugaaugugucacuuauacaaauucuguuucuauuucagcugcacugacacccugguccugacuucccuggaggagaaguauuccuguugcugucuucagucucacagagaagcuccugcuacuuccccagcucucaguaguuuaguacaauaaucucuauuugagaaguucucagaauaacuaccuccucacuuggcugucugaccagagaaugcaccucuuguuacucccuguuauuuuucugcccuggguucuuccacagcacaaacacaccucugccaccccagguuuuucaucugaaaagcaguucaugucugaaacagagaaccaaaccgcaaacgugaaauucuauugaaaacagugucuugagcucuaaaguagcaacugcuggugauuuuuuuuuucuuuuuacuguugaacuuagaacuaugcuaauuuuuggagaaaugucauaaauuacuguuuugccaagaauauaguuauuauugcuguuugguuuguuuauaauguuaucggcucuauucucuaaacuggcaucugcucuagauucauaaauacaaaaaugaauacugaauuuugagucuauccuagucuucacaacuuugacguaauuaaauccaacuuucacagugaagugccuuuuuccuagaagugguuuguagacuuccuuuauaauauuucaguggaauagaugucucaaaaauccuuaugcaugaaaugaaugucugagauacgucugugacuuaucuaccauugaaggaaagcuauaucuauuugagagcagaugccauuuuguacauguaugaaauugguuuuccagaggccuguuuuggggcuuucccaggagaaagaugaaacugaaagcacaugaauaauuucacuuaauaauuuuuaccuaaucuccacuuuuuucauagguuacuaccuauacaauguauguaauuuguuuccccuagcuuacugauaaaccuaauauucaaugaacuuccauuuguauucaaauuugugucauaccagaaagcucuacauuugcagauguucaaauauuguaaaacuuuggugcauuguuauuuaauagcugugaucagugauuuucaaaccucaaauauaguauauuaacaaauuacauuuucacuguauaucaugguaucuuaaugauguauauaauugccuucaauccccuucucaccccacccucuacagcuucccccacagcaauaggggcuugauuauuucaguugaguaaagcauggugcuaauggaccagggucacaguuucaaaacuugaacaauccaguuagcaucacagagaaagaaauucuucugcauuugcucauugcaccaguaacuccagcuaguaauuuugcuagguagcugcaguuagcccugcaaggaaagaagaggucaguuagcacaaacccuuuaccaugacuggaaaacucaguaucacguauuuaaacauuuuuuuuucuuuuagccauguagaaacucuaaauuaagccaauauucucauuugagaaugaggaugucucagcugagaaacguuuuaaauucucuuuauucauaauguucuuugaaggguuuaaaacaagauguugauaaaucuaagcugaugaguuugcucaaaacaggaaguugaaauuguugagacaggaauggaaaauauaauuaauugauaccuaugaggauuuggaggcuuggcauuuuaauuugcagauaauacccugguaauucucaugaaaaauagacuuggauaacuuuugauaaaagacuaauuccaaaauggccacuuuguuccugucuuuaauaucuaaauacuuacugagguccuccaucuucuauauuaugaauuuucauuuauuaagcaaaugucauauuaccuugaaauucagaagagaagaaacauauacuguguccagaguauaaugaaccugcagaguugugcuucuuacugcuaauucugggagcuuucacaguacugucaucauuuguaaauggaaauucugcuuuucuguuucugcuccuucuggagcagugcuacucuguaauuuuccugaggcuuaucaccucagucauuucuuuuuuaaaugucugugacuggcagugauucuuuuucuuaaaaaucuauuaaauuugaugucaaauuagggagaaagauaguuacucaucuugggcucuugugccaauagcccuuguauguauguacuuagaguuuuccaaguauguucuaagcacagaaguuucuaaauggggccaaaauucagacuugaguauguucuuugaauaccuuaagaaguuacaauuagccgggcaugguggcccgugccuguagucccagcuacuugagaggcugaggcaggagaaucacuucaacccaggagguggagguuacagugagcagagaucgugccacugcacuccagccugggugacaagagagacuugucuccaaaaaaaaaguuacaccuaggugugaauuuuggcacaaaggagugacaaacuuauaguuaaaagcugaauaacuucagugugguauaaaacgugguuuuuaggcuauguuugugauugcugaaaagaauucuaguuuaccucaaaauccuucucuuuccccaaauuaagugccuggccagcugucauaaauuacauauuccuuuugguuuuuuuaaagguuacauguucaagagugaaaauaagauguucugucugaaggcuaccaugccggaucuguaaaugaaccuguuaaaugcuguauuugcuccaacggcuuacuauagaauguuacuuaauacaauaucauacuuauuacaauuuuuacuauaggaguguaauagguaaaauuaaucucuauuuuagugggcccauguuuagucuuucaccauccuuuaaacugcugugaauuuuuuugucaugacuugaaagcaaggauagagaaacacuuuagagauaugugggguuuuuuuaccauuccagagcuugugagcauaaucauauuugcuuuauauuuauagucaugaacuccuaaguuggcagcuacaaccaagaaccaaaaaauggugcguucugcuucuuguaauucaucucugcuaauaaauuauaagaagcaaggaaaauuagggaaaauauuuuauuuggaugguuucuauaaacaagggacuauaauucuuguacauuauuuuucaucuuugcuguuucuuugagcagucuaaugugccacacaauuaucuaagguauuuguuuucuauaagaauuguuuuaaaaguauucuuguuaccagaguaguuguauuauauuucaaaacguaagaugauuuuuaaaagccugaguacugaccuaagauggaauuguaugaacucugcucuggagggaggggaggauguccguggaaguuguaagacuuuuauuuuuuugugccaucaaauauagguaaaaauaauugugcaauucugcuguuuaaacaggaacuauuggccuccuuggcccuaaauggaagggccgauauuuuaaguugauuauuuuauuguaaauuaauccaaccuaguucuuuuuaauuugguugaauguuuuuucuuguuaaaugauguuuaaaaaauaaaaacuggaaguucuuggcuuagucauaa

SEQ ID NO: 13774 - RNA, 27799 nt, Homo sapiens
ucaguuuuauccaaguaugaagaucagauuacuauuuucacugacuaccuagaagaauauccagauacagaugagcugguauggaucuuagggaagcagcaucuccuuaaaacagguaagauuugguagcauuugucuguaagaacccagaugagguaggcaccugugguucaggguuuguacuuuuucuucuuggguuggcagagcauugucuugcucaauguuaaugcuacucugagguggauuuaacuuguagucaaaggagcuuaagccucaggacuuuugcuuggacaggccccuuccaaggcccugaaaggcccuaguaguguguuuacaugguuauagguuuuugcacaauuugcacaaguaauauauuuuuauucuuuuccuuaaaggagaauccccaaauucuagaagccuuggguuucaaaaaacacggacccacuccugguaucacuaaucagucucuagccuuucgugacuggucuacauauuuauuacucucacaugcuugucuggcuagauaaaaacacccaaggacuucuagacaacccauggaccucagaaacaauaucagaccuaaguuuuucuuaaguuuuagaucuuuugcugaccguagcacugucucaguuuauucugauuuuguauagaacuuuuagccacugcagcuagauggaaaggaggcuugaauuuuucuuccuuaccauuacauucuuauagauugggaaagaaagaccuuuuaaccugaaacugcuaacagcccagcacccagauaaagccagagcuuggaaagaggcagcucugagauuugugucuuucugaggagacauccucuucagaggcccucacuuagcguggaggaaggaacaggaagaggcugaugaaaaggcaggagaggaaguuaggcauuguggagcuccuccugagccuggcuucauuauuuugauuggagaauucugaacaguggaaagccuggagcuagcaauuaggagaccuuuuguauucagacucuucuaacucagguaagucacugucucuuucuggaucuuaacuuccuucagugguacuuaaaaugaggggauuugaggggaucucuucuaauucugcauuccaugacaacaggaauccccagguugccaaaucuacucguauucaaauguuaaauugggaaacgccucuuaaaaugaaaucauugcuaaaauguccauacaacuuucccagcguaaagccacacaggaaggcauaaagacugucagaggcaggagugaggguguggacauuuaagaggacgagcacauaacagcuaacaucuguuauagguucacugcauacuagucaccauccaagcacuuuaaguguauuaucuuuugaauacucacaacucaaugaaguagguacuauaauucuccccauuuauggaugaggaaacugaagcucagagagguuaaguuaaccagguuacacagcugguaaguagcagagucaggguucaaacccaagcaaaguaugacuucgggugucuuacucuuaaccauuauacaucugcuucccugaauaugcuaggcaccggggcauggaagggagggaaaauacagauagcucaacuuuccgauuugcuccaaagaaaaggaagacagaaaauagaaacuauuggcuaaaaguagauuucccuuuguucuuuuuaagugcagugacuauaaguuuuauacagaauauaauacagacauguugagaagagggagagaggugacuaagaaagacagccacaucuaaguacagauaaaaauguggaagccauauuuguggcccaucaaaguaaauuuaugucauaaaauacaagaaagcaugcuuugaaaaaagacacaaaaacauuugugauauuauauaugcauuuagauuauaagugccaguugcacuaguugcuauacauuucuuacacaccuaauuugcuuaguaagacauuuccuuuuuauuuaaacaugcaugugugcaugaacagacacacaugcauccacacaaacaagccaaccccuaguuuuuguuuuguuuuauuuuauuuuguuuugcuugagacagggucucucuguuacuuaggcuagaguacaguggugaucauagcucacugcaaucucgaacuccuggguucaagugauccucauaccucauuuuuuuuguagagauggggucucacuauguugcccaggcuggucuugaauuccuggccugaagcgaucucccugucucagcuucccaaagcacugggauuacaggugugagucgcugggcccagccaaaccucuaguuuuagauaagggaugaugggugcugaugcaagauccaaccaaccaucauucaggcuggagcugauagucuuguuaguggguucucuaggauccuuaauuuucuuauuccuugucuuuuggcaaugaucccaguguuuguaacugccaggacuguggaacucagugaaaagaugacaggagcuacccaaggucauuauaccagucaaauagcucuggucaaacuauagguugggagaaauacugaaauuauuuggcuaaaauaagaauggguuuccugugaauuuaccuagccccauaauaauggaauugacugguuauuugaaauuaaguuaguagcuggcucagaaguaaagguggguauuuuuagauauggugauuuaauuuuaauuuuacauuuaauuacagaaaaaucuaagcuguugucugauauaagugcucgucuaugguuuacauacagaaggaaauuuucaccaauugguagguaaaucauuuguuuuacugugcuuuauuccuuguggauagcuugccugagguuaucagugacuucauagaaaccucagaauuaacaguucacuauagcaaagaauuugauugaggagacuagguaaaucuuacacuucauccaaaaguuucauugcuaaaguauccuuucacauauggcucuauuucauugagggauuaugacaguauacuuuugacaccaccuccaaguguucaggcaccagaugauauuacuuguuauacuuuugagauuaagggggaaaaucacauaaucuuuuaauuuguauaauaucuguuaaauuacaauccacugcuuuguggaacuacaugauuauuaaugaaaauugugucuugaaagaaagaaaauaauuuauuuguuuuuuuucccccuuaugacaugaaagcaccuugccauugagagacaaauuacaguaguuuccuuggaacuaauucuaggcuguuaccagcugucaacuagaaaaaaggacagcucaauaggugaagugaauaugcugucuucauaaaggauauacaacacauuugcaaguaggguggccacuuccuaguaucauggcccuguaggaaaagggccuacaaauggugaaaucuacucuucuaagaggaaacuagaaugaaaucaaccuuucuguucagugccaaaaaugaaggucacacagacuuuucuuuucuuucuuuuuuuuuuuuuuuuuuugagacggagucucgcacugucacccaggcugcagugcaguggcgccaucucggcucauugcaagcuccgccuccuggguucacgccauucuccugccucagccucccgaguagcugggacuacaggcgcccgccaacacgcccggcuaauuuuuuguauuuuuaguagagacaggguuucacuguguuagccaggauggucucgaucuccugaccucgugauccgcccaccucggccucccaaagugcugggauuauaggcgugagccaccgcucccggcccuuuuuuuuuuuuuuuuuuuauugcucuccccagaaauaccccagucacuaacaaacaaaagaacaaucuuuaguaaccagugguucugaacuguuaacuuucucuggcugaggagcucuuugcaaggcuggaaaauauuucuaauuuuacucugccaauauuuuggcaauagaugaucucuucuuuaugugggccucauugcaucuuuuccauacuaaucuggccaauaaucccagcauuagcaagagccaaaaggcaccccuuccaggucauaaauuggcucccuccuucccaucuucuuguaguaacucuccuucaguccccacaacuaaaagaaaggggugaccaccuugacccacuuguccuacaagguugaugacccccuuugaaguuagucuucugagaucauguuuagcauauuuuuccacuuccacacugggaaaagaaaacaaugaaaacaaaauauccucucugccauacaaguuaucugauuucauuggccccuuggaaaaggauauugagcucacccuggccucaaaugugggauuuucuuugcauaagguguucuuaaaauggaaccuauugucuuauuucguuuauuaacuaauuuuauaccuuuuaaagauacauuucuaauuuauuaauauggguuuaaauuaugaucauacucaaaacaucaaguauuugcaucauccucuauggguucuagaacacuuucacagauauucucucaguucuuacaauacccacugauaguaggcagaguauguacuauuaugcucagccuauaggugagauuuagauuagauaacuagagacuggucuucugaugccucaucuagggaucuuuccccuauuuuacaauguccuucuugcuguucagaucuucauaguguauauucagaauagucaugagccuuccaaaucucuuugaccauuuugaugauugccuuugguaguauuuguucuuuaucuaaguaagacuggcuucccugagaauuucagggccaugcaagugagcuaugcaaggcaagguuugggucuggcagaugaugacauggaauggacuaaggguugguauucauacauggcagucaccuaccaaaauugcauguauaccuagaagucuucaagcagaaaacauaagggacacauuuaguucauuugcuuguuuuauguuuggccauagaaccuguuuugguugacucagcacuauguuugcaaguuccaaccauauacccaaaucuuguuugaucuguggguguaucugucaccucacuuuucagaguauauauauuuaccugucuugugugagucccaaauaugcugauguuucaggaaagggcaauuugaggaacccauauuaauucccuuccauuuugccaacagguggaacgggcccuucaucagaugcugguuggggauguaugcuacgcuguggacagaugaugcuggcucaagcccuuaucuguagacacuugggaaggggugaguuaaauuuguuuuauaaacuuucucagagaccucugcaguaucacuugcugcuguugauuuagcuugaugcugagccuugggaacacucaguaacaaacuugagggucuuaaaaugcucucugcaagcucaagugguggggcugacaagucaacaaagccccucauaagaaggaaacagcuaauguuuccuugugagucaccaagccagggaguuauuuuccugggacagaacugaacaucgagggagguaugucauuuauccuuuccaucuuugcuauuguuugaguaaguccuuagaaaugcaagauaacaaagggagcaggaagaaggguguggugauuaagucuguuucuugaccucauuuaagauaucugccuggugaaggauguaagugaccuaaaggaagugcauagagggagcuggcgcuauuuugguuuugguucacuaaggauguccagcugaugaugaaggaaucuuuaaauuugcuuccuugggaggacauuuaauuaagaaagccuucugauaaugguuguuggaacuauuuuuuuuuuuugagucggaguuucgcucugucucccaggcugcagugcaguggugcgaucucggcucacugcaaccucugacccccggguucaagcaauucuccgccucagccuccugaguagcugggauuauaagugccugcuaccacgccuggcugauuuuugaauuuuuaguagagaugguguuuugccauguuggccaggcugaucucgaacuccugaccucagaggauccacccgccucggccucccaaagugcuaggauuacaggcaugagcuaccgcgccuggcugguuguuggaacucuugagucuugcuuucuuaagacauguacauacuucccuaugggcaucugaaggaugggguuggcuggaugccaguucaggcacuugggugaagguccaguuggacuuggggaugagagagcgaaaggacacuuuggaugagauugggcugcugaacucauuggcuguugcuaauugagguucagaaguauagaaacaucguuuuccuuuucccacugugcaaacucacagauuuugcuacagcuuucagagaggauuggagaagggccuagggagguuucagggcuuguuaccuucucuucaggguuugggauauccugcuuccccuggauaguauaauaauuuccauuuuacagaugaggaaaccgaggcucagggaagugaugugauuuacccaggguaaaacgcaagaaaucaaagauuuggggauaaaauaaagauauuccaacuccuuguccagugauuucccuuguuuauacaugcuucuugguguagauccauucuuacuauuuaauuuuuuuuucauuuauaacacacuucaaaaugauuauuuuggaagugaguucuggaaguagggagcaaacuggaaaaaaaaaaaaaaaacuccacagucagcaaucucaauuguuucaauacaaaaucaaguagcaggaagaaguuggaaauagaucuuguagcuaagaugaguuaaaagaguaauuuuguaaagaugucuuuuggauuguuuccuauucagcuauuuuaaaauuaagguagaguauucacuugccauugucgucagugaauauuuagugcuauuuagcagccagcuaauuaggauuuccccagacuuggacaauuugguagcuaaugaaaagaaguuggaugugguucacccucugagggcugugcuggauccaaaguuaaaaacuuugguuuuagaaacacuagaagcaaaagacaacugaagagucuggagauaauggccuuuggcuucaaguguaguucagucuuuauuucaaacucuuuaaaaccucaggagaaaaauuugucuuggacgcaaacuaagccucaaaaaucugucccauuagacagcguuucuagagcugagaggauugcagugauuacauaggguuuuugcaguuguccucagcaaguuacgaauggccucuguaggauuuagggggcugugcugaaggcacagaugguauccguacagaugcaguuauuuuggcauuggucuuagggaaacauugaacaccugauagcaaagguauuuguuuucccaaagcucagcauggacuuuuuaaaaggugguguaaaaacgacagcaugcaauuuuuuuaagcuuccuuaguugugagcuauguauauuccccugugaacugucguauaucagaauagcacuucuuacccgugagauccuuuugucaaugcugccaaaauauaagagcaaaagccauugcugucuauguggagaugagaugcuauggcaucuggcuuauauaccgauguacugccgggcuuuguggugaccuccuguucacugaguaacuggccagaaaggccuuugugacauuguuuuuauguaauauuuauccagcuccagcccuuggguuaagucaguuccuuggucaacuuuuuguuuugcuuuuacuuuauacccacugaguccuugaaagcaaucacuuuccagaugucuuugucaucaaaaugaaagauacuuagaaauguucuaacuuggucaucccugccuucuagauguggugccuuuguuuuucuucuaacuuuguaguuacaauaaaagugcagagaggaauaaacaguuauaaaaauguuucuaacccauuuuuuuuucuuaaaaagacuggagcugggagaaacaaaaagaacaacccaaagaauaccaacgcauccuacagugcuucuuagauagaaaagauuguugcuacucuauccaucaaauggguaaggucauaaaucaauaguuuaaaggcagugccuauuccuguuccuucucuucccuugccuuauauguggcuccauuaaguuguccaucugcuuaauuauuuaugcaaaaaauuaagauuuuguggcuuauuggaagaucuuuugcuaacauguuauuuuuuuccacauuaaaaacagcacaaauggguguaggagaagggaaaucaauuggagaaugguuuggaccaaauacaguugcacagguguuaaaguaaguaaaagagucuggcaucugccuuauucugcugucuccuaugcuucccucccuagacaacuaaaccucccaucaaccgagguauucuugcaaucccgcuaagcuacuccucccacuaaaccaucaaauaucugccauuuugcucagauggcucuuugaaauguguaagcauggauaucuguguugguguaucagaguuauauucacugguagcaguauauguggcuguauccuaggacucauucagugucucaugcuacagauugaugcucaugugccugggagccauuggccugagggucccuuugaagccaaaaguuucauacuaagugguagaggcuaagccagccuaagcaagaaauggacccccacagggcucccacaugcacuacauaauauuuaaaaacccuguucauucagcauuuucuguguaccuuuacugugcuaaguucugggggugcagaaauaaacuugacacaguccuugccucaaggaacucaccaccuguugggggcgacaaaccccagggaagucuuggaaucaguuugucaucucauagcagacucaaggugucccagugugguauuuuuccaguugucuuguuaaauuccagaauucaccucccacagcaagaggcaagguggagaggucaggaccaacuuuuugaaagcaaacagggugagugauguuaguacuuacaccugcagaccaccuuaccuguugucacucuccuuccuaacaaccuaucacuggauggaaacuccaugagggcagagauuguauuuaucuuguucacucuguaacacuagcacauagaacugccuggcaugcauaaguacucaauaagugcucgaugaauacaugaaaauggccgccagaaucugaggccagauuuagggaucagaagauugaaaccuucuggccuccuuugguguagaauauuaagcuccugggcauuaugggggaaccuguuccaugcaaaguacagacaggacccuguuuccauuacuaaccagucuucagugaacuagaaugcuuugggaaugugucugugaggacaguggccuggauuuuuuggggacccaaggaaaaucuguauugacuuuacuccuuccuaacaauguaaccucucugaggcugcucucuugccauagucagagugccuucugggcaucgcugacucugcugagugaaaaucugguaggauuucaggaaucacuguaugaacguaguguggaaaguauaagauauuagaauggcugugcugagcccaaaacucggcuugaaaugguugguguuaaaauaacaucccucagaauuugcuucuuucuucuaaauuuuaagauuaccaacaacaaaguggaaaccuagauuuuuuuuuuuuuuuuaggacagagucucacucugucgcccaggcuggagugcaguggcacaaucuccgcucacugcaaccuccaccucccagggucaagcauucuccugucucagccucccgaguagcugggauuacagguggcugcuaccacacccagcuaauuuuuguauuuuuaguagagauggaguuucaccauguuagccaggcuggucucgaacuucugaccucgugauccacccgucucaaccucccaaagugcugggauuacaggcgugagccaccacgccugguguagauuuuuuuaaagaauguaaauggguuccaauucaucaugaucauuagcauuaacaacaacauauuauuauuauuauuauauuauuguuauuauucuggggaaagauaauacaucaaaaugaaugaaauacaagggugaugguaguuaaccucuuucugggagcuaccugguagagagaauguguuuucuuugguccagugagacuggguuuuacccacacaucccagacguagccggguuaaacauggccuuacuuaacuggcaaggaaagaagaaggaaagggagaaauaggcaggguacuuuacauagacuucagaucaucucucuuuuaaagggguuuucuuucuaauacaccauaaaguccuacaguucagcaugguggcucucuucagcugcugaccaguaaagcuuggcacccgagucaaucugcagccuaugucacuugagaggcacucucagggcagcuggggaacaguggaaguaaucucucucucucuuuccccuccacccacugucucuaucucuggguuuaccuggaacauauucuccauauuaucuaugaucccaaacaaauaucuauuuuuuacggacagcuuccuuuuuaaaaguuuuuuuacaguuucccuuuuguaaaauaaaaauucaguaagucagaaugucuuuuauuuaagaaaacaaagucucuugggacuuugagagcagaugcauggguaacuuuucuuuuuuccccaguaggugucccgucauuuugugaaguagacuucuccagguuguaaagcagaaacuucuuuuugagguucagauacagugacucuguggcauucucaaggucucuagacauggagcaucccagagcucuggcaaagaagccagagcugaccugaacaccagcuuuucuauggcucaguguuuggugacuuuaggaacacugggcauaaauuguacuguuuucugcugauauuuccaucuucccaaauugugacuucauuauacauugcuuugcagaaaacuugcuuuauuugacgaauggaauuccuuggcuguuuauguuucaauggauaacacaguggucauugaagauaucagugaguuaccagccuguuuaacuucccagcugaugggugaugaguuccucccucaccauucaguauucuggggcucaagagagucucucuggucuuccccaccagggcaggggagcuuaggggagcacagggcucugauucucuuucuuuucagcuuucugagagggagaacaccauuagaggggccuugcuccuccucagugagguaccacacuccuucccugcagaaaacacaaaguguguauaauaauuuauucaaccaccaacagaucuuucauggaggcucacccuuguccaggcgugugauuccugcacugaggagugagagcaaccuaaagauacagucccugucucaaaggcccuggcagacuugagaaaugagauucuuccaauaagcccagaaucccuauugggagcuaaacaaguacccaguggccagaaugaagagcaugagcccuagaggaauggccugggcuuugugcaggcggggagucagcugagcccugguggcagaggagagggccuucuaggcaggguggggggcaugugagguuccccuuaguuuugauauuggaauaucuucuagggcugaagacuccuuacuuauccaauauucuguucuuccauuucuagaaaaaaugugccguguccuucccuugagugcugacacagcuggugacaggccucccgauucuuuaacugcuucaaaccagaguaagggcaccucugccuacugcucagccuggaaaccccugcugcucauugugccccuucgccugggcauaaaccaaaucaauccugucuauguugaugcauucaaaguaagucacuucuuucccugagcccauugcugccugcccaucacaccgccaucucagcacagagauccgugagcagcaguccacaagugaguugagaaucuugcauugucuuucucuccaggaguguuuuaagaugccacagucuuuaggggcauuaggaggaaaaccaaauaacgcguauuauuucauaggauucuuagguaagaaaggaggaaucacaaguaagucaucgugggcuaggggagggcguggggacaagguuugcaugggagaccaggcaauuccaguuaguggguucccgucuagcccaggaaugccguggccucuggucagcuccuucugucuccggccuaacugauggagagugauguuucugugugccugauggaaagcagguccaauuucaaugccuuccuugcuucuugauaagaugguuccauugcuuucccacuggauagccccaaggucauagcauugcuccagcaugucucucuccugccuguggggcccagggugguggaauuucaaucccuuggcuuugccaauaucucucuuauuagggccugcuggcucauuguucagagcugugacagguugggaauuggaggaggcaaagacagaaguaccccuuucccgagaaugggggcuaagccuuaaaaccacuaaccucuuaauguggacccgagcaagcaacccaacauucccugcauaggaaggcaccucuggaaacccagucucuuuacucacuagcugugaccagagacaucugagguccuugguacacaagguaagcuagccuagugcuucugaagcuuuagcaugcacaugaaucaccuugagagccuauuggagugcagguucaguaggucuugggugcggccugaguuucugcauuucuaacuagguggugcugaugcugcugguccacagaccacacuuugcauacccagggccuaaacaccugguuaguguugaagagcauaaguuagagagugauguggccaggaaaaguugguacaggacaccuguugcagggguggaauggucugagacuuggccucaggaaaguuaugaggucagauugguugacagacaaaggagagcuacaggaguuacaagggaauggcaugagggcacgugcaaaggacaggguggagauggccuuaguuauccuccccaacacaucuccucuuggacauucagggaggugaggugggaugggaacagacacacguggcuuugcaugccaaucccccacuugcuagcugugugacuucaggaaaaagauaucaauauucagucucagguuccuuuuauguaaaauagggcuaaugccugacucgcccuguugucaucuuacaguaaaguguucaucaaagagccaggcauauaggacagucacugaaagguggcugcaccuugcuuuaccccaauaccuauuuccuuugccagccccuucuuccucucuuuagguugggggguguggagcggggcguggggauugcacagcugccucugcucucucuaaugcugccaucuauugguugagcccaagaauuacagcuaaauggaaaacguggagccuguaaaggcuuuuauuuuucuaaguauaaaaccuaguguuuggaguucugcaaaaucagaugcccucuguuccuaagcauuuggguucaaagaaaauguugcaaaaaauagauuuccaguugcucaugcaugacuuagucucuucaggcggcuauaacagaauaguauagacuagguggcuuuauaaacaacagaaauuuaugucucacuguucuggaggcuggagguccaagauccaggcacuggcagauuuggugucuggugagagcccacuuccagguucauagauggcuguuuucuugcugcguccucaaaugguagaagaggcaaaggagcuuucuggagucucuuuuaugagggcacuaauacauucauaggggcuccacccucaugacuaaaucaccucccaaagaccccacuuccuaauaccaucauacuggggguuaggauuucaacauaugaauuuuagggagacauaaacauucaguccacaacaguguuugaggacagcuuugaaacagauuagaaaauaacuuuggaggaaucucagugaauagugugugugauuccugggugcccuggccucccuaucccaaguuaccuacagagaauuucuccaaguugauguagcccuccuguuucuugaggccacugggucagaguagcuuuugugaaguuugacuacucauuaaaaagaugugggcaauccucaguucuuuaauaccccaagacagagguucacauagugcccauuugccuguuaacuuuuauaaguccuuugugcaaacuucacuugagggcuuuaagucccucugacuccccuuuucugacucacacccuuacuguuugagguugagugguccagauuggcagaaugucugaagggagggaagagaugcaaauugccauuuucuaaauaguuguccuguuccagagacuucgcaaaguauauuaucucucugucuacacauauauacacacacacacacacacauuuauacauauauauacauauauauacauuauauauauaaaauauauauauaaaauguauuacauauacguacauauacauauacaaaguauuauauacauuuuacaaauauauaaaauguauaaauguauauauaaaauacauuguauauauaaauaaauguauauauaaaauacauuguauauauaaauguauauauaaaauaauauauaaauauauaacauaaauguauauauaaaauauauauaaaauguauuacauauacauacacaaaguauuacauauacauuuuauauauauaauguauuacauauacaaauacauacacaaaguauuacauguacauauacauauauacauauauauacauauauauacacauauauacauauauacacauauauacacauauauauacguauauauauacauauauauacguauauauacacauauauauacauauauacauauauauacauauauacguguauauauauacauauauauauauauauauauauauauauauauauauaucacuaaggaauggugccauauugagggcucaguguuggucugugcugcuggcaaauugggcacucagcaggggcuguagccaggucagccuuggugaguggaaguccauguugcugaacccauguguaaccucuaucccugccaccauggccacuuuguucaugggcccauugggugaugacacggguggcugaggaaaaaggcugagugguguccacagaaugggucauccuaucuacuugauuauuaaucaagaauacacacaauauuucugugagguagagacuguuauuucuguuuuacaugcagugaaacuaagagcuaaaauuaagagagauuaaaaaguuauuucuucaaggugauucuguuagaaaguggugaagccaagagucgaucccaauuugaucaucucuaccuaccaccuuccauugcucccccagggcccuccugcccagugggaagcugagagagcucuaggugugggaggauauggccaggaugacacucuggccuucaaauuuugccugcuuagagagaaggagauguugguuccuugcacuuggguauagguuuccaccuggagauccauagcauuagcccugucucugcaggugguuggucagccugccuuuucacuccaggucucacuggagaccuuuguuuaguccccagaucauuucuagagcuuuuuacaucuauuguauaucuuuuuuuaaaaaauuuuguuccagauucaggagguacauguguuuguuuguuacauggcuauuacauguguaaugguguggauugggcuucuaguauaccugucgcccaaauauugagcauuguaccccaauggaugaugauuagauaaauaaaauguguuauauacaccauggaauacuauguggccauaaaaaguaaugaaaucauguccucugaagcaacauggauggagcuggaggccauuauccuaaguguacuauaucucuuauaagcacucucagaaaugaugcagcuuguggcagcuuguggccaggcgcaguggcucacacuuguaaucccagcacuuuaggaggccaaggcagguggaucgccugagcucaggaguucgagaccagccugggcaacauggugaaaugccgucuauaccaaaaauacaaaaaauucgcuggaugugguggcgcaugccuauagacccagcuacuuggaaggcugggauggggaucgcuuccaagcagaucgcuugagcccaggaggucaaggcugcagugagccaagauugugccacugcacuccagccugggagacagauuguauuagucaggguucucuagagggccagaacuaauggaauauauauacauauauaugugugaauauauauauguguguguguguauauaacauacauacacacacacacacacacauauauauguaaaggggaguuuauuaaguauuaacucacaugaucacaaagucccacaauaggccaucugcaggcugaggagcaaggagagccagucugaguuccaaaacugaagaacuuggagucugauguuugagggcaggaagcauccagcauggagaaagauguaggcugggaggcuaggcccaucucucuuuuucacauuuuucugccugccacccuggcagcugguuagauugugcccaccugauuaagagugggucugccuuucccagcccacugauucaaauauuaaucugcuuuggcaacacccucacaggcacacccaggaucaguacuuugucuccuucaauccaaucaaguugacacucaguauuagccaucacaaguccaccccuugucaacuugaacccauauacauauccugagaucauacaucaucuucagauaaagacaauaauaaggucauaauuugccuaacauaauacaacuauccuucguacaacuggaaacgcaccaauccccaacccaaauacuauuacaugaacuuaauaauacuuaaaugcugaugugaagucaauaaaucuuaugucacaugauaaaggagaaaggaaauaaaaugagaauauuuucuuaguacaaguguauacaugcacaaacauauuuuuaacaaaagaaggaggaaauguucaugacaauugcaguccucguuucuguagcuggucacguggucguagcuaguauugaugacuaccuacuuuuacuaccuauucuguauucccuuugccgucaguaaacacuucagcaggucauguuuuuuuuccugguggagugacccaaaccuucauuccugaagggucugggccguuuguaguccugccuggauugggcuguuguaguuucccauugaccuuaaucacagggcaugguaauacuaagagacacccaaauggaucuccuguauuccaugcauacuuuuucuuaccuccauugugggguaguagacugauuucaucuugauaguccaagucagucaccccaaccaacacuguaacucccuuauuagccuguugauguaaagggaagaggagcccaaaguguccagguggcaaucuuaacuuccaguuuaauggaacuguugugucuccugauggcagcauuccuuccucuggaacuaagaacucuaggccagcagaacguaaugucgggggaacaggaagcaaaaauuuugcugguggaucacuggggcugauggugaguggugccacuuccacuuccacuccuugauuccuggaccugugaauccuggcuaugagagaaagaguaccauauauugaaugcuaauucagagcuuacacagccuucuggaaaacuuugccccagcccuacaaaguauugucaccuaguuggcauuguaauuguaacuucaaaaugaaauuccaccauucuaucaauccagcugcuucaggcugauggggaacaugguaagaccagugaauuccaugagaaugagcucacugccacacuuucuuagccauaaagugagugccuuggucagagucugugugggauaccaugauguuggauaaggcugauggggaacaugguaagaccagugaauuccaugagaaugagcccacugccacacuuucuuagccauaaagugagugccuuggucagagcuguguggaauaccaugaagguggauaaggcauucugugaguccauggaugggagucuuggcagaagcauugcauacaggauagguaaacccauauguggacuaaguguuuauuccagugaggauaaaucucugcccuuuccgugauggaagaagcccaguauaaucaaccugccaccagguagcuggcugaucacccugaggaauggugcuauauugagggcucaguguuggucucugcugcuggcaaauugggcacucagcaggggcuguagccaggucagccuuggugaguggaaguccauguugcugaacccguguguaaccuccaucccugccaccauggccacuuuguucaugggcccauugggugaugacauggguggcuggggaaagaggcugagugguauccacagaaugggucauccuaucuacuugauuauuaaaauucuccucuccugaggucacccauuggugaguacucacauggcauacaaauaucuucacaguuuuugaccacucagagagguccauccacauaccucuuccccaaauuuggcaccaauuucccaaucaugcuucuuccaagucccugaccauccagucaaaccauugacuauagucuaugaauuaguauauaaucgcacauauggccguuucuccuuccaugcaaagugcacaaccaggugcacugcucgaaguuaugcccacuggaaagauuucccuucaaugggucagaguaacacacccaaaugaggaauguguugccuccaaaauccaaauaggcccaaaaggcauugugccucuuucuugguuguaggaggggccaauugcagcaacuuauccuucaccuuagaaagaauaucuugacaggccccacaccacugaccccuagaaauuuuacugaaguagaaggucccugaauuuuagucagauuuauuucccauccucuggcaugcaaaugucuuaccaauaaguccaguguguuugcuacuuuuugcucacuggauccagucagcauaaugucaucaauguaauggaccaguguggaagugaaaagcgaucaaggucucuccaaauaagauuaugacacaaagacggagaguucauaugccccugagguaggacaguaaagauauauugcuggccuugccggcugaaggcaaauugcuucuggugggccucauggacaggaauggacaaaaaggcauuugccaagucaauagcugcauaccagguaccaggagauguguuaauuugcucgagcaaugaagccacaucugguacagcagcugcaauuggagucaccacuugguuaagcuuacaauaauccacugucauucuccaagauccaucugucuucugcacaggccaaaugggaaaguugaacugggauguggugggaaucaccaccucugugucuuucagguccuugaugguggcacuaaucucugcaaucccuccagggaugcaauauuguuuuuuauuuacuauuuuccuagguagaggaagcucuaauggcuuccauuuggccuuucucacuguaauagcccucacccuaccagucagggagccaauguagggguucuaccagcugcuaaguaugucuaugccaauuaugcauucuggcacuggggaaaugaccacgggaugagucuggggacccacugggcccauuguaaguugcaccugaacuaaaacuccauuaauuaccugacuuacauaagccccuacuuuaacuggaggaccacaaugauauuuuggguucccuggaaucaaugucagcucagagccaguguccaguaggcccugaaaugucugaucauuucccuucccccaaugcacaguuacccugcuaaaaggccggaggucuccuuggggaaggaugggagagcgauucacugcauaaauugucaguaauauagugagguccuuccucaaggggacccggccuccccuucauucaagggguucugggucuguaaacuggcucaagucuggaaauugauugaugggcugugauucucuguuucuguaauucaaauuagucuuuugugcauucgaccuagaaguuuucugcuuauauaaauuaaguaggaaugcaguaggcuuccuaucaauuucacuucuaggaacaccaugauuaauuagcaaaugccagagcucuacacgagucagacuauucugauugcaguagucugaaagcaauagucagacuauugcuuugccucugcuguccauuacgguagcuaugcccaccuugccuuugaugguugagugcugccacuuggccccugccaccucaggauccaauuauucccauuauauuuaaauuuuguaguugagugauacaguucccacuguuagaucugacauacagagaagagcaauuacaguacucuucgaagaugcauguucugcccucacaaaucuauuuugcaaggcauuggucaaggguauaucuucuggacccucccagcugggaugaauaggucugaagugacuaauccacuccaccaucccaaucucccuaagccuuuggaucccuuccucuacauaaaaccaagggagaucaggcauuuccaucucguucacagugggccaucuuuuaauccauauuucagcuaaccaagcaaauaagcuauuagaaccuuuuuuaacuccccgagcugcaacauuaaaugcagagucucuaacauagugggcccaaaucaauaaauucagccugauccaacucuguguucuuuccaccauuaucccacacccuuaauauccguucccaugccuguucuccagguuucuguuuauauaaauuagaaaacucaagcaguuauuuuugaguauagugcaccuccucaugggucacacucucaaccucaccuccaggagcccaccaggacuuuagucuaguugaagucuggaagcaaacagggguguuggggguggcuccugaggagaaucaacauuaucuugccuggcaacugccucagaggaggccaucacuguugcuucaggcagcacaggguuuaucuccucagucaaagguggaaaggcugaugacagcaugggccggggaggggauauugccacuacuggagauggggaagcuguuucuucuggcaaaaaaaguucaucagaguuuacaaacucaguguccccagcuucaucaggguccucccacacguucccauuccaaguugcagggucccauucuuuuccaaucaaugcccucacuuuaacaguagacaccuggcgaggcugugcaugcaccuuuuguuggaggccagucacucgcaugauaagagcuugugucuguuuuuccacaauuucagcucuuucucuacaggagauaagacucucacuuagggcaaucuuagcagauuuuagguucaauaucugcuucugaagccuggagcuagaaucccugaguucaucauuuucuuucaugacuuuguccacugaacuuaggagcaaccaacuagcuucauuauguuccuugguuuuccacguauggucaauuguauuauguauagucacugaacuccuugccucucacgagcgaugauucaggugugucaaaugcauuuauuuugcauaacucucuaaacaguucacaccaaggacuaucaguguucccuauacuauuagaaguacaguccuuagcauuuuugggucuaaucauauuaaauagccaacuccagaaaccccaaaaccaaugaaagaacuucauccuuaauauucuguuccucuagaacaacuccugguaccaaaaucuguaucagucaggauucucuagagggacagaacuaauggaaaauauauauauauauauauauauauauauauauauauauauauauauauauauauaugaguuuauuaaguauuaacucacaugaucacaaggucccacaauaggccauuugcaggcugaggagcaaggacagccagucugaguucuaaaacugaagaacuuggaguccaauguuugagggcaggaagcauccagcaugggagaaagacguaggcugggaggcuagggcugucucucuuuuucacauuuuucugcuugccacccuggcagcugguuagauugugcccacccagauuaaggaccggucugccuuucccagcccacugacucaauguuaaucuccuuuggcaacacccuugcagacacaccugggaucaguacuuugcaucugucaauccagucaaguugacacucaguauuaaccaucacacagagggagacccugucucaaaaaaaaaaaaaaaaugaugcagcuuguaaagcuccacuccaugcacauacacacacacacacacacacacacacacaccacccaugggaaaagguccuggucagagucagagaagauguuauuauucucaacaccuuaacuccaaacaucccauuagaugacucaguucuaacccuguuuuggcuuucuguuuucuugccuacaacuuccuuucccucagaccuuucuguggucuuagguaggcuuccuucuagccaucuugguugcucuuuaguguaaucugaggcuuuuucaguaucacugaucuugcccaccuguggucuaggggaaaaacaucuaccuugacuuucauaaagcaagucauauggggggauugauuucuauauacucuuaaacaugcauuuguaggaaaauacuguugauuugcaguaaaauauuucucuggccacuuucuauuuguauuguguuuuaaggauuucacagaggugaaaucuucugguccuuguaauauaccaugaggcaacuagaacaggcccgaugacccuaguuuaaaaacaagaaaauuaagacagagugaauuaagugguuuguccuugguuuaugacagaaaaauguuaaacuuuucaugagacuucagaaaugaacauauucuuugcugacagaaacauguagaugugcccaacacaauccuggauaccauuccagagggagucuuuggggcaucccucccuaccccagucuuuggcagcagguagaucucuccuugcucgccugauauagcugagcacacagagaaccagauggcccucaggcccggacagugaggcugggguaccucuuaggcacuuuugccuccucagccuguggcugaugaacauuagagggacugucagcccuuugaauaccaggucaaagcagaaauuuuauuauccuaaacuccucccauguuauuuuggggcuagacuuuuucaauuuaaugaagcauagcuuauaucucuugugucaaggucagucaucucaaagugaauuuuccaagugagcuguaucuguacugaugucaaugugacaaaggcagugcuuucugacaggaacuuacuaacuugcuaauaaguacuaacuugcuagcuaaucaggaccagaagucagcucacugguuucucauccauaaagagucagcauucccauuccauaaaaagucagcauuucuuuugaaggucaggaccuccucccuuaccagaggugcuuucugagcauggggcugagaaccagcagucuagccugagaugcuuuccaaugucaaaagaggcagaaagcucccuaaugguaccugggcccacgaccuggugacuccaccuaccgccucuuugcuacugcugcucacagagccugccaugccaucuguggucucucauucccacauuuucucaaaccugucacuuuccauuuugggacuuggacuuugaggagauguaaaugcuagggcacaucuucucauugaaugauaagauuugggcgcaaguggcuuccuuuaagcaugcucacccuggcuucaggcuuucugucauuccauucucauugucaccaagggagggguuaagagaaccagagugccuccucccaacaacagcagugggccaggaccgguaauccuuugaagguuaagcauaucuccuucaaaacaggugacgagcucaucuucuuggacccucauacaacccagaccuuuguugacacugaagagaauggaacgguuaaugaccagacuuuccauugccugcaguccccacagcgaaugaacauccuaaaccuggauccuucaguugcauugguggguauucguagguugggugggccaggagauacgauguguacagauugguucccugggaguuauccagauugcuagguaggaaggcaagaguauguuugcucacuauccccauuagaggcaguagaguguaguggggaaggaauggacccuggagccaaacugcuccaguuggaaucuuggcucugccacuuacuaacuguauuagucuguucucccacugcugauaaagacauaccugaggcuggguaauuuauaaaggaaagauguuuaguuaacucacaguuccacauggcuggggaggacucccaaucaugguggaagaugaaggaagagcaaagggaugucuuacaugguggcaggcaagagagcuuaugcaggggaacucccauuuauaaaaccaucagaucucauaagacuuauucacuaccacaaggaugguaugggggaaaccacccccaugauucaguuaucucuaccuggucccacccuugacacguggggauuauuacaauucaagaugagauuugggugaggacaccaccaaaccguaucacuaacuacgcacuuaggaggagucacuuaaucuuucugagccucagucuucucaucucuaaaaugaggaaaacaauaguucguuccuuaugggguuguaugaggugcaaugcauguaaggcacuuagcacugggccuggcacauuguaagcauucuauaaauguuaguuacucuuuccccuguuuccuucuuguccucaaauuauugcuacccaggcacagggaggaagaugggauaucacuagggagagauaagggagcaagaugcccugggugcacacaaucuaggaagcugcaggauuuucccccagaaguauggcuggugucuacacacacugaaggggcaucugccugugaaguagcuggugguucugaggccugucugcauccucuccucuaguuuaauccaauugucaguauaccagugaccaggagcugcaaguccuccucuugugaaccauucuuucacuacucugggauggauuugagguugagaaagcacagacugaugguucucucuauucugauagauaauuuccugaaggucaaugccaucuucuuaaguauugccucuagcuaaaaguaccauuuggcuuuuguuuguuggcuuaauugaauguucuuuggagauguguguauuuguacacugaaaguaauggaauuaacccuacacuuugaagaugaucuucaaguuaaaauaucucgcagcaugaggaaagagggaaagggacagagagcaagggugagaaugagagcaagacugagagagugauauguaugucugaguaaggcaaugaguuaggagagagagaagcccaggcagucuuccuucuuuauugcugagaagucacauccacagagacuggcccacauccuaauucugggccaacagcuccauugugcaauaccaaagguaauucuaaguuguguucuuuugcuuucccccaagggauuuuucugcaaagaagaaaaagacuuugauaacugguguagccuuguucagaagguaaagcuauauguuuuucuuagucugaaaaaugaaguuacccaauuuuauuccuuuucaagauuguuuuucauaguaaaaaaaaauccuacucugauacgacuuuacugcaagagaaagaaacuaaggcaacaaagaaacuaucagguguggggaauugugcauaacuucggggaaacugaacaaaaauuuugguuugaaauaugcuuagcaugucaagggagugauauuuuuagugaugaaaccuaauguuuuaucucauuaauagacaauuauuuucuaaaggcaauacuuacauuuuagaaugcagcaaaacuguauuuaugucacauuuaaagguggaaugagaauuuucugauaagacuaugccuuuuauuuuauuuuauuauuuuuugagacaaaggcucgcuccgucacccaggcuggagugcaguggcgggaucugggugcacugcaaccuccgucuccagguucaagcgauucuccucccucagccucccgaguagcugggauuacaggcgcccaccaccacgcccagcuaauuuuuguauuuuuaguagagacaggguuucaccacauuggccaggcuggucuugaacugaccacaggugaucugcccaccucggccucccaaagugcugggauuacaggcaugagucaccgugcccagcuaagacuaugccauguaaauuaggauauauaccauacauguuggacugccacugaaaccaugccaauauguagcaauagucucuuggggcagauuuaauuucacuaacugacauuucuuuggagccagugcuucaggaacaugucaccccuaaagugagcuggacccaugcgucuggcacaggcacuaugccucaugauggagaauaggcagugagugcuggccuucaucagauacuccccgcaaaguccuuccuuccuggcuaaacaguaucuagaauugaagauggcugagucuucagaugguucaaguagaggaugcauguauuuucuaggccccuguuuucaccuggaaaccagcagaccacugucucaggguuuggggucaaagauugccaauuagaaauguugugacucugaaguauuuaaaacuguuuugucaucuccccaggaaauucuaaaggagaauuuaaggauguuugaauuaguucagaaacauccaucacacuggccucccuuuguaccuccagccaagccagaagugacaaccacuggggcagguaagcuguuguucaauggcucucagcuagcagacccacauauagcaguuguuuuaugagaaagaagaauuguggcccaugcuuucuguggacaguaaaauuucuacucagcuggagugauaaaaaaauggcacuucugguuauuuuaaucuucugaugagcugauauuuaccaauuucaaagaaugauaauagaagaaaaugagcucauugcaaaaguucuaugcaaaaucaagaugacuaggauugcuuuuucauggucugguucagaauagcaaauugaggccaucgauaauucaaagguaucuugaagggcuuucagagccuuggccacaucaccgucguuagguuuauguaacaagucuggcuauuuugagucuuuauagauaauuucuaauacuuggcaguaguucuaauuguaagucuccuccacacaagucuuucuuuaguacagcaauuaaaaaugcuuagucuuaacuacugaguaaaguauuuacugaccacuucaacccaagugucaagcuuuucuucuuucucauuuccguauucugauagaauucauugacucuacugagcaacuggaggaguuugaucuggaggaagauuuugagauucugaguguguagaauccugggaacucaacuugaaggucugucuuccaucuggcaccauaaaaacaugaacuuauugcauaaaacuuuucuagucagcaagugccugauaugccaauagcauacaaacucaauagcaaucaugacugagccaaucacuguuucucagaaaaa

SEQ ID NO: 13775 - RNA, 12258 nt, Homo sapiens
caaagcuaacccucgggcuugaggggaagaggcugacuguacguuccuucuacucuggcaccacucuccaggcugccauggggcccagcaccccucuccucaucuuguuccuuuugucauggucgggaccccuccaaggacagcagcaccaccuuguggaguacauggaacgccgacuagcugcuuuagaggugagggaccccuuucucuucuagccccgccuagaaggauuccagggcuauugguucaaccaguuuguuagggaucuggggauaacaagaaagggcucuguuagagucuacagaaaauucucucuuaauaagaggaccuucggaaugacaagcccuccucuuaccccacauagaacaauuccaaagcaaaucgacuuuugcguuuuaccucugggauuagauagaauaagggggcagaguggaaacgagagccaaaauuguggggcugcaucuccagagaaggugaugauucuguugaaguuggagguucccggggaaucuauaacuuccugucuuuuuaacagguugagauccguagcauuuuaguguccgagaggauaauugcuaagggagcagagaccucuucacaccuucaugcgcuuagaccugccuagaggcucagauggcucaguggcacugcucacagagaacacaggcuggaggacauggagucgggguaggggccuaggugaaucucagcuaggcucuuugcacauuuagcaccucugcacaucugguuuccuuuucugcaggaguggaaggggauauugaagccuggcugaguuugcucuuuuuuucccauuccugacucccgaguugggccucucccugccugggaguuguaacccugcagccucccuccugaucccccaucccuucaggaacggcuggcccagugccaggaccagaguagucggcaugcugcugagcugcgggacuucaagaacaagaugcugccacugcuggagguggcagagaaggagcgggaggcacucagaacugaggccgacaccaucuccgggagaguggaucgucuggagcgggagguagacuaucuggagacccagaacccagcucugcccuguguagaguuugaugagaaggugacuggaggcccugggaccaaaggcaagggaagaaggaaugagaaguacgauauggugacagguaaauaaucugaaagcaggccccuaacucuucucagaaccgauauucuuccuuccuugcuucuuacucuuuuuuucgcuuugucccaguccauuguggcucugucuucuggaaucuguuuuagggaaaccucuguaaugccaggucuauuaaggagagguucuggggauccaggccgcugugguacccgcucuuucucaauucucccuaagauuggaggcaaccacugggcaaaugcucacuauucuccagaucacccacccugggggaguuccugcuggaggcaucuaauucuugccucuauuuccuuuuccugugcuuuucucaucagacuguggcuacacaaucucucaagugagaucaaugaagauucugaagcgauuugguggcccagcuggucuauggaccaaggauccacuggggcaaacagagaagaucuacguguuagaugggacacagaaugacacagccuuugucuucccaaggcugcgugacuucacccuugccauggcugcccggaaagcuucccgaguccgggugcccuuccccuggguaggcacagggcagcugguauaugguggcuuucuuuauuuugcucggaggccuccuggaagaccugguggagguggugagauggagaacacuuugcagcuaaucaaauuccaccuggcaaaccgaacagugguggacagcucaguauucccagcagaggggcugaucccccccuacggcuugacagcagacaccuacaucgaccuggcagcugaugaggaaggucuuugggcugucuaugccacccgggaggaugacaggcacuugugucuggccaaguuagauccacagacacuggacacagagcagcagugggacacaccaugucccagagagaaugcugaggcugccuuugucaucugugggacccucuaugucgucuauaacacccguccugccagucgggcccgcauccagugcuccuuugaugccagcggcacccugaccccugaacgggcagcacucccuuauuuuccccgcagauauggugcccaugccagccuccgcuauaacccccgagaacgccagcucuaugccugggaugauggcuaccagauugucuauaagcuggagaugaggaagaaagaggaggagguuugaggagcuagccuuguuuuuugcaucuuucucacucccauacauuuauauuauauccccacuaaauuucuuguuccucauucuucaaaugugggccaguuguggcucaaauccucuauauuuuuagccaauggcaaucaaauucuuucagcuccuuuguuucauacggaacuccagauccugaguaauccuuuuagagcccgaagagucaaaacccucaauguucccuccugcucuccugccccaugucaacaaauuucaggcuaaggaugccccagacccagggcucuaaccuuguaugcgggcaggcccagggagcaggcagcaguguucuuccccucagagugacuuggggagggagaaauaggaggagacguccagcucuguccucucuuccucacuccucccuucaguguccugaggaacaggacuuucuccacauuguuuuguauugcaacauuuugcauuaaaaggaaaauccacugcuccucuccuguguuuguuugggguagcccucagaucaaacuucccccugaccauccaguuucucccucccaacccauccccacuccuugagccauauuaaagacuugggcggggcucccuuugcugaggaagaguuuacugugaggcgccugggggagguggcagaaucccgccacuuuaggaggcuggacgaaaggccuccuuccacacccaccgccauccacagcagccaauccacagcagccauccuagaaccucaguggcaccgugccucuggcugugagacacuggggcccagggcagagauuccaguuccgauucucagaggauuuugaacuacaaaaugcauguuaguugcauugcauucuaguguggaaaccagagcccugaaugccuguguuuuuaguaagaacugaagucuccccucuaaaguggacucugccccgcaccccagaccuccacucccaccuccagcguugugcuccugcagggccagguugcacaaucauucuuggucuggaccgcucugauuuuccugcugccacggcgucugcgguuugugcagggaggaggggcagugaccgugucccagauguuggccuuacacggucugcagccuauucuugcuuuccuuuucuccacucucaucacccucaccuacccacuccagcccugaaccuggcugaagcccgucaggacuucuggaaacuuaacccucucuggcccauacccuggccucuggcguuggauugcagagcguaauguggggaagagggaagggagaagggagaggaggaggaaggcuccaggcuuuggacuccagucuccaggaaucugcugauuucugcaccaggcccccaccccagccucacccucacugcugcaugcucagcucgcaggggcaaggcuggcugaugggcaggauccacugcuuucaugaggaguccaccucaggcaugccuggggguccucuugguuauuugcucuagccaagugcgggaagggggcacagccuucuccccaaagcacagcccuccuucccgccccaggugggguggcucagucagggcccugugagccucccuuuaucuucuuuucuuuucuccucaggcagagcugcuccagacguagguugaugaggauggggaaagaaagacagugaagcaccucagaaaggcgcuauuauagggagaccggggcgggcaggggcucucucccauugaauucucuccuaauguggggcuggcaacaguaaucaccaccugucagcccacggaagggucugcccacagaacagcuggcugcggcacacguggugcacagggagggguugagggggaagggcauucugagcacaggccuggagaauggggucugggccacacggcuggcagagcaguguggggacugugggugccccauguggaaggggagcuugucugcucccuagcgugacuguguguguguguguguguguguguguugggggugggaggugccuguguguggcagaggugcuugucugcucccuagugugacugcguauguguacguguauguguauaugugccugcauguggcaggggagcuugucugcuagcuuguguggcuguaugagugugugauaggaggcuguagggucaggccgugucucuggaguuaccuuguuagagcaccaaacaccaggagcggcucugaugcccuugaugagagcauaaccugagacuccguguguauaagugacgucaaggaauauguauuugaaguacauucuuaacgccuuauuacuuccaugaaaaucagguaaccagguucuuccgcguugcaugugugugcuugucuuuguggcaucuaucuuugccugauuccuccuccaugagaaagaaaaaaagcauaucuuuuuuuggcuuacaauuucuguggaaaaguucauucaggcuuuucugaaagggcagaaaucucuggggccuugucguuuauuacuuuucucuuccuucuuuuuggcuccugugcaacagcuagugcuauuuuggaagcauuauggaaggugaguagaacugugugggcagauccagugaacuguccaaauucauuaaacuaaauuaucugcugcuccaggagacagcaccgguagcuaaauccuaucauccacaaguagccucagacccccaucagacccuccacaacccaucacuuggcagaaauagguuaugaccucugauuuuguugaacaaaagacaguggaaggcaaagggccuaguagaggagagagggguuaaaagcccaaagagaagucccacauaugccccagugccuagccauugggugguacaguaaacacccaaggauggggaugugggaagggcaccaagaaccaggaggggcugcugugguggaggcagcugucugcuaggucuuagguccagauguugcuucuccaucacaaggcaguauugagagggcucccccaaggcaguauugagagggcuccccucuccgccacacugggccucaggguuuccugcuuuacuuccuaagcuccccuccuuguucucaauauccucucuucuccaaugcuggucuuaguaucugccugccagcgaauccaaaguguuugucuuguucauuuuaaucaaggaagcugagccgguguugugagcgcccuggaugguggagagggacagggcagagauggacaggaagaaguuguugauucagcugucaauguuuccucugggaugggcucugagcuaaacagaaaccaagcccuccuuuuccuccuccuccagucucagauuuucugggccucuucucaucucuccuugaacaggcaccccuuccccaaggcuccugggggcauccccuuccacugcuccccacuccucuaccugguuuagaggaaagcaugcccauuuugagagcugcugagacuguccugguauuucucagggccuucaggauaggucucuucagggccugccacccagccucucugugucugccuuugcaguuuaguguggucugugguccaggagaacuuuucuauuucuccggcuggaaaguagggucuguccuguggccuuagcuccuguuagcagcuguggccucugcaggcccuguggaccccucagccuggcuggugagcuuuccuuugccuggucuuuaacuucugcuuuuacaaugcagagcuuaaaagaguaaagcuuuauuucuggauuuaauaacuccacagaauuauaaauguggaagccuauguauuacuuuaaagggcagagugagaagugaaaaugcaaaacucucagcaccaucuccccagaacuuggguucugaccauaccucuccaggacugccaagaccaacucgguuggagagacccuaacccagcagcgcuagaggaauuaaagacacacacacagaaauauagagguguggagugggaaaccaggggucucacagccuucagagcugagagccucaaacagagauuuacccacauauuuauuaacagcaagccagugauuagcauugcuucuauagauuauagauuaacuaaaaguauuccuuaugggcaacaaaaggauaggcagaaauaaaaggauggguugggcuaguuaucugcagcaggagcauguccuuaaugcacagaucacucaugcuauuguuugcgguuuaagaaggacuuuaagcgguuuuccgcccugggugggccagguguuccuugcccucauuuugguaaacccacaaccuuccagcaugggcgucauggccaucacgaacaugucacagugcugcagagauuuuguuuauggccaguuuuggggccaguuuauggccagauuuugggggccuguucccaacacaggacaguccugcaugaccucugggggucuauccagcuuacauucccccuucucugagaugagacaacuuuacucccuggccauagcaguaugcccagaagggaacacaucagacucccuccuggggaguuagaauugcaggucagagauauuagaucuuaggaaguguuuggaggcaucuuugcccugcuacccagaggcaaugaaagcccacuggaggggaaaggacgagguggaccccagggagaagccagggcagaagggaggaagcagcugaccugggccuguguuccugcccaguccccagccaucaauccugaggucacggcacacuucuggcucuuggguucugcaaggugccuauaaguuaauaugaguggauuucuguuucccaaaacccaaaggcggcuccucaucuuuaccuucccaccaaaaaaauccccugucugcuggacugcuaggcaaauggccuuggccccauagucagggguguucaaucuuuuggcuucccugggucacauuggaagaaaaauugucuuggaccacacauaaaguacacuaaggauagcugaugaccuaaaaaaaaaaaaaaucgcaaaaaaaaaccucaugauguuuuaagaaaguuuaccaauuuguguugggcugcauucaaagccauccugggccacauguggcccacaggccagggguuggacaagcuugccguagagugcucuucccugcacaugacccagaagacucacuagaauaaugaaagaaucuccccaaagccuggcccacaucauucuaccgaggcucacucaagucacaccuccuccacgacaccuuccagacgaccuggucaguuccacauuccuguucuguucauucauggucugccgucucaccccaucagagccuguagcacaguguucucagaggcaaacuuauguauuagaaagagcaucaacuuuggggucagagccccugggaucagagucuggcucugccacuuaccaaaguuacuuaaggccucaucuauaaaauaauaucuacccaauaggauuguugcugugaggauuaaggaugaaauacgcagauucuuuaguagugcaugcaaucagugugugguagcucugaaaccccacuuccuuugagaggauuuucuggcccuuucuacugccaaccacacaugucaggacccuuugcuaugggccccuguucaccccugggcauagcccacuuggagccuguaaugugcugcgcuguuugcucauguuuguguccccaggguuuaacacagagccugacucauaacuacuuguugaauguauaaacgcuauauauauccaugcuucuccaucaggcugugaacccugggaacccugagcauguuugucuccuaacucaggaccuagcucgggaguggcacauugcuagcaagcaguacauguucuugguggcauuuuucaagucaguugguguauuagucuguucucacgcugcuaauaaagacauaccugagacaggguaauuuauaaaggaaggggguuuaauugacucgcaguuccacauggcugaggaggccucacaaucauggcagaagaguaagggacgucuuacauggaggcaggcaagaaauuugugcaggggaacucacauuuauaaaaccaucauaucucaugagacuuacucauucccacaagaacaguaugcgggaaaucaugcccaugauucaauuaucuccaccuggccccacccuugacacauggggauuauuacaauucaaggugagauuuggguggggacacagccaaaccauaucaguuggacaaagacaagcuacagauaaaaacugaaaacagucgucuuucaauugcagaaggcauuggccuucccacaugauuccaguucaaacaucuaaggagaaacucaagcuaggccagcaccuuuaugcccugaggccacaggggaggaggguaauaaagcugcaggagguagcggaagaccuagguguucagcaccgguucauagcaaggguccuggaguaguugaaccuguguucgcaccccagccuggucacuugccagagugugauguggugcaaguuacuccaccucuucgagccugguuucuucaucugugaaauggauuuaauaguacucacuucagggauugcugugagcauuaaaugaaauaaucucuauaaagcagugagcccaguaucuggcacacaguaggugcucaauauauauuauuguuauuauuauuuugagauggagucucgcucugucacccaggcuggagugcaguggugugaucucggcucacuacaagcuccgccucccggguucacaccauucuccugcuucagccucccgaguagcugggacuacaggugcacaccaccacgcccagcuaauuuuuguuguuguuuuuuuuuaguagagacaggguuucaccauguuagccaggauggucuugaucuccugaccucaugauccacucaccuuugccucccaaggugcugggauuacaggcgugagccaccaugcccagccuauauuauuauuauuauuguuacuaaugucaucaucauugcauaagucuuuucaguuagcaaagugcucucauauauuuucucuccuuugaucugcacaauaaucccaugagauaagcaggugucagaaaccugaggauuauagagaugaaaugauuccucuaaggccacauaacugauaaguguuggagcuggaaccuaugcuacggaggcuguguggaggagagugaagagcuggagcucugaacucaaguugccuucaaauccuugcucugccacuugcuagcaauguaauccugugcaaccaugcccuaucucagagacuugugaggaaugggugagcuaguguauuaguccauucuuacacugcuauaaagaacugccugagacugggcaauggaagaaaagagguuuaauugacucacaguuucccaggcuguacaggaagcauggcuaggaggccuccagaaacuuacacucauggcagaagggugaaggggaagcaggcaagucucacauggcuagcaagaggaagagagagccaagggggaugugcuacacacuuuuaaacaaccagaucucaugagaacucacucacucucaugagaauagcaaggaggaaaucugcccccaugacccaaucaccucccaccaggucuucccccaacacuggggauuacaauucacaugagauuuggguagggaccagagccaaaucauaucagcuaguguuuauaaaauaucuagcagagcaucuagaagaauagauguucaauaaauauucauuccuaggcccaugacucuugcuauuuuauuuuuugggggcaggaggacagguucucacucugucacccagguugaagugagaucucaggucacugcaaccucugccucccaggcucaagugauccucccacuucagcugggaccauaggcacacgccaccacaccuggcuaauuugacuuuugcuaucuugauguggaacagcaugccagugaucaucucugcuaggcauuauaaaccauuuauccugacccaguggcccuucugcuccuuccuucuccauuuguacacuguucuguaggaagacguggcaccuuuuucccaccacagaucucuguguuaucaguaacagcaggguugacaggugccuugcacuagccaugagggaagaaaguaaggugcacugacacauccuccuuuucucugugccuggaccgccucucccagcagugauauugauauguguguguguguguguguguagagaaagagagagagagagagagagagagacagagagagagacauugugcuccaaagcuacauuuuuccuucgaucacauuuucucucaaagauauuuuaguuuuucagccugugucccuaaaauucaucauuacuaacuuuuuggacuuaccuuacuguggauuuuggcagauccuuuggugccauuuugcugcacuucaucuuauggguguuuauuacuguccaauuucacauaauuuugguuuuguagcuggugaauuuuguguuccagaccuguaaauccaugcaguugucaaaugcaugagcuguucucuaucuauucuuauugugcuuucuuggggaaggaagauaguguggaaagagcacaggugggaguaagaugaacuuuccauuccuauguaauuuguccaugugcucaguguccugucucugcuccucauugaccgugugacauugaaccagaugcuaaucccucugugccucaguuugcucauuugcaaaacaggauuuuauuaucuggauuaucaucacccacgaucauugcaguucaagcccuaaugcauaaagcauucagaacuucuagcaaggacucuuaggaaucauguccuuuggcuuccucuucuuauaaugggagaaacugaagcucagagagcguuuugagggcagggaccaugccuuauccaucuuucuauccccaggauccagacacagucuggugcauacuggguguccaacagauauuuuguaaaugaguugugugaccagcucccagugacauauuugugauuuagcccccuugaugacucagagugauuauccacaucaaucacuacacugugcauccugccaggauggcuucagaaccaauuauguuauauagaauguggcuguuaugcuuuucuacuuauguuuccugcucucuucucccucacugucagcugucaguucuccccguagccacuggauccacuuuaagaaaucucugucacuguuuugaauggguauccacuguagucuggggcagaauaggaguaaaaggacuuugaaagauuucaaguuuggcgcacauagaagguaccuuuauuggagucacaaggauuauggcggaguagaccacagacuagaagcauugacuauuuuaagcuggaagaggccucacagucaucugaucugaccucuugaagucaugcaacuauauccuaacucaugccccuguccaguuccuucuaagcaugguguuaguuuccucagugacuuaugaagcaggugcauguuuuaugcggguaaugguugagaaagucaugguuccaccccuuggaauuucuacccaaugaucuggauucuuaagcaauuuuccucucagcacagaggagguaaacauacguagaugugaguuucuccucugauugcuaauuaugaccuagcaacuucccuccuuuucuccucuauguucucucuagcccuuuucaguccugauugaggugaaauauuuuuuuacagccauauauuacuuagaguucuaggggaaacucuaaaaauguaaacugaaaacacucaaggauaauuaaguaggggaggggugacagagagaaaugguaauucuaucacuggauuucaaguugagauaagaguaauuccauuuaaaccaaacuucaauauucacuugaaagccuguaaauuucaaguuuauuagccauaaauugugauuuauguccuguggguuuuuaaugagggcaaaugaggcagagaaaugcucuuauugauucauggucugg

SEQ ID NO: 13776 - RNA, 17253 nt, Homo sapiens
ccuggcuugaaagauauuuuaguaaaguacuugcgguuggaacuggaggcagccaagccaguaaaguaucuuagaauaaaauggugaaugagaucuuauaaauauacuggcucugguuggcaaguagaacuuuugcuggugauaccuucaugaauaguuuaucucucgacacuguaguuuugugguuuuuugagcaaguucguugguaacuugagacuucaaaccaaaccagaacuuccuucuaaaagaaaaaaaaagaagagauaaucucaaaguucacaauucuuuggaaaauaaacuucuuucauucugugcuuuuguuuuuauaagcacagcuccaucaaugauuuguugguacaaaucagugagucauaccggccuuguaaaguucuuacacuuggaacuugugcagcuuguuaguuauauauuguaacuggucuuguaauuugaaguaauuuugcaaacaugagcugcuugaucugccaccugcaugaguguauaacagcagucuguauuuuuuaggucuuuuuaaaaaaaauuuacuauuauuccucccguuaucuucccuuccucucccuuugugccauucugaacacaagucaucaagauuauuuuccuuuaaguaccacuucaacaaucacugguuugucuuuugguuccuuuuguuuuuguuccugaucuucccuuuaguuguuggaacccagcuccuaaaugccuaauauauuccuguagugcauaauuuggcacuugaaaaauuuacauccuguuuucauauuuuucuuucuuuuucauguguuauaucauuucagcaacauuuuaaguuuuuugaagguaaggaaacuuacauuucuuuuagauucuuuaaggguaccugguacagugcuuucccagagugcuuaaggaaaaagaaugagaagaccuuugccagcauugcuacucauuagcgcuggguaaaacucguuuggccuuuuuggaucuguuuuuuuuuuuuuuuuuuuuuauuugagacaagaucucgcccugucgcccaggucggagugccgugguggguucaggcuggagugcagugguggguucaagugauucucauaccucugccuccuaaguagcuaggacuacaggcacuacaggcacgcaccaccaugccuggcuaauauuuguauuuuuaguagagauaggguuuugccauguuggccaggcuggucucagacuccugaccucaagugauccaccugccucggccucccaaagugcugagauuacaggcgugagccaccaugccuggccuggaucgccuuuuucucaucucggaauuaggggguuuuagaaucuuuaaggucccuuuuaucuguaagaguuccaguacuuuuuugcuagugucuucugcuccaguuaaauauaucuccuuacucuacacgguuuuuuauuuuuccacauccuuuggcauacuagcauagcaaaagucaucucauucuucugaaagagccuccuccaucuuccauucuccaaacugcuguugccuuacuuaagucccguuuuccuucagccuuugcuggcauauuguuuauguuucauauugaucucugcuuuguuaauuuuaacuuuuucuuauccuggaaacuccucaagguauaguuuucuuaauucuaagcuuuauagaccuauagacuguuaugugcagguacuaaaauguaguaccuuuuuacuaaacacaaagcacuuacuuuucuuuuguucuguugccguagucauuccaaauaaaucuaagugaacuauugauuuugauacaaagcaacagccucugccacacugaagaagugagcuuuaagcagagacuagaaggguaaguaaaaguuaggaaaagaaaagccuaagggggaaaaugaaguucagagaggaaacauguugaaggaacuagggccagagaaggcaaggucuauugugggaacccagagagacuugguaguauuggaagagaaagugccuggggaaaagcgcagaugaaacaaggcugugcaaguaaucgugguccagaucuugcaaggccugguaauccaaauuaggaauuuugguguuuguccuaagguuuuaagugggggauagguacacuuuuuuuuuuucagaugugcauuuuuaaaagcuucaguugagaggugaauaaugaauugggagaggggagcuuagaaaaggggcuugaggccagcaucguggcucacaccuguaaucccagcacuuuuggaggcugagguagguggaucacuuuaggagucugagaccagccugagcaacauggugaaacccugucucuacaaaaaauacaaaaaaauuagcugggcgugguggcauguacugguagucccaguuacucgggaggcugagguaggaggguggauugagcccuggagguccaggcugcagugaacgaaccaugaucguguacugcacuccggucugggugacagagucucaaauaaaggggggaaguugagaguacaauuuggaggaaaccaguuaagcuguuuaaguaugggauugugcaguagggguggagaaaacuuaggagaguagagagagauuuagguguucuguugggaagaauuuucuucccaaacuugucucacuuuguuuuuacagaagauguacucuuaucaucuguaaaaaauauguaucagaguaugugauagacaauauguauaccuguguucaugucaucugaggauaagugcuggagcaagaaaucaauauauaguacaguuuuuaggucauuuggcuaaccagcuguuaaauuguaugaaagaggcaaagauaacauugagcaaaagcaacaggaauuuauuacuggugugucaggaaaaagguuacugagggguaaggacaaaucaauggaaaaugauuaccuggguugucuuauccaacuguuccauucaggguuauaauauuuggauccuuuuaauaagauuauuugccuauagugcuuauaguguggagcacccaguaaauaauguuaaauggaugugaccaugccagggagugggaaaguuguuaaucuguuuuugaaagccuuggauucuagcuauuaucuuuuagcaauaaguacaaguaccaaugaucuuuugcccaucauugcuacuuugguauuaaugaacugggcaaauuugucauuauauugagaugguuaaguccuuggaaagucagauuugaaauguaaagacuucauuuauugcuggagucaagaggcgcagcauuuucaggaagucaaaaauaacuuuuuaugccagguacgguggcucaugccuguaaucucaauaucgugggaggccaaggcaggaggaggauugcuuuagagcaggaguuugacaccagccugggugacauaguaagaccucaucucugaaaaaaaaaaaaaaaaaaaaaaaaaauuagccaacuguggcaugugccuguagaaauuagccaagcguccuggugugugccuguaguccuagcuacuuggauggcugaagcagaggauugcuugagcccaggauuucgaggauacagugagcugugaucacaccacugcauuucagccucacugacaguggugagaaccugucucaaaaaaaaaaaaaaaaaaagaaucagcuguuuuuuuuuuuuaaaccuuuauuuuagguucagggguacaugugcugguuuguuauauagguaaucuauaugucacagggguuugguguacagauauuuugucguccagguaauaagcauagugccugacauuuauuuuuucugauccucucccuucucccacccuccacccugaaguaggccccagugucugugguuggccucuuuguguccauguguucucguucuuuagcucccacuuuuaagugagaacaugcaguacuugguuuucuguucuguguuuguuuaggauaguggcccuccagcuucauccauguugccuguugcugcaaaggacauggucuuguucuuuuuuauggcugcauaguauuccaugguguauauguaucacauuuucuuuagucuaccauugaugggcauuuagguugaauuucaugucuuuccuauugugaauagugcugcagugaacauaugcuugugucuuugugguagaaugauuuauauuccuuuggguauuuacccagugaugggauugcuggaucuaaugguaauucuguuuuaaauucuuugaggaauugccacauugcuuuucacaaugggugaacuaauuuauacucccaucagcaguauaaguguucccuuuucuucacaaccuugccagcaucuguuauuuuuugacuucuuaauaauauucauucugacuggugugagaugguaucucauuuuaguuuugauuugcauuucucuaaugauuagugauguugagcaauuuuucauaugcuuguugacugcaagugugucaaaaauagcuuuuuaauuuauugaguugcuauucacauugaauugaaaauaucuguaauuugccucacagauucugauauauaguaaguuuuccacagauguuaauucuguuuuuguuguuguuguuguuugaaagcucuccaccuaggaagagaauugccuccccacuugcaaaggcaaguuuaauagaacauaauaucuuuauccugugucuagaaauugcuguuuuagcugaguuucagaguagaauauaaauaagagucuguugguuuuucuaggccauugugauucuguauuuucuucucaccuuguguuaauugaggucagaaugagucucagccacacuguaagaaccccgguggucugauacugacuuuuuguacaucacacccuugcuguggggaagaccagugaaagaauucugaguuguccuuuccccuugggugaacuaaauuugucuuuauggauaagaacuauaaucauuuaauauuaaaacauucugaaaaauauccuagaacuuguacuuuuuucagugcccagugugaagaucugaaaucauaaguaaucuuuuauuauguuuuuuggguaaaaaguuggcaauaauguuacucugccaaaugcaaaauuuuauagaguaucuaguuacgaauccuuuuuuuuuuugagauggagucucacucugucgcccaggcuggaaugcaauggcaugaucucagcucacuacaaccucugccucccggauucaagugauucuccugccucagccuccugaguagcugggauuacaagugcgugucaccacgcccagcuaauuuuuguaucuuuaguagagauggcguuuuaccauguuggucagguuggucucgaacuccugaccucaugaucugccugccuuggccucccaaaaugaauacauuuuuaaaaauuugguauuucaugaauucuuuucaguauuacuuuaugaccccccuauuccuagacaguugcuacaaacugcaaauuuucuauuuagauucuuucacuaaauacuucaaguuacauaaaaguuguguuuauguuuuuugauagauuguuaaaauuaggugaacaauauuaacauuguuaauggaaaacaaauuuagaaaauuugcuuccuuuuguuguucaacagguuggcuuaauuuuaugauaaauacuuacacauauauuuuaauaggugcauuuuguaaaggagguacuugguuucagauuuuucuuuuauuauauuugguauuucagugaaguagguagaacaagaugauuuguaaauucagccucacaguuaaauuguacugaccuuagcuuuuaauuuguacuuuuuuuucucuucaaaguuuauauaaauuauggaaacucuuaaaguaaaucucaacugaguuuuagaaauugaaggcagaggauuuguucuuuccagcugacuaguccagugcaggugguuucuaguuguauucaggcacaaagaaauguacuuacugccuuuugauguucuguaacauccuuugucauguuuccuuccuuucuuguuguguuuauucuuuuaugauuaguaauguuauacuguauggauuggaguagagacuucccccaugacucaaggaccacacagauaaaaaggagggaagacauuaaaaaaaaaaaaucaaggaucgagcauuugaaaauacuacaguugaaugugagugguagggaguuguauuuaauagauaugagauugguaggcaggggucaaauaauucauccaacagauaauugaguauguauauauugucagucuguauaaggcuuuggugauagaagagcaagacagagaugguacaugugccggagcuuauacuguagcugggaauguagcauuaaauaaauacuuucaaguuaacagguugcugugggaaugcauggugggggcagggggugaucguagggagcguuucugcaugugacagaggugucagggcaguuuucgcagcagaaagucuucaacauauuuagagggccuggaggugaguggccuuccaagaacuaaagaaagaaaggcaguguggcuagaguggggguuaggggaggaaucaaaguggggagauguuggaaggcagcaagcagauuuuggagugcauuuuaaggcagguugagacagguuuuuuuuuugagauaggaucuagcucuguugcccaggcuagagugcaauggaguaaucacaacucacuguagccucaaugucccagacucagaugauuuuccugcuucagccuccugaguagcugggaccacaggcaugugccacuuacacuuggcuuuuuuuuuuuuuuuuucccgguagagauggagucuccccauguugcucuggcuggucuugaacucguggacucaagugauccuuccaccuuggguuccuaaagugccaggauuacaggcgugagccaccacaucuggccuaauuuuucuuuucuuuucuuuuuuuuuuuuguuaaugcuucccaggcugaucuugaacuccugagcucaagugauccuccugccugggccucccaaagugcgggaauuacaggcuugagcgaccauggccagccaaguugagaaucuuggacauuaucuccaaagcaaugagaaaccccgggagaaggggaagcaagaugguuaagaagagagagcaguuaucugauuugcauuguuuaaaagcaaagaucuacugaguggauuuaaggagauuaguuuggaagcuacuggcaguuugaacuagaauggugccaauaaggguagggaaaaagggcugauuugaaauauacuuaggaggccaggggcaguggcucacgccuguaaucccagcacuuugggagggugagggggguggaucacuugagcucaggaguuugagaccacccaggcaacauggugaaaacccaucucuacuaaaaauacaaaaaaauuaacuggguguggucgugcacgccucuacucucagcuacuugggaggcugaggcaggagaauugcuugagccccagaggugaagguugcagcgagccaagauugcaccauugcacuccagcuugggcuacagagugagacucugucucaaaaaaaaaaaaaaaaaaauacacacacacacacacacacacacacacacacacuuaggagauggaauggauaagauagagauuagauguggaggaauaagggagaggaaugagccaggauaauaguauuaaauaugugguagacacuaucauuuuacauguauuaaauuauuuaauucucagaacaaccccaugagguagguauugcuaucaccauuauguagcugaggaaacagacaucccuaauuuuuuuucuuuuuuuugagacagggugucauucuuucacccuggcuggagugcaguggcacgaucacagcucacugcagccucuaccucugggcucaggugaucacuucugccuucugaguagcuaggacuacaggcaugugccaccaugccuggcuaacuuuuuuuucuguuuuuuuuuuuuuuuguuguuguuguuguuuguuuguuuuagagacgguuucaccauguugcccaggcuggagcucccugauuucuggcuugaggcguuggaugugugauggcaucucauaauuaagauagaaaacugaaggugggguggaggcucguaaguuuaauucugaauguauugaauaugagguguuugugaaauguccaaguugcaggguuaaguagucauuuggauauaggguuuggaguucaaagcgagagaauccuggguuagagauagagauuuuagucuuuugaagaugacuaauuuugaggaguaauuauuaaaaaggggcaaaggguagagcaaggaaagagggauuacuauagagccccaaggcauaugagaucggaugguugaaaauggagaagauaaauaugaaauggcuugugugcuaugucagauguuuggacuuuauucugaaaaaauagcuuucaguuuaaucugugggcuuauugagcuggaagugucugugggauauucagggacagaaagcuggacuguucuuacauccuuuccucauauuuuucugcuaacuuuccucgguucuucagaauauacucuagcuuucucaucauccugguuacuuuuuuuuuuuuuuuuuucaauuuuaguauuuuuagagacagggucucacuacauugccuaggcuggucucgaacuccucagcucaggagaucuuccugccuuggccucccaaagugcuggaauuaaaggcuugagccacugugccuggcccauacugguuacuuuuuuaucuuaaaaugugguagacaauugaaugcauuuuauguaugaccugagcagaguggauaaucuucacuuuguccagcacguucuguacacuguuucuaugaauauaggucaagauugaauuaguuuuugagaagaggagaacauuauuacaucauguuucuuuuaucaaguaaaaguguguguguguguuuguguguuuuaaaucuaagccuuguaucuuuuauccuuguggucuaauucuuccuuucucucaauauagguauggcaucacagcugcaaguguuuucgcccccaucagugucgucgagugccuucugcagugcgaagaaacugaaaauagagcccucuggcugggauguuucaggacagaguagcaacgacaaauauuauacccacagcaaaacccucccagccacacaagggcaagccaacuccucucaccagguagcaaauuucaacaucccugcuuacgaccagggccuccuccucccagcuccugcaguggagcauauuguuguaacagccgcugauagcucgggcagugcugcuacaucaaccuuccaaagcagccagacccugacucacagaagcaacguuucuuugcuugagccauaucaaaaauguggauugaaacgaaaaagugaggaaguugacagcaacgguagugugcagaucauagaagaacaucccccucucaugcugcaaaacaggacuguggugggugcugcugccacaaccaccacugugaccacaaagaguagcaguuccagcggagaaggggauuaccagcugguccagcaugagauccuuugcucuaugaccaauagcuaugaagucuuggaguuccuaggccgggggacauuuggacagguggcuaagugcuggaagaggagcaccaaggaaauuguggcuauuaaaaucuugaagaaccaccccuccuaugccagacaaggacagauugaagugagcauccuuucccgccuaagcagugaaaaugcugaugaguauaauuuuguccguucauacgagugcuuucagcauaagaaucacaccugccuuguuuuugaaauguuggagcagaacuuauaugauuuucuaaagcaaaacaaauuuagcccacugccacucaaguacaucagaccaaucuugcagcagguggccacagccuugaugaagcucaagagucuuggucugauccacgcugaccuuaagccugaaaacaucaugcugguugauccaguucgccagcccuaccgagugaaggucauugacuuugguucugcuagucacguuuccaaagcugugugcucaaccuacuuacagucacguuacuacaggcaaguggcaaaugcugaaaaucguaucuuaggcuagaguucuguccuuauauuuaacauauaccccguaggcuacauauagcaaugaauuuguuuauagauucugagauagaaauaggauauguuuuagcucauucuauguguguggcauuccuauauaugacauuuauuucugaaauuuuaucuagcacuggaaaaauuaacucagucugauucugaaaguuguuacuaguugaauuauacuagcaccugguucuuuaguauuauuuuaccucauuuucccauuuuauuuauuuuauuuauuuauuuauuuauuuagagacagaaucucgcucugucgcccaggcuggagugcaguggcgugauaucagcucacugcaagccccaccuccuggguucacgccauucuccugccucagccuccugaguagcugggaccacaggcacccgccaucacgcccggcuaauuuuuuuuguauuuuuaguagagacgggguuucaccguguuagccaggauggucucgauauccugaccucgugauccacccgucucggccucccaaagcgcugggauuacaggcgugagccaccgugcccagccuauuuauuuauuuuuuuaagauggaguuucacuugccacccaggcuagagugcaguggugugacauugacucacggcagccuccaccuccuggggucaagugauuucuccugcuacuccuguccugaguagcugggacuacaggcaccugcuaccacgcccggcuaauuuuuuuguuuuuaauagagaugggguuucaccauguugaccgggcugguuuugaacuccugaccucaggugauccacccgccucagccucccaaagugauuagaggcgugagccaccaugcccagccauuuucccauuuugaagagucuugaaauacacaaagauauuuacuuauuuguaaugaaucugagcauauguugcuguuuuuucgaaccucuuaucuuggcagguaaaauaacgugggaauaacucuagguuuaacucuaguaacauuuuauucuuuuacauuuucuucuguaguagcaugaauugaauuacaugguugcuacaaucucuuccuguuuuaacuuucucuaaauacuuugaacuuaauggguuauccuagaauggccuugacccaaguaccuuauacuuuaaugauauauauuucuagauugauacuuuuaauguagcuaccauuuuaauauauaauaauuauugggacaguauguaaaugcugauauauacaauuuugucuguaccauaaccaaggcuuuuaaaaugugcuuuuuaucagcacccauuuacuuacuugccuaguuauuaauuuuaaggaaucuaauauuuaguuuuaauggccauacauuaaauacaaaucauguaagcauccaaucaagaagugaaauaauaaaaacauagauaaccuauaaaauauguuuauaaggagcuauacaugccagaugccuguaauaaaauuugaggaaauagaaauucugaauuaagaauuuuauauuaugugugaaaauaaugugaggauauuuuaacccauacaaggacucagaaaaaaugucaucugcauguuuccuuuuuuaaaaacauugugguaagauguuuauaauaggaaauuuacaauuuuaaccauuugguaccacucauuguguuaaguacauucauaguguuguguaaccaucacugcugucuguuaaguauauucacaauguuguguaaccaucaccacuauuuccaaauguuuucaucacccaaaacagaaauucuaaccauuaagcaauaacucccuauucucucuucuuccuaccacugguaaucuugauuugacuuucugucucuaugaauuugccuauucuagauacugcauguaaguggaaucauacaauauuugucuuuuugugucuaguuuauuucacuuaguguaaugcuuuugaggcuaauccaugcuguaacauguaucagaacuucauuccuuuuauggcuguauaauauuccauuguuuguauauaccacauuuuguuuaugcauucaucuguugguagauauuuggguuguugcuaccuuuaggcuguugugaauaaugcugcuaugaacauugguguacaaguauccuagucccuauuuucaguucuuuuggggauauagcuaggaguggaauugcugggucacaugauaauucuauguuuaacuuuuugcagaauuaccaaauuauuuuccacagaggcugcacuauuuuacauuccuaccagcaguggaugugcauuccaaauuucuccacauuuucucuaacauuuguuauuuuuuuuauuuaaaaauauuguuuguuuauuuuuacagagacaggggcugccucuauugcucaugcuggaguacaguggcacgaucauaguucacuguagccuccaacuccuggacuugagcaguccucccacuucagccucccaaguagcuaggacugcagucacacuccaccauaccuggcuaauuacuauuauuuuauuuuuuguggcgacaguguuuugagggucucauuuuguugcccaaucuggucucaaacuacuggccucaagccauccuccugccucagucucccaaaguucugggauuacaggugugaacuaccacuccuggccuuguuuuguuuuuuaaauaauagccauggguuuuuuuuuuuuuuuuuuuuuuuuuuuuugagauggaguuucacucuuguugccuaggcuggagugcaguggugcgaucucggcucacugcagccucugccucccaggauucuccugccucagccucccgaguagcugggauuacaggugccugccaccacacccagcuaauuuuuguauuuuuaguagagaugggguuuuaccauguuggccaggcuggucucgaacuccugaccucaggugaucugcccaccuuggccucccaaagugcugggauuacaggcaugagccacuaugccuggccaauaauaguuuuuuuuuguuuuuuuuuuguuuuuuuuuugagauggagucuugcucuguugccaggcuggagugcaguggcacaaucucgguucacugcaaccuccaccucacagguucaagcaguucuccuagcuuggccuccugaguagcugggaauacaggugccaccaugcccagcuaauuuuuguauuuuuaguagagacaggguuucaccauguuggccgggauggucucgaucucuugaccucgugaugaagugcugggauuacaggcaugagccaccgggcccggucaauaauagccauucuuaugggugugaagugguaucucauugugguuuugauuuguauuucccuaaugauuaaugauguugagcauuuguuuuauuuuguuuuguuuugagacagagucccacuuugucacccaggcuggggugcaguugugcaaucauggcuuacugcagccaugaccucucaggcucaagcaguccucccaccuuagccuuucggguaccugagacuacgggcaugcacccccacaccugacuaguguuuuguauuuuuaguagagacgggguuucacuguguugcccaggcuggucucaaacucauaggcucaagugauaugcccgccucggcaacccaaagugcugggauuacagacaugagccaccaugcccagccuggcauuuuuuuaugugcccgacaucuguauaucuucuuuggagaaaugucuauuuaaguccuuuccucauuucuugaauugggcuuuuuguuguugaguuguauacucuauauacuuaauuuucaucuauuccuuggguugccuuuuuaccuguugauaguguuugacacagaaaaguuuuuaacuuuggugaagugcaguuugucuacuuuuucuuugguugcuugugcuuuuggugacauauccaagaagucacuguuaagucgaaaucauacagauuuuccccuauguuuucugcuaagaguuuuauaguuuuagcucuuauauuuuggucuuugauucuuuguugauuuuugucuaugguccaagguacaaauccaguguaauucuuuggcaugugacuauucaguucuucaaacaccauuugcuaagaagauuguccuuucugcauugggugguuugggcacccuuguuggaaucauuugaacauauauacaaauaauucuuaucuucuauugcuuucccauuuucaauguugggcucucuauuccauuaaucuauauaugucuuuaugccaguaccacauuguuuugauuauuguagcuuuguaguaaguuugaaaucaggaagugugagaccuccaacuuuguucuuuuucaagauuguuuuggcuauuuggggucuuugaggguccauauaaauuuuaggauggguuuuucuauuuuauacaaaaaccauaauugcuuuuuauuaaggauagcgaugaaucuguagaugacuuuggguaguauugacagcuuaauaguaagucaguccauccuuauuucuuuauaucuuuucacaguuuuauaaaacugguauuuuuuacuugagguaagguaaauaaacucuuagagccuuuguuuucugguuuuaugcugcccuaggcaaccuuggcuaacuuuaagaaugucaucuccauuuauuuauuuaugccuugggagauuuagguuccaacuacauuugcuuuuuaaugcucuccuuugagcagucucaccaccagccacaccaacauaacauauauauaacauacucuacaggugcacugaagaauucagcgcagcaucccauuuugaguccucaggagggacuaggcagaccacagcugaaggaagagggcugaucagcucuuccuuucugucuugacucugugccugcagguguucuuuaacuauuuguuugcccugucaaagacaaagugcauucucuugugauaacagaguaguuuuuaaauugaaaaagggagagcaauaggagauaaaaauuauuuggcuuuguuauaauuggggcauguuaauacaaaauaaaaugaauuauuuggcugcuuagcuuucuguaauguguaauucauuugaauaauuuucaguguuagguugcugaucuuuguauuuuuuauccuuuuaauuuaagcugucaauugauucauuuugguuuuguuuuuuauagaaacuaagguuuucaaaucuucaaaguuacccuucgacaaagcuuucuuuaaauucacugcaauauaguuguugacuauaauuuuaaguggagcuaaguuugccucuuaaaaacaggaguucauucuguguauuacugaguaauuacucuguauacugaaguucagugcccagggcuugacaguguuuaggauuuaacaugaguguucuguugugucacaguaauacuugauaaugagccuaaggcagauggaacagcagcucaggcauuccuucuuuaucacuaguuuuacccgcagugguccucuuaagcuucuuugauguugcuuuguugccauauuagaguccauuaaguccucacccuucugucuuucaaaaaaccucugugaaaucuguuuggcuggugaagcauuuugacuccaaagcuaguccuucucuuacccaccuuuuuaguuuaccuugcuuugucuuucugauaauaugccaguauuaucagcucacauaaauuugccaacuugcuguguccauuggcccugggcauggcuaaaugauucaggcaguggaaauaauauacuuuacucucuggcucacuguaaaugugcacagacuccaagcaaagcuccugucuuucgggcuugaguuuuagagacaaagguuugccaugcuuacaggcugaauguuuuucccuacugaacaaacuagccagccuuuauuucaagcugaaucacuuuguuacuuacggaaggaaaaggucuagagaaggaaaacguaucuuccauuuauccuagacaaacaaauaaucuaauuuccucuggcagucaaaauauaguuucaccuaagccacugaugcaggaaguuagguuuuauguaaccucucuaauugguaaguaaguagguuugaugucucugagauaggaagaaagaaacgaaaauguucaugaaaauaaucagagugauuuguguuaagugauccuaaccuuagcuugcucugggugccagugaaauuaaccucaacaauguugguuggaagaauuuuucaacuuaaagaaguuugaaguuggggaaucaaaaggcagggauuguuguuucuaucacuuagcuguaauaaccagagccuguuuaguauuuguuuuuuaaggaugggaugugucuucaaagaggagacuugccauguucaaagcacaauuaaugccauuuuccuacugaagugaacacugccaguuuuuaacaguuucuuucacuuuccugugcuucuguagauaaccuuuuuuacugcccaguuguuggaauguuacagcuggaaagggaccuagaagaguaauuaucuaacucuguuuccuuauuacacaaaugagguagaaccagaguuuuacgugucuguagaguuuauauugagggauuaagaaauaaggaggccaagaggaaagauguaaugaaaauaauucuaauaauuauaaucuggauucacaguuuaaaguauucaguccuuagagauaaaccugcucuagugaugccuuacuguucaguaaaguagaaaauaacuugucuuuuugcuucguagaguuuggguaagucuaacauuuauaggcccaaauaauacaaaacccucagugaacuaagcagccuuacugcuuuuuuguuuguuuuugagacagggucucaggcuggagugcaguggcgcaaucauggcucacugcagccuugaccuccugggcucaagugauccuuccaccucagcuuccugaguagcuagaacugcaggcaugcaccaccauaccuggcuaauuuuuuaaauuuuuuugguagagauugggucuugcuguguugccuaggcuggucucaaacuccugcucaagugauccuccugccuuggcuucccaaagugcugggauuauaggugugaaccgccguuucuggccguauuuuuuuuuuuuuuaaacugcuuuccuuuuuuuguuuuuccuuuugcuauuugccuuuuuauaagguagauacgguagaguugcuguuu

SEQ ID NO: 13777 - RNA, 1664 nt, Homo sapiens
gggcuguaggucgcagggccgggagaggcccucugcgcggcggcuggagccgaggaaaacucgaauccgagagggaccgagcuccccgaagugggggcguggccggcgaguuaggcggagacgcgggcggagccucugagccugugcggggcgcagagaggggccggugugcuuagauuggaagacaacgugcggaguccugagccggccgagguuccggggccuuuaggguggccuguuacagccgauaguuugcauugaguggauauugcuuguucauucguucauucaacagauguuacugaacgcccauugaggcagggcuucggaguccgguugaugaaagauauuauaaaauagaguccggcacugcuguaugaccuaagacaaauuagacaaccucucugagccgcagcguccucagugaaaagugaagauuacagaagauguacaaaauaacugcauagugccugacagugggugguugccucuuaaaguuugguagcugcugcugcugcugcugaugacgaugacgauuuuguguuagauauugugcuagguacugggauucaagggugaagaaaacagaagccccgcuauugaggagguuacagucuagugggagagacugagaaguaagcagacugccugaggugagggagugggguggagguagaagguggauuauuaagaacuaaccugguagccagcagaucugguuggaguccugacaugcuacuuacuugcuguuugaccuuggccaaaucucaguuaaaggaggugaagggagaacgaacauuaaauaaaagauaucguagaucccuuccagcucuaauuuuucagaaauuucacuugagcuuucucucuuccccggcuugacuuacacucuucccugucuuuggaaugcccuucaucucaucucuuuuaaaacuccuauccguccucaucccaaaugccggcucuuccagguagcuuucucugauuucuugcccucaaguggaaaguguuuucucugagcuaugaucuuuguuucacuuuugcagcaugacauuuauuuguguagucuccugucucccuuuaauaguaggugaaagcccuuauaaaacuccacaccucagauagacuggaccaagcuucaauagcugcagugauuucguugacaccauuguaucagucaggguccuggcaggaaacaaauggcauuuugcaaagaugugggcagggugugggaaaccacaagagaagcuggaacccugaggcuacagcuccuagaucuguccaaucgggaaagaacaguuaccgaaaaauccagacacacagggccaccugacaggagucugugaccuucagucaacggaugcagucagccuaaguaaacacccagcaaaggaccugggggauuuauaucuaacucaccacccuccuccagucuccugcuggugcuugucaauggccaaguccaaccagacgccagagggcaagggaggcuuuugauauaguucauaucagucaguuucagaaaaggaaacagugcaucugaggggaaaauauucagcacagacaccauguggauggcucagauuuaaccauaucugagacaaagcuuggaguauuuuuuuucuaaacuacuaccuauacuaauggauuccuggauaaaaucucca

SEQ ID NO: 13778 - RNA, 1664 nt, Homo sapiens
uggagauuuuauccaggaauccauuaguauagguaguaguuuagaaaaaaaauacuccaagcuuugucucagauaugguuaaaucugagccauccacauggugucugugcugaauauuuuccccucagaugcacuguuuccuuuucugaaacugacugauaugaacuauaucaaaagccucccuugcccucuggcgucugguuggacuuggccauugacaagcaccagcaggagacuggaggaggguggugaguuagauauaaaucccccagguccuuugcuggguguuuacuuaggcugacugcauccguugacugaaggucacagacuccugucagguggcccugugugucuggauuuuucgguaacuguucuuucccgauuggacagaucuaggagcuguagccucaggguuccagcuucucuugugguuucccacacccugcccacaucuuugcaaaaugccauuuguuuccugccaggacccugacugauacaauggugucaacgaaaucacugcagcuauugaagcuugguccagucuaucugagguguggaguuuuauaagggcuuucaccuacuauuaaagggagacaggagacuacacaaauaaaugucaugcugcaaaagugaaacaaagaucauagcucagagaaaacacuuuccacuugagggcaagaaaucagagaaagcuaccuggaagagccggcauuugggaugaggacggauaggaguuuuaaaagagaugagaugaagggcauuccaaagacagggaagaguguaagucaagccggggaagagagaaagcucaagugaaauuucugaaaaauuagagcuggaagggaucuacgauaucuuuuauuuaauguucguucucccuucaccuccuuuaacugagauuuggccaaggucaaacagcaaguaaguagcaugucaggacuccaaccagaucugcuggcuaccagguuaguucuuaauaauccaccuucuaccuccaccccacucccucaccucaggcagucugcuuacuucucagucucucccacuagacuguaaccuccucaauagcggggcuucuguuuucuucacccuugaaucccaguaccuagcacaauaucuaacacaaaaucgucaucgucaucagcagcagcagcagcagcuaccaaacuuuaagaggcaaccacccacugucaggcacuaugcaguuauuuuguacaucuucuguaaucuucacuuuucacugaggacgcugcggcucagagagguugucuaauuugucuuaggucauacagcagugccggacucuauuuuauaauaucuuucaucaaccggacuccgaagcccugccucaaugggcguucaguaacaucuguugaaugaacgaaugaacaagcaauauccacucaaugcaaacuaucggcuguaacaggccacccuaaaggccccggaaccucggccggcucaggacuccgcacguugucuuccaaucuaagcacaccggccccucucugcgccccgcacaggcucagaggcuccgcccgcgucuccgccuaacucgccggccacgcccccacuucggggagcucggucccucucggauucgaguuuuccucggcuccagccgccgcgcagagggccucucccggcccugcgaccuacagccc

SEQ ID NO: 13779 - RNA, 45547 nt, Homo sapiens
acauaguuuuguacaaacuaugcauucauguuggcuaguuaagacaguuuauagauuuggguauaacaugguaauaugauaugauuuauguuaccaugaucugcaguuguucagccucucaguuucuugaagacuuuuccugcuuugacuuaggagccuauuucagagcgugaccccugaacagccccgugccuuuucaggcacugcaacuaccuacgaacugucuauauucucucuguguuauagagaaaaagaaaagauaagcaggugcuuuaugcguacaucuacuuucccaaagcagccacugaaaccauguuaacugaaauaaaacuucaaaugcagucaaucuucaaauggaguaaaggacaacagacuagaucagaaagcccaguugcuuccaguguugaccugcaucacagagaugauaagcugauuguuaauaaagagagacucagaguaggccuauguugagcuuuagugugggcucuguuaccaaaauugauucugaauaaaucccuuaagccuauauauucagcggcaaaaugucaggguuguacggguaauaaaacauuuaguuccagcuuugagccgguuauaggcauaccuuaaagauacuauaggugcaguucaagaccauggcaauaaagcaagucacacaucuuuuuuuaguuucucauuguauaugaguuauguuuacacuguauccgguagucuuuuuuuuuuuuuuuuuuuuuuuuugagacggagucuugcucuguugccaggcuggagugcacuggcgcgaucucagcucacugaaaccuccaccuccuggguucaagcgauucuccugccucagccucccgaguagcugggacuacaggcguccacuaccacacccggcuaauuuuuauauuuuuaguagagcugagguuucaccauguuggucgggcuggucuugaacuccugaucucaagugaucugcccaccucagccucccaaaguguugggauuacaggccugagccacugugcccagcaugugguacuaacuuuugcuucugaauacagcaacuucagaacccuugugauaaguggugguuaaucugcaucacaaaacccucacuccacuaacaagauucaacuauugaacagagauuaaacggaaagugcuauguggauaugacuucaacaauaaagaugaggaaaaaguuauuuauacuugcuuuacuuuuauuuuuucagauuuccuuuacuuacauuccuuauucccucaccaacaguaauccucauuuuuauagaagguaagagagaagaaguacgcagagguuacagacuuggguccaaagaaaauuacagaguccaaacugaggccaagccugccaauacucucagcagcaguuuucuccucuaacacucuuccucuaucugccaugaugcccaggcauacaaagggaguuuuucauuguuuccuuaagguuaacugcucuggaugcucucaguucaaauaagaugguuuuaaaauuccccuccuccuugccuuacagcaaagaagaggaaaggagaaauucaaaugaaaauaaaucauauacacaaauaucaagguucaaaagcuggaggauuuaauucaaucaauuuagcaaggcccaaaaugaaaccugguaaugaaaaugaagacacagcaauauuuuccucaagaaaauagacauuugggagaagaaauguuuucuuaaaaaauguuuauuuggaaaagucagccucuuacacaagguuuuguaucuauacuuuuacucugucaauuacagugguauuuuaaaugcauugaauauaauucauugaaugucuguaucuuucugccucgauuuaagugauauuagguuaaaaaaauauuuacaguuuucauucugguccaccuucccuccuuauccuuauacugaauccauuucucuacuuuucagguaagugaaaggggucacaaaauuuuuagguuuguguggaggguaaaaaugcauccagcaauucuaagcacaacaauuuucuguaaggccuucucugaaaaaagagaaggaauuacuuauuaaaacuaagcacacuuagcaacuucuuucccaauccuaucuuuauucguuugccuggugccaaauuuuucuggcccuuuuuaauuugcaaaccuuaaaaaaaaaaaaacaaaaaaacaaaaacaccaaacacacacauaucucacacauagcacuaagcuagaagcagauauaaaugggaccacugugaaucaaaggggaaaaauuccaggaaaaaaaaauuccaauagcuucacaguuuaacugagguuuuggaaaaacuuaagugaauucagcugauguuugaaauaucugucuacauuuaauuagauguguuguauuuaccaaggaggcacaaauauguaguucuguagauuuuaauacuaacuuuuccaguaagaaaaauaauaccaggugauuucaaaaagggcagugaucuauaaacacucaaaaugcaucuuugaacaggggagcagaaauagcuaauuuaaugaaaacaaaccuuaagcacuuuacuuggcuucuaauaagcaucccaagaaaagguaccugagagggguugacaaguacacugugucuagaacagccaagauguugccaaaguuuuaugcuuugaauuuccuaaauauauagcuagcagaaacauaugccagaaaucuacugaugcuaggaaaauauuuuugucagcauuuuguaaaaucucuaacuuucaaccaauauuucuguucauaaaucuuccagugaaaaugucugaaauauauuacauguaacaaugaagcaagauuaauuuuaaauuuuagauuugccucaaacaaguuaguuguuauuuuuccuuuuaacacaacacucgaaauagaugaauucagcaaaaaugguuuaagaaguuaaggcucucuagaguucuaaagacuaaaacuuaaggcacauauuauaaucuuuaugacacuauuaaaagcuaagauuaaaacaaaacaaaacagaaccuacuucuuucccccauccuuugcuaccaaucauucccuccucaaauucaggcuauugguaaggagucaaacaaaaaucccaucaaugaacaacugguaugauuuccacacaaaugucuacuauuugcauugagcaccacugguagauuacaggccaguagaauauuuucagauauccugggucaugaacugcucaauuuacccuucagccccauggauucagacuggacuuuccuccuccuugggcccuccaucugugucuuucugguccggagauucugcugcuuugguaacuucauuuggcuucccagcaacaucuauacuggucucuuccucuuuacuuuccuuuuucugcucguuugcuuucuguucuuuugccaaaagucgauaauugaugcccaugccaaugaagagauagauaccugaaauaauuaggacgacgccacaugcccaguauguguauuuguagucuccauacaugucauugagccgaccuaaauauguaaaacaacacaaacaguuguuucuaagaguaaacaguuuuuuuuucccccaagcaaagcuuaaggauccauucagaaagaugucaauccaaucuuuaaagagucccaaaaugaugaauuaguauaaggaauugcugaaaauuagcugauccucuguuuauaaugcaucauggauuuuaaguggccuuugcauauucuguuauuuuuaguaacuugaaaauaguuaacucuuggcaaacuggaaauggaagagacguagugaucaccuagagucaauucucuuaauacacuauagaaauaaguguugcuaaaagaggcuugggagucuuguccaaggccauagugcugucccauuuacccaggccaaugcucuuucucucucagcauuucccaaagaguauuccuguaaacacuuguccagugcuaaaaauuuaaaagcaauaucuuacacccauucuaagugcuuaaucuuuauaacaggcagauucuauuaucauccucacuggacagauuuaaaaacuaaauuacagagauguuagcuaauuuguccauggucacaaaacuaauaagugaaaugacuuggcuuuaaaccuagaaagucugacucggaagucugcacccuuaagcaugugcuacaaggauacugcuuuaauguuucaaaagucaaaugaauugauaaauggcauauuauuuucucauaaaggcuuugugaagucugguaguaaagaacccuauuuaauuugauguuuacaaauuuuauuuuggucauguaacuuucauuacuguaaaauuuauuagcaucucauugaacugguaucucugggaaaauucuacucuaugcuuaaacaggacuuaauacaaccaauuuaaauaugauuccauauggcuuucuaacucagggcaucauucauucaacaauauuuauugagccuuuaucauauaccaggcacuggcucagcuaagcccugaggauaagggugaacagaggauccacaguucaguggacaagagauguuaaucaaguaacuacacaaacugugacaaguacuaccaggagaguuugaaagaaguggggucaagaaagcuuuccuuaaagugucaacuuagcugggauuugcaggauaggaauuaucuaggagaaaggagaugggaauuagauccaggcagagaacuguagugcaaaggcgcaaugguaggagagagcauggugugugaggggaaagaagggccagguugcuggggcacagagagcaggaggccagugguagaaaugaggcuggaaggacagcuggggccagcccaugcagugccuugcaagccacauuagggaauuugcuuuucacccugaaaguaaugggaagcaacuggagaguuuuaagaaaucuugaagaguucugaacuggagacuucaaggagacugaagaacagcuagaacugauacagguagaccaguuaggagguuacaguuaggagcagcccaaacaggagacaggagcuuuggauaaggguaguaguugugauggagaaaaaugggcagaugagaacaagauuuagagcauaaaaacucauagaacuuaguaacucacuggguaugagauggaagaagacagugaucucaaaaggcagcuauggaucuucuguuauauacucacucacuccccaaaucaaaguuccuaaaguaugagucacauccagaagaagggucaaauuauuuuuucacuauguguuauguauugagcuauuaauuugaaagauaaaguauucaauaaccuucaggaauaguucccaaguuguaauuaauuuucuagcuguaugauuuuagccaaguuauuucaccuuuugaagccucuguucacuuacaaaauggggacuuaaaacgguccuaccucauauggacuugugagauacaacaggagauacaaaaugauaaggacagucucugguacacugugagcuuacaugguagcuauuauuauacuacugcuacugaaauaaacuuuuuuuuuuuuuuuuugcuuuuuguguguuuuuaaaaaauuuauggaucaggcaugguggcucaugccuguaaucccagcacuuugggaggccaaggcggguggaccaccugagguuaggaguucaagacgagccuggccaacauggugaaaccgucucuacuaaaaauacaaaaauuagcugggcaugguggugggcgccuguaaucacagcuacuugggaggcugaggcaggagaauugcuugaacccaggaggcagagguugcagugagccgagaucgcgccauugcacuccagccugggcaacaagaccaagacugucuuaaaaaaaaaaaaaaaaaaaaaaaaaacuuaugugaaauauacuucauuuuuaaaaugaaauaaucacuagcgcuuuaaagauuggguuguuuuucuacaugcuuuucuacacuaagcacaucaguuuugcgaucagaaaaaaacauauuuuaggccaggcacaguggcucacaccuguuacccagcacuuugggaggcugagacaaguggaucguuugaggucaggaguuagagaccagccuggccaacauggcgaaacccugucucuauuaaagauauaaaaauuggccaggcaugguggcaugcaucuguaaucccagcuaccgggaggcugaggcaggggaaucgcuugaaccugggaggcggagguugcagugagcugagauggugccacugcacuccagccugggcaacagagcaagacuccaucucaaaaaaaaagaaaaaacacugacauuuguaacaauauuugaucccccuuuugccuugaugguuccauuuaauuagauucuauauuugagcaauuaugcugugccaagcauugucccagcaucaaggguacauaaaugagaaagauuuauucuuacccaaauagcucacuaauguuugcuuucugucagcauucccaucuuacaugcuuguuuuguaauagacccacauuaguagggagauauacuauaccuaaaagugguggccccaggaggacaggacagcauuccacaauggucaccaaucccacagcgcuggagaaccucugggguccaacaagguccaucaauguuucaaacaauacggagcugagccacccgaaggcaaauccaaagaaucccgcauagacacagaauccaacauagguaguggauaaaggugcuagcauaugacacacuccauuugcaacaacggaagccgcaaagaaauacugaauucgaggucuuauuggcuuuguguuggcuacaagucccauagauggucgggcuaccaugucaacaaaagccagaauggaaagaaggaaggcagacuucucacuagaauaaugcugacucuucccauaacuacuaagaaacaccaaaggugcaaagaguccaaaaaacaugaucacauuuccagagagguauagcaaaaagccucugugggugaauaggguuaaguccaggaacugauuaauuguuuggaagacugaucguuucucuuguuuagggugucuuccaauaagaucuguauuugcaucaugcagaucuuuuuucacaccagauuuuccagcuuucucaagggaugcuuuagacuuaucuuucccugccuugguuggcuugggcccgauuggucgcaugagggcuccagcaacacagcaguuuaguagcaagcccccaagaauuagaaagcuuccucuccauccaaagauaccgaagaaaaccugauugaggggggccagaguacagaggaacacagggcugccugccauggccaguccguuggccaauggucgccucuuguagaaauacuugccaaucauggucagagcuggauucaaguugaaggcaagcccaagaccugugaagacaauaaauaaauaaauaaauaaauaaauaaauaaauaaauaaauaaauaauaagagguauaaauaauggaaggaauaggauauaaauccucauuauuagaggacauguuauguagugguuuaaaguaugacuucuaaaacagacauggguucaaaucucaguaucagugcuuacugguugcauaaucucagacauguauacccuccuaugacugcuuccuaauauguaaaacgggcacaggucacuguugugaggaagaaaagauuuguuaagcacuuaguacccagugcccaguauguaguaagcacuuaauacauguuauuuuuauuauuguuguuuuuauuauuugaaggugaauaacuauuuugucuaaucuaacaaaaucaccggaaggauuauuauaaccauauaagaucauuaagucgacaguagagauaaaacaaauuuacacuagaaaaugcauaaggccagcugcaguggcucaugucuauaaucccagugcuuugggaagccaaggcggcaggauugauuaaggccaggcauucaagaccaccuugggcagcauagcaagaccugucucuacaaaaaguaauucgaaaauuagucagguaugguagugugugccugcaguccuagcuacuugggcggcuaaagcuggaguaucacuugagccuagaaguuugaggcuauggugagcuaugaucacacaacugcacuccauccugggcuacagagaaagaaccugucucaaaaacccaaaaacgaaagaaauaacauauaguacaaaaugaucccuuccacuauagcaccaaaacuuaaaaacaggccaauuccuaagacuccaauugugaaacuuuccugagagaucagagaauuuaaaauacacacaaaguuuugggaaaauaaaacacaacauugcuaagaugccaaggcuccugaaaugaauguacuaauuuauuuuauuuauuuauuuauuuauuuauuuauuuauuuuugagacagagucuugcucugccgcccaggcuggagugcaguggcgcgaucucggcucacugcaaccuccaccucccggguucacaccauucuccuggcucagccucccgaguagcugggacuacaggcgcccgccaccaugcccggcucauuuuuuuuuuguauuuuuaguagagacgggguuucaccguauuagccaggauggucucgaucuccugaccucgugauccaccuggcucggccucccaaagugcugggauuacaggcguaagccaccgcacccagccugaauguacuaauuuaaugcaauccaaugaaaaugucagugaauuuuacuuucggauuaagguaaaugauucuaaaggauacuuacagaacaaauacagagcuacuaggaaauuuuugauggugcagaggaaaaagugggaccaaccagaacaaauuauuuaaauggcuuuacaaaagcuacagucauuagagcaguguggcccuguuucaggaaccaguaaaaauucgucagugaaagugcagaaacacuauagaaaguccaggaacagaguugaaauacauggaaacauuuaauguaagauaaaguagcauuuuaaauuaauagagagaaauuauucaauaaauagugcuagcaaaaguaauauucaaagaacuuccucccugaccucauagcaaaccauucuuacauuuguuaauaagcucuacggucuaugaucccuuacauuuucacaaaucugguucccuguuguuaugcaggucucuacuuaaaguugauucuucagugagcccugaccuucauugcuugcccaguucuucccugucacaacacucaguuaaaggcuuuauauagcauuuaucacuaccugauauuuuucuuauuuauuaauuuauuuaugaguuguacuguuugucuccuccuauuaaagaguguaacugccugacuuguugcucuaucucuacagcaccuaaaaugguuccuaacacacauacaguuguugcucaauaaauauuucauaaauaaauuaauaaaagagcaaaugaaccaacugauuaaccaugugggaacaaauagaguuauauuucuuuuuucucaucuuaugucagauguuuucauccauuuggaauuuuuaaauguagcugggcguggucgcucaugccuguaauuccagcauguugggaggccgaggcaggcggaucaccugaggucaggaguuugagaccagccuggccaacauggugaaaccccgucucuauuaaaaacacaaaaauuggccaggugcaguggcucacgccuguaaucccagcacuuugggaggcagcggcaggcggaccaugaggucaggaguuugagaccagccugcacaacauagugaaaccccgucucuacuaaaaauacaaaaauuagcugggugugguagcgggcgccuguaaucccggcuacuugggaggcugcggcaggagaaucgcuugaacccaggaggcggagauugcagugagccgagaucaugccauagcagucuagccuggcagugagagugaaacugugucucaaaaaaacaaaacaaaacaaaagaacaacaacaaaaccagauuuuuaaaauauaaaaacuaaagugcaguaaacagaaguggacaaauauuuucauaaucuuggaguagaaaacaacuuucucaggaugacauacaagauggaaaccauaaaauacguuuugaauacauaaaaauuuauauguuuaauaagggaaaaacauuggaaaagacugaauuuuaaaaauacuuuuuaacaaaauucaacaucagaaggccgggcaaggugauucacgccuguaaucccagcacuuugggaggccgaggcaggcggaucacaaggucaggagaucgacuauacugacuaaugcgaugaaaccccgucucuacuaaaaaaaaauacaaaaaauuagccaggcgugguggcgggcaccugcaguuccagguacucaggaggcugaggcaggagaaugacgugaauccaggaggcggagcuugcagugagcugagaucgcgccacugcacuccagccugggagacagagcgagacuccgucucaaaaaaaaaaaaaaaagaaaagaaaauaaggauuaaaaccaagagauacuguucucacguguuaaacuggcaauuauuuuuuuaaaaaaggcaauaucccauuguugacaaaagggauaaucuuggaaucucugauauauuguggugggauaauaagugaguauaacuuuuuuggaggacaauuuagcauacauauauuaaaacaaacacacagcaguucccuuucuacaaauuuauacgaagaauauauucauguucacaaaacuuucaacuuaauacugacaaaaaucugguuauaaaauauuagacauaauuugauccuuuuuugcucaaaaaaagguguaucugugcauagaaaaacacauggaaggauauacauagaaauguuaaugauauucuuuggauugugagguuauggguaacuuuuauucauuaugcucaucaacaguucauuaucuuaauuuagugauuuuuaaaauggggggaggaauuaugaagcguauccucuaccccucagaaauguuauguggacauucuaucaaauugccacucucgcaccaaguugccacacacauuguaucuaccacuacuggcuauucuuaggacaaggaaugcaaucauucuuucaauucauucacucauucgacaaacaauaaauauccauuauauaauggcaauuucuuuaaaaguuugcuuuucuaguacuuuuaucucuaguucuucaaaaugauaaucaagucauuucuauaagaaaagaauuucacuccagagaucugaaagaugaaugcagguaaauacaaaauagccagccauaaacuaaugcuuccaaaugaaucaguaguaacucaccuccaaugacuccaauacagacguauaguugcuguacgguguuacagaaagaagcugcaaucaagccacagccugacaagcagccaccaacaaucaugacuauacgacuuccauauuuauucaccaggauacugcugauaggaccuaaaagacaaccaaaaauguaguaauauaaaggaaacugcucccucacaucuacacaaguaugaaugacaaugaaugacaaauccuccaaaauaaacaagcagcaaugauaagaauauuguuuucuauaauuacuucugagucacauguguacuaaaauaaagauguuagaaaacauaauuaauugugcagguucuaaaucuaaaaauacuggauggaauuuuacuaaaauacaaaagaccugaaguuauccuuaaucuuucucuuuuauggcagggcaggcugaaaacaccuugguaauggauguucacaagguucuugauguaucuaggauacgauuaacauguauguagaaaguggcugggcgcaguagcucacgccuguaaucccagcacuuugggaggcuggggcagguggaucacccgaggucaggaguucaagaccagccuggccaacauggcgaaaccccgucucgacuaaaaauacaaaaauuagccaggcgugguuggcgcgugccuguaaucccagcuacuccgaaggcugaggcaggagaauggcuugaaccugggagguggagguugcagugagccaagauugcgccacugcacuccagccugggcaauagagugagacucugucucaaaaaacaaacaaacaaaacaaaaacauguuaguagaaaguauguucuguuuuaaauuucagacacacgcagugauaggagacguauaaaugcaucuagauuuuagaguacuuguauauuaucauaaaugugguuugugguguuguguuuuuuuugagacggagucucacucugucacccaagcuggagugcaguggccugaucucgcuuacuguaagcuccgccucccggguucaugccauucucuugccucagccuccugaaagacagggugggcgugguggcucaugccuguaaucccagcacuuugggagguggauggaucaccugaggucaggaguucaagaccagccugaccgacauggagaaaccucaucacuacuaaaaauacaaaauuagcugggcgugguggcgcaugccuguaaucccagcuacucaggaggcugaggcagaagaaucauuugaauccaggagguggagguugcggugagccauugcacuccagccugggcaacaagagugaaacuccgucucaaaaacaaacaaacagcaaucccuaaagccacgcggccgccaacuccagggagcugaugcuuccaaccacugcacguugcucccgggcugucgcagucuccuguugccgccaucaugucccggcccuccacgguguugggugccauggagauggggcgccguagucacccgcgccuuccuggagcacggccacaccaagauagacacggccuucguguacagcgacagccaguccaagaccauccuggguggccugaaaauugauaccaaggccaauccauuguuugggaacucccugaaaccugacagucuccgguuccagcuggagacgucacugaaguggcugcaguguccccgaguggaccucuucuaccugcucaggccagaccacagcaccccgguggaagagacacugagugccugccaccagcugcaccaggagggcaaguuccuggaucuuggccucuccaacuaugccaccugggaaguggccaagaucuguaaccucugcaagagcaauggcuggacccugcccacuguguaccagggcauguacaacgccaccacccagcaggugaaaacggagcucuuccccugccucaggcacucuggacugagguucuaugccuucaacccucuggcuggggaccugcugacuggcaaguacaaguauaaggacaaggacaggaaacagcccaugggccgcuucuuugggacucaaugggcagagaucuacaggaaucgcuucuggaagaagcaccacuucgauggcauugcccugguagagaaggcccugcaggccgcguauggcgccagcgcccccagcaugaccucggcugcccucugguggauguaccaccacucacagcugcagggugcccacggggacgcagucauccugggcauguccagcuuggagcaguuggagcagaacuuggcagcggcagaggaagggccccuggagccagauguuguggaggccuuuaaucaagccuggcaauugguugcucacgaaugucccaacuacuuccacuaggcccaucguuucucagguugcccaaggcucuucuguaaccucuuuuguuucucacacuuucuuuaauuuagaagugccucaguaaauucuuagggauggaaguauuuggacaaaaaccuaacaguaaagucaccaccaaaugaagaaugaaaccuccuggggugcuguguguuagucuguuugcauugcuauaaaagaauaccugagaccgggucauuuauaaagaaaacaaacaaacaaaaacaacaacaacaaaaaaaagaaaaaagacaaaaaugcaugaucauuuuuuccaaguuuaaguaguguugcaauuagguaaucuugauuaaaaaagaaaaaguuccuaguuacauccaaauucagguacuaaaccaaauauaucuuucaggggccagguauggugguggugcaugccuguagucccagcuacucgggaggcugaggcgaagaaucacuugaaccugggaggcagaaguugcagugagaugagaucgugccugggcaacagagugagguucugucucaaaaaacaaacaaacaaaaaaaacccacccaaauauauccuucagaauuacuugguuccaugccuauauuauuaaguuucaugguaguacaauugugaaaaaaaaugcuugcaggauaagauuaaaucagauaacagucaacacaacguggguguaacaacucaagagaauaggaaauaguauuauccaagaaaaccagacauuuccucagcuaacuauaugcauauaaaaaucagcauuucuaguaugugagaaaaggaaccaaaugaaaagcauuauaagaaacaagaaaauauuuuaugcauuucauguaucaguuuuuugcgaccagucucccucuguggcuggagugcaguagcgcaaucacagcucacugcagacccaaccuccuaggcucaagugauacugccaccacugccuccaaaagugcugggauuauagguguaagccaccaugacugaccuauguaucaguuuuugagaagaggaaucaaaugucaaguggccuuucuuuuuuuuuuaaauuugagacaagguguuguucugucacccaggcuggaaugcagugguacuaucaggguucacugcagccucgaccuccugggcucauucaaucugccugcccagccucccgaguagcugggacuucaggugcaugccaccgugccgggcuaauuuuuguauuuuuuguagagacaggguuuuaccauguugcccagguuggucuuguaaucccggacucaagugauccaccuaccuaggccucccaaagugcugggauuauaggugugagccaccgugccuggccuucucuucuuacuugcuauaaauagguauaaucuguaauuugccuuuuccaaauuucaaaaucuuaauuacaagaaagucuuauccaaacauagagucuauuucuaaaaacacauauugaauguacauauauucagaauauacuaaugaucacauauuggcauauucuauuuccauaaauacuaugaaaaauacuucaguuacuuauagucuaguuuuacuauucagaguugcgguacaguauacuaacauuaaaaggauaggcuguagccccagggcacccuguuuuaaguuuugguuucaccauauucuugucuguuucucagagguuauuauuaaacuacuuuauaggauuguugaaagaauaaaaaauuaacuaauauaugugagguguuuaguugguccucaauaaauacuggcagugaucaugauacuggugcacaugcuuauuuaugcuuucacaugacacagacagaaggugcucucuuuccaucuccauccauauagauauagauguuauguauguauauauacauaagauaagcauguuaagaaggaauuaaagcuuuugauuauucauguguuucauaggaccaagucucucuaaggugcuacaucaagaacuggccguugccaggcgcaguggcucacgccuguaaucccagcacuuugggaugcugaggcagguggauuaccugaggucaggagaguucaagaccaaccuggccaacaccaucucuacuaaaaauacaaaaacuagcugggcguagugguacacaccugcagucccagcuacucaggaggcugaggcaggagaauugcuugaacccaggaggcagaaguuucagugagcagagaucaugccacuguagucauaagacuuuguacaguuagaauuacaaagauaaauaccaggcuaggcaugguggcucaugccuguaaucccagcacuuugggaggccaaggugggcagauuguuugagccuaggaguucaagaccagccuuggcaacauugcaacaacccaucucuacaaaaaauacaaaaauuagccgagugugguggugcaagccuguaguccuagcuacuuggcagggugaagggggaggaccgaucaccugaggccagggaggcugaggcuacaguuaguggugauugugccacugcacuccagccugagugacagagugagaaacccuaucucaaaauaaauaaauaaauaaauaaauaauaaaaaaacuuaaaaaaaaaaggaucagcuugggccauagagugagaccccaucucuacuuaacaaaaauaaaaaauuagcugagcauaguaguagggccaccugcuacuggggaggcugaggcaggaggaugguuugagccucgguggcugaggcugcagggagacaugaucaugccacuguacuccuggucaacagugagacccugugucaaaaaaaaaaaaaaaaaaaaucccacaaaacaaagaucaguaucaccacacuguugacucugagguagaaguuaauacuguagaaguuaaaguuuuugaaauauuuaaaauuccaaaccacaaguguuaaggugacccuuguggaacugauaaaauuuauacuuucauguuuaaaaaaaaaaggaaaaacaaauaaacaaaccaaaaguaggcagguaagaucucuuccccgcaaaauauacuuuaacaaccaucacuguauaucucugacccaaagcacuaaaaaagaaaacaaaaccaaccauaucucaagacguauuaguguucagauugugguccaaaugaacaaguuaaaggauuaucacaguuguaaaagugaugaaaacuauuaggggauauacuauuuagaaaccaaaccaaacaaaacaacccauuuaguaaaaauucugcaacaagguucaugauaggcauuuugucuuuuaguguuauuucaggaaggauaggccuaauuagcuaucauuaaaaauagaaagggguacgguuuauaggccuauuauaauacaaacucaaaaaaaugugcuaguuaucucacuaauugaguaaggacaaagaaggaacuguuuccccaaaggaaagugucaugugcaacuaauaaaacugacaucacuuacuuuugaugcaaaacacaaguggcuuucucgcucuuugguagcacagaauagcaacauguaaacuucugguuuguagucaacuuaagaagacacugaacaccuggaguaccucuggguaauguuuauaccaauuucuucaagccaucauagucaaaaccugauuaaaauccuggcagaauggaguucaaagccuacaaaauuauuggcucucagaagcuaaugcccaaaguccauuuugauuucucugaacuuauuaaaaaaaaacacuacaauuaagcacuuagguucuuuaauuugauagacaaaauaggccuauguucaaaauguaaaaggcacaaaaagauaaacaguggaaacauaagucuuccuaauccuguucccagucacccaguuucucuuucuccauggcagccaguuaccuguuucuucuggacgauuuaauuacaggcuuaaugaaauuaugauuucaacugcuuauuccuguuucacgaucauauauuacugucucaaaaggauuauaaacuucucaaaggaagggaucaguguuuucugucacucacaauaccuagcccagugcugaauauauucauagaacuugacagauauugguugacucuggcaccaccuuagcagccuaaggcuaaguuauuuauaguugaaaccaagaaucauuacauuggcuagaaacaguauuuuagaugauguuaagugagcaacuuacuuccaacauuuccuuuacaauaugccaaaaaaaacaaaagagaaauaaaugguaaaauuuaaguuuagggugcagcugaaaugcuuuuaggacucauaacaucgcaaguaauacggaggagguuuuuucaguuaauucuaacaucauauaaagauuuuaccugagaaucugaaccaugccauucaggcuagucugauuuauuuuaauccucccaacaucaauuuuuaaaaaucuauauuuauguuuacauuucaagaguccagcagagaucaacaaaaaaaauacagcugugaauacaucauuuuuauaacagucuuuuaaacucaaugauacaucaguuggagcaaaucaaggucccucacaauuuucucauuucuguuuugaaauacuacaguauacuauagcaagaguugcuauuguuaucaggaaugaaaaaugugacucuaaacaccaaacuuuaagaaauaacauuucaaaacaucucacugaauaagacuuuuuuuuuuuuuuaaaguuaccuaauacagacacucuggcugcuucaugaaaauuaaaagagcaggccuuaauggguacuuaccuccaccauacaugacagccaacauuauggaggauauccaugacacuucgcuggugguggcauggaauauaccuucaaucucuuugaagaagacaguaauugauuugggaaaugcauaagagaagccgauggaaaugaaagcuccaauuaccacugcccagccccagccuccaucuggggggguguauccaacuggaccuccaacugcugguggcauuuuaaguguagauaaauuccaaaaugcaggucaaauccaaauaucugaaagacauaaaauuaaaauaguaugucaauauaaggcacaccuauaaaacucuuuugugaaauaagaaauauagccaaucgugguggaucaugccuauuaguaaucccagcuacuugggagguugaggcaggaggaucauuugaggccaggaguucaagacagcccgggcaacacagauccugugucuaagaaaauuuuuaaaaaauuagcuggguaugguggagcaugccuauagucccagcuacucaggaggcugaggcaggaggaucacuuguacucaggaguuugagaccacccugggcaacauaaguagaccccaacuuuacaaaaaaauuaaaaaauuagccagacaugguggugugugucuguggucccaguuacuugggaggcugaggugagaggaucacuugaaccugggagguaguggcugcagggagcugugauugcaccacugcacugcagccugggugaaagagcaagauccugucucaguaaauacauaaauaaauugguaaacaagagaccugaugagauuccagguuggucauugcauccaugugcagggaggauagcauaccccaauuccacgggggaagaggcuccuguacuuggggacccuuccagacuuugcccuauguacuucuucaucuggcuuucacauguauccuuuaaaguauccuuuauaauaaaccagcaaauauuaguaagcguuucccugaguucugugagccuuccuagcaaauuaaucaaacccaaggagagggguagugguaacccgauuuauagcuggugagucacaaguacaggugacaagcuacuacuuauguaugauuggcaugugaaguaagggccuuagucuugugcaacugaggccuuaaccugcgaucuaacuccagguagcugaagucaaaauugaauugaauuacgggacacccaguuggugucuccuacaauugcuugguauaugugggggaaaaaaacccccacacuucugguuacaguaguguuuugugaugugcugaguguugacuguguaagaggaaaaaaaaaaguguuuuucuccuucagaacuuuacaccuagcucucgaguaaaugaauuuuuuuuaauguuacuuauccaauagacauuaucuucuuuuaaagacauuaucagaaaaagcuuuagagucauaguauugcccauaauuuuuuguagcuuaaaggaaaauagcuucucaccacuuaagaaaucauaauugaaauaaaucccuuucaauaaaucaguuaacaucauaauuccuuaaauuacuuagauaaccaaaugccccauuugacuuaucugcuuaaccuaagauaacacauaauacauaaccuacaaacauuuuagguuuuuuuuuuuuuuuuuugagacagagucucacucugucgcccgggcuggagugcaauagcaagaucuuggcucacuacaaccucugccucccaggcgguucuccugccucagccucccgaguagcugggacuacaggcacacgccaucaccuuugacugauuuuuguauuuuuaguagagacgggguuuggccauguuggccaggcuggucucgaacuccugaccucaggugauccacccaccuuggccucccaaagugcugggauuacaggcaugagccaccacucccagccccaaugcuacagguuuuaauauagccuuuauaaguuuuuuaccuuuuccaaaauauauucuuccauacucuuuucauucucuuauuuauggcugacuuaacauacuaggaagugggugccugacucacuagauauguagcaauuuacaaaaaaaaagauaauucugaacaccgaaaauuuucacuuaacaggcuggggaauuaucucagaaaaguuuccuuuuaucuuaauagcuuugauucaagguauuuuuccgcauuauaugacaagaaacuccuaaacaacagcuagccaauacaguuaaaaucauaaauauauauaugaugucaaaagaugguaguuuuaggccaggcgcaguggcucacaccuguaaucccagcacucugggaggcagagguagguagaucaccugagaucaggaguucgagaccaaccuuaucaauauggugaaaccccauuucuacuaaaaauacaaaaauuagccaggcaugguggcaugcgacuguagucccaacuacuagggaggcucagauaggagaauccuugaacccgggaggcggagguugcagugagccgggaucaugccacugcacuccagucugggcgacagaguaauacucugucucaaaaaaaaaaaaaaaaaaaaaaaaguaguuuuaaaucaaagauaacuccuuugucuugaauucacuuaguacuaaugaauaaugaauagcaugguuagaaaauguaaccuucuguuacauuuucuaauaagauuuuaauaaggggcaggugggagugagcguuuggugguagguuaccuguuuucucaugaaggucuccuuuacuuuaagccaacuuccacccuauauuacaacuuauccuguauguuagcagguccauuucaaaguacuuccacucagacuauauuacagcaaugaacacaggucagagaugacaaguucacucuugacuaccauguucuuuagucuauaacacaaacgcuucuucauaauauuagcacucaacuccaaaacacuguuccuuccaaccccuaugaacacuucaaauacaauuuaggacacuggacauugcgggaguaugaugaaaauagcuccauacaagaaguuuccugaaaagcaaggauauacucaccacuuauacacaacauucuacuauagguucuagccagugcaugcaggcaagaaaaagaaacaaaaggcauaaagaauggaaaagaagaaauaaaauaggccaggugcaguggcucacacuuauaauuccaaugcuuuggaagaccaauguaggagaaucguuugaggacaaaaauucaagaacagccuggacaacacagcgagacccuaccucuacauaaauuguuuaaaaauuggguguggugguacacaucuguaguccuagcuacuugggaagcugaggugggaggaucacuugagcccaggaauuugagguuacagugaccuaugaucaugcugcugcacuccagagcaagaccuugucucggccaggugcgguggcucacaccuguaauccccagcacuuugggaggcugaggcgggcggaucacaagguaaggaauccaaaaccagccuggccaacauggugaaaccccgucucuacuaaagauacaaaaaauuagccaagcauggugguaugugcuagcuacuugggaggcugaggcaggagaaucgcuugaacccaggaggcagagguugcagugagccgagaucgcgccauugcacuccagccugggugacaaggggagacuccgucgcaaaaaaaaaaaaaaaaaaaggccugucucuaaaaaauaaauaauaaauaaaguuguuuuuauucagaugacagauauguauaaagaaaacccuaaggaacaucaaauaagugaauuugacuaggucuuaggauacaacaucaauacacagaaaucaauuguauuucuauauauuaacaaugaacaauccaaauaugaaaacauuuuuaaaugcuauuguaaaugguaaacuauauagaaauaaaucucacaaaagauguaugagauauguacacugaaaacuauaauacugagaaguuaaaauagauaaccuauccucucggacugaaagacucaauauuuaaaucaagcaaagauuucugaaggaacauaaagaaacaacuauaaaaaaaguuggccgggcgcaguggcucacgccuguaaucccagcacuuugggaggcugaggcgggaggaucacgaggucaggaguuugagaucaaccuggcugucucuacuaaaaauacaaaaauuagcugggugugguggcgugugccuguagucccagcuacucgggaggcugaggcaagagaaucgcucgcuugaacccgggaggcggagguugcagugagcugagaucacgccacugcacuccagcauggccgacacagcgagacugcgucucaaaaaaaaaaaaaaaaaaguuuuaaaauuagacuucaaaauauaugcaaaauaauauacucaagaaaagacauacccagaacauaaaaagaacuugcacaacgauagcaaaaaggcaaaucacccagcuuaaaaaaaaagcaaaagaucuaaacaggugcuucaccaaagauacaugaaugauaaacaagcacauguaaagaugcugaaugucguugguuauuuaaaaaugcaaauuaaaaucacaaucuaauacauaccuacuaaaaauaagacagauaauuccaugacuuugugggguuauaaagccaauggaacucucauauugcugauguuacagucccuuggaacacauuuuggcaguuccuuauaaaguuauagauauauuuaacauaugagccagccauuacagugucagguaucacccaggauuuauauaaaaaauucucuagcagcuugaugcauaauagccaaaaacugaaaacaacccaauguccaucaacaaaugaauggauaaacaaugguacagccauauaauagaauacuacucagcaauaaaaaggaacuacugaugcaugcgauaacauggaugaauuuuaaaagcguucuguuaaguaggaaaaaaaagcuagacaaaagauuguauucuauauggucacauuuauauuaaauuguagaaaaggcaaaauucuagcacaggucaagcauuucucuaaucugaaaauaugaaacccaaaaucugaaacuuucugaacaccagcaugaugcucaaagaaaauacucauuggaacauuucgaauuuuggauuuuuggauuagggauguucaacugcuuaaguaacugcaaauauuccaaaaucugaaaaaaucugaaauccagaacacauuuuaucccaggcauuuuagauaagggauagaaaacagaucaguggcuaccagggguuggggagaggagacugacugcaaagcaguaugagauaacuuuuaggguaaauggaaauacuuuauuaucaugauggugacaguuacucaucaaaguauacauucaaguuaguaaauuuuauuaugucaauuauaccucaauaaagcugaucaaaaccaaaagaaaguccaaggacagugacaaggggaauaaaauuuguucuguggcacagggagacaauacagaagcaaaaggagagggcaggcaaacuucuuugucuuaguuaucuagacgguuaaaagaaagaggaagaagacaaagaugaggauaaagaaaaggagacaagaggaggacagaagauucuucugagaauucacaacucaggccagugugagcucaugcuuggcagggaauuaucuguagaauaucuuuguuguucuuccagagauacacuauauuugauuuugcuagcaaagauuucccacaaaggccugccaaacauaagcucacaauugugaacacaucaagaaccaauuaaccgugagcaaacgcaaugccaaucuaacacaguuggauuagacacucaggaacuauaggcauagcaauaugaauauuuaaaugacuaaagacauaaaacaaggcauuuaaaacauuagaaaaaacuguguauuucucuaaaauuaugucuuucucuaaaaaagauccauagaagaagauuaauugauuugaaauagaacuagaaauggaaaguaaaguuagccaggcaugguggcuugugccuguaaucccaacacuuugggaggccgaggagaguggaucaccugaggucaggaguucgagaacagccuggccaacauggugaaaccccaucucuacuaaaaauacaaaaauuagccaggcaugguggcacaugccuguaauuccagcuacuugggaggcugaggcaggagaaucgcuugaaccugggagguugcagugagcugagauugcacuacuguacuacagccuggugacacggcaagacuccgcuucaaaaaaaaaaguaaagucagugaaauuaauaacacauuaacuggaagacuggauguagcuauauacagagucaguaaaccuuaagaauagguuugaagagauuagucagaauucaggggagugucauucugaagcuaugaaagaaaggcuuuagaaugggaggaucugacauuuaucuaaugggacuuuggaaaaagagaauagagaauggagaagagacaacugucuggguaaaugacuaaggguuaaugacuaaggauauuauagacuugaugaacaauauaaauccucaguuugagaaaacaagauaaagagaaaaaucuuagaagacaacuacuuagaaaauacagaugacucagcuaacaaauauucauacugacaaaacagucuuccugacaauuuugaaaaauucucaccuauuaugucuucaaauauugcuucucccccauucucucuuuucacuuuucucagacuccaacuggauauggguuggaccuucccaugcuaucuacucucuuacucucccuucuauguugucauguuaucauucauuccuuuguuucucugaacuucauucuggaugguuucuucuguacuuuagcuguguuuggcacuaaagauuaaggugauguaacuuaagauuaaggugauguaacuuacaggaaauagcuggccaguccucauuuucaaaccaaucaaguaaaagagauuucuguuaaacaaaagcacacuucauuuuaauucaaauaaauguguugauacacaucucugugauaacuaucucauuuuuauaauaauaauucuaacuuagagaaggcagccgggggcaguggcucaugccuguaauccaaacacuuugggaggccgaggcggguggaucacuugaggucaggaguucgagaccugccuggucaaaauggugaaaccccaacucuacuaaaaauacaaaaauuagcugggcauggcggcaggcaccuguaaucccagcuacuugggaggcugaggcaggagaauugcuugacucugggagacagagguugcucagucuaggugacacagcaugacucugucucaaaaaaaaaaaaaaaaaaaaaaaaggagaaggcaggaguuuguuguccagaugaaauaauuuuucaauauucuccaauauuucugaccuaaucucuuuuuggauuucuaucaugggacucucucuaggacuaugcauucuggaauuuucccuuccuuugagauuuuuauugcuuaggacagugaaccaccauaagaaaugggaugaauaagagauacaccucucuuuuguagugggaguaaaaggcuuuuggauaacucaaguuggaaaagaaaaaguagagaucaggcauccauucucaagagguaauuuuuagcuaagguuaucucucaaccugaggaugugcagaauaauuccuucaaaaauauaacccaguuuaaaaauugaaggucuuuguccuagggcauuucaucuaccuaggauuugggugagauaaaaauauuuacaaguuaagguuuccuaaaauuucuacuggaaugaauaugauuaaaagcuauuuaacaggucagcucugcuaacagcaacagccugaauucuaaaaugauguuaaauaaaacugcugcaggcauugauuuuaugagcuuuuucuucuucuaaguaugaaaaaagagaacacuuaaaaaauuucaaagaaccacuaaaaagauuaauucaucucagaauauuuacacacauagaacacccacacacagacaguagggcuguuuaacacaucaagcucugacuagaacagcuaauacgugcuggacgugauuaaacuuugaguuuagcugccagcuaugauuugucccaauuaaggcaguuacaauuuuuagucacuaaagcuugccucaucaaguuaauaccuuauuccacagugccaaaauuagauuuaaagccucaagaaacuuuagaaaaauuuaaaaggaaauaagaaaguauaagaaauaagagcaugcaaaaucauuaugaaaaacagaacacuucaaaaaaccacacacagauucaacacaauucugccaccaccugacaaauggcuaucccuguuaacuuaaaaauacugaugguacauaacugaaaaaaaaaagucaguuaauauuaucuaagcauauuauuuccuuuuuuaacuggcaaaucucagcuauaaacagaagggcucauucaaaaaguaaauuaugagagcaggcccccuugcagaguacucagaguucccuugagaaagcagagcacaugcauucuuuguaugcuaaagcccagaggcuaaaagggacuaaaguuuaagauuuuaauccuuacaauaugcacaguagcuuuccuaucagcuuagcuauuacugcccaagagugauggggagacuaaaaaacaaagugauaggguaaugagaaaaauucuucauuaauucaucuucuaaaggaugauagaaaacaauaacccuaacuuuucuuggcaaugacggugauaagaaucaccuucuagauuuucugauauuuuuuucucguaacucucaugaauugugcuaguaaacuaaucuggaaagccgaagcugugcuccauaccugccauguccuugccccacucccaaagagaagagcuacaaaagccuugaaaauaguauucaucauguucuguacacuuuccucaucaacauuuaaaaugaagccacugucuuuuccuaaaaugacaaugaccaguuugugaacuuaaaagaagcagaaaguaucuaaaaccaauaaccuuaaaauaaucuguuaaugaguguaaacuaguuuuagguuucaaacacauggaaacauucaaauccagaaaggcugauuuccugaagcuauugcugcuaaaguagauaaccuguuguucucuguaacuagcccuaaugcagcuucaugguuuacagaaccaccugucccaaguuaacucccaagauucaaagucuaggaaaccucacuuucguuucuuuuccacuuugaaacugaauacauugaggaaaccaaaacaaugaaaaaaucaagcagaaagcgcuagucaaagaaggaauguaacuacuggaucuggcuagccaaacacucagcaauuacgaaaugcauaauuuugaucaaacugcauauaaagaaucuuaaaaaauauaaaccugucucugcaaacuuccaacucucuuuaccuacccugccauucugggaaaauccuauccacauuacaagaaguuaaauauauuaugcuuauaagagaaauuaacaacuugcuaacucgaaugcuuaaagaaggauuuuaggccuaucuuucagaauucuguuuaugauaauugauuuuagaccuugcuuuuaauucauauuuauaaucccuaaaaaaaucaguauuuuaguuaauaauuuacaguuuaaaauuauuuacauagaccacucuaccaauaaauagaaagcauuucuuuuuuuuuuuuuuaccuuuuuuucuuuuuugagauggagucuugcccuguugcccaggcuggaguacaauggcgcgaucucggcucacugcaaccuccgccauccgguuucaaacgauucuccugccucagccuccucaguagcugggauugcaggcacacgccaccaugcccaguuuuuuuuuuuuuaacuuuuaguagagacagguuuuaccauguuggccaggcuggucucgaacuccugaccucgugauccacccgccucagccucccaaagugcugggauuacaggcgugagccaccgugcccggccaacguauuucuuuuuaaagacagcagauuuccaaagaacaagaauugguaaggauguggagaaaaggaaacccauguacacuguuggagggaauauaaacugguguagcuguuaugcaaaacaauaugaagauucuucaaaaaauuaaaaauacaauuaccauuugaucuagcagucauacuucuggguauauauccaaaggaacugaaaucuggaucucaaagagauuaccugcacacucccauguucucugcagcauuuuucacaauagccaagauauggaagcaaccuaaauguccaucuacggaggaacagauuaagaaaauguggaaaauacauauaguuggucuugucgcccaggcuggagugcaauggcaugaucucggcucacugcaaccucugccucccagguucaagugauucuccugguucagucuccugaguagcugggauuacaagcaugugccaccaugccggccuaauuuuuguauuauuaguaggaagggguuucaccauguuggccaggcuggucuugaacuccugaccucaggugauccacccaccucggucucccaaaguauugggauuacaggcguuagccaccgugcccugcauuugucagcuuuuuaaaaugaguuauguauuauuucuuucaucauucuaaacaaaaacucagccucauacucccuccacuccccgccccugcccauccccuggcacaaaaagacaacaaaucucaaaguuuuuguuccaaggcagaaauguauuuggaaaagggaguauuuuaauagcauuuucagauaauugaggauauuccucuuugauacuacaccaaaaccugaugggugauuuuuuuuuuuuuuuuuuuuuuuuuaaagacagugucucgcugugucacccaggcuggaguagaguggugcagugccucacuguagcuccugggcucaagugauccucccaccuuagucucacgaguagcugagauuacaggcaugagacaccaugccuggcuaauuuuuguauguuuuguagagaugaaguuuugccguguuucacaggcuggucuugaacgccugggcugggcucaagugauccgccggccuccgccucccaaagugcugggauuacaggcaucagucacggcccggcugauaguuucaugaugauuaguuuaagugaaaucuaaagaccucaaucgugagagagucuugagguccuugaaggauccaaaaaaaccacacuuugagaacggcuguuuuuuuaaaucauuaauucaauuugaucacaaacgugacuaaauugauaccuaaugguuuauucagacugcauaucaucuuggugcauucaacugaaucagaaucagguuagacaauguuuuuuucagcacuacaguaaauucugauguauaacagggauguauuaauuauagaaaaaagcugauauauauguauacuggaaaggauggucagagauggugcagaauacacuauuuuucacuguacaucauuuaggcucuauuuaaauaauauauauuuuauacuuugauaaaaaguaugcacauacuucuuauuaaaauaauuuugaucaaggaugucaaauuuacuauuuuuagucaguuaaaaaagaacaugcaaaaauucuauuauagaacaaaauaauaauucacuuuccuuuacgaguucuuuagacaaaaucauguccuuugcaacaacaugaagaugguggccauuauccuaagcaaacuaacacaguaaaccaaauauuuuucucacuuauaagugugagcuaaacuuuggguacacauggacauaaagaugggaacaauagacacuggggaauacaagaugggggagaagugaagaggggcaaaggguugaaaaacuaccuauuggguucuaugcuuacuuccugggugauggguucaauuguacuccaaaccuuaccaucaugcaauauaccuuuguaaaaaaccugcacauguaccccagaaucuaaaauaaaaguugaauaaauaaauaaauaaugauguaguauaaaaaaagaguucuuuggcuuaucaaguuuauccccuauagaccucuucacaccuuuuuuuuuuuuuuuuuuuugagacagaguuucgcucuugcugcccaggcuggagugcgaugguacgaucuuggcucaccgcaaccuccgccuccuggauucaagcaauucuccugccucagccucccaaguagcugggauuacaggcaugcugccaccacaccuggcuaauuuuuguauuuuuaguagagacgggguuucuccauguuggucaggcuggucucaaacccccgaccucaggucauccgccugccuuggccucccaaagugcugggauuacaggugugagccaccaugccuggcccacaucuucuuguaguccuaaauaccauacguauucuuggagagcauucuccaaaccagaaauuuguccaaaguuuuuccuaacaagaaagcucgcaaugcacacuugucaggagucuacaggaccauaaaacauacgaaagcuaacauuuguaacuguccucaucucuacugugaucuagaaaagcccuguuuuguuucaaguaaauauagcaugugcuaaauuugugauacgugaugaaauggagaguguuuguaagaucucagggcccuuucaccaccuaaaguaagacagaaggagguugagaggaggguuucuccagcauaaacaauaucccuuaauuuccagccuuucugacaccucucucuguccacugcaguucaaguaugacccccuuuuuuuuuugagauggaguuucacucuugguugcccaggcuagaguacaauggugcgaucuuggcucacugcaaccuccaccuucuggguucaagcaauucuccugccucagccucccaaguagcugggauuacaggcgcgugccaccaugcccagcuaauuuuuguauuuuuaguacagacaggguuuuaccaugacggccaggcuggucucaaacuccugaccucaggugaucagccuaccucagccucccaaaaugcugggauuacaggcgugagccacugugccaggccaguaugacacuuuucuaccuugugaaugacuuuuggugaagaaucuuugcuaaauauuaguccaacugagucagcugagcaaagcuucaaugcugaaauuuuuugaaaaggcauaaacaaaguucaaguaacaugaaggcauguggacauaaagaaccagccuuaagaaauuuccagagaaugggauuuaacuaccaaauaacauguauuauaaauauuucuggcuuguuaggugaaauggguuuaaguuuuccuagacagcugccuggcaaucaauguuucugcuaaccagcauuaagagcuacuuuugcuauaucaugaacaaagccagucaagcuguuucaaugaaaaauaaacaaauggaaaauguuggcuuucuauuugcaacuucaacuaaauuucauuaagauacaauaugccugaguaagaaucaaucuucauuuguauuuacugggcauauguugauauauaauuccaauuaauuugacuugacuuuaauacucuacaauacccuaugaugcuacuauugugaccccaauccuaauccucuuguacaguaguuguuuuagauaugaggaggauuaaaguaguauagagaacugaugaagugaacauauuuguaaaugggcaaacuagcaugcaaacuuaaagguaaugaacauagauauacauauaugcacgcacuuguguguauauauuuacuuauuuaauccucuuuugucaaucucagccaacguuauguuaaauaaucugaaucuaguagcaaacacucuuaauucuccuuguaagaaaaugacuuacaucauuuguucaaccaaauaagcaugauuuuauuuagggagaaugaggcuauuauauaagaaagguguggggguauaaaauggaucacuuacuuuugggauaaguacccacaucaguacaacuuuuuucaaaagauagugacccauucauuuuaaauugaaaaccggaauuuuccagugucuacuaaaagcaccacagauuagccgggcaugguggcgugcgcccggagucccagcuacucagaagacucucuugaaccuggaaggcggaggcugcagugaguggaaaggaagaaugggguauacuuuguuagcuaacaaagaaagauuuguagaagggcaauauuuuaggauaauagccaaagaagaucaaauaucaauguccuaaauuaucaaacuucaucguauuguuuuugcaauuaaaauugcaaaccggcugggcgcaguggcucacgccuguaaucccagcacuuugggaggucaaggcggguggaucaccugaggucaggaguuugagaccagccuggccaacauggcaaaaccucgucucuacuaaaaauacaaaaauuagccgggcaugguggugggcgccuguaaucccagcuucucaggaggcugaggcaggagaaucacuugaacucaggaggcggagguuguggugagccgagaucacaccacugcacucuagccugggugacagcaugagacuccaucucaaaaaaaaaaaaaaaaaaaaagauugcaaacuaagauuuaaaaaauuacacaccauacaacuguaucaucauuuuuaaaaaguauaucaggauauacaccaaacuuuuuggccauucauucaacaaaucugagugccuggaguaaaggcaguaaaagagaaaaagagacagacauaaucccugccuucauggagcuuagauucugggaaagaaagaaaguaaauagguaaacaaauuaauuaaauaaauauguucuaauaggcauacuuaaaaugccauauugcuggagguugagaaggggaguuaauaugcucuuuccauauaacuauguugacugacuuguuccaaugaacauguauuaccugauaguaaagaaaauauggccagguaugguggcucacaccuguaaucccagcacuuugggaggcagaggcgggaggaucaccugaguccaggaguucaagaccagccuuggccauauggcgaaacccugucucuacaaaaaauacaaaaaauuagacagcagugguggcacacacuuguggucccagcuacaugggaggcugaggaucacuugagcccaggagguggaaauugcaugagccaagaucacgccacuggaccccagccugggcaacagagugaacccgucucaaaaaacgaaaaacaaagccccacaaaguaguaguuuuaaaacaugacaaguuauacauguguguuauagaaaaauuaaaagauaugugugaauagaaaauaaaauuuaccugucauucuaccauccucauuuaaaguuauuuauguuuugauguaaauccugacuuccuuuuaugauagucaugcauaugaauaaacauaaauauggaauauguauguauaugcugcuuaauagacauuuuccauuaauaucagaaacuuccuuuuuuuugacggagucucgcucugucgcugagguuggagugcaguggugcagucuuggcucacugcaaccccugcaucccagguucaagccauucucauaccuaagccccacgaguagcugggauuacaggugggcgccaccacaucuggcuacuuuuuauauuuuuaguagacaugggguuucaccgugcuggcuaggcuggucucaaacuccugaccucaaaugaucugcccgucucggccucccaaagugcugggauuacaggccugagccacugcacccagccucuuuuuuuuuuuuuuuuuuguuugagacggagucucucucugucacccaggcuggagugcaguggcgugaucucggcucauugaaaccuccaccucccaaguucaagcgaaucuccugccuuagccuccuaaauagcucggauuacaggugccugccaccgugccugccuaauuuuuguauuuuuaguaaggguaggguuucgcccuguuugccauggcggucucaaacuccugaccucaggccacccgccucagcaucacaaagugcugggcuuauaggcauaagccacugugccuggccggaaacauuuuuugaugugucuaguuccacaaugcuguuuuugaagaacagcauucuggucuauggauguauuauacuuuaaaacauuaccuacuguuggccgggcaugguggcucacgccuguaaucccagcacuuugugaggccgaggcggguggaucaccugaggucaggagcuugagaccagccuggccaacguggugaaaccccgucucuacuaaaaauaugaaaauuagcugggcaugguggcgggugccuguaaucccagcuacuugggaggcugaggcaggagaaucacuugaacccgggagucggagguugcagugagccgagaucgugccacugcacuccagccugggcgauggagcaagacucggccucaaaaaaaaaaaagaaaaaaaaaaauuaccuacuguuguccaggugcgguggcucacaccuguaaucccagcacuuugagaggccgaggcagacagaucaccugagguugggaguucaggaccagccugaccaacauggagaaaccccaucucuacuaaaaauacaaaauuagccaggcaugguggcgcacgccuguaaucucagcuacuagggaagcugaggcaggagaaucacgugaacccagaggcggagauugaggugagccaagaucaugccauuggacuccagccugggcaacaagagcacaacucugucucaaaaacaaaacaaaaaaaccuacuguugcacauuuagguugcuacauucuuuuuuccuuuuauaguauuuuccacacuacuguggaaaacuagaaauuuaggauauaauuuuagacaaagaauuucugcaaauucuauuuuuuauucauauugccaacuugcuguuaagauucuaccaauuucuucuuccuaccacaguguaacaaaggguuauuuuuucacucuuucacugcauuuuguggcaaaaguaucuucaacuaacaaccauggccacagcaauauuaaaaaacuaagaguagguugggcacaguggcucacaccuguaaucccagcacuuugggaggccaaggcaggcggauccacuugaguuaaaaaaaaaaaucccuauaucucauccaaauauuagcauuagaugaacuucaaguaaucuaauuuucccaguuuuugagaaguagagaaaaauaugaaaccagaaaaaaaaaccucucagugauguaaugcuuucuagaucuacugcucucuacagugaaagaagcagaaaaguuuuuguuuuguucuguuuuguuuguuuguuuuucuugagagggagucucgcucugucgcccaggcuguagugcaguggcacuaucucggcucacugcaaccuccgccccucgggcucaagcaauucuccugccucagccucccaaguagcugggauuacaggcaugcaccaccacgcccagcuauuuuuuguauuuuuaguagaaagggguuucgccauguuggucaggcuaauuuugaacuccugaccucagaugauccacccaacucagccucccaaagcgcugggagaaagaacuuaucaaucuuguuuucugagcuauucuuggcacaaagaacuuaucuaucuuguuuucugagcuauuauuacaccagcaaauuuugccuuuuuuaaugcuucauuuuugccuucuucucacagacugaaaaacuggcuacuaccuaaguugagaguccuaugucccuuucacauauuaauuuauuucuugguuggccaggaguuuccaaauauagacccauuucacauuuuauaaaaugacaugagaugucauggagaaaagaaagcugggggcuauguccaucaauaguauguuuugcuuggcagaauucuaaauuauauucuggaauaaauaaugguauguguucuauuuucuacagcaacucaaaauauauucaacaaaucgauaucuaagugggccauuuaaauuuauuaacacauaaccuacccuguuccagaauuugaagaaauguacuggcuggauuaaaguuacaaauaagugaguugucaggauuauaucauuuauguuacuuugaauguaaaugaguauucgaauauauuaauaauagaugguauuucuauuacaaucuacuucacuuccacuaucagaugccaaauagggagaauaaguggauuauaauucauuaagaaaaagauaaacaacagagaaagcuuuuccuuuucuugcaaagagcuaaauugaacuauucacucacagaaauaauuaacauuuuacuuaguuuuacauuaacaaaaucuuugaggacuagagacaacaaaguaauauaacauuucauuuuaaaguuuuagucucauuuuaaacguuuuuaaaccauauuuuaaauauguauuuacaucucuaaucucuucuaauaacuuucuaauaacugcuuguauauaacaguaacuguuuaaaaauuccuugaguaagucugaacuucauuaugaugcuaucuuugacuucccccauuaucuccaauaaagaucuaaguuguuuuguuuucuuguuugcuucaccaguaacagacaaaucucacaaaagaguauuaaaauugaguacucuuuggcacugaaacaugauucaccauucucuccauggaaaucuuuaguaaaaggagaaaaauuugcugggugugguggcucacgcuuguaaucccagcacuuugggaggccaaggugggcggaucaccugaggucaggaguucgagaacagcuuggccaacauggugaaaccccaucucuacuaaaaauacaaaaaauuagccaggcguggugguaugcgccuauaaucccagcuacuugggaggcuaaggcaagagaaucgcuugaacccaggaggcggagguugcaagugagccaacaucacgccacuguauuccaguuugggcaaugagagcgaaacuccagccgggggcggcgggggagaaaaaaaaaagagaaaaguucaugugaucugaagagaaaccaggguauacuauucucaaauguuuacuugcaaagcuuuuugggaagauauuugcaggcauuaaaaauguaucaaagucagcauucuuaccucaaaacagcaccauuaaauagccuuuuuaauugcuaacgauauaaaucuuagacuaugcugccauuaagauaauugucaguuauuuuauuagaaauauacaauauauuuuuuuuuagauggagucuagccuaaaauauacaauuuuuuuuuuuuugagacagucuugcucaguugcccaggcuggagugcaauggugcgaucugggcucaaugcaaccuccgucucccggguucaagcaguucucuugccucagccuccaaaguagcugggauuacaggcaaccgccaucaugcccagcugauuuuuauauuuuuguagaggcaggguuucaucauguuggccaggcuggucucgaacuccugaccucagguguucugccugccugggccucccaaagugcugggauuaugggcauggccccugcaccggccaauauacaauuuucaaaugaguguuuuauuuuauuuuauuauuuuuuugagacagagucucgcucuguugcccaggcuggagugcaguggcgugaucuccguucacugcaagcuccgccucccggguucacgccuuucucccgccucagccucccgaguagcugggacuacaggcgcccaccaccaugcccgguuaauuuuuuguauuuuuaguaguaaaauauuugcauuuuuaguaguagagacaggguuucaccguguuggccaggauggucucgaucuccugaccuugugauccgccugccucgcacucccaaagugcugggauuaccuccaccucucagguucaagcgauucuccugccucagccucccaaguagcugggauuacaggcaugcgucaccaugcccggcuaauuuuguauuuuuaguaaagacaggguuucuccauguuggucaagcuggucucgaacucucaaccucaggugauccacucaccucggccucccaaagugcugggauuacaggcgugagccacugugcccggccucaaaggaaaauuauuaugccuuaauuugugacaaucauuuuauucucuguuagcauauacacaaacauuuuguucccucucauuugugaggucagaauuuaugaugauuaguaaauaaaaccaagucaauaaccaagaaauggcaucaugauucuguagaauccugugacaucagcaucugugugccguguugcuucacagguucuggcuaacuucauucuaaccuuggaacagaaguaaagaaguuaggagcagggguccuuagacucuggugccagggauuccuuuggccauuuaguaaaacuuauggaacccuugucagaauaauguuuucuuuuuuuaauauaauuuuauuuuuuuuucuuaaacaaauagagacaggguuucgccaugcugcccagucugcucuugaacuccugggcucaagugauccacccaccucagccucccaagugcugggauuacagacgugagccacgugcccagacagaauaauguuuuuaaaugcauaaaauaaaaugcaaagauagaacugucaaaauacuuuaauugcaauuaacaaugugcuuuuaaaaaauaaaauaagauccagcagugggucuaauaaucacacuaauuuugagguagugauaagcuuaaacaauuucaagauagcuauaacagcugcauuaugguaugaaguacaugauuucuacuggugacaaagucacagguacugcuaauacaacuaugguuuguugccuacacucauauuugaaugaaauuccaaguuuuaguuauagguuaaugaaaagauauaauauuuuucccccaaacaaguucacagaccccucgaauucaauagaccuuaggggaucaauaugcagaccccaggauaaaaauuucucauacaggaacagaagagcaggucaauaaaguacaaacauaaguuuugguuuccaaaacucaauaagacaaauuacaaaggcccuguuaccuccaaaauagucuaacacaccacagcaguguauagacuuucauucauucaauaaucuucaaaagguuuguguaggaagagcaaaaucagaaggaagacauauuuuucaaucaaugaucaaauauauagcuuacgauaucaguagauuuugaggaaauucuccuauacuaaggcuaagucauuguaauuaagucagauucaacaauaucaugaguugugauuagcaacaugauaguguagauaaccaacagaguuggaucuuacucugcaggacaaauggucagugacacccuucaauggcucagcccaugcagcugccucacuggugugguggaugugaacccuucuuaucauuaugcauacugugaucccagaagauuguuauugcuagacaggugagguagcucacaccuguaaucccagcacuuugggaugccaaggcaggaggauggcuuggggccaggaguuugaggccagccuggguaacauagugagacccuaucacuaaaaaaauguuuaaauaaauuagcugagcauuauggcccaugccuguaguccuagcuacucaagaggcugagguggcucugcuugagcccaggaguuacaggcugcagugaaccaugaugguuucacuguacuccagccugggcgacagagugaauuuauaaauuuauaaauuauaauuuauagauuuauaaaauuauaauuuauaaauuuagaauguauaaauucuauacauucuaucuuuaaaaaaaagauuguuauugcauuuuaaucucuucucaggaugacacuaggaaccaaacaugccaccuaaacuaguccuuccauucauuguaaaaaucuccuauaacacucccuuccugcaaagagaaaaauauauaaacuagguagcaguauuacaaaugaaaagugggggguuggacgagaaauaacaaaagggacaagagauuggcaccaacugcaugugguagggcaggggggccuacuaggagaaauauuaagaagauucagagguuuuaagccuggcuaccuucaagaaugguagaaucagaagaaaaaaacuagguuuggaggaugaaggaaaguugagaacaggcagagauaaugagcuuuaagugacauauuaaguucaaaaugcccaagaagcaacuggaaaagcagaucaucaauaagaguguucaaccccuguccuugaggaacuuacaaucuggaauccuuuuauagcuaaagauuuggauuuaguagugauucuacuagguauucucuaaaagcugugggaacagcaaaguccuccaagaaagagcaugaaagaccaaaagaaacgccauaaauuuaaggacaaaaauuuuaaauauucuaaauacuaaaagccauuugaaauguuaacaucaagugcuaaaaacacuuuuacaacuuaaaauaguggccuuuuaagaggauauaccucaauacauuuaaauacauuuccagaaaacgacagugucucaauaacauagcauauuguauuaaaacauaaacuuuaacuuguccuuccuauucaaacuguaccucucuuuauagagguauucuaguuaaauuaaaaauaaaugguagaauuaaaggcauaauuauuuccacuugcaaaccacuagugaaauaaugaaaacaggcuauuaguguaguacaaagagggauaaccaaauauaugccuccugaaggaaguacacaccaauaucuaggaauuauacuuguccucucccccaacacucccacucggaaaucaaaccugaacuaaauuuguucagucuucaaucuagcuaccaauuuacaagaaauacaaaggauagagggacauauuaaacuaggacauguuaaaucuauaccugagggacauauucaucaacauccaggaugagagaaaccggaggaaaaauggccugguuccuucaacaaauauuagguuggugcaaacauaauugcgguuuuucaauugccauugaaaguaauggcaaaaaccacaaugacauuugcaccaaccuuacaaggaaaauacauuacgaggaaaauaauuaagaugagggaaccuauagauuaaaaaguuuaagagacaucccaaacaaauguaauauguuaccuuguuuggaccccaaaucaaaccaaccaauuauuuaaaaacaacugaggaauauuugaauacugacuggauauuuggcgauguuaauuuuuaaagguaggguaauggcauugugguuaugacuuucucgagaguuaucuuucagauaucuauauugaaauaaaacaaaugaaaucauuuguagaauuugcuucacaguaauccaguagggucuggggaaaguagauaggggaagagagaaaucgugucgcucaacucuuuguguuuugaaauuuuccauacuuaacuguucaaaagggaaaaaagaaaaacaccauucucagggguugccaacaaaaacugaaaacaacaguuugaauuuugucuccaagccuuacaagcugagcagcccuggucuagucacacaacuuuuuagugucccuauugguuaaauggagacaaacaaauaccaccuaauaaacucguauuuguucaagccagaaaccuggguuauauccuuaacgucucugacuuucccagucucccacaucuggucuccaccaaauccuccaccaaauccugucuguuucucuaccaaauccugucuuguccaucacuguggucucacaccacuccaacagccuccuuucagccuguucuccauauugcauccaaagugauguuccuaaaacacaaaauccaaucagguuauccccagccccacugaaaauccuuuuuuuuuuuuuuuuuuugaaacagagucuugcucugucgccugagcugagcugaagugcaguggugugaucucaguuuucauugcagccuccaccuccuggguucaagcuguucuccuguaucagccucccaaguagcugggauuacagaagcaugccaccaugccuggcuaauuuuuuguauuuuuaauagagacaggguuucaccauguuggccaggcuggucuugaacuccugaccucaagugauccacccgccuuggccucccaaaguguugggauuacaggcgugagccaccagcuugaaaauccuucaacugcuuucaaucagcuucaagacaagagcgcuccuuuaaaauuuuuuuacccuccuuuaucccuuaaaaaucccuuuaauuuuuuuacccuccuugauuccuuaaaauggcuuacaaggcccuccauuuucucauacugucuaucucuucaacuucuaucucuucccauucucuuugacuuuuuuaugcuuuagcuuugguaaaauucagcucuugcauuacacccuguacucuugaguguagcuucaguguucaugucuggaauguucuuuccacccaucaucacugucuugccuggcuagcucuuucauccuucaagucucagguuaaacaguauuuccucagagaggucuagccaaauugcuucuauacuaaguugggugucuucucacaccuacacaauacaguauuuguuccuacaggaaccuguacccacccuauuauaacaguaccuacuuguuuguaaagaguauuugcuguggcaauuauauauuuaucuguuuuccagcuagacuauaacucuaggagggcaagugguaaaauuuguucacugcugaauccuaagucucucauggugccugguagccaauaacaaauugccgaacauauaaaauucacaacaaucuggacuguuuuccucauacccaaguuccaucuuccuaguccucaacugcaacaaaaacaagacagcuauguaggcauuuacgcagagaucuuaaucuugcauaggagugagcauuauaaagugaauugaaaacacgaugggaaugcagaacauaaggagcugagaaaucuauuuucaggcugagauaauuuguauccaaauuuacaaucuaaagaaaaaucaggagugccaaucuaacaaaaaugaguccaaagacacacauaguucccaccaaaccauaacaaguuuucagaccuaagauguuagaucacuuaaucccuccagccccaguuuccuuauguguaaaacaagggauccugaucagcuggucauuaggauccuuuccagggcuaauauaugcccuaauauuuaaaggcuaaaacauguaaacuagugaaauacuaaucauuugcuuucauccuauagugauaugacuuuuuuccuuuuuaaucuguuuaaggacauuacagucuaucccguuaagcuuacaacuaaaccuucaaaucuauucagcuauaaaaaucuuacaaaaugcuccucagaucauuaacuugcauauuuaacaaugguaacugcaaucugaugaaacaacagcaucuaccuaagaccaaaaugaauuacugaaauauauucaacuucuguguaaauaauaaaucuuaccacguguuuuaagugcuaaauaucuugaauuguuggucauuucuauggcaaucugaaggcaaagucgugccccaggguguaagacuugaauuuauggguacuauuuaacaccuaacuaaaaaacugaagauacauagucuuugcaucaccucacugggcuggugguugggauaaaaaaauuguugaaaccagaguaauuuuugaaaaaaaaauucaaaacaaguuauaguaaguuacaguaaauaaaguagcuuaguaaguuacaguaaauaaaguagcguguaaacauuuuacuguuaucaguagcagcccaguuucuaaucagccacuggaaacccaaagaaagacuaaaguaguaacaaguuugucuccugguuuagauuaauuacaaacuaguuuuggcaacugcuuguuccaucaaauaugucaugacaaaguaauaaaauguuaaaacgcaugcuggaaaaaaaaaaagacguacuuggaacaaaaaacuugcaucggaccaaguguaacgcuauccuccagauuucucucaacagggccgccuuaaguccaugaguagaagggcgcugcggcggacgcuggcagccacagguugaaugacaaagagcccccgucagcaccacucccaggagucugcgggcugccccguccccuccgcaaagucuacucgaacccugcagucacgccuuggcuguggggaaugcggcucuccgcaccacucucgcaagucaccagguggggcaaggaucggcgggccaagaagguuggggcggacaaugucacgaaucauaaauaacuucugccccgagucccuucccuuggggcagaagcggccaggagagucuggagguaccacaugcagcagccucauguuaucccuuuuccagaucaaagcaucucucgaggagccuauugaagacuuaggggggaagggacuuccccaccgucaccgggcaccacgacccaacuccucggccaggccugggaccggcaucuuagcacggggcccgcggcucggcuaagagaggcgcugaccccagcgccucaaggucuccuucaccagcacugcaguccgaggccacgcggcugccugugaccacgaugcccucugcugggccgccucccuccgccggagacaaagucucccaaccccggagguccccuccgaccccaccagggcagcgagggcaccgugggguccgcgccgcgugccgccggcuguuacccaacuaaccguuauaugcgcggaucgcagcgccgagcgugugcgugacgugguggcgcaggcuggaguuccacggggcccaggguccggcucccguccuucgcucgcugccucguuugcuuguuccaguacccacgcagcuagccagucacgucgcagcucaccacuuugucug

SEQ ID NO: 13780 - RNA, 5336 nt, Homo sapiens
ggccgcggccgagggcggggcagggaggcagcaugcuaaaccgggugcgcucggccguggcgcaccuggugagcuccgggggcgcuccgccuccgcgccccaaauccccggaccugcccaacgccgccucggcgccgcccgccgccgcuccagaagcgcccaggagcccucccgcgaaggcugggagcgggagcgcgacgcccgcgaaggcuguugaggcucgagcgagcuucuccagaccgaccuuucugcagcugagccccggggggcugcgacgcgccgaugaccacgcgggccgggcugugcaaagccccccggacacgggccgccgccugcccuggagcacaggcuacgccgagugagcgcccccuggggcacccaaaccaggauggggcucccaccccucuccccagcuccgcauccccggcgcuaggacgcguuccccacgccgcguccgggccaggagcucccuuuuccguggaccuuugcuauccucuggucuucgggccgcacccccucccaacccauuuuccaguggggggcagccugugucaccuucuucacguccuucccgcucauugacugcccucgcccacgccgccucaggacccuguucugccccagagcccggagggcggagagcccggcgaaggaugaguuggccaguuccccgucgcggcccggcagcuuaaaggcuaagggaaaagggguuucacgaaggagcgggguucuuuuuaauaggggacauagcgguugggaagacucgcucacccgcuucccggcuccagcgccccaguucccugucccucuuaccguaguuccccucccccuccacacccagaaauagcccgcgacaccaggaggccgccagcuuccccaggagcggggagggggacgcccgggguagaggagggucccauuuagaugcccuucagccugccaacucgugcuggccuggcaaagaagcggacccccugcccggagcggccggcuggcccccgggcuguguguauuuuaaaugcaucugccgggaacgcagagcaccgagggagaugggggcgcucaguucgcugaggaagguggcugguggcccauggacccaccaccaccucccuuagccuccugugugggaggaguuuauggguauguggcuccugcccaguccaggugggcuuucacuucuacucuauuucaguuccucuuucccgaucugggcuggagagcuuccucauuguuaaggcagcagaaacuuucgcuggaugguuuuaggauaagggugggugugcccaugaggaugaggugcuggggacaaggcacugggagaguugauagugguugagggugggauguagggucuagcuagcagggaaguaaaacuucugcuaccaacuagccccucccccagaagcaccacuaggaaugccuuuuucuuuuuucuuuuuuuuuugccagggaugggggaagugaggcaggcaggggacauagcgguuggccagaagcuccugcuggccuuucugugaagugguagggcuggccacccaaacaguacuccuuacaccuugccagcccucccuucuccuccucccucuggccuggaucccagguggcugugaccuuucucagcuuggccagcgggcgcaggagacggugugugucuaagguggggguuauuccaggaccuggucugguguccaaccugauguggucauucuggccuggcagggucaucaaugcuggcaagagucggcacaaugaggaccaggcuugcugugaagugguguauguggaaggucggaggaguguuacaggaguaccuagggagccuagccgaggccagguaagacccauccccuuucccagagacacagugacaccucuccccagggacucaggccucugguuuuaaaucugagccaugcggaagaccugaugaacucacuggcuaucuaccuucuggcacagaaccuuuaccugguauucaucaguuagauucuaccauguaagcaugaauguuacuuucccaccuaaaauguagaggcucacauauuuauggaugauuuaauugccagugcugaguuuuggaucuguuauccucugaguuuggguuuuugagccuuuccuuucucuugacacauacgaagccuuaugugaauaaaccuaauuugccuucaguagcaaacacugaccucucagauguuuguauggaugcccagagucuuguuauucaccuugcauaacacacacacacacacacacacacacacacacaaacaaaacucaccuccaacuuuuccuccaccagggacucugcuucuacuacuggggccuauuugaugggcaugcagggggcggagcugcugaaauggccucacggcuccugcaucgccauauccgagagcagcuaaaggaccugguagagauacuucaggacccuucgccaccaccccucugccucccaaccacuccggggaccccagauuccuccgaucccucucacuugcuuggcccucaguccugcuggucuucacagaaggaagugagccacgagagccugguagugggggccguugagaaugccuuccagcucauggugagugggugaccugggccaagagccugcuaggcaaccacucuggccaacucuguguggaagccagaggggguuacccugagaacccacaacaccuuugagagccugagcagagcuugguucagaggggagggagaaggggcaguuacaccccagucuucccuccugucuuccaguguagccuggcugggccaguugauuucuacggguggaggggguagggggagggugacugugugcuggaaccucuccuucuacccaccucugacccuuccuuauguggcaggaugagcagauggcccgggagcggcguggccaccaaguggaggggggcugcugugcacugguugugaucuaccugcuaggcaagguguacguggccaaugcaggcgauagcagguaugggggagggggcuccaagguggcgacagagggccacacucucugaguugggggaauacaggagaguaagguggcagggguuaaaaaucaagauuggagggagucaagaggggugacagacauaaggaguggccugaaauauccauuggguggggucaggggcagauaugggggucuggguaagagaucugaaaggucauuauggagagggccuggucuuucuggaauuuuucaugagugggucugaagagaaccaggucccaauuccuuuucuuucuuugggcagggccaucauuguccggaauggugaaaucauuccaaugucccgggaguuuaccccggagacugagcgccagcgucuucagcugcuuguaaguaggaaccaaauucccuacccccauucuuugucgggucuugugccucccugcaccccauggcccugagaacucucacacccccaccacaggcacagaaagcacuuuacugggaaggccgcuguguggacuauggagugcggggcugagccggugggagguugcagcagggaggcugcagcacugggcugguccagugcucccacuguggccccagcugaggcaggaaguagagacugaggugggggaaggaaacagcaaaggccccugaaaggcaguccggcuuagugccuaaacgcauguggcuguggagcuggaagcccgggaugcauccuggucugagugcuuugcuaauugugugaccggagcaguucccucccuuaaccucucugugcaucaauaguuccugccuuaagggcuguugugaggaguaaaugaguuaauauuugcuaauauuagaauaacguguggcacaugguaaacucuguuuaagggucugcuguagucaacgucaucugugugccaccgugugcugugagcauaaugcccccuggcucucuguucugaucauccccaacuccagggcuuccugaaaccagagcugcuaggcagugaauucacccaccuugaguucccccgcagaguucugcccaaggagcuggggcagaggauguuguaccgggaccagaacaugaccggcugguaacacuucccucagagcuggggcccguucccauggcaacacaaccagucccucgcccgcagcaagguggaagcuggaggcugggaguugggaggauguggcccuucuaagggguuugugugaggguaugcagcuccuaggggagaggggcuuugaugccugggugaugccuccucuacuccccccuccccagggccuacaaaaagaucgagcuggaggaucucagguuuccucuggucuguggggagggcaaaaagguaaacuccaugguagaggugggagaggggaggaggaccuaucacaacuugucuagggagguggagguucuaccugaggguagggguggaagggaucuuugguuucagagaaucuagcagaggacuacaguggcacucccuccucauuucuuucaggcucgggugauggccaccauuggggugacccgaggcuugggagaccacagccuuaaggucugcaguuccacccugcccaucaagcccuuucucuccugcuucccugaggugagccccuuaaaccacaccuugccuucucugggagucucaggccagcuuucaucugcagucccuuuaucuccaagcucccuguccagcaaaccccacaccucaauccucucugcccuuuucucccaccagguacgaguguaugaccugacacaauaugagcacugcccagaugaugugcuaguccugggaacagauggccugugggaugucacuacugacugugagguagcugccacuguggacagggugcugucggccuaugagccuaaugaccacagcagguaggggcugcauggcauggugguaaggggauggcauuggugaaagaagggucaaagggaagcaaugcuugggaccccacaugugggccuguguaucugucuucccacauacauguugguacaugaaugugcaugugugcuccuggcagguauacagcucuggcccaagcucugguccugggggcccgggguaccccccgagaccguggcuggcgucuccccaacaacaagcuggguuccggggaugacaucucugucuucgucaucccccugggagggccaggcaguuacuccugaggggcugaacaccaucccucccacuagccucuccauacuuacuccucucacagcccaaauucugaaguugucucccugacccuucuuuaguggcaacuuaacugaagaagggauguccgcuauauccaaaauuacagcuauuggcaaauaaacgagauggauaaa

SEQ ID NO: 13781 - RNA, 6737 nt, Homo sapiens
ggaaaggagauacgcguguagguaaauauccuaugcgccaagucagaccuaggagugggaacagaauucacagcugggauccagaagcauuucuaggcgcacccuuugaggaguagguaggaauuggacuccuggaaauuccaggcccagggaagaaagcgaauugugaggaggaacgguggucugggucugaacggcucugagaggucuucaaguuugggggaugacguugggcuguacgauccuaggaacaagaggguggacaucuccccccaaccaacacacccgcgccgggcccugggaccucccggcggauacccuuucccagucccgcuucccgcgaggucccaggugcagcaggagcggguggccgcuuggccacaggagggcagcagcggcccuuccugaccccaccccgagcaccucuuaacuuucccgacgccgguccuccccuaggggauugaaggcugggcagagucugaguccacccgggucgugcuccccccgcucgcccggcuccuccgcaguccaggaaucuccccguggcucuccccgaccuggagggguggacgccccuggcccccaguccccggccugcggagggggccgguggcugcggcccugcgcggggccggggcgggccgagccaagggccgcccccggccgacccucccccugccgggcccgcccuccccgccgcggcgcuggaggagggcggggcggggcccuggggucagucugagccuccggcaccggccgcgcagcuggaggcggcggagcggaagguacccugggccggggcugcgggcgguggggcgucuugggaacucguccccaggagagcacuuucccuuccucgcuggcccggagaucggggcccgugcgaggaggggcuucggccugggcguggaccccguucccuccaagcggagucggcauccgggcugggcgguggucggaccgcgucggccccuccccgggcugcagcgagggggcccggaccugccggcaggggcucuggccuccugagguccgagucggagccccuucccuucuccucccagcuucccggaaccugccccgccgggcgaggggcgagggaacuucaacucagacgccccagcccccagggugggcggccgcaggggaccuagagugggauggggugggaauuccuccaggccaggagggagguauggcgggaauaggggcgggaugugaccauuggggccugccacugcucggcagggucuggacgccgcccuggacgguuccuggagcccgcuuguguugaggauaagggagauggggaaggauccaacucugugugugugugugugugugugugugugugugugugugugugugugugugugugugugugugugugugugugugguguguguguguguguguguguguguguguguguagagagagagagagagagagaaaaugagauugagaauccuccuucuucauacucgaaccaagaaagaguauccugggguuugggacugggaucccgaggccgagucccgcccucacucugguuuuaaaguugagaaugcaguaucucuugguaucuccagaacggauuccuucccuagguguagggugggccggcaaagucaaccggccgcucuggaucaucugggaauucaagagagcgauuggagagaggucugauguagccacacugucuugucuuggggaaggccccagaaguuccaggcuccauuccaggcccuguguggggcucaguugccccucuuaaggggucagugggacagucccucuggggcugccucucacagggaguuguccaugccaucuuggccuugggccuaguguccuggccugggcugccugcuguucuggcccaaucauagccuggagggaaagucuucuaauugggcuggaggcuccaggucccuuaacgcaugccucaaccccggguuucuguccucugccucccaccacucuggugccgucugaauuacccugcuggggggacagcaguggcauacucaugccuaagugacuggcuuucaccccaguagugauugcccuccaucaacacugcccaccccagguuggggcuaccccagcccaucuuuacaaaacagggcaaggugaacuaauggaguggguggaggaguuggaagaaaucccagcgucagucaccgggauagaauucccaaggaacccucuuuuuggaggaugguuuccauuucuggaggcgaucugccgacagggugaaugccuucuugcuugucuucuggggaaucagagagaguccguuuuguggugggaagaguguggcuguguacuuugaacuccuguaaauucucugacucauguccacaaaaccaacaguuuugugaaugugucuggaggcaagggaagggccacucaggaucuauguugaagggaagaggccuggggcuggaguauucgcuuccuaaagggcagugugaggugguggugggguguggggaguagaggcguucagucagcccaguuugacaggaugugggacugagagaaaaagcuagguuugaggcugagaucagguuaccgucgcuuucuuaacugcucccugccugguuggugcugggacuggcccucauuugucucuucuuuuggggcuccucccagcccagacucuagcccccucccccuucccaacagccuugacuucaucucagcuccagagcccgcccucucuuccugcagccugggaacuucagccggcuggaggucaguuccccuccccagggaaggaggaagugagggaagcugcgaaggugugaugaacugugcagaugcucgcugugugugcugggggugggggacacauggaagcccgggaagcugacuccuugcccugagucacagggaggggugggcagggcaugcgggugagcuggacugagggaggaaggggcuguuccagaguggguggaggugauucccugguggauucuucucagucacugugcugugguagauguguggcucccuacaguguggucauuguccccugccgggggcugagugacccaguguugcuggcaggccuaggaggaaggggggaggaaggcagccugcccaaacucgagcugugggcauugcugggacugagccuccuuuguauuacuuggggcuuuggggaccgggugggguggaccagggaagcuggcuggcugcuaccccuguccucugucuggguuucccugcuucugcucucccuccugccccugaggugacaugucgaagaggcacgacuuugagucacacaguccugcuuugggugcugucccugccccuuauaagccacagcucugaaucugucuuaaccucacugagccuuaguuuccugguuugucaaaauggaaagugcaccaucuaccuuccaggcaucuggguaccgaaggagauaauuccugccaaaaugcccgacagagugccuggcaccuaggggcucuauaacuauucuuccuuuacccaccuaccaccugguagcugguucugcuacucugguccuagagagggacuccucauuugugacuggacagguaugacuugugcugagggacagucuguucuagauuggaccuuagagauuauuaaacuguaaaugcaucaaaauccugguaaccaaugaagucugacucgaaacccugaugugugaaguagauagaagcuugcucccuggacgucccgcaucccugagcagcucucuagcuaccuggaguccccagguuggcaaguggauuagauugaaacucauguuuuccagcucccaaguggggucaucaucuaccucccaccacuguauucuaacccaucgagggagaccugucccugacccagagauuaggaauuucaagcucuguugucgcacaauugguguuuugccagaacaugccugagcaagcccccugucccuuugcuagaugccucgguuuccagggagguuugggggcccuagagaaguguuuuuggacuuaauggcuuuuccucaaauccccaauacgucuuuccuggcagccccaccauggcugcaauccgaaagaagcuggugaucguuggggauggugccugugggaagaccugccuccucaucgucuucagcaaggaucaguuuccggaggucuacgucccuacugucuuugagaacuauauugcggacauugagguggacggcaagcaggugaaggcagaaaugcccuucccaccccacccugagaccccgccccccagucacugaaugaccuaguauguccuuccccauuccuaccccugucuuugcuucauucucccugcuggaaccaguaaaaguuaggaaguaaaucugcagucuuaaaaaaccuggauauacuuucugguucucccacagacuggcucuguaaccugggccgagucccuuugccucuggguuuaagcucccccaccugcaaaauggggaugaugguaagaccucccucaaaggguuguugugagaauuaaccaaaauaauggugcucacaguggcaacucaagggucaaacacgucuuagauuucuuuaacaaacugaccuaauuuauguugugggacagugauuaauauaaugccuggugcauagcaggugcucaaauaaagaaguucagugagcccgaaggacagugguuucaggggaccuuuggguggcaggguuggggcccucaggccagcuacucacuggcccugugugucagguggagcuggcucugugggacacagcagggcaggaagacuaugaucgacugcggccucucuccuacccggacacugaugucauccucaugugcuucuccaucgacagcccugacagccugggugaggggauuggagggaggggacugagaaccccuuggaaucagccagaggucucgugccuuggccugucuucagucaucuucagagguggggguggggaugcaggggagcacucaggcccuguuggucuccuuuacugugguaacuggcccucugagggcauacuacuguugagguuuugagcugugaaagggaccaucaugcugaauggcuucuaagacugcucugggaagaugagggcccccccaggggagcuuucuagcuuaaguggaggcaccgacaccuguuggugcaugucuacacagaaaacauuccugagaaguggaccccagaggugaagcacuucugccccaacgugcccaucauccugguggggaauaagaaggaccugaggcaagacgagcacaccaggagagagcuggccaagaugaagcagguggguacggcugccaggcuggagccccuggggaagaaugcacccucugagggguugcagacgggcaaagggaacuucucuccagcuacugccguguguuaggggaaacaguaauaucuccuggugagggaggacccauaggguugugucugaugagguaucagaaugaagugacuuguccaaagucacuuggcauuuuuauuuauuccaguuaauuguccauuccguucagaauugggacuauuaagaugauuaagaaaaucugcccucggggagacagcuuauguuucacuugggauacccaggcugugccaucagagugccccugggggagguguagggauguggaugcgggaaugagggcaggcauuguguaaguggcuggaagaagggaugugagagcuggcuuauucagggaccuguaaguggcucucuagccagaggacuagaguuuauuagagaaagcugucaggauaagaaaugcaaagauaauuauggcaaaguuucaaacuggggagauguuaggucuguguguuagaaaaauaauucugacuggaagagagugaggauggaggcagagcagucaggaggugggagacgcucauucaggcaagagaaccaggggcugugugugggaggagguggggcugcaugggaauggagggaguagacuggagggauuuuuggaucccuggccacgaagcugcccaggguagcuggggccugggcgcuuucugggucagggcuggagaaggaggcauuuguuccagcugcuacacuuaugggugaggcaggagagguucauguagucaacagcuuccuuugaccccucaucuuaugucuucucaggagcccguucggucugaggaaggccgggacauggcgaaccggaucagugccuuuggcuaccuugagugcucagccaagaccaaggagggagugcgggagguguuugagauggccacucgggcuggccuccagguccgcaagaacaagcgucggaggggcugucccauucucugagauccccaaggccuuuccuacaugcccccucccuucacagggguacagaaauuaucccccuacaaccccagccuccugagggcuccaugcugaaggcucccauuuucaguucccuccugcccaggacugcauuguuuucuagccccgaggugguggcacgggcccucccucccagcgcucugggagccacgccuaugcccugcccuuccucagggccccuggggaucuugcccccuuugaccuuccccaaaggauggucacacaccagcacuuuauacacuucuggcucacaggaaagugucugcaguaggggacccagagucccaggccccuggaguuguuuucggcaggggccuugucucucacugcauuuggucaggggggcaugaauaaaggcuacaggcuccaacgugu

SEQ ID NO: 13782 - RNA, 2047 nt, Homo sapiens
agcaaaugcaggaaaauagacaccuaacuagagaucaugaaguuagaauuugucuccuucuuuggcugcuacuucagccccugguaguaaauuagaauaaaguuccucauuuauuagugagcugguuuugcagucucuaaagcucuuuugcagcucuucuauucacuauggccucagauacgauaaaucugcuagcugcaaaaauucaauauaccaaguagaauauguaggaccagucaaguuuuaaguuugggagugaggaaaagcagcauguauuuucuauuuuaaauuauuuucuuuucacauucuaauuucuuaaggguuuggcuugauuuaugccagguucugggccuguaagccuacauuaauguaucacaguacuggauaggauauuugauaucucuuacuuagcccagaaucucaaaugauaaggagcuguaguuaaugauauguagcauuuuguugaacuuuacaguguagaucucuguuagucccugggucuguaacaaauggacucauccuugugcuuuuccauaggugcccugauguuuacugacauaaaucaagauacuauguggcucuauaggggaugcugaaccauuugacagucuaggugcacacagucaccucacauuauuuaagcccugaucucagcauucuaauuucucuguauuccccaguguauauaauguguacuugcuugaaauuccuuauauauugcuuguacauuccugcuucuaaguuucagcacauaccaguucccucuauuuagaaugccuucuucugacugcccucagucaguucauaaaacacauaaagcuaucuuuuaaaaauucaacucaaaagucaccuccuguggaaugccaucucugcuuaaucucauuaaccuaauuccuuuauucucagacuucugcuuccuaguccauuaaacuguuucauuuuauuguaauuguugcuucuguauauugucacccaguaagcauaauuauucuaggaaugaucaucuuccuccagccucuugugucuacuuauuacacacaaauauuuugaaggccuauugaugaccuuuucaguuuccccagaguuccaguucaccuuccuuacuguuuccuuuuacuucauaguuacauuccuaaagaagcagcgcauguguucaggguuggccuccaccucagcauguguguggcagccugcugaauagaucccuacaauugggaaggaguuaacccucuagcuugacaaucucugcauucuacuuagacaccuucaagaaguagaugugagaccaggaguagaccugaaaaugggaguagguaaauuuccacggaaagccaaguuagcuuuuuccuuccuuuauacacaagaccuaugaagcugcugucaucagcagcucauucaacacucuccugcucugccucuuuuccaggagucaggguuaguuuaagaaaaagccucuugcaagaagccaugaccucguacuuuuauccccuccaucugguguguggccucauggggcugugcugcuaugcaggaggugagcaauggaauucuuuagaugaugacuucugagcccacaugcagaggcaguugggggugggaagcagggagaacagugagagccaagaucgauggaccaaaaaauaaagucugccuuggggaaguccugacuauagguagacuguuuucaugagguguucuucuccuagcucaaguaggggcccaggucagggagcugcagcaucccagagcuaugauugaugaacauuguacuuuucccuucugucuuaacaguuggggugcaggauuaggauagguagccuaugcugucucuaacagaaaacauuacaggauugaacagaagaguuccccuugcauacgucaucuuuuggagcugcucuuacucacugucuugcgccuaaacagagguccagauuuuggaugggaaaacaaagagggguugagagcagcaaguguuugaucaagugaaaaucugcugucugccucaucucauggguuucucugcaggauugagaccccuugccuuggu

SEQ ID NO: 13783 - RNA, 2047 nt, Homo sapiens
accaaggcaaggggucucaauccugcagagaaacccaugagaugaggcagacagcagauuuucacuugaucaaacacuugcugcucucaaccccucuuuguuuucccauccaaaaucuggaccucuguuuaggcgcaagacagugaguaagagcagcuccaaaagaugacguaugcaaggggaacucuucuguucaauccuguaauguuuucuguuagagacagcauaggcuaccuauccuaauccugcaccccaacuguuaagacagaagggaaaaguacaauguucaucaaucauagcucugggaugcugcagcucccugaccugggccccuacuugagcuaggagaagaacaccucaugaaaacagucuaccuauagucaggacuuccccaaggcagacuuuauuuuuugguccaucgaucuuggcucucacuguucucccugcuucccacccccaacugccucugcaugugggcucagaagucaucaucuaaagaauuccauugcucaccuccugcauagcagcacagccccaugaggccacacaccagauggaggggauaaaaguacgaggucauggcuucuugcaagaggcuuuuucuuaaacuaacccugacuccuggaaaagaggcagagcaggagaguguugaaugagcugcugaugacagcagcuucauaggucuuguguauaaaggaaggaaaaagcuaacuuggcuuuccguggaaauuuaccuacucccauuuucaggucuacuccuggucucacaucuacuucuugaaggugucuaaguagaaugcagagauugucaagcuagaggguuaacuccuucccaauuguagggaucuauucagcaggcugccacacacaugcugagguggaggccaacccugaacacaugcgcugcuucuuuaggaauguaacuaugaaguaaaaggaaacaguaaggaaggugaacuggaacucuggggaaacugaaaaggucaucaauaggccuucaaaauauuuguguguaauaaguagacacaagaggcuggaggaagaugaucauuccuagaauaauuaugcuuacugggugacaauauacagaagcaacaauuacaauaaaaugaaacaguuuaauggacuaggaagcagaagucugagaauaaaggaauuagguuaaugagauuaagcagagauggcauuccacaggaggugacuuuugaguugaauuuuuaaaagauagcuuuauguguuuuaugaacugacugagggcagucagaagaaggcauucuaaauagagggaacugguaugugcugaaacuuagaagcaggaauguacaagcaauauauaaggaauuucaagcaaguacacauuauauacacuggggaauacagagaaauuagaaugcugagaucagggcuuaaauaaugugaggugacugugugcaccuagacugucaaaugguucagcauccccuauagagccacauaguaucuugauuuaugucaguaaacaucagggcaccuauggaaaagcacaaggaugaguccauuuguuacagacccagggacuaacagagaucuacacuguaaaguucaacaaaaugcuacauaucauuaacuacagcuccuuaucauuugagauucugggcuaaguaagagauaucaaauauccuauccaguacugugauacauuaauguaggcuuacaggcccagaaccuggcauaaaucaagccaaacccuuaagaaauuagaaugugaaaagaaaauaauuuaaaauagaaaauacaugcugcuuuuccucacucccaaacuuaaaacuugacugguccuacauauucuacuugguauauugaauuuuugcagcuagcagauuuaucguaucugaggccauagugaauagaagagcugcaaaagagcuuuagagacugcaaaaccagcucacuaauaaaugaggaacuuuauucuaauuuacuaccaggggcugaaguagcagccaaagaaggagacaaauucuaacuucaugaucucuaguuaggugucuauuuuccugcauuugcu

SEQ ID NO: 13784 - RNA, 14793 nt, Homo sapiens
gggagcaggugggggugcagcgcgguggcgcgcgggagccccgaggggcggaggcggcugcuacaccuagggcgucgcggagcgccccgggcuuggcgcgggcggagccgcccuaagggccgcgcguguccccggccucggccccgccccgucccguccaaugagagcccgcggccgaaggggcuguccgcacacuaggcccgcagcucccuucagcgccgcagacccccugacaccgcacccgguccucaggcagcgcgccccagaccccggguucggcacgccgucgucggcuuccggacaucgcaacuugcgccccucucggggauccuccucccgggcucuggaccccaggugauccuagguccccagccgccggcgaacaccauggccccccaggggggugagguaggagcagccugaguacccccagaaggugccccguccacgccccuccgggcugcgcggcgggagucuucggggagcuaugcugagaccggguggugcggaggaagcugcgcagcucccgcuucggcgcgccagcgccccggucccugugccgucgcccgcggcccccgacggcucccgggcuucggcccgccuaggucuugccugccuucugcuccugcugcugcugacgcugccggcccgcguagacacguccuggugguaaguguggcucucaggcugggcgggugaggcgcuugguaggagaggccggaggcgccuggagggacuggcugcucacgggaccaggcuguugcuucgacggguuggagacgauucgggcaggacugucacugaaaucugaagucgcgggguggcgggagggugaggcgccgcgucuuacacgacuggugagaaaggcgcugggcauucggagcaaggaugcccgguggucgcggcuccuuaggccuccacgugcuguacccccucuauuucagcucaagccccuuagggcagaagcuaccuuccgaguuucccucagggugaguucaaggaacgaauaaccuuccagggcccgcaauagcuucgccagggccccaaucgccuaaggucgcccucugagagguggagaaaggggcagcucgcuagucuagcccacccauaccacaggaaggcuuuggugaggcagcagcacccagccgaggcuuagaaauggaaucgaggcaaaauuuaccccauuaacucccacaauuaaaacaaacaaaacgcauggguuugcauuaucuaggcauuugucuucagccaccguuuugaggaugucacuuaggaaacuuugccucccucccuucuuccuauucuuucccaucucccauuucuccccuccaagagccagagggcugcggagucccaagauacuaagagacccccuccccagauuucuugcaggcccuagacuccagacacuucacaagagggcagaugaggcaaaaaggcauuacagauccacuggaugucucgugucuguucuuuuuagaauccucccugcccccuacuccuuggauggcacucaucaccuucccguaggagaaggagcugcuuucccuucuuccccaccauggggagagggcaaagcagggagaguugaaccuagaaaagacucagucuuuccucuucaccccacaaucaaacuggccucuuggacuaggcuauugccccucuccaccaggcagugccucccguccuuuccuuacuccguucuucuucccgugcaagccccccuccccgaaauguggucucuucucuccuugcacccuguggcuuuucuccucuugacuuggaaucuuggcugaagggugagggguagcuggccgaggggcccgccagcuugggcugcagauuccuaucauuucaagaugccgucucuccuuaucccaacccccacccccuguuuuccuguuucagaaaaaucucuuuugaauuuuuuuuuuuuaaaucucugcaguguuggggaaggcaaggaggggggguucugguugggggaacagagaggccuauaucuuacaucuggcuugaaacauucuuuuagaaagggaaaggggagaagggggaugaggagaaaaaccuuucaaaguucugagugagaucaaagcuaccuuuugccuucaugagcuuggucuggcuggggacuuggcaucuucagggucuuuguugagacaacaugaaguaaccgcugcccaucuuuaucuggcucagacagcaguuugcuuuuugggacucuugauugcuucuuaccaguuugggauauagucuuggggaccaauugguguuugggugaggaagugucacucugguaauuucagcauccuggcagugguuccuaaagacccaaaugggggucuuccuaguucccauuuuguacucuugacuacucccucucccuuuuccuuucucccucuacuacccuccccugaugugguucauauuaaagauucuggaaaaauuccugggugaaagagcuagggagggagggagggagggaggugacacagagugacuuagcagccccugugaaaaggaggaaggcugcaacagggccagguugggaaguggguacagagguuguuucagccuccuugcuccacaccugucauagcuacaggcccagaugccugccucagugaucaccacuugugggauaaggugaaaagcuaccuucuaagggcaggcuaagcccccaagccuuucucuuaggaaaaaaccagcaagauugauguucuguacaacccguggaagagaaaugccuguugacucugguguguccauguuccacucuggagcagaaggccaucauuuucaccaguuaauauuuggauuuuucucauagcuugagauucuuccccuuacucucuaaccacugcccucccucuaucuauccuaaacagaccaagaaauagggagcuuccggcaugugcuuuccuguuucauuuugcauucuguaggggguuggauguagggaaucacaagaacaggauuguauucauaggcucacaaagggagagaaacacaaagugguaucauauuguuagcacuacuuuuaccaacagcaguugcuuuuaauaagcccuuacugagcuucaggcacuauggccaaacaccuuaugagcaugaucuuugucaaucugaaauaauccagugagauggguucuauuaucauccuuauuucacaaaugaaagugagggaugcuguggcauuaagagcagauucauggaggcuaauaguguuaucucuguguucaaaguucuauaugugcugggcugaaucauguacacuaggggcuguacacgaaaggaggaaagaaaaaaaaaaagcagaucccuggcccguuugugucuuuaacauacaaacauaaaacaucugcagauaggcuggcaacuguugacaaguaaagcuguaauggaaaugggaguuaauggcuggcuagagggagaagggaguuggggauaaaucagaacaguuagguguuuauucaacaaauagugauugcauaccuacuaugugccaggcacuguucucaguacuggggauauugaauugaacaaaaccgacaaaaaucccugccuuuguggaguggugcauccaaaccaugugaggaucauggugaaaugcagauucuguuacgguaggccuuggguggggccugaaugucugcauuucuaacgaauccccacaugauacagauacugcuguucuggggaccacacuuugaguagcaaggggcuagaguaguguaugccucacuuugucaaaugaagggaugugaauuggccaaaagcaggugaagagaagcauucuggggcaggaagcugggaaggaagugaagaacuuccagaagggaaaaacaaagcuagagucagggcaucuaacacucuaccagaccgugaggugggagaugccuuaaauaucuuugugucccugacaucugagcucagugcuuggcacaugguagacauuuugcaggcauguguugaacugagaggaagaugugguuagccucaggcucagcuuuauuggaggcucccuacacuaacuacaaggggcugacuacuggagagcaagcaagcgccaugcucuguggagucuugaagccauuacuuaguggaguaagggugguaauagagacauuuaauuaucuucccaucuuagauacugaacagauguucccacacucagugaggauguaauaaaaaggaccuaugugggcugcagcagaauggauuuaagucagaccacaagaaggacuuguugcccgaguuuggccugccccacuccagacugucucacgagggcuggguuauuggucucucauucccauccaacccuccucacccaagccccauuaaaaaaaaacaaaaaaacacacccauugccuagagcaguacuugggcugaacuagggaagcugaacgguggugagacagggacaagcuccaacuccaacggucuugauucuccaaacaaagcaccacagcaguggguguaacucugggcugugcgucaggcagccuuuccggccuggcccugucugggguguuuauuuuguuuguuccuggaagcuguugcccugauggacagugcuggggaugcugauuccaugggauuuguuaggggagggccagcccucucaccccuuccccgggacagaugggccccaucagcccugcugaguucccgaagaggcaagcaucagcccuccuuguguuuguuugaguuggugucaccaguggugauccagucugugggugagggccggcugugggaaugcaggggggugguggggggggacacagagcccagggcagucuagcuuuuccccuccccacaccagcugcccucccuucuccucacccacuucuaggcccauuuuggggccguucccaaaccacaggcucauucauagcucaaaccaagucuuuucugucugcaguaacaauugcucuccauggccccaccuguucaaaacaggggagggagggcagcccuuugaugcguucuggacaggagaauaaaaaguucccagcaaaucaaggaaggugcuaugggguuaaagggagagaaagagaaugacaaguggagcugggcuguugagcuggaggaagugggugaaugggucagaucucauuugguggccucuuggggaagaagggugauauacuccuguuuucucucugaaauauucuuccugaggcuuguggugggauccaggguuaaaacugagugaagagaaaauauugccuugagaaacaauaaugacucuggcaacccaccuauucuuuaguagcccaucucaauugaccuucuuuuaauuguucauauuggacagacuggagacugcaguguggggagagucauccucuuacuuaucuuggccuuuggcuucccacugcagacagcccuugcagguccauccagguuggggaagaugguuuuaaaagguucauuaguuaagaaaggcccuggggccuggaaauaaaggguuugaggaggagaguagaggguggggucuuccuccccggaccucacgauugggaaugaggauuuuuuuuagcuacacgggucugacuagagcuguaaacguuacucagauugcucacuaugucucuucccacgagccccucccugucaccaccccccugcugucaaaccauaucuucguggaccagccaugcgggacaucccucuuaaugggagcauaagaguguugucucagacccuuauuuuguuaguuuauguuuccaugaagcucuuaauguuuauuaaauaaacagacaaugaguuugugugacaugcccacagcuucuguguaugugacacaugccuagccuguguucugggaguguaugucacuuuggccuuuggcuggggaacuggugauggugggaggccacucaauuacucucucugcaacuguauaacuauuaauacuucuucagaacugugggaaaugguucuacucaucagcuuuauggaauguggguuagggagaggggacagaaucucuucaaggucuggaugcuaaacguaccccuuccuuauucccucccaaugcagaaaaaggucugggauguucugacagggccaucucugccuugcagguacauuggggcacugggggcacgagugaucugugacaauaucccugguuuggugagccggcagcggcagcugugccagcguuacccagacaucaugcguucagugggcgagggugcccgagaauggauccgagagugucagcaccaauuccgccaccaccgcuggaacuguaccacccuggaccgggaccacaccgucuuuggccgugucaugcucagaaguaagagccucuuccauccugugucagcuccuucccuuucugugcuggggguggugagugggaagaguaggcaagaucuccccucuccucucccacacacuguuucaucaucagagaaagaacugugggcagagcccaggauauaauugggaacagacucuuagcaucuuagauuuguagacaggggcuccucuaaaucuuagugcucugggacaagaccaagguaaagcauucccuagaaccuccaucuuucucccucauuuuccuuguccuccccaauccccagcuugggaggcuaccauguacuguaaggcugaggucuaugauaggcccucuguucuuaacaccaccaucacuaucgucaccccaacacucccaacacuacaguaaugggaacaaaagauaaacagaaaggugauauguaaauauuuggagagucaguggcuuggccucagcucagcaaaaaagcuaaauagagcuagacaguaaacuaggagaaagggaacaagaugggaaucuggaggugucaggcauacaggggcgauaauucaucagucuccaagagcagggagggagagcaagcaggcaagggaggguagcauggaucucuaaacaggcugaccccugggcuggggucuccauugugggggaacuguccagcagagugggccugaaaaggccuggaauguggacuaaggcaggcuuagcugagccagugcuggcacucagugggaggggaugauucaccaggagacuuuucaauggauggacacagggaauuuggcaggaaacaagaguauaggucagcucaaaaggucagauauacaaagaaguggauagagaguagugagggcugaggggaagaggucagauacucuggggaaugcucuuggaaaugaaaggcaccuugaauaaaggggguguaggggugacucugggaaagaaaauuagggaagagguuucagagucagagguuguaugggcugaagaaggggacagacaugggccucuuuccugaagcacaccucuacaauucucucucuagguagccgagaggcagcuuuuguauaugccaucucaucagcagggguaguccacgcuauuacucgcgccuguagccagggugaacugagugugugcagcugugaccccuacacccguggccgacaccaugaccagcguggggacuuugacugggguggcugcagugacaacauccacuacgguguccguuuugccaaggccuucguggaugccaaggagaagaggcuuaaggaugcccgggcccucaugaacuuacauaauaaccgcuguggucgcacggucaguacucaugucuguguaaguacacucauauuugcugggggugaccagugugugugaccauggacuaaauaaaugugaagauggaagagcugaaggcuucugggucacuuccaaaagccccaacauccugggacaggagaacuaaaugcaagggagcuuaggaaugccuagggucaaucaggugcgugaagagucuucacauagguggaaaguaggaaaagguggagaaaagaaguaacuuuuuaagaaggaaaagaacugccuucauaaagacugagaggauaagagguuguucuagucaguucccugguauuugaacaucuucuaugugccuaguacuaugcuggaaaauggcacaccacuaaaguagaaggcaugguaccuggcacucuaaaacgugaaaaguagaggaugugcaagcacacugucaucgugaacagaauccuguggcucuacaguucagugggcugucaugaaaaggaaagcacuguugguucaggcagauuuccuggaaaaagaguuucuugaacuugaucaggaagaaugggugggaucugaugugggagagaaccgagagcucaaucggccagccagggccagguccagccuaucucagagcacucauccuuuuggaccuagggaugacuaaaauguguccugaccagcuacuucucccuuaacugccuucccccucccccaggcugugcggcgguuucugaagcuggaguguaagugccauggcgugagugguuccuguacucugcgcaccugcuggcgugcacucucagauuuccgccgcacaggugauuaccugcggcgacgcuaugauggggcugugcaggugauggccacccaagauggugccaacuucaccgcagcccgccaaggcuaucgccgugccacccggacugaucuugucuacuuugacaacucuccagauuacugugucuuggacaaggcugcaggugaguaaggaaggcaggcagggacaugcagucccaguucuuagugcaggcaccccugguuaaucauggucuguucagucucaggaguuagggaagggggugcugugggaggaggcaguuuccucuccacaugaacaccuggucaugagauuguugcaguccaccaggcccagugcugcccaaguagagaggaggucacucagcuccuugaggccugaggucaugcaucgcuccuuuguaucccagcaucugggauacaguaggcauuauucaggguauguuuaacuuaguuaccuguuuucaguuuuaagcaaugugugggcugcacagaaacauaagaugcagcccuaagccuuuggcucuucgcaaucuacuuaaagaaaugagacauaauggguagacaaaugcaaagagagauggagaaaucaauaaaguuuauuugaaaauguagggaaaaaaaagaaacuagaauuuaagcugcuccuugaaguguagggaguaucuggauagcuugagagacgagugggcaauuucuuaucagagaguaguaggugggaaagcacaugaucugucccagggacagagaacagaccaaucugcuggguaaagguucucucuaagggagauuaaagcuagaaagauguccuugaaaggcuuuauccagugugcugccauugaagauucugaaacagcugaaaaagaaacgaagaagagaucccuaccaaaggcagguaaagcagcaaaugguuguuuuucagucuguucgagguauuuguggugggauucuuggaggugcuggaaguugauaugguuuuuccccaagggaaugaaaguuaccauccuggcucacauuucugguucagauagguuaaacuaggaacaugcaaugcagcagaacucuucuccucugguuauugcuguggggcucccaggcucuuuucuacaggcucagcgucaggacuugggugaaguggagccaaaaaaccucagcuaucuucgguacuguuuguuuucacccaucacugucauuccuggaagagucaaguggcuuggaguaaaacugggcacagaaaaaggguggggcucuacccaauuaaugaagaaaguagucuguauacuuuguagggugcuagaagaaaaaaacuuggagcccuucugauuuuccuagugauuuccugccacuaaguauacuuuccucccacuuggucuaauucagagggucacucucuggauaccuagaaauaauuccauaacaucugagguguaaaccuauacuaccauacugaaaauacaccuuuagggaaggaacuuuggaguuaggagggaggauaagucaaauguguguucguuuuucucagaggcauaaaauuaggccuccuaaaacccaaagugggcccuggaauucaaagaauauaagucaucccagaaagaauauggagccaggaauucccuccaaagcaauagaguccaauugaacuuucugugaugauagaaauguuuuccuaucucuguuguccaauacaguagcaacuagccacaugugauuacugaguacuuggaauauaacuagugugacugaggagcuaaauuuuuuaguuuaauuuucauuaauuuagauguaaaagaccauaugugacuaguggcugcuacccuggacagcacagcuccacaguguagaagggguuuuuggugcccaagaggacuuaagacccagcccuuggaguuaggagacuaacauauacaguagaccuagucaguccacauuccagaccaguggucuccuaacauucuggauccuuuacuccuaucauuaaaacaauuugagcauauaucuccauuauauguauauuuauuuauaccuguguuccacuauaugaauauguauauuauaaaacguaaauauuuuaaauugaugagauaaaaaacauagaaguucuagcauuuuccucccguaucccagugacauuuggagacuaauucuguagaaaucaguuaaucuauucuccguuuugaaccuaggcuagucaguuucccaucucuggauucuuauuaaccauggaaaagcuuggaguagaugcucucaugggcccaacucauccaaaagucuauugauuuuaugaucuguuggcaggaucucuuuugcuaaaaucagucagaaugagguucuaagcauucccuaugcauggggaaaacaugaucccuauccuagaguuuccacuguaaggggaagggauaaugcuuagggauaauagcaauaauaauaaugcaagggauauuacuuaggaauuccuuaggaauaugccuccagccagucaugguaaucaguucaccucuucagaugaacagagauuauaucuaacaaucuauuauugugcuuauuuucauaugagaaacuaaguuaauguuucauuuugacuaaaucacacaacuaagagugguagaacugggauuugaauccagacaagaugaugucagagcccaugcuucuuuuuuuuuuuuuuuuuuuuggagacagaguuucacugucacccaggcuagagugcaguggugcaaucuuggcucacugcagccucgaccucccagccucguguuacuuucaccucagccuccugaguaucuaggacuacaggcucaugcccauggcaccuggcuaauuuuuuaaguuuuuguagagacagggcuugcuauguuucccaggcuggucuugaauuccuggacucaaggauuccuucugccuuggccuuccaaaaugcugggaugauaggcaugagugagccacugugcccagcccaaaaaagcgauucuuuuuaucuuccuucugagaaugugguuaaggguauccagggcagcugaagagauaacuuuguucucacucccucucuuccccaacccagguucccuaggcacugcaggccgugucugcagcaagacaucaaaaggaacagacgguugugaaaucaugugcuguggccgaggguacgacacaacucgagucacccguguuacccagugugagugcaaauuccacuggugcugugcuguacggugcaaggaaugcagaaauacuguggacguccauacuugcaaagcccccaagaaggcagaguggcuggaccaaaccugaacacacagauaccucacucaucccuccaauucaagccucucaacucaaaagcacaagauccuugcaugcacaccuuccuccacccuccacccugggcugcuaccgcuucuauuuaaggauguagagaguaauccauagggaccaugguguccuggcugguuccuuagcccugggaaggaguugucaggggauauaagaaacugagcaagcucccugauuucccgcucuggagauuugaagggagaguagaagagauagggggucuuuagagugaaaugaguugcacuaaaguacguaguugaggcuccuuuuuucuuuccuuugcaccagcuucccgauacuucuuggugugcaagaggaaggguaccuguagagagcuucuuuuuguuucuaccuggccaaaguuagaugggacaaagaugaauggcaugucccuucucugaaguccguuugagcagaacuaccugguaccccgaaagaaaaucuuaggcuaccacauucuauuauugagagccugagauguuagccauaguggacaagguuccauucacaugcucauauguuuauaaacuguguuuuguagaagaaaaagaaucauaacaauacaaacacacauucauucucucuuuuucucucuaccauucucaaccuguauuggacagcacugccucuuuugcuuacuugcugccuguucaaacugagguggaaugcagugguucccaugcuuaacaaaucauuaaaacacccuagaacacuccuaggauagauuaauguaguaagucuggcuaggccuuguguugccuuuuuuuuuuuuuuuuuuuucuuuucuuuucuucucuucccaugcacuauucuggagguuugccagguuuggggagacauggaguaaaagaaagauaggcaacucauggauggugggagagcagguaagcaggucugaucucaagggcccacaugaggcaucaguauauauuaggcagguagggaucucuggcuuugguaauucuuuaugagaggauccuagccuuugaagcugggagcaggagucaguggcuacagugggaaggaguacugcagguuggggccaaagugauacacagcuuagaaggcagccuuccuccacuuacucaacaaaucuuuauuuagugacucuccaaguccuagugauuauuauuauuguucacuccacauuuggcuuaauggguaaugcuauuacccauugccuaacuagguuugcaguaguggaaucuccagagauagcaggcuuaguaagcuggagguaggacaugaagucccccaaaacuugauguccuauuuuuaugugaguuggacagugguuaucuuuugccuguugauaucuuaaagcagcagagugguauagaaauuugcgguuaugacagacccggguuaaaaaucacagcugugccauuugcuuugauauuuugagcaagguagcuaaauuuucugagcuucuauuuucucaucuguaaaaugaggauacguaccuguucuuuuuuuucuuucuuuuuauuucuuuuagagauagggucucgcuuuguugcccaggcuggagugcacuggcaugaucauggcucacugcagccucaaauucccaggcucaagcaauccucccaccucagccuccccauuagcugggacuacagggccaugccaucaugcccagcuaauuuaaacauaguuuucagagauggagcucacuauguugcccaggcuggucuugaauucuuggucucaagcaauccucccacugcagccuuccaaagugcugggcguacaagcgcaagccacugugcccagcugucagacgcugaguuuuaauuaugcaccaaacuccagcccgcagauccucuucaccaaagccccuggcuggucuagcccaucaugacuucucuaggaacaguccuucuuuaggacuauaaaguauuaacaaaagucuguagauuaaggagccugcauaaagaauucuggauacaggccccugucuuuccaaaguuccucuccaauaucccuugggguccucauguuuuugaagcagcuucacucugcacaggcagcaggagguugggggagccauagcucugggccacgggggcagauuuauuuggaugauaggacuaauauuuguguaaccugcugagaccugugugggagaguuuagggugguuuuucuuuuggugaggggauuugcucugguuucacauccauuaacacaaaacaugagcuagucagggcccuuguggucugcgguaaggggaugccuguggagaaaugggccugagugagucaggccaagagaaugucuuccuucagaauggagucaacuggauaacugaugagccaauggugggauuaaggagggggaaaugggaggggaagagaacagcugacaucuugaggaaagcuuugggguaguggagagguaagggggucauggucagucugaacucaacaauagggcugaaugaauuuaccaaaggaagcugccuuauauuauaugccaggcugcuggggaaagccucagguccuggccagccccuguucucacaagaacaugcagguuaccacauaaauaauggcauaugccuuccauaggacgucaaccugacuuaaaucuaccuauacccuacucucuauucuuugguuuuugguucucaucccuguggaaggaaaugggccucuucuggcaucucaugcuacucugugcuuuuccuugggcuccaaauucuagcucauaaagaugcaaguuuugcaauuuccuauaaaugguuaagaaaagagcaagcuguccagagagugagaaguuugaaaagagaggugcauaagagagaaaugauguccauuugagccccaccacggagguuauguggucccaaaaggaaugauggccaagcaauuaauuuuuccuccuaguucuuagcuugcuucugcauugauuggcuuuacacaacuggcauuuagucugcauuacacaaauagacacuaauuuauuuggaacaagcagcaaaaugagaacuuuauuuggugcagucagggcucca

SEQ ID NO: 13785 - RNA, 24887 nt, Homo sapiens
uuucuugcauucuucauuccauucuaguguuucucaaacuuuuuggacaguaacacauauuaaaaaguagacuuugcauugugacccaggguacacaccuauauucuuaugcuagaaguaaaguuccucaaaaugcaucuucuaacauucagugcucugcaguguuuuuuauucuguuuuguuucauuuuuaaguuacugaucaagaccuacuaaauugaaauucauuccuacaaaguccuggggauguauuucuguauuacucaaucagcuaacauagucagcacuuaacuauauauaacacuuauuguucuucacuacuuaauuagcuuugugaccuugggaaagucacguguuugauauucaguuuuucuauaaaaugaagauaauagugauguuuacuucaugaggaaugcuguuaggaauagauuagauauguaaaaagcacacuguuucgcaggcaauaaacgcucgaguguuaacgucucuguuguuuuugcugucauuguuaaaaauacuuugauuugaccuuccuaucuguuuuggaaauacuguauguaaaacauauacuacauauaacuuguuuccuuauaacuuuuauuauauauauuuacauuuuacauuguuuaacuggagguauaauuuggauauagugaaaugcacagaucuuaaacauuucaauucaauguguuuuuacagaugcacacauccacauaacccacacuccuaucaagacacagaacauucuuaucacaccaggaucuugugccccuucccagucaaucaucccccuguccccagaggaaaccacucuucugauuuuuuguucaccauaguucgguuuuguuuauuccacaacuucaucuaaacaaagucacacagaacauacucuuuuaugccuggccucuuuuuuuuguucaguaugauguucagguucaucagugucacuguauguaucagcacuuuguuccuuuuuauugcugucuaguauuccauuuuauaaaugcaccacauucuguuuauucuccuguugauugauaucugauuauuucuaguuuggggcuauuacgaauaaagcugcuauagcagcuuuauuguauaaaacucuuguagaaauguguuuucauaucuuuuggauuaauauuuaauacuuacaaguagaauuacagguaggauuugucuaacuuuaugagaaauuuccagaucaguuuccaaaguaacuguacuguuuuauacucucacuagcaaugugugaguguucuacuuacucuacauuccuuccaacauuugauguugucagucugucauauuagccauucuaguggcuguauagugguaucuuuuuauuuuuuuaacuuacaccucccugaucccuaaugacuuaggcacuucuucauaugcuuuucccuauugcaguuuucucuuuaggucugugaugcauuuuuauuuuuguauaugguauaagguaugcaucuucccauuguauuuucagaaauguacggucucccgaaaaaagagauuaggaucuaauguaucauuuaaaauaauacuuucuucaacuggaacaaauguaccacuuuggugaugauacugauaaugggggcggcugugccuguguggggcaggggauauaugagagaucucuguaccugcugcugcauuuugcagugaacccaaaagugcucuaaaaaauaauguuuuuuguuuuuuguuuuguuuuguuuugagacagugucucacucugucacccaggcuggagugcaguggcgcgaucucggcucacugcagccucugccucccagguucaagcaauucuccugccucagccucccaaguggggacuacaggcaugugccgccaugccuggcuaauuuuuauauuuuuaguagaaacagaguuucaccauguuggccagacuggucucaaacuccugacuucaggugaucuucccgccucggccaaaaauaaauuauuuuuaaauuauacuuuaaaauucuuaauuuauauucagagcauucucccuuuaucaguucauuaaucuguucaguacuuguugaauuccuaaacacauuuucuuccccaccucaaaaaguuauucuuguggacucaguccagaauguacauauaauuuguuucaaccaccuaccuacacugaacaaguaagaacaaaaagaaaaaaaaaucucaacacauuugauuucaguuucauuagaacauuucacaggacucuggaauuugaauguugaaacagcuacauuauucuguuacucauauucuuuuuuuuuuucuuuuaagagagucucgcucugucgcccaggcuggagugcaguggagcaaucucagcucacuauaaccuccgccucccauguucaagcaauucuccugccucagccucccaaguagcugggauuacaggcgcccaccaccacacccagcuaauuuuuguauuuuuaguagagacgggguuucgccauguuggccaggcugcucucgaacuucugaccucaggugaucaccugccucggccucucaaagugcugguauuacagacaugagccacugcgcccagccuguuuacucauauucuuaugcuaucagcaagcagccugggggcuagaagugccacacuuauaccuauuuauacuaaacuauuuuuagucuugaauagaauuuaguacacuguagucaaauaauaauaaauggucaucuguccuuauguaaauaauugcuuuuauaaauauuuaugguugcagguugacuccagagggaauauuugaaguucauucuauuucacaguuaguuaaaauauuuuugagacagagucucacucuaucaccgaggcuggagugcaguggugcgaucuuggcucacugcaaccuuucccucccagguucaagugauucucgugccucagccuccugaguaucugggauuacaggcgugugccaccaugcccagcuaauuuuuguauuuuuaguagaaaugggguuucaccauguuggccaggcuggucuugaacuccucaccugaagucaucugcccaccuuggccucccaaagugcugggauuacaggugugagucaccacaccuggcuaauuuuuguauuuucaguagagaugggguugcaccacauuggccaggcuguucuugaacuccugaccucaagugaucugccugccuuggccucccaaagugcugguauuauagcugugagccacugcaccuggccugaaauauuuuuaaaucaugacaauuuucucucuuuacugucauguuuaauuuuuguacuauuuuccaaaaaauaaaguuuaauuuaaaugaggcuaaaucagcucuuuuauuaguaucaaacauuaaaaucuaguucuuguucagcaauuauaaaggaacuuccagaacaaggguuuucuuauuguugucaucuuuauccagaauguuugcuuuauuuccaguugcucagguugcuauaaacuacuuauaguuuaucuauagugugaauuacuugacaguaaauagauucagugugcaugugauaaugauuccuuuuaacaugcuuuugguagcauuaaccaaauacuuggaaucauauuguuguucuggucccuggcaugaaguauucagauuucuuugaagaccuaugauguucacauugcugauuacuuuuuaaaauaucacuucagaauugucucuuuaguggcaaaaauacauccuaauccaguuaugguaccagccugagucuugaaaauaaaaccuuauaguugaauauaaacuuccaauuaaaugagccuuaauucuucaccauuggauuuugaacgauuuuucauguuggugccaaagaauaaaaagaaauugauuuccuacuuuaagauuggaauauacacacacacuguacugggaaguggagaggaggugacuacuucauauuuccuuuugaaguuaggaauaacacagcugaaacuuuuggagagcaaguauggccgacucuaagaagauuaugugauuugauuuuaagcuuucaguagugguguguuucauucagccugugauaguaaaaauaaaugaguaauagaugacuagugugcucuggcugcugugauaauacccucuguuauugaaucugucuaaccagccaguuauuuuucugcugucugaaauuaaagaccaucauguuuucugacaauguaggaauuucuguucaguuaauguguguguuguuauugaauuaaaaauaauaaaauugaauuuacuuuauuuuuauuacuaaacccccuccaaacucuaauaucauuuaaaauuucuuauaaaauaacugaaauaucauuaauauauuacaacucagcuuugauaguuuugaauauagguguuuggucuuuaaauuuugacccgagauauaaaugauagugguagcacaucuagucauugaccuuguagccagccuccaagauggcucccagugaucucuaccccaugauauucacacccuuggguagucugcccccaaauuuaccagaguuggucugugugacugauagaauacaucagaaaugauggugugucacuuccaagauuagguuauaaaagacauugggacuuccaucuuggucucugucucuuuuauggggcugagggucacuugcugugugggaagcuggcacuuguaaggagccaaggccuacgccaacagucaugugaguaaguaagcauggaaguggguccaucagucccagucauggcuucagaugacuacagcccugaccaacaguuugauugcaaccucaugagacccugagccagaaccacccagcuaagccccucccagauuccugacccuccaaaacugugagauuuuuuuuuaauguuuauuauuuaggcugccuacuuugggggugauugguaugcaggaauagaucaucauuacacacccccauuaaaucucuucauucuucaaaucuuaauaucuguuuugggguuuuuuuauuauuuauacuguuaaaccuguaauccauauaguucaccugacugaaucauuaaguugauugaaaaauaccauguucugucucccauguuccaguccaguguuugauauaauaaauauagacuuugaauucaccuuuccuauauuugaccccauauuagaauguacuuaagagaaucgcucucugacaaggagucuucuugagguuauuccacagauccuuuuccuuuacaggcaaagccgucuguauuauacaacuuguaauuacuaugcaagugauuauggaauuacuaugaaguacuacaggagaaagcagacagccaaacaacuguucucaggcugagaccucaccaaagaagcucuuugucuauuacucauaacucuguggugcuuauuaauuauacaggguaaucacaguguggguuuuaaaagucauauuuuggggauuaguuaacuauauacuacucaaaccagagagacagcuucucagcagaucugaugucaaggucaugaauuguagucccagcuccuacuccuccaucccacuuucuccauggugcucugaaaaggaaaagguuauuaaaaguauuuggguuuacuuuuucuauuuccuuuuugcccuaacuaaaccaacagugccaauaguuauuccuuuaccaucacuaaccauacugaaauggcuaucaugaauaagaaaugugacaguuagaaaaguaguauuucagcugcauaaagagauuauuuuuucuuuugcuucuuuuucuaaacuuuucuauuuuucuaaacauggccuaaaaaaguggaaaaaaaaaaaaaaacaacauagcugggugaggugguaugugccuuuagucccagcuacucaagaggcugagguggaaggaucacuugagcccaggaggucaaggcugcagugagcugugaucacaccauuacacugcagccugguugacagagccagacccugucucaaacaaaaaagaaaaaagaaaaaaaaaauuugauacuuucagugaguuacagguaaucaauuucagguuuuuauagcugaauuuaaagaaacaugguaaaagggaaacauugaugagucccauguuguuuggcacuguugcuuuuaaaauacaacuagcuuuuugguuuuacuuucaguauguuuuauuuauuuauguauuuuuagaaacagguucuucuucuguuaaccaggcuggaauguagugguauaaucagagcucauagcagccuagauccuaggcucaaccaauccuccugcuucagccucccaaguagcuggggcuacaggcacaugccgucaugcccagcuaauuuuuuguuuuuuguagagacaaggucucccuauuuugcccaguuuggucuuaaacuccugggcucaagugauucuccugccucugccucccaaagugcugggauuacagacaugagaugcugcggccggcuauucaccauguuuuaaaauaagaagaagaauggcugguucuggagcugaucuuuucuuucuccauccuaaauggacuggagguuauuuugaaauuuuacugugaauuuccuuuuuaacuuggagcugaaaaaaguaggguuucagccaggcgcaguggcucacgccuguaaucccagcacuuugggaggccaaggcggguggaucacgaggucgggagaucgagaccauccuggcuaacauggugaaaccccgucucuauuaaaaaauacaaaaauuagccgggcgugguggugggcaccuguagucccagcuacuugggaggcugaggcaggagaauggcgugaacccaagagguggagcuugcagugagccaagauugugccacugcucuccagccugggcgacagagcgagacuccaucuaaaaaaaaaaaaaaaaaaaaaaaaaguagaguuucaucuuagacucuguguuuuauaccucccccacuuuuaauucacacacacacacacaacacaccauaaggcuagaaagauaguuauuaguaacuuaaagaaauggauuucucucuucauauuuccaguauacaaauaacauccaaauacuccaguaaugucauaaaguaagauggcugcagucaagccagaaguaaaacccagaauuucuaacugcuuugaacauuugccagcugauaagaacguaaaauuuuaccauaaggcuaagugauuccuggggccuaaauuggacagucaaugaagaagaagucuucagauuuucagcacugaaauacuucuguguuaaaaaaaaaacccauguuugcuuuauuuucuuaaaguuuccuuuaaauuaaagcauagccaaugaauugcaaauuucccuuuuuuuuaaacaggcuccuauuuguggauggcagugcuaagaaaacaugacuacugauuaguuuuuuaaaauggauaaauaauaguaguuuucauaaccagauuuaauuugaaagcuuaaauuauauaguacuuugcugugacuuuuuaguuucuucaacccuguguuaacacuucauuuuucauuguaaaauaucucaagaaacuuuuaaauaucuguguaauaaguaaaaaguaauguacauguaauguaugaugcucauguggaguucuucaagcucuuccuacagagauaaggaaagagggaagccuaggaauaucuuuccacccacuuccugauccuuauacucccaacuggguacccagggcuaacguccuugaccagacuccaggcaccagcuugcaucccuuucuuacaugcucauccccaaggcucaucaagccuugaaagagacagaaaagagaauggaaaguaacaaccagagacaagaagaggggguggaauuuggcagcagguggaagagguuuugucugcaugucugguuaugaggugccuccauccuccuugacccaucaacaacugaguaaugguucauauguacaggucacaaguaguccuagauuguaaugugauccugcuuauauuuugcacacuuuauauaucugcuggcauuuuguuaggucucuaaauauauaaacucauaaaauuaucauacuuaacauguuuuagaaaugcuaguaccauaacacggaaaaaaauaagauguaccugcugguaauauaagcauucauaagcagauauaagcagagucaguaagcacagagguuaaggacacagacuucggggccagguugccuggguuuaaaucccaauucagacagcuugcuagaugaguaaccaggaauaguuuucucaucagcaaaaucgagaugauagcacuaccuuacaggguuguaaauuuuaaacaaguuaaucugacuauaaauauuuaaaacaaugucuaauacauagugcuuuauaaguauuuguucuuguuaauauaccaugccaccuuucuaaugcuguuucuuuagauggcucaaucugacuuguaauuaguagguuacauuuauacuaauaccacaaccuuuaauguauaaccacuggauagcaaaucccccuuccucaguaguuuuaaaaagcaagaugcuuauuuuuuuuccucuuucccaggcccaacacagagauacuuucauugaagaacgcuauggaaaauauaacaucagugauccuuuaauggcucuacagagagauuuugaaacacugaaggagaaaaaugauggcgaaaagcagccagucugcacaaauccacucucuauucuuaagguugugaugaagcagugcaagaacaugcaggagcgcaugcugucccagcuggcugcugcugagagcaggcaccgaaagguagguucaccucaguugauguguaaaucuuugugaagucuuuauaaauuaugccugauacuuucuugucagcugccaguuuuucacaguaauucaauugggacaucucacggguaucaaaaagccccuuaguuuauguaagagccaggagauaaaaaagaaaacacagcuuauugcaaauguuaaguuuagagaacgugccagacacguuauuuaagacagcauuucuucuugauaugucacuccaaaacacuuuguauguuuuuucaguucuugaucauucaaacuuugggguuuggccaagcuuguagcugacgggaguguucucuauuugcuuacuuaagagauaaauaaaaagauuaacagguauuugaggcaugcuauauccaagggagagaaagaauuuaccugaggauaaacacagaagccaauagauuauuuucauuuauuccuauuauuccuaguuuugaguuucauugcauuuuguugcucaugaaaccauaaacagucccuugguuuauuuaccuuaaagguguucuacucuauuagugagggguguguguguguguguguguguguguuuuccauauuuaacaagcccuaaaauaggaaggcaaaccuuaugguuauuuacaguauuuacuuuaaagcuguucuacccuauuaguaaagaguguguguguguguuuccauuucuaacaagcccuaagaaggcaaaccugugcuuuccucugcuucaucuuacuggaauucuagugcuugugaauuuauucaccaacuugucaucuugucauuuacuccucaaauuuggccuguaaaagaugcuuggcuacaaucuucauuuuuaaaacacugucaguuuagauuuaugccaacaaggcaguuaucagugcauuugguaggaaacauuuucaucugaaaaauaggguuagcagcugcaaaauuugguggaccuuacuuuuaugguuaucagcauuagagccaucuucuuaaauugcaucugauacauuuucuaggcucuggaucuugcccgugaucuuuucuuucccuucacagaagccaaaugaaaggccagaguggaacuucuuaaccauggauaggccucagauguuccacagucccccagaaaauagacagaauguucagaguuuaugcauuuuuguaggaaauguauuuuuuccauagcuuuaaucagauucuccaaguuacccaagacccaaaaauguuuaaccucugguuagaaugaaguaaucugaaaacauuuacacuccaauuuaaaagguaucagugggugggaguuaguugccuaaauuggguggagggggagcuuuuacauaauucucuaaaaaucuucacaacauucuuguuuaauaggcaggcuuuauuuccacuucauccaugaggugacugaguuguguugaagcuaguugggcuagcuuucaugcccauggaagguguacuagggacaguuuguguuucuaggugauuggagagaggaagaaguuaaaaauaauucaaaauuucuuaauacuauauugcagugcuaaauguuuuaagugaauauuaaauuuuugaaacaaaguaccuaucuauucuuuuuuuuuuuuuuuuugaggugaagucucacucugucacccaggcuggagugcagugguacaaucuuggcucacugcaaccaccaccucccagguucaaguuuaagugguuuaucaaaguagaagacugacuuuguuagaaaucaaacaguaccuagaggcuuauaauuagggugcucauagucucagcuuaugccugucaccuuggcuuaguuauuaaccauauucccuuugacugucagaaauguucugguuugaauaauaaauuacauggucauugugcuuacaaugaaaaacaguuuucuauuccaccucuucucauuccccauccuccccaguauucacaggcaaccaguuuuuucuuuuagccauucacuuugguagcuaaccuccauauuucuaaauacugcacuguucucucuugcuuuaucaauuuuagacauuuauauuacuuucuuuuauauaggugcagauuuaguuaucuuacaccccgccucccuuuccucuccuuaacccuuacccagaacaaauuuaauccucuuuucccaccaccauucucugucacaucuacuauucccaaauccugagccugucacacuauuucuugaaugugacaggcucaggauuugggaauaguagaugugacagaggccagaugcugauggucugugugcaggaaucagggugaagggacaaauaauucugaaaauacaggcuuugaaggccagacacagugacucaugccuguaaucccagcacuuugggaggccaagacaggcagaucacuugaggucaggaguucgaggccaggccagccaacauggugaaaccccaucucugcuaaaaauacaaaaauuagccaggcaugguggcguuccuguaaucccagcuacucgggaggcugaggcagaagaauagcuugagcccaggagguggagguugcagugagcugagaucacaccacuguaauccagcuugggugacagagcaagacugucucaaaaaaaaaaaaaaaaacacaaaacaaacaaacaaaaaaacaggcuuugagccaguucuccuguuuucuauucuacauuucaccucuccucugcaguaccugccaccuccagguuccaucucuuuggggcucugcaaggcaaaacagcuucccuccuucaaaguaaaguaguuaccacaacuccagccucuuuucuucuucaaaauauuauuaaaauuuuuucucugcuagaggcucucuccuuugugggguuuuagucuuuuuauuccauuucuguaauuuuugaggacucccaaaagggagaagauaagacuuaccacuuuuggccaaaagcaugucuuucuauuaaauugaaaaauuagauuaaaaaaaggaaaugugccaaauuuuuuuucuuucauuuauuuugagagacagggucucgcuguguugccugggcgggaguacaguggcuauuaacaggugcgaucauagcacccuauagccuggaacucuugggcuccagugauccaccucagccucccuaguaucugggacuacaagcauacaccacagcaccagucucuucuuuuuuuuuuuuuuuuuuuuuuuuuuuagacagaguuucacucuuguugcucaggcuggagugcaauggcacaaucuuggcucaccacaaccucugccuacuggguucaagcgauucuccugccucagccucccgaguagcugggauuacaggcaugugccaccaugccuggcuaauuuuguauuuuuaguagagacaggguuucuccauguuggucaggcuggucucgaacucccaaccucaggugauccaccugcuuuggccucccaaagugcugagauuacaggcaugagccaccacuccuggccucuuuuuuuuuuuuugagacaaagucucacuccguugccugggcuggagugcaacggcauaaucauggcucacugcaaccucgaccucccugggcugaggugauccuuccaccucagccuccugaguagcugggacuacaugcacaccucaccaugccuggcuaauuuuuguacuuuuuuguagaaaugggguuuuggguugggcacagugggucacaccuguaaucccaucacuuugggaagcugaggcagaaggaccacuugaguccagguguuugagaccagccugggcaacauggcgacaccccauuucuacaaaaaaucagcaggccauagugguguaugccuguagucucagcugcucaggaggcugaggugggaggaucacuugagccuaggaggcaaagauugcagugagccgagaugaugccacugcauuucagcuugggugagaguaagacccugucuccucaaaaggaaggaagggggugggggagggagagggagagggagaaauaaauggcuggucucaaacuccugugcucaagcaauccuccugccucugccucccaaaagugcugggauuacaggcaugagcucauuuuuauuuuuauagacagguuucaugucccagaaaauuuacucucuucacucauaaaaauuuuuagugagaagacuaagaaauggccuuugggacaagagugcucuacccuggaggucugggccaaggcacuucugaagcaugagcagaagcuacuaagcaaucagaauauuugcaguuguagaugggauuaugugaaaaaugucucuuuaaauuuguauucuuggccaugugugauggcucacaccuguaaucccagcauuuugggaggcugaggcggguggaucacuugagcccaggaguuccagaccagccugggcaagauggcaaaaccccaucucuacaaaaaauacuaaaaucagcugggcgugguggcgcacaccuguagucccagcuacuugggaggcugagaggugggagaaucucuugagcucgggaggccaaggcagcagugagccaugauugcacuacuacaguccagccugggugacaaagcaagacccugucucgaaaaauaaauauauuugucuucuccuuaaaauugggcuuaauccuuuggcaccaggguaagugaaauagggguaggcaaguuaaauaaaagggcguaugaaaaaucuccauuuaaggucucuauauuugagccuuuuuacaugcaguaggaagucaagagagucuauccaccucuuaucuaacuauauaaaaauguauauuauuaguuaaacaaggcacacuuagaaugucaccuauuugaaauguugaauuucaggcuccuucuuuggugccucuggugauuugagaauugagaagaaaaucucagcuuucagguuucugugguccugucuugcuccaucaccuacaccuggccccuaguaacaccaaacugccugcaguuucuuggaauuucuguuaauucucgacaccuccucaaccccucuagcuaauuaguugcucucuucucucuguuugcauaucauucucuacauacuucaaguaaaguaaguaucuuacuguuuaacacagagcuuucaugucuuucacuguaaggcagugugcuccuugauagcccuugcuggguuucauuuauucguuuguuuguuugaucucuggaacuaucuaaggugccugauuuggcacuuauuauugguuguauuaauaaaugugacuccuugauauuugaaaaugaaauuuaaaaaauucuuuaaaggugauccuagaccuugaggaagaaaggcagcggcaugcacaggauacggcugaaggagaugaugucaccuacaugcuagagaaggaaagagagaggcugacucaacagguaauuaagguagagggauucacaguagcauuugccuggaacagcauuucccaaagauuauucugcaggaugccaacugguauuguucagaaaaggggcuuuguggucaaauaaguuuaggaacuacuggauuaagcaaaguuaaacagguuucuaacuuuguuaggaucuuuaguaugcagaagcacauugugagucuucaagaacaagauaggguauucuguguuuagcaaauccaugguuuuauaaaaucuuuuauuggcauagaucccucacugugggauuauuauuguuccguagaacacucuuuggggaaugguaacuuagcgcuuguagcucucaaacuuuugacuuagaacccccaguaagaagugacauuuuaugucacaacccaguauauguagacauacacaguuacgccugaaacaaaaaucucaugaaaucauauauaaccccuacugcuacaguacacauugauguuuucuguuuauauauuuuuuuaaaauucuagucguggcucaguuaguuuccccauccauuaauggaucucagaguuugaaaaacacugaguuucuucaacccuuucccucucacgcagagucucugccucaaauaggguugggaagacaauuaaaacaggcuauauuuguguaaaaaauaugauucaggcugggcacagugguucacgccuguaaucccagcacuuuuggaggccgagguggguggaucaccuaaggucaggaguuugagaccagccugaccaacauggaaaaacccugucucuacuaaaaauacaaaauuaggcgggugugguggcgcaugacugaucccagcuacccgggaggcugaggcaggagaaucgcuugaacccagaaggcggagguugcagugagccaauauugcaccauugcacuccagccugggagacaagagugaaacucagucuccaaaaaaaaguaugauucaaaugcaacuauuuguguguguuuguuucugagacccaagaaaauuauugcugaaacuuuaaaauguuuguuuucagcaacauucaucacaaaaugugguugauacagcuuucuguuaucuuguuuugauugguucugaugcucuccacauacgugaaacacaaagauacgucauauucccacuaaucacugcaagacaguaugggaacuagaagugccucccaaaucaucaaagaaagauuaaaucauagugugugcauuuuuuguguuagguguucuaaaauuucagaaauacuugaucuaagcacugugaugugcauguuaauccuguauaccagagaacagcuaacgaagacagucuacuugaucacaguuugucaguaugucucucuuuucuuuuuuuuucuaguuggaauuugaaaaaucccaagugaaaaaguuugaaaaagaacagaagaagcucucuagucagcuggaagaggagcgcucccgccacaagcagcucucauccaugcuagugcuugagugcaagaaagccaccaacaaggcagccgaggaaggacagaaggcaggagagcugagccugaaauuggagaaggagaagagccgggugaguaaacuggaagaagaguuggcagcugagagaaagagaggcuugcagacugaggcccagguagagaagcaguuaucagaguuugacaucgaaagggaacaacugagagcaaaacugaaccgagaagagaaccggaccaaaacccugaaagaagaaauggaaaguuuaaagaagauagugaaggaccuagaggcuucccaccagcacaguagcccuaaugagcaauugaagaaaccaguaaccguguccaaaggcacagcaacugagccucucaugcuaaugucuguguuuugccaaacagagaguuuuccagcagaaagaacccaugggagcaacauagccaagaugacaaacacugggcugccugguccugccacuccugcuuacucauaugcaaaaaccaauggccauugugacccagagauacaaacuaccagggagcugacugcaggcaacaauguagaaaaccaggugccuccacgggaaaaaucuguggcauuggcccaagagaaaccaguggagaaugguggguguccuguggggauugagacuccagucccaaugcccaguccccucucuuccagugggagcucacugucucccagcagcacugccuccuccucucuaacauccucuccuugcucuucgccgguacucacuaagcguuuauuggggucaucagcuagcagcccuggcuaccagucaucguaccaaguagggaucaaccaacgguuccaugcagcucgccacaaauuucagucccaagcagaucaggaccaacaagccaguggccuacagagcccuccauccagggauuuaucccccacccucauagacaacucugccgccaagcagcuggcccgaaacacagucacucaggugcucuccagauucacuagccaacaagggccaaucaagccagucucucccaacagcucucccuuuggcacagacuaucgaaaucuagccaacacugccaauccaagaggugacacaagccauucaccuacuccagggaaaguguccaguccccugagcccccugucuccaggaaucaaguccccaaccauccccagagcugagagaggaaacccuccacccaucccacccaagaaaccuggccucaccccuucuccaucugcuaccacuccauugaccaaaacucauucccaggcagccucuuugaccacugcagaagaccuugccagcagcugcucuuccaauacuguuguagcaaaugguaaggauguugaguuacuuuugccuaccagcagcuagucccuaggagggagucuccacguuugacauuccaucagauuucguccaaaagcucagucagacuucugagucagauuauguuauuuauuuugauaguagcugaaaccaucuguauaauacauuuaguauauuucaccauuuuguauuuuuuuaaguagaaacugaguaguuuggauuuuuauggcucacaucuuuuuacugaagccagaaaggcaccucaaagaugucucaagcucagcagucaccgucauguugugaugaagaaagcgaaucaccagguggugauuugcuaucuauuugagaacuagaaucacucaacacucauuuugaauuaugcagaagugguucaugcagauuuuuauuccagaugaacauguuuuaaaagugccugaaauaugacugccauaugaaugugauucugcagcaaaaaacacaaaauagaucauuuaauuacagaaaaugagauccucugugaauucugaauguuaaaaaccaacacugcuuuuaauccucuuuuaauguuuuaauacaagcuuuguguucugaaacaaggcugcauaaguagaaugggaauccuucuaaaggugggugugaacucaccacaagcugagcuuuauagagcccuugagaaacccuccugagcacuaagcaguuggggugcugauuuucuuguacuuuugaaaaauuaagucacucccaguuuccugcauaaguucuugaacagaaugaaaucacaucuccauucaaaaaaugucucaagcaucuacuguuguguaaggaacuucugauucugauugcuguuacuugaauaggaaaugguuacucauucuguauaaaaguuuugcaagagaaugaauuuuuuauucuguaaucaaaaagcaauaacuugaaauucacucuguaauauuauaggucagucagaauuauacaaguuuuaccaaauuguuacacuuauucuccaagcugccagaaccugguaucuguaucuguaaaaccaaauuaacuuuugcuuaaaugggaaguauacauauaucuguauagauacauuaccccuuuacauguuuaacauacacacacuuaaacacauaaauacuagugugauuauaucuuuggaguuugcaauauagcauaaaggacaaguagaacugcacauuaagauuaccuaccgaagcaacuagauguggcugggacacaaucaaaggaggaauuuuguccacaggaaggugaggaaauuccaaaugaagccuagaucuucaguaucauaaaaaggcagagcuggccaggcacaguggcucaugccuguaaucuuaucacuuugggaggcugagaugggaggaucucuugagaccagguguucaagaccagccucaucaacauagugagaccccaucucuauuaaaaaaauaaauaggcagagcuaaacuaaccccagugucacaaaacucaacuggucauauaaaugagugaaacaggccucucacacaagcgauguaaaacagcugggagcagugggagcuguggcaaacuaaagugcccaagccgcauuuaaaaagggcaucuguucagcuccaucugcuugcugcggugcaagaaugcuaaaccaggauuaccaguucuucacauuuuuugaaauccaaauuuucaugagaaacauucucauuuuuaaauaucaagaagugauuuuaaaauguuuaaauggugcugguuaaacaaacacgucugcagcuggauuuagcuugcaagcugccaaguugcaaccucuuucauucuagaaacuucugucauuuucaucauagcaagucuaugcggacaaaagccuccaaacuuuccaacuguguaggccaguacagcuggcaagguucauagaauauaauggcuaucccccucugccaaauaagacuauccacaacccagcucagacacagugguuauaugauuuuguguccauacaggagaggccuuggugucuucacauacauucucugagccaacaucuauccagcagcccugaccuccugcuauaauuuaagucuauuuccuuuuaaucuaauaagaguugauaguaaaaaggcaggugauggaaaucaguguauaaaucacaauggaguauauuggcaacuccacagcuuauaguuugauaaaggcaaauacaugaaaaauaaaaaugcuacuaaugccccaaggugucuaucaaaaugauguaggggguaucuuaaacuguccaaggcaaucaugcauugaacuuuauuccuaugcagagccaaaacgaauaguguugauaaaauagcuaaacuuucuaaacuggagaggaggcuacagugccagagaguuauugucucuuuugcuuuaaaugguaaucuuaaaaguugcauugugcucuuccuuuguuuugggauagauauauauagagagagauacuauaaggaaguuuauuucuuaggaagugcacugaauaauguauuucuuuuacaguguaauauggggguggggauaugcgaaagaaauguguauuuuugcuaguugccuaccuucugagauaaauaagcacaaucuugcaauggauccaauaacccaguuagguauuauagauuaguauuuaaguuugcuguagauugugugugugugugcuaaguaaaaguuccaugauucacaauuuuaguauuaacccauguugcaaaagcuguuacuggccaacagauuguaaugauguguaccauauaacacaagcauuaacuaggcauuaacguuuguaaagccaaauauaccaugcagaagucuucauuuuuauagcagacugcauuaaaacaaguuaaaucuugcuguuuggggggaaauagucuuguuuguacaaagugaaaaauggcacaauuugggcauauuuuguugggaagagggggugguguagagggagcacuugacuguggcuuugacaaaacaaaugaagucaaugacccauccagguuagacuccauaaggaacuaagacauugauuuucuuuagagucuuagagcuggaaaaagccuuuacaauaauccagucugugauuuuuuaaaccuuuuggugguucuggaccuuuuugagaaucuuagaaaagccauggaguuuaucccuagaaaaaugaauaugccuauaugcaaaauuuguuugauggcuucauaggauccaaagacccugaagccauccauggcucauguauuucugcuuaagaaagcauaaucuuguucugcucucucauuuuacaaaugauuaaugcaucccuuuucaacuacuccagcgcuguugcugcugcaauguuagcaaaugcaagccagagagaagcacuugaaaauccuuugaugucuaaaaaauguucaaauaguguggauguuuacauaucugaaguuuucagcauuuaagcaaauuaaugaucauuucaacaaauacuagcauauccgguuucccuuaauagccugucagcagugcugccuugucaauuuguguguguguguguguaugugugugugugugugaauucauaaggagugcuucugaugcuuaguccuugaaauggaacuucaacugucuuucaaaacacuggcuucaaaauaggauguguuuuccuaaugaaucagaagugggcaaugagcauuguuccacaggaauaauuuuuaauuuaauuucuauaaaacuaguugagaaaugagagccuguccacccaccauuuguguaucaguggccaauucauuaguaaaaauaaaggaggggaaaggagacuggaguagugguucucaaacuuuacugugcguaaguauaaccugggaagccugcuaaaauaaagauuucuggagauuagauccucagacuagcugaugcagcuagucuguuuugagaaacaguccuucauagcccuuaccuguucuuucacaacaacuugcuauuugccucugaccuaaggaaaugucuuaagcuccugaaacugguuuggcagaaugucagugauauucagagucaagagugccuacuugaguaccaagcaccaugcuaaugauuucacauacauauuaccuuauuaauccucacacgggugcugugagguauuauuauccccaguguagugaugagguaguugagggccagagaucugugcaagggcccuuagcauaugacagccaggauuuaaaccuuagugcuuuguucuuucacuaccaguauuucccaaaugagagucucuggggaggagcagauucccaggcuccuccccuggcgauucugauuucaguaggcaaagguggagcucuagauaaaugccuuggugauucuucagauagagcaaguuuagaaaaugcaugcgggacaccaugcugcuccacagccaccccagaaauggaucaucagaccuaaucaaugccaggagaccuucaucaggucagauaaauggaacaaaaauaaaacaucauuaauuccccucaaacaacauguuuuuuaaguaucuaagaugaaccagaaagcaaggugcuuauuagggaagacacaaguuuaauccuguucccugcccuuaggguacucacaaucuaguuggggaaacaaaacauuaacaaaaugauacauagugaguccagaggcaacaguuugauagaauaaugcaggcgagcuuuuaaaaaccacagggagggccaggcgcgguggcucuugccuguaaucccagcacuuugggaggccgaggcggguggaucacgaggucaggagauugagaccauccuggcuaacacggugaaaccucgucucuacuaaaaaauacaaaaaauuagccgggugugguagcgggcgccuguagucccagcuacucggaaggcugaggcaggagaauggcgugaacucgggaggcggagcaugcagugagccgagauagcgccacugcacuccagccugggcgacagagcaaggcucugucuaagaaaaaaaaaccauacacaguuauugaagaugguucugguaaaagcacucugguagcucagagguaacagagcucuuugugggcaggaaaacauuaacuagaaagggaaugaaugucuuuucuccucucuccagggcauuauuuacuuggaguucuguaacaugucccuguguuugcuuuuuguuuuaauuggcuugucuugauucuaggauaaggucagagacggaggcacaagacguccccaagaggugaguucuguuucagggagacugacagacaccagugggugcuuucuucaaggguuggggcugaccuaagaaggagcucccaggccacagcauucugcaauacacuguccaauaauuuguagggaagaucuaggaacaugcaaaaggcaguuugaaaaaggaccugguugccaaaguaccauauuacccaucaauguccucuccuacccauuucccuuuuucacacccucuaaaucucuauaagcaaaugcggaaaaugcaaacuaagcuuugaacagaaucaaaugagucccucugggacacuugcaggggacuuauuucuuccgaaggaugugacagcagcuucucccaauaguggcagcguuuguuucacuguuagacuggaggagcacaaggagcauacaacauguggcucuguccacaccacugugaaguuguugguucugagaaauuacuggggggaguguuaaaacaagauuggccuuaucucuggggagucaccuguuuaaccugacaagaauccugcucauuaacucaauguguuagacacuaggaugugccacauggguucccuuucaggagugaaauuuaauucccuaggugcagggaaugcugacaguaaguggcccucaagauauaaccccuuauaggaauuaccuucacugaaagaaaaucagcuugaccaaagucacagcuccuucccuggacagcucauauauuaauacaaagacugggcaugguggcugacaccuguaaucccagcacuuugggagacugaggcagguggaucacuugaggucaggaguucgagacuagccuggucaacauggugaaaccacaucucuacuaacuaaaaaaaaaaagccaggcaucguggcacagaccuauaaucccagcuacuugggaggcugaagcaggggaaucgcaugaacccaggagguggagguugcagugagccaagauugugccacugcacuccagucugggugacagagcaaaacucuguaucaaaaaaaaaaaaaaauacaaagacugauugauguagaguuuauacuaacccucuugucccaaauuaggagaacuccgaagguucaucucagcuucaaaacccccuuuagaguugccugagaccuuuauugagacuauauugcagaucaacuucucccucugcccaauccugcucccauccugcuuccaugcccuaggugcggaucccaagggcacuuccaaguaagccaucuccaucguaaucuccaucucagucuacucuguuccuuuggucaugaugaaguccucuaaagaagggaggacacauuuucugaguauuuauauagugccaagcucucaaucagguauuuuacacguuacuucauuuaaucaacaacuacgaaaagaggcagauaaucccuacuugacagaugugaucauuaacuccugcugagacacaguaaauugcccaagguccuacagcagagcugagauucagugucagcugggauuccaaucguugaaacccuauuuggcuuucaaguccacucucuuucugcuggccacacuauaguaucaaaacaguaauaauacauuuggggaguuuggaauauugacuuuuugucagucaaauacccaaguauaaguccacugaucagcuagcuuucuuugagaccuucagcuagaaacaagauacugaaggaauuggguuuuggugcagagaaaggaaaaggaugauuucccuacacacguggagucaucagauguuagagcuagagcucaucauggaggagacccucauaaucgagaugaggaaaaugagcccuagaaaggccaggggacaggcccaauugugcaugucuaguucacagcaaggccuggccuguacagaaaguccggcucccucauccugccucagccaacugcuccuccccgagcugaccugaaaccagcaguuccuagcccagcccuggcugcucccuggggcacuccuucccucucaccugcucuaccaugucuggcuuugaucuuguucaccugggcugccccauauuccaggcccugcccucugccuagggcugucugccugccacacuuguugccacaaaaauccuguccucaugucucugaacagguuugacggcuggagcaaggguaggaggggggagcaugguggggcuucucuucccaggccgugccuccaucugucuagaaccagcucugggaagcacucaucaggcaugucuugcuccucaggucaggcauggacaagaugccaccaaaguccugagcaucuagccccucccugcucgggagucugacuugccacaccugcuuguggaggagggaacaacugaaugcuugaggggagacaccuccuccuccuccgacgccuuccgcaccugaacucaaacauaacagcucugcugggaaggggcuuuugcguuuuuaaaggacuuauccauuucccuucucucuagugcccacccucccacucccccgcucccucagcccacccaacccaaaucaaagccuucuaggaugguuugugccucugagcagacaggguguccucaggaagacccugauccaaagggauucgggguggugggguaguuuagggguggcgaccaaagcacacaggccccuucuucaucccuagcguguuuuccuucuccugagucuuggugagucagagccacagggccacacacaaggcuacuau

SEQ ID NO: 13786 - RNA, 11661 nt, Homo sapiens
gggcacggcugggcggcuccgcccagaagagggccgagaggcggggcggugcccccaccgcaggcccgcggcgcccucugcaggccacaggcagcgacucaccaguugccucaucuuuccucuccucccucuuggggcuuuccucaggccacauuuuuugugugucugggcagucucucagccuccgacucccgucccuuucuuccacuuccaggccgggcguguuagugucuucgcgggaaaacugccaauaaaguuuuucuucuucucgcucccaagauccccgccuccccuuaagcaccgcgagaucugacggcgcggcuaccauggcggcggcauuugaagccucgggagccuuagcagcaguggcgacugcuaugccggcugagcauguggccgugcaggucccggccccagagccaacacccgggccugugaggauccugcggaccgcucaggaucucagcagcccgcggacccgcacgggggaugugcuguuggcggagccggccgacuucgagucacugcugcuuucgcggccggugcuggaggggcugcgggcggccggcuucgagaggcccucgccggugcagcucaaggccaucccguuggggcgcugcgggcucggugagagcgggggcccgggauaggucgggggguggggugggagaagggggaccgacgggcggcggcggccaggcccgcgccgcagcucaggaagagcccucggucggcccccggagcagggcccugccgggggcuaggcgcuacgcucaguuaacuuauuuguaaaacuaacgugcacuauugaacuugaggauaguuaagaccuuuuuuuaagcacugacaaaugguucuaaguuugagaagauaaacgguaaacguucagggacuaggcguguucucauacguuuuugagaaucaacuaaaaaugaaggugccaacuaggggaaucucaggagacccuucuaguucucugauuccauguuagccccuaaguugcuucagugaguacuggcuagugauaauuguuuuuuuccuucgcagauuuaauuguucaagcuaaaucuggcaccgggaaaaccuguguguucuccaccauagcuuuggacucucuuguucuugaaaacuuaaguacccaggugaguuagcugagaggaccagaggaggauguguuuuguggacuuuaccacaggucagaugaaauaccaguagcuccucagagcuggaagugaauuugaugaaugauugaguuaagugguggugguggcgaaauuuggaauuuucuaugcguaccuuauuuaaauagaauaaagcuaccauauaugucaauuuugucacuacuugguaauacagacagggauucuucuuuuacuuacugacuagauuaaugugagacuuaacauuugacuugauucaugguaauguagugcucuggcuauuguugguaacugcagaguuuguuuuuuuuuuuugagacggugucgcuuugucaccuaggcuggagugcaguggcggaucauugcucacugcaaccuugaacuucugggcuccagugauccucccacccaucuuccuaaguauuugggacuacaggugugugccaccacaccuggcuaguucuuguauuuuuuguagagauggggucuccaguguugcacagaccagccuugaacuccuggguucaagcaauccucccaccuuugccucccaaaguacugggauuacaggcaugagccaccacagccgguaugcaggugguucuuaaagcucuguaaauguaucauauugaucucccaucuuccagguugucuuagaguguuucuaagauugccuuacccaaauuagcaggaaauuugaguuuggggaucauuucuccaacaaagguuuguugaguccguauuacguauaaacagugugccaggcauuggggauucaaagaugaauuagaugugauucucauagccuuacuugguaguuuaguuguuauggcagacuguauuucaaguucucaggcauugguauaucugaugaugaaucuucaacagugguuuuuaacccagauauccauguucaucaccugggaagcuuuuugaguccaucuuaugucuaccaaauccuaggugauguugcacauuggaaauccuccuacuucccaagaaccugaguuagucuaauuguagacuaagauguauuugagauuuuggcuucugacaauuuggcagcagauaaaaugcugaaauccuggaaaaguuucaucaacucauuuuuuuuugagaccgagucucacucuguugcccaggcuggagucaguggcacaaucuuggcucacugcaaccucugccucccagguucaagugauucuccugccucagccucccgaguagcugggauuacaagugugcacaccacacgcccggcuaauuuuuuuguauuuuuaguagagacgguguuucgccaugucggccaggcuggucucaaacuccugaccucagguaauccaccugccucagccucccaacaugcugggaucacaagugugagccaccaugcccggcaaauucauauuuuuaauuucagaucuuuggauuaugaaaauuacauuauucucuguguguguaucaaaguaauacauauucauuuuuagaaauagggaaaauucagaaaaauuaggacguaccagaaaacaaaaucuguaaucuuacuaccuagagagaaacugcuauuaacaguuuuggcauguuuucuccuaguccuuuuuuuuuuuuuuuuuuuaaaucaauuuuuuuuucuuguaguuaagagcacaaaguuuuguuuucuccuccuccaguaguuacauugcaaaguuuuuaccaugacucucaaggucuuuugugaucuagucccuggagguagaucucugaccuccuuuacuuuccccugaauucugucaugugggccuucuuuuucuuccucaaauacaccaagaacacugccaucuuauggccuuuccauuugcuguuuccucuuggugaaaacgcuuccccaggggucauauagccagcucuacucuaugccauucacguaggucucugcucaaaguaccuccuuugaggagguuucaugaucaccucauuuaaaaugacuccuuuuuuccuuguuugauuuuuuuaugauacuuuuuauuaccugucauuacuuauuuuuguuuacuguauauauucuuauccaagaaugaaaguaccaugagggcaaagacuuuguacuguuaacuguugauuccccggcaacuaguauguugccuagcacagaguagguucuuacuuaauauuuguugaaugaaugaaugaaugaauggaauacagucagcccucccugucuucagguuuuguaucagcugauucagccaacuguggaucaaaauacucagggcaggauggaggaacaauaaaaaauaauacaacaaucaaaagauauaaacaaaaauacgguguaaccauuuacauagcauuuaaauuguauuagguauuauaaauaaucuagagaugguuuaaaauaugugggaggauguacacagguaauauacagauauaugcaauuuuauauaacagacuugagcaucugccaguuuugguauuugggggcuuccuggaaccaauccccuguggauaccaagggauaacuguaccuuaccuuaucaauaaaaacucauuugaaaugaucauuuaaaugaaauauagugugucauguaaugaauauaccaguccccuauguauuuauuccucugacucaaagguguaauuuaugguuuuuuuuuagauuuugaucuuggcuccuacaagagaaauugcuguacagauacauucuguuauuacagccauuggaauaaaaauggaaggcuuagagugucaugucuuuauuggagggaccccauuaucacaagacaaaaccagacuuaaaaagugucauauugcuguuggaucuccugguaagauaacaaugccuguugguaaccagggcuuuuaaggaacuacacacuuuuaauauaacaauaaagauauaugggagucuuugauaacugugauaauuauuuugauuagaaaugaagagcaggccgggcgcgguggcucacgccuguaaucccagcacuuugggaggccgaggcgggcggaucacgaggucaggagaucgagaccauccuggcuaacauggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggugacagagcgagacuccaucucaaaaaaaaaaaaaaaaaaaaaagaaaugaagagcauuagaccagugagauuuagguacaugacugguuuaccaguggaauuuaugaaaucuccauuccuaaguauguuugagaagacaugggauaggcuuuugagaagaggagaaaugcagugacuuucaggaggcccuucuaagccauggauugggauuauucuuuggcuucucuauuauauuugguugcgaaucacucagaaucagcaucuugcauucagugcuuuaggucuuuugauagaaaugguguuuauuuacuggugaugaaacgugaggggaaaacaaugaguuuagucaagaucagagcuccagauuucuaauuugugguuuaguguguacaugcauaaugagaguugaaucaggaaauucagcagaacaaccuguaaguaauaaguagaguaacaauauuggcugagauuuacacaaauuugguacaucauaaauauuucaauuuuuuuuuuuuaauuaggcagaauuaagcaacucauagaacuugacuacuugaacccaggcaguauacgccucuuuauucuugaugaagcagauaagcuuuuagaagaaggcagcuuccaggagcaaauaaaguaagaaaaauaacuaacuugacuauuaaaacaguguuccgaaguaucuaucuuuagcuuuuccaaguggugauuauuguuugaauaauuuacaugguaucuguuuuuauuuugcaguuggauuuauucuuccuugccugccaguaaacagaugcuggcaguaucagcuacuuaucccgaauuuuuggcuaaugcuuugacaaaguacaugagagaucccacuuuuguaagacugaauuccagugauccaagucucauagguguguacagcuuuuagguacuuauauuauugguuuauuugugauaugcuggagcuuucccuugccuaguuuugucuugcuguuucaugguuaccauuagcauauauauuuguuuuaacugauagcucuucuuuguagguuugaagcaguauuacaaaguugucaauucauacccuuuggcacauaagguuuuugaggaaaagacucagcauuuacaggaacuguucagcagaauuccauuuaaucaagcuuuagucuuuucuaauuugcacagcagguaauguaacuuaaaaggucaucuggggaacuugugaaauaaaaggauagucauggggcaauauuuguaaauuuguaaccauuuauguuauauuucauagagcacaacauuuggcugauauccuuucuucuaaaggcuuuccugcugagugcauuucagguaaguucaucucuuacuuuaaucuuuauuuaguauacugacuugaagccuccaaagucaggaggaaaaaauaccacuuuaugaguugucuugagagugugaaauuaucuuguaucuuuuagaguaaaggaauuuucaggcuuauuuuucauuggaauuugauaugucaauauucuauuuuuaaggaguaacuugguauauaguaaaaaguuagaaaacgaguguucagaaagacaauuuuauuagaaucucucuuauagccacauauaacuuaauucuauaaaaccaaguuugucuguauuguguuaagauaaaaauauuuuuucuuuagaauuuuuuuuuuuaauaauuguuaaaaugcuggagauugcuaacugaauugacuguuuuaugguuuuguggaaggcaaaagugauugaguucuugcugcaaaguuaaaugauuacugcuggcauaauaagaaugaaagagucgaaggauuuuuugaucagugagauccuuuuuagaguuuuguuuggugucagcuuaauuuuuaaccuguuggcaugagcuuguuuaguuaugguauaucacgagauacuggggagacuauuuucuaaugaaccaauacuuaaacuauagaucacacuuuaacaccaaauuauaaacagcugauuaaagcauuuuuauuuuccuaagaauugcuaguuauacuucauauguaacuuugcaaauagaauguuauauauucaggcauggccugaucacuauuuaggauugauuuuugaauuucaaguugauugccuaaaccauaguuuaaaagauuuuaacuuuggaucuuaaccuagauuugcacagaaggacagaauuaacugugguugguguauuaaaaguguuaagacuggguguuaugcuuuuuacuuuuuguggauuggauaaauauguauuagcuuaguuguuuuuaugugacuuucuuuugggguccuuuuaggcaauaugaaucagaaucagcgucuugaugcuauggcuaaacugaagcacuuucauugcagaguccucauuuccacagauuugguaaauuuccuauucaguuugggugacuaauccaucuugacauauguucuauuaucagauguacagauuucauauauuauuuuauguaggcguaucuaacaagaauaccagaagauaauuaucuuuccagugcugaggaaaauacuuucuuaaaaaugucuuuaauauguuuaucuuuguccuugaaauuagucauuaggaaugaauuuccuuuuccucugcuccucaguauucaguucuuaauuugucucuugacuguacuggaagaauauaauaugcauugguauccaugcuguauaguuaaugcaaacaaauaauugcuaucuucuucaauucaagacuucucgugggauugaugcugagaaggugaaucugguuguaaaucuggauguaccauuggauugggagacauacaugcaucggauugggagagcuggccguuuugguaaaaaaaaaaaaaaaaguuugagugcuuucuuuaaggggagggaucuauaaugugacaggugggcuuugaauauuauuuuugugaaaaugauuuacuaccuaacauucucucugcuuuuagguacauuggggcugacagugaccuacuguugccggggagaggaagaaaauaugaugaugagaauugcccagaaauguaauaucaaccuucucccuuuaccagguacauuucaucuguuucauuauuucaaaauaauuauaguggugauaagcauaauaaaaaugauaauaauagcuaacagagugcuuaugaugugcuggguacuguucccaguccuguauguacguuaacucauuuacuucucaccacacuccuaugaggugugugcaauuguuuuguagaugaggauauuuagacauagagaggguaaguaaagguguuacagcuaguaaguagcacggagaggagugcaagcuaaccacuggcacaugaaaaaugagagcuggcuaggcgcaguggcucacgccuguaaucccagcacuuugggaggccaggacagguggaucacaugaggucaggaguucaagacgagccuggucaauguggugaaaccucuucucuacuaaaaauacaaaaauuagcugggcgugguggcaggugccuguaaucccaacuacuugggaggcugaggcaggagaaucgcuugaacccaggagguggagguugcagugagcugaaaucaagccauugcacuccaaccugggcaacaagagugaaacuccgucucaaaaaaaaaaaaaagaaagaaaaaugagagcuauguuagcucuauuuuauuaguuaguggcuuugcaauuugauuuuauucuuugauacaaggggggauauuuuaccucuuaaauuguugugaagguaauucuugccauauucuccuuugucaccauguggaaagaacagcaucuuuaauuugaauacuauuuugaaaaauuggagugaaauguuuucuuuugauuucaguucagucauuuguucugcuucuuuuuaagugcccucuuggaaacaacgcauguuuaaaacuaguaaugaucucuuaaaaacaaaaaauucuaaaaaacccuugaguggaaauauggcauuuuugacgugcauguuauacagaaaaugugcacuauaaauagugucuauucauauauagauguaugucuauauagaaaaauacacauauaggucacgccuguaaugccagcacuuugggaggcugaggcgggcggaugacgaggucaggagaucaagaccauccuggcuaacacagugaaacccugucucuacuaaaaaaaaauacagaaaauuagccgggcaugguggugggugucuguagucccagcuacuuggaaggcugaggccggagaauggcaugaaccugggagguggagcuugcagugagccaagauccgccauugcacuccagccugggcgaaagugcgagacucagucucaaaaaaaaaaaagaaaaauacacauauaguauauacaugacuuugcagaauauaggauauguaguuauugaauaaauauaauugaguauuuuaccgacuuuauauuuaauuauuuuacagagcuagauuaagcacagaucugggaguucuauguauucuaguagaucggguuaguaauaacucauuuuaugaucuuuuacaaaucucuguaauugcuguaagcuuagaguccugauuugcaaaguacuuuagaguaaauggucuuuaggcucuaugucaguucuaaaacugucaguucuuucuguguauaagucuauucguagucugauaugggaaaaaaauugaaaauugguagaagaggguuaagacuucuuguaggauucaauaucauagcaucuagugauaaaaauugccuuuggauacuggaaaaugauauauuuggaucuuuauguaauguuaauagggcccugaaaucaugagaaaaugauauucaugcuguuaggucuguauuggacugggaacuuguguaacaacagauguucagaugaguuuccuggggcagaacuaggagggaaauuggccuguauuauaggacuaggcaagcaagggauaucaacugaguaggaaugagaguuuuaaucauagaaucuguucagcaaaggaucaagagacuucauugaaguauccagaccugugggauuuauagauaacauggagcauaaauagcaacaacaggcaagaucuuuguaaagcaggggcuugauauaucuugucugccuaagacaaaaauugaucacacuuugaaaggucugagugugggaagcaaauugucacaccuggauggaauagaaaauuuagaggguugaagccagcaaauuuuuuaaaaauuagaaaugucauuucugauuuucauagucacagaucuuuucauagucaucuaguuuuuuccccuauagagguuuucucuuuauuguuaagggcagugauuucucccuguuggaauauugggugacagauuuaguuggguguacagaguugcaguuguauuauuuccuaguugauaagcuuuggggagcacaauccauuuucuaauaucuuguuuugcugucagaaguauugagauaaaggggaggggcuguggagagggaggagagaaaagaugggagaauuguugcaggcuuguacauuacuccuagaguaagcucuuuuucuagugagagugaggggagauagugcuugugaguaugggaugggucuuacauauuucuuaggcagguuucuuuauuacaggauugcuucagucuuuaaaaauguuauaucuauuaaacaucuuaguauauuugcauauuguuucuuaaauguauuugaucauagaaaacuuuaugaaaucauucagaaaacaguggucuagaguagcuugagaauuuuaauacauuuuucuuccuuuuuauguagaucccauuccuucuggucugauggaagaauguguggauugggauguggaaguuaaagcugcugugcauacauaugguauagcaaguguaccuaaccaacccuuaaaaaagcaaauucagaaaauagagagaacccuucaaauucagaaagcucauggugaccacauggcuuccucuagaaauaauucuguaucuggacuaucagucaaaucaaaaaauaauaccaaacaaaagcuuccugugaaaagccacucagaauguggaaucauagaaaaagcaacgucaccaaaagaacugggcugugacaggcaauccgaagagcaaaugaagaauucuguucagacucccguugaaaacuccaccaacagucagcaccaggucaaagaagcuuuaccugugucacucccccagauuccuugucugucuuccuuuaaaauccaucagccauacacguugacuuuugcugaauugguagaggauuaugaacauuauauuaaagagggguuagagaaaccuguggaaaucaucaggcacuacacaggcccuggggaucagacugugaauccucaaaaugguuuugugagaaauaaaguuauugaacagagagucccuguguuggcaaguaguagccaaucuggagacucugagagugacagugauucuuacagcucaagaaccucuucccagagcaaaggaaauaagucauacuuggaaggcucuucugauaaucagcugaaagacucugaaucuacgccuguggaugaucguauuucuuuggaacaaccaccaaauggaagugacacccccaauccagagaaauaucaagaaucaccuggaauccagaugaagacaagacuuaaagagggggcuagccagagagcuaagcagagccggagaaaccuacccaggcggucuuccuucagauugcagacugaagcccaggaagaugauugguaugacugucauagggaaauacgucugaguuuuucugauaccuaucaggauuaugaggaguacuggagagcuuacuacagggcauggcaagaauauuaugcugccgcuucucauucauauuauuggaaugcucagagacauccaaguuggauggcagcuuaucacaugaauaccauuuaucuacaagaaaugaugcauaguaaccagugauuauaggauauaccugagaccaucaggaacugucaacaaaugauaccuuuggauauccauccuccucgacuuauaguacagugguguauaguggcauuucugauaaacuugaaaagacuugagucuuuccacugggacacauccauuuuucagauuguuuugauuuaggccagguauauuaucuucauuuuuaagaguuucuuuaagaaacuucaucagauuguugaaagauaauuuuugggacauagagcugaaaguuucagggugccauuuucuauaagaucuucccaaaagaaacauuuaaaaagaugacauauaccaccacuuacuuaaaaacaauaaaagcaauagauuugauua

SEQ ID NO: 13787 - RNA, 1547 nt, Homo sapiens
aucuuuuauuuuaagguccucuaaagucauucugcuuuaaaacaccccucaaacauaccuuuaaacuuaagaucauagacagacaucucaucaaccaguaaaacuuucuaaauacuaccuugucacaucuauuguguaguuauuuaacagauuaaauagaagucauuuaauaagacuccaagucucagucugcuugacuaguagcauaaacucagucuauucuauuuuagaaugugguggagaaagaugauaguuauuagauuccuuugucacaucuuauacaguccacuuggguuaaagguggaacugucaagaaaaacgccuuucuggcacacagugauaugcagagcaggaccagcugaagucagaugugcaaggaaaucugugguugcugagcaggaugaaaaguauccuguuagaaagugagauagguguguuuuuauauuguccuaaugugaacuccuuagucuugguuccaaagggaaggguaccugaaaauaaauguauuuuuauagcugaaaaaucaagaguuucuaggauauugugugaaugucaaaugauaaauaucuagaaacugauuucauauuaguauguguggcuauuuaaaguauaaugacuuugguuugguuauaugagugacacagaauuuaaggaggcuucaugccauaguucauaguuugcucuaauggcuuggugguaucccugaacagucuacuuuuagaaauuaacaguaaauacacaauccagcuguaaucuuacccuccaccagggggagcuucaacaucgguuaauacuuuuuuuuuuuuugagauggagucucgcccugucgcccaggcuagagugcaauggcucagucuccgcucacugcaaccucugccucccggguucaaacaguugugccucagucuuccaaguagcugggauuacaggcacccgccaccacgcccagcuaauuuuuguauuuuuaguagagacgggguuucaucauguuggcgaggcuggucuugaacuccugacuucgugauccgccccccccucagccucccaaagugcugggauuacaggcgugagccaccgcgccuggcccgguuaauacuuucauaagcauugaaguaacuauuuaaguccuaguacauaaacacugugugguucacaaaaaggcauagagacauucucucaagaguuuacaaucuaauugggcagggaagauacuacaguucaucaaagauaugaauaacacccuaguuuucugaacugcagcugcauggguaauuaucuuaagaacuuuuggcaaaauauggauguugguguguuacucucuucucccuacaacucugaacuaaucuguguuuggcaccuugauuugccaucauaaauggccaccauuuacuccucacugaaauauucuucuucuuugagguuauaauguacuuggaaaaguuaauacuuauagaaaauaaugaucuuuauuaccaacuuuauuaaaacaggcuuggaacauuuuucuccauagaagaauaguaauaagacauucuacauuuccugga

SEQ ID NO: 13788 - RNA, 4170 nt, Homo sapiens
acaaagaguuuucuauuccugaacuuucacauuucuguggaauggcagggguuacccccauuuugcuggucugcucaaggccaaguuugaauggaaggcagcgacaggucccuaauccgcaucuccaguuccuccucaggaacuccgagagugagaggacaaguagggcaagagaccuggagauggucgaagggcuaaagcaguugcaaagggagagguggagggguuggagaggugugaggacugaaaacucugccccuuuugggauucguuuggggccaccuggaagacggugauuucagccaggacaugcgcuuuugcggacugcaggguguucgcuaagucaagccuccccgggagccccacggagggugggaacgagguggcgccgcccagucccggacgcgcgucgagcgcccucuuccaccccacgcugcccugcccagggcgagggcagagcgggcccgcccaggugcgcccggggguugggccggaguccggaaggugcgccgcgccgccccgaaccuguccccuaggccuccccccgcgugaaagugaaagugucggacccgcggaggucaaggauaggggggcggggccagcgcggagcugggagcgggagccgggcacuccaggggccauggaugggcucggccgccgccuucgagccagccugagacugaagcgcggccauggggguuagugccggccggggagagcgcggggggacggcgugggcaccggggagccggggcuagggcuggcggcuggggcccgguggagggcggcacggggcgucgagauccgggagcaguuggaaggggacucaggaggcugcgcgggggcaggugagcgggaaggagcgcgcggagaggggaagagggucaggugggggcggggacggcgaggccaggccugagggggcgagggggaggcggcgggacacaggaagccguuguggggccccggggccacguguccuuccauccaggaagcuuguggugcaaccgcagugugccugaaagcgccccgguugugguguccucccagaggcacugccucagcucccggcgugcccgccgccccgccccaccucgccgcccugggaguccuccguggucuuugcccaguuccucggagccagcgccccugccccugcccagcagauagccaccggccacaaacacaggucuccccgaugacguuaccacccccacccacccucggccaggugcccuucagaguguggccuccagcggagcggcgguagaaccugcgcagcugcugcuuuccagcgugucgcccagacagggcaccccuucccuuucccucagccccgcaacagugaaauggacauaauucccccguccaggauuauggggauuaaauuagaagucaacuucuaaguuaaagaagcaccuucuuuucuuucuuagcagagcccugggguuggaaggagggcaguuagaaauucauucauuuauucauucacucggcaaauauuuguguggcuuaccacuagccaguccuauggcugaacagccgugacccuuagauacuuugcccagagguccuacugucugaggagcaaagagcaggggccauucccagacaaccugcccuuuccaacauuggcacgccaggaggccaagugagccccucucuuagcccaagccccagaguuggggggaccucagggagugaggucagugcacccuucuuugaacugcagugaccucugagugaucugcucuuccuccuguugccauuccuccugccacacccugcuccuucccucuuuguaguguccucucuagacacagaucuccaauaucuggccauuccaucugcaccaucagggagaggucagagaccacaguuuggggcagaggccugggaccgugcaguggugggagcagaaggcaggaugaggcugacauucucucuucucuggagagcacuggccuggucuguccuggucuucccagacccugggacaucugugugaauggaaggggucugcccccugcagcccagaggagacauuccaguuguucccacccaccccugccccaacaccaggcacuuccugauugugccuggaggagcuuccugauacugaggaacuguaagaacugaggccuaacacuuguagggccaggagcauaugcccucuucaucuuccauaccauccuccacuugccuggggauucucccccuuccuccuuugccuuucuggccccaggacaguuguguauuaggagggaguguguguguguguguguguguguguguguauccuggugacaaggagugaugugguggugguccuggguugagagcagcugagcuggaagggaugggccagcuucccagaucaagguuccagaagguccccucaccuauguucuagacagaucugggacuucagucaggugugugugggagaggcuuucugguggaggaacaaguguaaccagauuccugacuucccuagaaaggguggcucccuccucaacuaaaacucugaauaauaauuccuuucuagggcacuggagauuaaaugagaugccuuauaugaaacaugaguuugauggagguuaguuuucucuuacgcuuuucucuccuguggauaacaccuuuugaaagaggggagaaaacagucuuuugcugcauuucuugggccucaucccaaaagucuaauuacuuucuuuugucaaugauuuauuaauuuugcuauucucuuggcuugcuugauaaagcagaagaaaaugaucugaaaacgcagcccaaaggauuuagggaaaggcauaauuucauuagaaucuggaaugaucagugauaagauucuguuucucaauguccuuugaaaaccucugugggguauuugaugucaaaugcauccagaaggcaggagcauggauuuggagcuuuccuaauccccauucccaacaaauccugucaauuuuaauagccuuugaauuacuuuaugccucaguuuccccaucuguaucaggaagaugcuuguuccucaaacaggugguaaggcuugugcaacaagucugugcagcuugcaaguaagguguggugccagcuccaaguguucuaguucgcucuucucacccauuacagcauuugaacaucuuucuuuacuguacaugaguuuggccgugaguccuggcuuuuucuagucccacagaagccaggucuagagcucuuaggagcaaagcagcuguuuucccuauccuagcaccccacucucuuccagaggggugcuuauucuuagcaggaguggcaaacacuggcgucaaacccuuuugcccccugcuuucccuuugaggcagcuuccugguaaaagccuucccuguauuuacucauucagggguuucugugagaauccaaggugauuuuuuugcuauuccuucucucuuaccuagucuccagacacagcagugggcuagcagcugugccuguagcuugggcagaacagcugaccuggccugacccggaggaaggcugagcaggcguggggguuggguggagaucacccagauguuuuccacugccauggaaucacccucaggcugcuggugcaaucaguccccuaccuuaugcuggggacagucuucugagccagugcuuccuauuugagaagagggacucugcuggaacccuggaacaagugccagugacagaacucuccagggggugaaauucaccauuguagcuauuuccaaaauaucacgaacucugggcuuagagauggauuuugcucucuacugcaccaucaggaaagaaggcuauuggguauugacuuccagaacucuuucuuuuguuggaagaauuaaucuauuuggauaauuauuaggccaagucuauuuaucuuaaucaggggagggcagugacauccuggcugcagaaaguguuuggccaugugcucuaggucgggaaguccuggaaguucuagaauucagcagguggccuugcugggguuuuugacuuccguugaccaaguugagaagugaaaggucagcaauccaaguguuggagguauaggaucccuauccugagaccagccgguuuccagugcccacagucugacacuaucaagcauuguccacuguucuaagguuguaaauuaacucucugcacaaucugcagcccagauuc

SEQ ID NO: 13789 - RNA, 6660 nt, Homo sapiens
agauccauuuuccuccaaacagauuuauugaauacagcaaaauucuauauacaaagugaccuggaccugcugcuucaaaacaugauccuuucuuacuaauaucuugauagucgguccauagagcauuagaaagcaauugacucuuaaauaaacagaaaagugccuaaugcacauuaaaugaauggccuaacuacuggaacuuuaguaguucuauaagguaauuaacauagguaggauccaguuccuaugacaggcugcugaagaacagauaugagcaucaagaggccauuuugugcacugccaccgugaugccaucguguuucuggaucauaauguuccugaaaugcaggaagaaaauauucaguaaaacguaaucagugggacuucacugcaagauuaaagauguuguuugcuuuaggauacaauauuuaaaauaauguaauuguuucuacguauaaaagcaauauuuaaacauaacaaaacauuugggaaauacauaaacauauagcaugugaacacgaaaugaauccuuaauccuacuacacacagacaaccacuguuaauauuucccugguucuuuguuucgguuuuuuaggcacugucuugcuauguugcccaagcuggccucaaacuccugggcucaagcaauccugcuucagccaccucaguagcuggaacuacaaaaaaaaggcuuuacuggucuuuguuuucuuugcauguauaugauacagucaugugcugcauaacaaugcuucagucaacaguggacccuacauaugaugguggucccguaagauuauaauggaacugaaaaauuccuauugccuagugaccuuuuaaccgucccagcaucacauagcacaacacacuacucacauguuugugguaaugcugguguaaacaaauugugcugccagucauaaaaaguauagcacauacaauuauguacaguacguaacgcuugauaauaauaaaugacuaugcuaugguuuauguauuuacuauacuuuuuuucuuuuuuuugagacggagucuugcucuguugcccaggcuggagggcaguggcgugaucucagcucacugcaaccucugccucccggguucaagcaauucuccugccucagccuccugaguagcuaggauuacaggugccugccaccaugccuaauuuuuguauuuuuaguagagacaggguuucaccauguugguuaggcugucucacacuccuuaccucaagugaucugcccgccuuggccucccaaagugcugggauuacaagugugagccaccaugccgggccuacuuuuuaucauuauuuuagaguauacuacuccuacuuauuaagacaagguuaacuauaaaacagccucagacagguccuuuaggagguauuccagaagguaucaucauuacaggagaugacaacuccaugcauguuacugcccuggaugaccuuccagugggagaagauguggagauagaagccagugauauugaugauccugacccugugcaggccuaggcuaauguguguuucuucuuugcuuuuaacaaaaaagucuaaaaaguaaaaaaguuuaaaaaaagaauuuuuguacagcuguacaacuguuuuaaguguuauuauaaagucaaaaaguuuuauugacucacucagagcaacuuccaguguuguaagcuccauuaugguaagugcccuauucagauauaccuuuuaaaaaauuucccuauaccauacuuuuacuguaucuucucuacguuuagauacauaaauaccacuguuauaacugccuacauuauuuaggcuacaaaucuuuguagucuaagagcaauacagccuagguguguaauaggguguaccaccuagguuuaaguacacucuaugauguucauacaacaaaacugccugacacauuucucagaacauauccccauuguuaagcaaugcaugacuguauguuuuuucuuuuuacaaggcugugauaguagcaguuguauauauauacuuuuuuucacauauuauucugaggaccaucacuuggaauaucuuuaguaauuuuauugcuuuagaaguaauuuuuggcugggugcagugacucauuccuguaaucccagcacuuugggaggcugaggcgggcaaauuacuggagcccaggaguucgagaccagccugggaaacauggugaaaccucaucucuacaaaaaaauacaaaaauuagcugggugugguaguguacaccuguagucucagcuacaacucgggaggcugaguugggugaaucgcuugagcccggugggguugaagucacagugacccaugaucacaccacuguacuccagccuggugccagagcaacacccugccucaaaaagaaaaaaaaaaaaaguaauuuuuauucucugauuaguuuuccuuugugcuauuuguuacuuucuuuuuguugguaaacugauagcuucugccaauucuuauucuucauuuaaauagcauuguggccugagagcacauuagcuuuagggaucaacuugucuguuccugugauucaaaagauuaagaacuuuucccaaaguagucugaauaaggaaucacugaugaacacagggccggcccccgccaauuuuaccaggaauuuuucugaacaaaaaggaaaggaucugcugaaaucuacucacccauuaucugauucuagacacaccacaggaauaucaguggggucagagguuagcuuagcugcuugcugggcuagaacagauaucacuccagcaugcucaucugacagggucccgcggccuggaaaauagagaugauauaugucaccugauugcucauagaguauuucugcuaaaauaagcuagcuggcuguuuuaaaaugucuacagaauugucuuuuuauuaaugucuguauuagucuguauauauuauaguaacuaaaucucggguacaaaaguaccuauaaauucuagguacgaaaauuaauuacuaaguguacuuuacaauauauuucuguauauaaaggcaacacaaaguuaacuguaccugaaaccaaaucagguaauagacaugccacuauggcagagcauuuggauguacuauuacuauacaaaacauuuugaccagauccgaugccgacguuugagccuugaagguuucuugaaggaacucauuuaguuuuagauuuccauaccugaauuucagucuuuccauuaguaagccuagcaaaugcuuccaaaaauuuacccuuuuucucccaaaugacugaucugcauguuaaacauaacugaguuacaccgauuaccucuuucaguuacccuuccagcaaaaauucagagcuuuaaacauuccugcauuaggagcaacaagucuuggguuuacuaguugucacuaauuaacugaaugcuuuacuuauuuaccuuuccaaacuuauuuccucauguguaauugcuaccauuuauuaaguauuaugucucaguucuauguaagcauuuuauacauauuauauaaccuuaaaauaucgugauuaggccggguguaguggcucauuccuguaaucccgcacuuugggaggcggagguggguggaucaccugagauaaggaguucgagaccagccuggccaacauagugaaacccuguaucuacuaaaaauacaaaaauuaucugggcgugguggcaggcgccuguaaucccagcuacucaggaggcugaggcaggagaauugccugaaccugggaaauggagguugcagugagccaagaucgugccacugcacucuagccugggcgacagagcaagauuucgucucaaaaaaaaaaaaaaaaaagugauuaagaggccucagggccagacaaaaauccuagcuuaacgacuuacuagcugcaugaccucaggcaaguuauuuaaccucugugucucaguuucuuuuuuuauuuuuugagacagagucucgcucuugucauccaggcuggagugcaauggugcaaucucggcuuacugcaaccucugccucccagguucaagcgauucuccugccucagccucccgaguagcugggauuacuagcaccugcuaccaugccuggcuaauuuuuuuuugcauuuuuaguagagaugugguuucaccauguuggccaggcuagucucgaacuccugaccucaggugauccacccgccuccgccucccaaagugcugggaucacaggugugagccaccgcauccggccucuuuuuuuaaauuuuaaaaacauauauauauguuuauuguaaaaauagagauggggggucucacuguguugcacaggcuggucuugaacuccugggcucaagugaucugcccaccuuggucucccaaagugcugggauuacaggcgugagacacugcaccuggucccucaauuucuuuuucuaccucacuggguuguuaugaggaauaaaagaguauauguaaagcacuuacaauggugcuuggcacauaacagcucaauaaauauaauucuaugauuauuaccauuaucaaauaacaacccagugaagaaaaugagggccuaaaagguaguuuuuugguccacguucacacuacuaacaaaugaaagagcaagggauugagaccagguauguccaacacugaaaucccauuuuacugccuauucacuucuuguuuaguguaguugagcuucaaaauuguacaccacccaccuugccggguuguugugaaaauuaaagauaauguauuuagagccuagcagucucagcauauggcauacauucaauaaaugguuaacagcuguuauuaucugaaguccuuucuagacucaauuuaaaaugauucaaauauuauuuuuaguagagacaacuauuuauuguuauaggacugcaaggaacaucuuccuucauaaauaccaacugaaaaguuucaauuuucugauacuguuauuuggagauaaucucuacucucaaacucagaaagaccuggcaagguaacaggaaauaaaagcuagaaaauaauagcacgcuaggcuccaagucaacaucagaugcuaugcaauucaucaaauaguugguaugagagauacuuacaacccagauuaaguccuugugaaucugugcacaggacuccaacaauggagggauucuucauucuaauuccaggaacacaagagaguugaaguacauaaugggagaaaaaggauuuaaauaaguacaaacauacagguguucuauguaccaggcauuaagugcuuuaaaucaauauuucucaaucuuuuuucauugucacacccuaagaaaaaaauuaaguucuagggccgggcgcgguugcucacgccuguaaucccagcacuuugggaggcccaggugggcggaucaccugaggucgggaguucaagaccagccugaccaacauggagaaaccccgucucuacuaaaaauacaaaauuagccaggcgugguggcgcaugacuguaaucccagcuacucgggaggcugaggcaagagaaucgcuugaaccugggaggcggagguugcagugagccgagaucacgccauugcacuccagccuggaagacgagcgaaauuccgucucaaaaaaagaacacaaaaaauuuaaguucuaguuaauuaauugaaauaaaccaguuucucucugaugagagaaaaaaaugugcuaaguacugcugaguucuggagggccacaaacacugcgugaaaaacaucuaggauguuuucacucuuguuaaaaacgcauguuuuaguacuaacucauuuaaaacaacuguugaaaaacucaaguuaccuccuggaggguaaguggaagcugagggacaucggugggaggcaggugucucucuguacccuuuacacuuuuccaguuuugaauuuuacauagauacugcuuguucgaaaaauuuaaagaaugauuuuuaucuacuuaagcaccaaguaacugauagguuacacacaggagauacguguuuguuuacacugcagggcucgacacugcacaacuggcacaaucuucccaaaagucaacccguuuucuaaaacuuccgcagaaccacccugaccguaaagacgauuucaacaacgagauaggcaguuuuggcccguggccugggcccgggagacucgcucaagagggaaugugcggugcccggcaggauuuuaauuccgggucacccgccccgcccugcggccuuggguagaguuuagcccccucaucccgugucccgggggucgcgcgacguccccgagacgcccuggccgguacucgcagcucgcgccuuucguuccgcucaaguuccuccgccgcgaccucaggacaggccgaagaggcgcgcacuacucacgugucuuccaagugcugcuccaaggucgccuccaucccacccaccgaccacuccggcucagaacccagcggcacggcacguccuucuccaccacaggccucagucacuugacgcgagcggggcguggaccguaacggcgccuccaaagggacaaaauugaucacggugcaacguccgcguucuuuacuggaaaacaucacugcgcuuccgucgcacagagccugacgaaggcuugggcuccccgcgcggugaccgucgaggugaccugcaccuggcuccauggcggaaccggccggcacggauuauuccccucucgggag

SEQ ID NO: 13790 - RNA, 28343 nt, Homo sapiens
ccccucaggaaguaaaguccacuagcaggagggccuaaaucgucugagcccuccuuggcucuuacaaugcucacuuguuuucacaaugcagcaaaaugaaaugccuuagaaaaagaguaacauuccagaaaacgguguaauuuauuuuucuuccuuaauugccccaucuguggaggauuucuuugcugaacaccacaucaaagguaagaugggaaugggacugugugcuggguugguuuucuaacaacgacuggcaucucuccccacccagccugcucaccagauggccauuccgcauacccugccagcugacuuuccuuuccaguuagaaacagucagccuucgacccgacaggggaaauaaugaguacuguucccccuuccucagaacauuuacauuuucuuuuugcuaucauucuuuauauacacuuguuuauuuuacggaaccgauugggagaagguagcauagugucauguuacuccugaauacuuuagcauguaucuccuaagaauauucucuuguggaagagguuccaagagguuaaccuugguacaguauucuguauuauacaguccauauucaaauuuccccaacuguccccacaaacugucuuuuacaacuuuuuuuucugaucuaggauauauucaauaagcggguaucgcauuucguugucaugucuguuuagcuccaaaaauauuuacauuuagcaaguguuuucuaaggagaauuccuaaacucaaggcucgccuucccuuucuauuucucuuaagaguucacccggaggaccagcagggugacgcacagcuucuccaagaaacuggcuugcagaccuggggggagggacacugaguacaguucuaggaguggccaccccacagucacugagaucaggcuuuccagguaacuaaguccuuaguugcaucaggcagacuucaucuguaacugagggguuaaaaaaaaauuacaagugguuuuauaucauagggaaagagguuuuuuuucuguuuuguauuacauuucaacuuuuauuuuagauucaggggguacauguguagguuuguuacaaaggcauauugucugaugcugagauuuggaguauaauugaaccccucacccagauagugagcacagcauccaauagggaguuuuucaacccuccucccucccuaucuuguaguccccagugucugugguuccccucuuuauguccauauguacccaauuuuuagcucccacuuauaagugagaacaugcaguauuugguuguuucugcaucaauuugcucaagauaaugguccagcugcauccauauugcuggaaaggauaugauuuuguucuuuuuuaugguggcuguguaguauuccauggugucuauguaucacauuuucuuuauccaacccacuguugaugagcacguagguugauuccaugucuuugcuauugugaauaaugcugcagugaacauaaaagugcauguggcuuuuugguagaacaauuuaucuuccuuuggguauauacccaggaaugggauuacugggucaaaugguaguucaauuuuugguucuuucagaaaucuccaaacugcguugcacaguggcugaacuaauuugcauucccaccaacaauguaugaacguucccuuucagauaaaaaguuuaaaaguuuagauuaguuucugguccacugaaucaacugucuuggauuuaucacagggaucuucugcauuuaaaauagaagaggcaucaugcugaagagggaggggaagguccaaccuuacacuaaaacccuggauggaggauggggauggaugauugugauucauuuuuuccugguaagaauucacuuuuuucccccuuuccuauugccuaaaagcaggcuuucuggagaaaggcucagagcugccuacgaauaggaucacuuaggaaaucuuuggcaucugaguggaggggugggcaggaacaaggccaggagcugccaaaaacugcuaaagucagaggcccaugccgaacccaggagaaaguugaaaaugccccuagagcaaaagcagaaauguuccugggcugggugugggggcucacaccuauaaucccagcacuuugggaggccuagguguguggaucacuugaagucaggaguucgagaccagccuagcuaacauggugaaacccgaucacuacaaaaauacaaaaauuagcugagugcaguggcaugcaccuguagucccagcuacuugggaggcugaggcaggagaauugcuugaaaucaggagguggagacugaagugagccaagaucgugccacugcacugcagccuaggcaaccaugagagacucucucaaaacaaacaaacagaaguguuccugaauccagucaucuacucuuccuaucaucucuuaaaccugagaaugcucagucacaaucagcaguucuguacuggcugcauggcaauuaggguuuggggacaaucauacuuuuaaccaucccaaaaguagcacugggaggugcuaaaaagugcucugggggugaucuccccaguucagcccagcauagauagaacacugugggcacagccccuucuaccgauaagggguggggacauuuccucuguuuggccugcugucuacuucccaauccauccccacuaacuauaguuuaugcuaucuauauuuccgauguguuuggaaagggaggacaaggauuuugaagggggagccugauucuucuccuuuacccauaagcaacuagacgaggcauuccauuuuuuaaauuaacuucuuucccucacccucccagggguugaggugugagaguggugaucugcaucaucagcaugcccauuccagaauguuggugaaccccagcuaugccccacacagcucuccagagaguggcaccagcugcacaauucuuaaguguuuccagaguucuauuaacuuugagaugcacucaaaaaaaaacacccuuuucuugccgacacuuccccccuacucagcccuacaguaagcagcucacggggaaagguagcacaggucuuggugccuucuaauaauccuauaguucacaugcagauaucuaagaauucuacaaauaggauggugggaaaacaucaggccuccucccucgugcuagacaagauaggggcagagguccccagccaggauuuauguaauacaaaacucuuaacacauaauaguaguacuugcuaaacauuagcuucaguacuaaacaaucucauuuucccccuagaaauguuacuaauagggaaacuaaaggaugcccuaagucugagagcccuuccuggggcugggccaccccccuaaaucauaggcuuugcagaauaggcacuguuggugaggaucucuaauucuccugccuuucuccccaguaaccacccugacuuuuucuacauuauccucugaggauagaaugguuuuugaucaauuuaguugcugauaggaaaaaccaucuaauaaccagauuaauaaacacugucccacuuuuagggugugauacugcuuacuaagcacaaaaaaugcacuggauccucaaaauguuaacaauaaauucaggggcuaaucccccacaguuguaauguggauacuugaaugacugugcuuuuguuucuguaugacuuacaacuguucuuuucuauaacagaugagcuccuaguaagugaaaaauaacaauguucuuugggagcuuccuacuuaaaaaaagagagagagauucauucuaaccaacuuaccacacuuuauauauuuguaugacuguuuucuguauucagucugucuuacuagacugaauguuccaugggggcagggucuaugucugcauugcucaugaguauaugcucauuaccguaagcccagugccaguauacagccuggaacauaguaggcacucaguaaaauacuguugguggauggauagauggauggaugaauugauagcugcacacauuuaugaauaaacaaauaaggaugaaggggauaguugaugaaacugaagagaugagaauggcucuugaggcuaugagaagcuaaugagaaaaauuaagcagggaugugauagauuugcauuucagagaaaugugacgagcagaugcuacugagaggucaaauaggagagaaauaacaagacucuauugguuuagcaacaaagaaaucuaauaaccuugauaagagcuaguacaguggagcagugggggccaaaguuagugaacuuuaguuuucaguggaguagcagaaugacagaaaguggagauaccuaauagaccauuuuuuacagaaguuugccugugaaggucaggaggagcuagggugauacuagaaaaggacgcaggauaagaaguuguuauuagauaaaacuaacucugacaaagccuggugccuguauugaaaauaagucacugaggcugauccaacuccuuucccagacaauaauuaaaaugaucuagugaggaagcucuuauuggagguggggugugggggaaguccugcuuaagguguuccugccagguucaacccaauuaacugcucuuaaaaacaaaaagaaaaugaggggacuggagaaguucuaggguuuuugcuuuauuuuggagugagccauuuacaauguaugacguggacucugguaacagaacuaaaacccaccaagcuuggucuaagacaugggauuauguagaauaaugcagauuuauguagucugcuaaauuaacuaaggaaaaaccuagaccuugggagagauuuuuaauaucuuugagucaaaacugaaacaaaguuggaagacuucaaguuaagggacgggaagcaugguaggugcaaaggcucugcccuuggucuucuugauacauaguggacacggacucaguuauuagagacaaguccuaaccauucacugcugcuacacgcagacaccaaggacagaccagagaugaaaagcucugaacugggggaccaguagcuagcuaaauuuagguagcuaagaauauagaggucaacauccucuagacaccagcacagaacccacguccauagaacaaaaggaaguuuacuuuacagaaugaugcacuguauuauuccuugcucaugagaggacacaaucaucacauuauuaugaacugagagaagaaagucuaagucauuugagaucuguguauauuuucuaaccuaauuucuagccugacagaagugccuuagaggaaaauuaugguuauaaauugccucaaugggggccugauaaaaugucuuuuuaacuuuugaauauauaguccuggcguuuauagcacucuucauucuaaauaaguuuuguuccuuuuaucaaaucagaaugggaaaaaguauauuaagagacuucuuccucaccacuaccacuuuugcaauuucugagcaucgccaguagugauggggugaaaagaagggggcaggucuugaccauuauuuaaaagcaggggcugagggagggaggugucuaagagaaagcacaucugucacucaaaugaauggguggaugguaccaauagaaaaaacugaaaagaguaggcauaggauaagggaaaugugaguuuauguuuggacaaguugaccagaaguuauaaagauaugguagacaauuaggagucugaagcucuugggaaagcagaauggaaaccacaguuaauuguuugaguguuaagugccaaauauuaaguacuuuaucagaauuuucucaauuaaucuucacagucuuaugagcuagguaauauuuucauccccaaugccgccucccccaucauaaaagcggaagcuuaacccaugugacgugcgaaguuguuugcccaaggucacgccccaguaggaagaacagccuggaugcaaguuaaggcagacugauugcagaacccuguucagcuacaccaccauaaguaugcaggugguaauuaaaaccuugagaguaaaugauuguccagggagcagauaucaagcgagaugaguacagaacuguaacaggcgggccgagaaaguggaauuaaugaaggggaaccuaaggcuuugugguucuuuuauuauuauuaauuuugagacaaggucucacugucgcccaggcuggagugcaguagugugaucacaacucaccguacccucgaccucccagguucagguguuccucccaccucacccucccagguagcugggacuacagguguuauaccacuacgcccagcuaauuuuuuguacuuuuuguagagacgggguuucgccauguugcccaggcuggucuugaacuccugggcucaagcgauccacccaccucggccucccaaaguacuaggauuauaggcaggagccuccaugcccagcugguuuugugguucauaagcaaugcauggccagguugaaagcagaaguggccuugaaaagccaacgcuacgaaaccccuggagacagagaguacaccugggcuuuacgagugaaugcaaacccuggcuagguuccccucuagaccccugugggauaaagcaugacuguuacuuaaaaacggaaagaaggaauagcacuuaacagccccccggcuaacuagaauucugagaaauaaaaguuaauacuccacagaaagaaaaccucaucuccaaagcagcaauucuaguggaguacagguaaggaagauuagguggggcagaaagaaaaggauggggccccuggcccaaccuuaagauggccacaaaucccaguuaauccaaaauuaagcaccccuuuucacucuugagugucucaauuuggaugauacauuuuauggucaaccuauuuauauaucuagugaaggaagguacucagcucagcagcagaguuaaaucaaaacuaaucuaagaacugacaggaauaauuauuccucuuuggacaaacacuuuucucccacaaagguaacuggaauuagcugucuuuaacagaugcuacugagggcaguaaaagagugccaggucuagagucagucuaaucuggguucaaaucucaguuccaguaccccuauuuuaagcaacuuuuuaccucucuaaacuucaauuuccugaucuuggaacugcuguugcaguuauaacugagaaaauuauuacagugacagagaucugaccuaaccaacuccauccauccugcuucuaacuuccaagcuguccuuguucauucccaugcguaggcugaacuaacuuugggggaaacuuaguugauagcuuaacuuugaaagagaaacuaacagccguuuccaaaaaaaaaaaaaaaaaaaaaaaaaaaccuccuuuuaacagcccuuuccaaaaaaaaaaaaaaacacuuccuuccugccuggggacuagauugccuuuguaggacuaacacauuagccauaagauuagaaauuaugguuuaggagucauacagcuggaggccacaagacugacccuccccaaauugcucgggggauaacaucacuauugugaaaccuaagaucagugcuugagauaauuugcaggcccugcauuugauggaucagcuggcaccacccagauuaauaaacuggcucaucugguugugggucccccuccacccuuccacccagaagugacucagcgcaaaagggcagcuuugauagaauuucaucucugacccaaccaaucagcacucccaacucacuggccucccacccaccaaauuauccuuaaaaacucugauccccaaaagcucggggaaacugauuggucuaauaaacuccagucucuugcacaaugggcucugugggaauaacucuuucucuauugcaauuccugucuugauaaaucaacuguaucuaggcagcaggcaagaugaacccacugggugguuuauuugguauaaauuauuugguacacaacauuggcaugccuauuccaaagccaugaaaugaggauuaaaugagauguuuccauuuaaaaugcuuagcuacuuuaaaaggaaugacuucccccauaaaauauaagauguauaaugaggcucaaccaauaaggcaaacugguaaauaguaguaagcugagggaaucauaacuucuaguagccguaauugccucuguaauggcucacuuaccaccugaguuggacucuggucugcuuugauuuaggugaauguguuugugauggggaugaccaagacuuuugcaauuuucuuuguggucuuucaagaagaguuugaaggcaccucagagcaaauugguuggauuggauccaucaugucaucucuucguuuuugugcagguauaaagcuggcaauaagcuugcugucuaaggagaagaaccacaaagggcaauuccaagauuccuauucaagacugaauaggaauucaguuucuaaaauuaagguucauuuacugauauguaacgcugagaaaguaaggaauugcaauauuuagcuuccacuugacuuaguaacaaaguugggagaaucagcauucaaacaaagaaagcugaggaauuauuaaaugccaugauucaguauuucaugcauugccuuuccagucuguuaaugccuuaauauagguucaaugaguaaggcccucaaccuggaaguuaggccaugaaguucuaguuaucuaaguauauucaaaacaauuuuauuuauuuuuuuuuuuugagacacagucucacucuguugcccagguuggagugcaguggugcuaucucggcucacugcaaccucugccucccagguucaagcaacucuccugcuucagccucccaacuagcugggauuacaggcgcccgccaccaugccuggcuaauuuuuguauuuuuaguagagaugggguuucaccauguuggccaggcuggucucaaacuccagaccucaggugaucugcccaccuuggccucccaaaguaugggauuaaagagccacggcguccagccucaaaacaaauuauagaaccaauuucuucuccuuuuauuuggagcuguaacaggguggaagagcagauaagugauucaaccuuauucuagucauugaccacuagaugcaaucuuuuuguggagguucuauaaugcauuucaaaucaccuccccuccaaaccuuacuuacaaucaacauuuccuuuuaaacuccccuuccaaaaacuaaaauaguguggcacuagugauauuaagaaacccgauaugaaaaucuuuuuugaagaauacguaauacuucaaaguaaacaguccucuugcuuuccuugucauucauuuaaaucgccaucagaggauaagggaugccagaucauuauuuaccuaagaauugccuuucuuucuucucuuaagguccccugguugcuauuauuugugacauacuuggagagaaaacuaccuccauucuuggggcuuucguuguuacugguggauaucugaucagcagcugggccacaaguauuccuuuucuuugugugacuaugggacuucuacccggugaguccauuguaauuaugugaccauagaaggccaggagugguggcucacacuuguaauccuagcacuuugggaggccaaaguggguggaucgcuugaguccaguucgagaccagccugggcaacauggugaaacccugucucuacuaaaaauacaaaaauuagccaggccagugguggcacaugccuguagucccagcuauuugggaagcugaggugggaggauugcuugagcccaggaagcugaggcuguugugagccgagauugugccacugcacuccagucugggugacaaagugagacccugucucaaaauauguguguguguguguguauguauauaugcauccauccauagaagauagaagauggaacaggacucuucccuucuacuguuccuggguccaaaaggccuagcuguauuaucucggauccaggagauuaucuuuucuguuaccaagccacuuaauguaagagugauucuaaacuauuacguuuuucuuuuagguuuggguucugcuuucuuauaccaaguggcugcugugguaacuaccaaauacuucaaaaaacgauuggcucuuucuacagcuauugcccguucugggaugggacugacuuuucuuuuggcacccuuuacaaaauuccugauagaucuguaugacuggacagguacgucauucuaaguuuauuuacuaucaacugugcaagauuuagcguucagcuuucucccuuugagaaauggaaguuaagacuuucagagcaaucgauuucacaagguauugcaagagaggaaaugagcauaauuucuaaaguaaacaugcuucucuucccuggagaauacauacgcaaaagagaucuugaaauacuugcaggcuuugccagcucacacaagcaacucagaauucaccauagggcucaaugucugaggagauggagggcauuccgugcagcuggaaacagcuugcaguaaaagcgauacuucuggggaaauaaggcuucccccuuccccccccgcccccgccccaucaaaaacccucacuuuucccauuuucccuuuaagacaaaaaucugcauuuaaaaaaacuccucccccaucggacucacugaaauagauaaaaaagaaacaaauacuuugguaaaaagaguauguuccuuaagaguuuauguaaugucaacuauaaauuuucacaaaugaauaaaaaaugauucaacucacaauuuucuuuguaacuaagacauuuggauuaaaauaauccuaaacuacuggaaaaaauacauguauauguguguauucauaugccuauugcuaucuacauggcaguuuuguugaaucuuuccuaacuauucaguagucucauggugaaugggaccagcugacaaauccaugauaggauagcagaaccuauagcccauucuaucuuuagaagcaccauacaaaucauagcuuugaucaggacacgcugaaugcaagcaacuauucagcuccaaaggcaagauuagcaucugucaucuuuuaaggaagaucuaaaaaaugucaugggaugaaaggcuauccaugccuuccucccucccgcugcuuuuuuuuuuuuuuugagacaggcucucucgcuuugucauucaggcuggagugcuguggcaugauaccggcucacugcaaccuccaccucccaggcuaagcgauccucccaccucagccucccaaguaacugggacuacaggugcacaccaccacaucaauuaauuuuuuuguauuuuuuguagagacagguuuucaccauguugcccaggcugguccugaacuccugggcucaagugaucugccugccucagccucccaaaaugcuaggacuacagguaugagccauagcaccuggccagcuguccccucuucuaaggcuguuuccaaaugauuucuuucaucuuauucuauuuuuucuguaccuaaaucuguacucucacuucaggauauuuaaauuuucuauuuaauuuuuuagcauuugaaacacucuccucucccuccaaaaacuugcccccccuaccccccuuaacacaaauaaccaccaucucuccuuuuaucccaucuauuggugcagcuuucugguuuucuaucuccaaagcacuacauuauuacacggauacagcaguguauaugacuaauaagucaaaucggagacaaaguaauguuuucaagaauuaaugggcuaugccaguggggccucuucugagccuaugaacacaaagcaguauugugaacugaaaggcuauuuuuaauugcucaaucucucccuauuuaggagcccuuauauuauuuggagcuaucgcauugaauuuggugccuucuaguaugcucuuaagacccauccauaucaaaagugagaacaauucugguauuaaagauaaaggcagcaguuugucugcacaugguccagaggcacaugcaacagaaacacacugccaugagacagaagagucuaccaucaaggacaguacuacgcagaaggcuggacuaccuagcaaaaauuuaacagucucacaaaaucaaagugaagaguucuacaaugggccuaacaggaacagacuguuauuaaagagugaugaagaaagugauaagguuauuucguggagcugcaaacaacuguuugacauuucucucuuuagaaauccuuucuucuacauauuuacuuggucuuuucuccucagucaguuagcauacuucaucccuaccuuucaccugguagccagagccaaaacacuggggauugacaucauggaugccucuuaccuuguuucuguagcagguaagaaagccuacaucagccuccuacccaaaaggaaagaucaacuuaauuuuacaagcuuauuacauuuuaauaaaaagcuaaagaaaaacaaaagaggaauuguagaagggccagagaaaguaaaauuuuugaggcuagauggagcaccugggcauuucccaggaagagaucucugucacugcacacaggcuccccuacuagacaguggacccuaaaucaagucuuauucaucuucauauaacaguguuugacacaguagacauuauuuauuggauaaaugcggaaauuucaaaaagcugaugcucaauggcaauagccacuauaaggagcagaaaaccccagguagacagcacagugcaguggcucaaggauugguucuggagcaagacuucccuggcucaaccuccugcucuguauuucuuaacugugggaacuucagcaaguuacuuugcuucauggugccuucauuuccucaucuguaauauagggauaauaguaucuacccucauaagauugucaggaucaaaaaagcaaugcauguagaguuuagaauagugccuggccuguaguaagcauucaauaauguuuuauuauuuguagcuaaggaauuuuccccuugaacucauaguaaaacagauaaauaugacuuuuaaggcuagucacuuauggacugucugauauuuaaaauaaguuaaaauguaaauuaaaaguaaaaacaacuggccgggcgugguggcucacgccuguaaucccagcacuuugggaggccgaggcagguggaucaugaggccaggagaucaagaccauccuagcuaacguggugaaaccccaucucuacuaaaaauacaaaaaauuagccaggcgugguugcgggcgccuguaguagcagcuauucaggaggcugaggcaggagaauggcaugaacccgggaggcggagcuugcagugagccgagaaugcaccacugcacuccagccugggugacggagcgugacuccguuucaaaaaauaauaauaaaauaaaaauaaauaaauaaauaaaaacaacuauuuuaguugacuacucauaaaacuguuuaaagacagaaugcuugaucuagaagagggauuuggccaggugcagugguccaaaauacaaucucccauuuccaaacuuccuacauauuuucaaauuaagcauaaacuuuggaggacuuacuuccuaaaacuucguaugcaauuaugagucccaacaucuccuuuuuuaacagaagacuuauuuauacuccaaucuucuacaauaugacuuccccaagacacugaccugaaggucuauuugucuuuuagaaacuucauuuucucacuugcaggaccucuuagacgaagagacugcauggccuucugugcccaggguccucuguaaccagggauuaccacuguagugacguaagcuuuccaaacacaaucagaaaaaaacacuaacuacaugggucuucuacacuacucuagcggagacuuuuuugcuauuuuauuaaauguauuuggaauagguaaguauauaauagagcuuacugguacacaaaucaaaucauuuuuuuccucacauauccuggccucaggaugagaucauauuacuugggaaaugaugcuguaugcauucacauuuuucaaagggaccaggaaaauaaaaagauuucaauauuguuccagguauccuugagacggucagucagauuauuucuggauggguugcugaucaaaacuggauuaagaaguaucauuaccacaagucuuaccucauccucugcggcaucacuaaccugcuugcuccuuuagccaccacauuuccacuacuuaugaccuacaccaucugcuuugccaucuuugcuggugguuaccuggcauugauacugccuguacuggugaguagacacacucauuaacauuguuaaaccauuuaguaaaagcaaguaucaguaacaaucuccccaaaauacguauuuuguauuaauuuuguaacuuaaaaaaucauuucaaagaccuuagaaacucugcagcuauauccuguccaguuacucaucuugugugugaguggggagggauggugagaggacuauccacaugggacaggaauaaaauuaaagcaaaaaagggaucagcaggauuccuuuuuacuuaucagucuccuagauuaggauuguguucacgucucuccuucagcuccagaaacuuguuuggcuccuuuuaagacacaaucuuaaagaaaagaucccugagaacacuucaagagaaaaaaggauuucccgaccagugugguuucucucuugaaguuauugccuugguccuguguacuuucacagggccauuguuuuauacuuccucuccauuuuuacccuaaacugacgcaaaguccucgacccagauggaaccaaaauacuuauacaaacacuucaguguucugggaaccccugggagucucauggguucuccuuagaaccaggaccuaaacaugcuggaacagauuuccuagaaaacuucuguucuaucaauauuagcguaagugcuacaggauauuauaugaagugcaggcaaaaaucaagcuuccuaaagcugaaauuaacuccuugugauaucugauuacuuacaaaccaaugguugauacuuagccuuagaggauucaagaauaucaccgucuggccgggcgugguggcucacaccuguaaucccagcacuuugggaggcagaggcagguggaucgcuugagcucaggaguuggagaccagccugggcaacauggugaaacuccgucucuacaaaaaauaaaaaaauuagccaggugugguggcacgcaccuguggucccagcuacuuggaaguaacugggaggaucgcuugagccugggagguggagguugcagugagccaagaucacaccacugcacuccacucugggugacagagugaaacccugucucaaaaagaauaucacuauuaauucauauuguaaauaucauuuccuaauaagagaaaagcagcaagguuuggggaagaaaaaguacccaugaaccaccuaaaaaauuaaaaugaaaauaaaaacuuguguucuuacuaauaaacugaaaacacugccugccuagcauuuacuguucgcuauuaguccucagcucuuucacaauauugggggcaaaaagccaaccaacucaccccagaagucacuguucauagcuugagaugauauaaauaguauuugucccuuuuaggcauaggucucuauagaauuucacccuuaauauggcuaacacugaauucuaauuccuacagguugaucuguguaggaauucuacaguaaacagguuuuugggacuugccaguuucuuugcugggauggcuguccuuucuggaccaccuauagcagguaacaccuucaccacauucugaacaaauuucaauagcaauaaaagagaaaaacugauccaggauuaaugguaacauguaaugaugguaucagguuaaaagaaacagauuauuucugcuuuuccuauaucuacucacuccaccaccaaugcaggaaaaucugaaggcucagauucuuguauuaucuuaagaugugccuuaagcagauucuuauauucuugggaguuguagggcagacacuggaucuaugucuacuugucuggggagacaauccagaguuuuuucagagccucaaagacccaugaugcuuuaaaaaaaaaaaaaaaaggcugggagcaauugcucacgccuguaauucuagcacucugggaggccaaggcggggguaucacuugagcugagggguucaagaccagccugggcaacagacagaccuugucucuauaaaauaaaaaacaaaacaaaacaaaacaaaaaaaacaaugaacgacuagcaucuuguaucuaaacaugagucacuuuuauagagcuugaaagguauaggccugacacuuuuguucuucugaugugccauauggauguccaagauugccuguuaucuguuaaguaucucucuuugaaaagaggcccuucaaauugucaguaccaaggaugggaggauacuuggccuaaaggccccaucucuauggagaggauauugggggcuguuggaaauuauuauauacaaguacaguaaacauuuggggaguucugauauguaaguuaacuuuaagauucaaauuguaguuuuacauucacuuuuuaccuaauuagacauucuguacuugcugaauauuuaaucuaauacuauuacaaacuugaauacucacacagaaguauuucuagggaacagaccuaaacuuuaguuucucacacaccacagguucucaauguauuucaguguacaaauuacuaugacauuucuaaucauccacauaaaggaacuuagccuaaaacuuacuuuugcuucuuuuaguccugaaguaagacagaagggaguuaaucuuguccuacuaucauuuuuuaaaaaauuaaguuucauaaugauguuaaguuuauaccucuuaagacugagaaaggggccaggcgcaguggcucaugccuguaaucccagcacuuugggagguccaaguggguggaucaccugaggucaggaguucgagaccagccuggccaccauggugaaacccggucucuacuaaaaauacaaaaauuagccgaguguaauggcagaugccuauaaucccagcuaacuugggaggcugaggcaggagaauugcuugaacccgggggacagagguugcagugagccgacuucacuuugcaccacuucacuccagccugggcaacagagcgagacuucaucucaaaaaaagacucagaaaaaguaaauauuaaaagaaggagacuauaaacuaaggauaacaagaauuguuacugagagggccuggcauaguagcucacgccuauaaucccagcacuuagggaggccaaggugggaggauugugugaguccaggaguuccagaccagccuggacaagauagugaggcaccaucucuacaaaaaaauuuuaaaaaucagccaggugugauggugcauaccuguagucccagcuacacggcaggcugaggcaggaggauugcuugagcccaggaaugagugcagugagccuugaucaugccacugcacucuagccugggugacagagugagaccccaucucaaaaaaaaaaaaaaaaaaaauuauuacugggaacaaaaaauaugccaauagcugagguucaauuaaggcauacuuauucuaaagaaaaaauuuacauaaauaugcaaccaacucucuuauuugcauuuaugaacacaccccuucccaugcuaucuaacacuuagccuacguuucauaccuggaaagcaggcuagaauuauaaaguaaagcccagaauuuuuauauagggacuaguaaaaggaggccaaauaccagaaguaccuugcacaacuacucuauggcuaguacccaggacagugaaauacagaaaacagagcucaaacacaguuugcugaugcauuuuuuucaaucuugauccuucuucauuggcugucccaguagugccuuggaauuuuucaagccuauugggccaaaaguacaaggaaguaacaaauacaagggcauagaauaucuuacucaaaugaaaaagacaagcaacaaaacuauaacauguuuaauguccuaugugucuuuguauacuucuuaaaauaaaauguuuaaauaguucaauacuccgagaagacaagucaaauuucugaagaccauuaccugaaaagaaaaagcuacagguauauaugugaguucugaaauaaauuuguugggucaugaucucauuguuuuuauggaaaaagauagacuaccacagagcagauuaaaaaagaguauaucacuuuauuuucaaacuuuuauuucauacacacacacacaccuauguaauguaaaauaugagauauaaaauacuucugucaaugagacaaaaaaaaguuaacaagcuuuuguuagcccaaauccaguauagccuagcaccauacgugaggauaaaaaacucauaauauauuuuuuacccauuaauucagagacuauuacuuaggcagccauacauucuguaagcucuacaaaaaagucaaaggaagcuauaagguuguugcuaaagcuuauguagaaauuuuuaguccaggacgugcuccuaguaucuuaaacaagauucuaacugcaaugcugugccauuagccaucuguugaagaaagaaaucacaggaaagcuuuguuccucuaagucauuccuccgugaaaugacagaggacauuacaaaggccauuagauuuguuccuaacuucugacuccagcagcaacuaccaaagaaacaucagaaauguugauguacagaucaacucaguucuugcagguguaggcagaacugagucuuuaauugaaucaaaagucuuuaauugaauuuacuggugaugaaacauuaaauucucaaccaaacuuagaucuucagaacuguaugagauucucauuuuuuacuuaccuaaaucuguuauuaccaaauugcaaaaguugaaacuccuauaaaagaguauaggcauuuuuaauuaggaaucuaacaaaaguaaaacuuuucauaauaaucuucagucaaaacacuaguuaaaaaugguaacauuucagccaugcucuuguagaucacacagacaaaaaaagguaacacauuacaugaacaauauuucucuccuuccuguauaaaaauaaaaaagaaaacaauauuaguucuaugcaacauauuuuaauaauucaaggaaagcaaaaauagcacaagaaauucauagaaccauauucuuauuuuuuuuuaauauagagaauacgggcaagaaaauuacacaccucaauugcuuacauuucuuucaugaauuuaagaaagcaacaaaauucuuuauaagaucuuugcugaaacugagagauugaaaggaugaaaguuaaaacuuaccgguccccacaccuccucuguaagacaaugcccugcucacccacuccaccccaaagucccuucuuauuccaauacucagugacaauuucaauuuuaauuaaaaaauauggccugcauuagaguaggugaguuuuaggauuguuccagguucccugaccaggguggugaguagaccuacguguaggccaaaugucacacagcucauccaaacccaacugcugcuuuugcgguuagauggcacccagagccacacacuggcacaaagauggaagccuuggaaggcuguggaaaaaugagaaguauugauauuuuaagccuuauuucucacagaccccuguuaacagaaguaaaccugcaaaaagcaauauaaauacaaaaauagugccuugggcagaaaagcaaguauaucuaaucacauucuccaacauacagggcagauguaagcuacuuacaugaaauuccuacucuuccauucaaggcauuugacaugaaagcucaaaaugcucaaggcucaguuucauuuuaaaauaaaaccaaaggaccauauuaguugccuauaaaauaaaaacugaaugcaguuccccacuucuccauauuccccucuuucccaacugacaaaugcauacaguaugcuaauauacauauauaaucauuuauuuaaucacaaauaucuucugaaaacucccuaaaacacuauaaguaauuauuugauuacuugguaaucaagugacuaucaaauaaauauuugaaacuuagcauucauucaauaacugucaagcaaaucacuagcauaguacuguuauaugcuaugugggacacacagaagauaaaaguuacucacaguccucacaugacucaccaggucgugaaacauuauucacucugccacauacacugccaggacuucauacuaagaacagucuagaaccucuacaacugugaauuauuagaaucuguauccuucuucuacuucauuaacugaacaccugauuaagccacuguagcccaucaccuuauuuucuuaccuuuaauugaagacauucugaguugugggauaauaaaaugacuuuaaaauauguugaaguuuaagucaaggcagguauuucacgaguauuuuucccccaccaagcccuagaaaaaucauuucuaacgccaaauaguuguaagucaauuguacuccagcauauguuaaagucagcuagcuccuaaagaaguaugucucucucuauuauuuaccgaucucaucagaaauaccauggagugagacugguaauuuugcaccaagucuauuuguguuuuauggaaaaagguaagugcuaaaauauauauucauucaucuaagcucaucucugucccauuaucacagaaaagucaucuccucaugaaaugauaggucauuuccuaucuaucccauccucaauuucagauacaguauuaaacaaaaauuccaucugguccucgcuccacuauuaccaauccugaccucuagaguuuuaucagucaccuuggccuaucaauugcgaauuucucuauggccuaaaauuuuacuuggaaaacacacucuggagguugggggugaguggggagaaagugagaaggcagagcaaagcccuguccucuauauguucuguggggggaaaaaaaggcuaaaaaaaaguaaauauuuuauguaucuagugauuauuuuccccauaaacuacaaagccuuacagauuuuuacuuugauucaguuuuccuaagauugaugaauaccuacaaagcaucaaaaauaaauuccaaauagcucucuauugugguuuaagaagaggaguucuucccuuuuauaacacacuuugcaaggccaaagaauccagcuuccacauccuaauagacaccacaauccuuuuaauaaaaauuacagcacagagcuaauacuugaagcauuccuaguaaaucuuauugcaaauuucuaucaaggaaacuuuacugaguucccaucuuaaaaggcccugaaauuuaaauuugcuaagccaaguuucccaagauuuuuccgaucauggcacauauagaaaauauuugcacaauacacccaaaguaaaagaacaagauugccaauagccagcugguggcuccaguggccccagggaugagaggaaaauugucuuugcacaccuuggaaauuugccacuaugcuacaacccaaccacaggaguucugauucaacucugaccagucaccugcagaauuuucaaccacuuuagaacuagcaccaagaaacuuuggaauuaaggaccuucuaaguuuuuuguuuguuuuuuguuuugagauggagucucccucugucacccaggcuggagugcaguggugcaaucuuggcucacuuauccagguucaagugauucucccaccucagccuccugaguagcugggacuacaggcgugugccaccaugccuggcuaauuuuuucuauuuuuaguagagaugggauucaccauuuugcccaggcuggucucgaacuacugagcucaagcaauccgcccacaucggccucccaaagugcugggauuacaggugugagccacugcacccggccauguuaaguuucaauaagaugaccaauaguaaacuuacauaguaauccuaauaaaaaugauucaugacugggcacaguggcucacgccuguaaucccagcacuuugggaggcugaggcagguagaucacgaggucaagaguucaagaccagcuugaccaacauagugaaaccccgucucuacuaaaaauacaaaaauuagcugggcguaguggugugcaccuguaaucccagcuacuugggagguuggggcaggagaaucgcuuaaacccaggaggaggagguugcagugagccgagauugcaccacugcauuucagccugggcgacagggcgagacuccaucucaaaaaaaaaaaaaaaagauucauaacuuagcuuaacaaucaaguucugagauucugagaugucugaagguaugaauacuuuuuagacaggaugcuaaauuccuuuugaaacauguauggccuaacacauaaaauaauguggaauaguuuuaaaauauuaacacuuaaaaaaugaguucagaauccuauauuaaauaucuaacuugaaugauuauucuuauuccuuuuuaacugacuguaaaaaaaaugguuugcaccaguauuuaaagaagcucagcccaaucuuccuauuuguuuuaaauuaucacaggaaacauuacuagacauuucugccuaaaacaaguccuauagccauagauauaagaaaagagucuggacuaguaacuucaaauacaauaauuauuauuguuaaauaauaauuuuacugugcguaagaaucaacugagugccacccaggauggaguuaugcuugacagaauccagugaaucugcauuauuaacaugcaucucagguaaaucugacgcagguagccuguagacaccaaggaaaugcuuacagaggucuucagcuuaauaauucugcaucagcugccaguuuauuccucagagugcuggcuacauacaguaauaccaggcauagagugaacauucagauacaugcacauuauccuagauuauaacugguauguaaucuugucuuucucugacguucacaaugcuuaugcuaugaccacaaaggaaucuagucuuuugaaugucaacuuaugugugugcuuccauuuaaaauggugagaauacaguggcuucugaacuaucaacaauacuuucuuuuaaaaauauuuacuuggcugggcgcaguggcucacgccuguaaucccagcacuuugggaggccgaggcgggcagaucacgaggucaggagaucgagaccauccuggcuaacauggugaaacccugucucuacuaaaaauacaaaaaauuagccgggcacgguggcggacgccuauggucccagcuacucgggaggcugagacaggagaauggugugaauccgggaggcggagcugggagugaguggagauugcgccacugcacuccagccugggcaacagagugagauuccucucaaaaaaaacaaaaauuuacuuagaagcauuaaaccguuuaggguccgaagugcaucugaacagauuuuucauccuguuaccaaaaaaauacagagaucuaauaaaaucagacacucguucucucucccuauauauauauauuuuaaauuuuugagacaggcucucccucuguugcccaggcuggagggcagugacacaaucacagcucacuguagccucaaccuccugggcucaagugauccucccaacucagccuccugaguagcugggacuacaggcaugugccaugacaccuggcuuuuuuuucuuuaacuuuuucuuuauucuuuuccaauauuuuucuaaauuuaauuuuaauuuuugauagaauagggacaaagucugacuguguugcccaggcuggucuugaacuccuaagcucaagucauccuucuaccuuggccucccaaagugcuaagauuauaggcaugagccgucacgccuggccaacacccagcuaauuuauuacuucuuuuuuguagagauagggucucaccacauugcccagucuggccuugaacucuugggcucaagugaucugccugccuuggccuuccaaagugcuaggauuacaggcaugagccacugugccuggccaauccuuuuacuuucagcaguagagaauggcuaguuauuccaaucaaauaaaguagauguuucaauagcaacgaagcucaaaacuuaacuaaccuaguagccacuuaaauauaagcuugauuuuaacaacuaauacuuucauaaaauaaucagucauauguauauuucugcauccuacauuuuaccucauauuugcuaguauaaacagcauccuaaaacuaaauacucagcuguauacuauuauccuauugaauggcaauuggaucuuaauuuagaaucuaaaaaauacaaauaucucaaugaucaaauaugacugggagaaacaaauuuacaacaauuauuucauccagguuuuauuucaccuaauuuugcauggaaauacauagaaauaauucuaaaacaugcuaaacaauuccccgcccugguaagaaaauauauuaaauauagucaugaguuauuuaacagggauacauucugagaaauguguuagaugauuucauugucauaugaacaguauaccuacacacaccuaggcuauaugguagagccuauugcuccuaggcuacaaaucuauacagcauguuacugugcugaguacuguaggcaacuguaucuaaacauagaaagauacucguguauccaaacaaaguauucauguaucuaaacauagauacaguaaaaaugcauaucauaaccucaugagguuuguccuguuaugugccacaugacuauauuuuaauacuuaauguuucagaaacagcauucuaagagugagugaaauccaagcacuuuagaaggcugaggcaggcggaucaccugagaucaggaguuugagaccaaccuggccaacauggcgaaaccccaucucuacuaaaaauacaaaaaaaugagccggguguggugguaggcaccuauaaucccagcaacucaugaggcugaggcaagagaaucacuugaaccugcgggucggagguugcagugagccgagauugcgcaacucacuccagccugggcaacagagcgaggcucugucucaaaaaacaaaaaaaaaagugagugagugagagagagagaaagaguguguguguguguguguguguguguguguguaaaaugaaaggcuuggucggcaugauggcucacaccuguaaucccagcacuuugggaggccaaugcaggaggaugacuuggggccaggaauuugagacuagcguggguaacuuagauccagucucuacaagaaauuuuaaaaaaagaaaagaaaagaaagaaaaggcuuauaaacaguuuuucucuucaauccauuuuuacuauuuuuagcugugcuaucugacauuuuaguagcacugucuaccuuuuuguccaagaauuccuagucuuuccccaggguguuacuucugagaccacuauuuuauaauucacagguuuuauauauacacauauacauacacagacacauacacucuaauacauuugcuguguuggcaggacuaaggcaagaaugacaagggaugggaggguaaggacugcuaccuucuauacuccuuccuuucuagaaaugucuacaagaguucagagacuagucaccuauuucuuagagaucuauaggucaauaacaaucaacauaacacaaagacuuguccaguuguuuucacuccaguaacuccaagaaacauuuaauagaggucacuaaucaaacaggagucaguaaguaaaaagcaacuuaaaguuaguugaacuuaagagguuauaaaacauucuauucacuuauuuuuuacauuaacaauaggaaacacagagcuauaaaacaaaaauaaauuaagucaauuuuuucuggucugcuugucucaucuccucuguguccauaacagaacaaagaggagaugaaacaagcagaccagaagaaaaaggugggggaggguauacucuacauauccagugaggcaucaugaucuaagauagaagggaaaaaucaaagacacaauguaagcuccaugagggcagauauuuucaucuauuuuguucagggguauaucccugaaacccagaccugugcugccauacagcacugaaauuucuugaauaagugaucagauauaauauacauacuauacuuuggaaaagaacuucucaaagugaggucaacagacccccagagauccuugagacccuuuaggaaguccaggaggccaaaauuauugucaugauaauacuaaggacauuauuugcuuuuuucaguguugacuuuugcaaugaugugccuuagcauaaauauucuuugcuaucaccuacucaguuaaaaaaaaaaaagaaaaaaaaguguuucgcuuaaguuuuaguaugugccauuagccaaaagacuuugaagacccuccaacuuaugcuuuuaaaaagcacuuaggaccaggugcaguggcucacgcuuauaaucccagcacuuugggaggccgagguaggcggaucacuggaggucaggaguucaagaccacccuggccaacauggcgaaacuccgucucuacuaaaaacacaaaaauuagccgggugugguggcgggcaccuguaaucccagcuacuugggaggcugaggcaggagaacugcuugaacccaggagguggagguugcaguaagcaaagcagagaucgugccacuacaccacuccaaccugggugacagagcaagccucugucucaaaaaaaaaaaaaaaaaaaaagcauuuagauuucaggggggaacuugucauuguuuaacccacgugaucaagcagucaguuccuucucauaucuucugauagccuccugcaccuucccuucauagcacuuaucacauaucauuuaugugguugguaccuaucuccccacuaaaguucugugagggcaaggaccguaucuguuuuggcucacuaguguauccucaacaccuagcaauauuaacaggaauauaguaaguacucaagucuuuguuuaguaaaggaaaaaaaagaaaacugauuauuaucacuucuuuuuuucucuggaaaacaauaauuuaugauuauuuucuucauaauagcggccuucuaauaaaauucaugguaaaauaaaacgguauguguuccuaauuuucuccaacuuccacuguaagauuggagaugguguaagucccuaacucagguggagcugauucaacuucaucagugaaaaauagggcagcuaagaagcuucacuaaguucaaaugggucacaauacaggaggcuccuugcuuugaggagcuauucauggcugagaguuacuaauggcaaaauuuccuucccuaacagaaaucauuccuuccuuccaggcugguuauaugauuauacccagacauacaauggcucuuucuacuucucuggcauaugcuaucuccucucuucaguuuccuuuuuuuuuguaccauuggccgaaagauggaaaaacagucugaccugaaagaaagaagacugcaaucaagugagagcuaaacaaaagaaaaccuaaacuaaugucauuggaaacaaaagcuugaaagaaacacaucgcaucuacauuuguaacaugagaaggaaaacaauuuuuuuuuuuuuuuuuuugagacggagucucgcucuuucgcccaggcuggagugcaguggcgcaaucucggcucacuguaaucuccgccuccuggguucaagggauucuccugccucagccucccaaguagcugggacuacaggcacacgccaccacacccagcuaauuuuuuguauuuuuaguagaggcgggguuucaccauguuagccaggauggucuccaucuccugaccucgugauccgcccgccuuguccuccaaagugcugggauuacaggcaugagccacugggcgcggccagauaaguuuuuaagguuccuucuugcuuuagcauucugagaaaugucuaauugguaguaagacaagaguaauagcaaccuguauuguuaguauuuaaccaaauaggcuaaaauuuuaaucagguaccuuauguauuaaauagaaaucggaauguaccauaauaaauccaaacucucaauuacgccaugguaauucagucacuaaaauauguaaagauagaaaauuuuuuaauuuaaagaagugugaaacauagccauugauugaucagaauucuggaaucugaauauuaaaaccuuacuuagugacuggaaugguauaugcucccuccaaaaguuuaucuuuguuuauugauuaaagguaauccuuacuuucuuuguauuacuuagguucuuaauuaaagguaauccuuacuuucuuuguauuacuuagguucuuaaauuucuaugauaaacauguauugcuaaauaauaaaaaguauauaaaaauugcuuuaaaaacuucuuuauuucaagaucaucugaacagcaauuuugcccaucaaagcguuauuuuucugcuacaucuaauuaacaaaauauucacacuaaauauugaaacgucucuuuacaagauuuacauga

SEQ ID NO: 13791 - RNA, 28343 nt, Homo sapiens
ucauguaaaucuuguaaagagacguuucaauauuuagugugaauauuuuguuaauuagauguagcagaaaaauaacgcuuugaugggcaaaauugcuguucagaugaucuugaaauaaagaaguuuuuaaagcaauuuuuauauacuuuuuauuauuuagcaauacauguuuaucauagaaauuuaagaaccuaaguaauacaaagaaaguaaggauuaccuuuaauuaagaaccuaaguaauacaaagaaaguaaggauuaccuuuaaucaauaaacaaagauaaacuuuuggagggagcauauaccauuccagucacuaaguaagguuuuaauauucagauuccagaauucugaucaaucaauggcuauguuucacacuucuuuaaauuaaaaaauuuucuaucuuuacauauuuuagugacugaauuaccauggcguaauugagaguuuggauuuauuaugguacauuccgauuucuauuuaauacauaagguaccugauuaaaauuuuagccuauuugguuaaauacuaacaauacagguugcuauuacucuugucuuacuaccaauuagacauuucucagaaugcuaaagcaagaaggaaccuuaaaaacuuaucuggccgcgcccaguggcucaugccuguaaucccagcacuuuggaggacaaggcgggcggaucacgaggucaggagauggagaccauccuggcuaacauggugaaaccccgccucuacuaaaaauacaaaaaauuagcugggugugguggcgugugccuguagucccagcuacuugggaggcugaggcaggagaaucccuugaacccaggaggcggagauuacagugagccgagauugcgccacugcacuccagccugggcgaaagagcgagacuccgucucaaaaaaaaaaaaaaaaaaauuguuuuccuucucauguuacaaauguagaugcgauguguuucuuucaagcuuuuguuuccaaugacauuaguuuagguuuucuuuuguuuagcucucacuugauugcagucuucuuucuuucaggucagacuguuuuuccaucuuucggccaaugguacaaaaaaaaaggaaacugaagagaggagauagcauaugccagagaaguagaaagagccauuguaugucuggguauaaucauauaaccagccuggaaggaaggaaugauuucuguuagggaaggaaauuuugccauuaguaacucucagccaugaauagcuccucaaagcaaggagccuccuguauugugacccauuugaacuuagugaagcuucuuagcugcccuauuuuucacugaugaaguugaaucagcuccaccugaguuagggacuuacaccaucuccaaucuuacaguggaaguuggagaaaauuaggaacacauaccguuuuauuuuaccaugaauuuuauuagaaggccgcuauuaugaagaaaauaaucauaaauuauuguuuuccagagaaaaaaagaagugauaauaaucaguuuucuuuuuuuuccuuuacuaaacaaagacuugaguacuuacuauauuccuguuaauauugcuagguguugaggauacacuagugagccaaaacagauacgguccuugcccucacagaacuuuaguggggagauagguaccaaccacauaaaugauaugugauaagugcuaugaagggaaggugcaggaggcuaucagaagauaugagaaggaacugacugcuugaucacguggguuaaacaaugacaaguuccccccugaaaucuaaaugcuuuuuuuuuuuuuuuuuuuuugagacagaggcuugcucugucacccagguuggagugguguaguggcacgaucucugcuuugcuuacugcaaccuccaccuccuggguucaagcaguucuccugccucagccucccaaguagcugggauuacaggugcccgccaccacacccggcuaauuuuuguguuuuuaguagagacggaguuucgccauguuggccaggguggucuugaacuccugaccuccagugauccgccuaccucggccucccaaagugcugggauuauaagcgugagccacugcaccugguccuaagugcuuuuuaaaagcauaaguuggagggucuucaaagucuuuuggcuaauggcacauacuaaaacuuaagcgaaacacuuuuuuuucuuuuuuuuuuuuaacugaguaggugauagcaaagaauauuuaugcuaaggcacaucauugcaaaagucaacacugaaaaaagcaaauaauguccuuaguauuaucaugacaauaauuuuggccuccuggacuuccuaaagggucucaaggaucucugggggucuguugaccucacuuugagaaguucuuuuccaaaguauaguauguauauuauaucugaucacuuauucaagaaauuucagugcuguauggcagcacaggucuggguuucagggauauaccccugaacaaaauagaugaaaauaucugcccucauggagcuuacauugugucuuugauuuuucccuucuaucuuagaucaugaugccucacuggauauguagaguauacccucccccaccuuuuucuucuggucugcuuguuucaucuccucuuuguucuguuauggacacagaggagaugagacaagcagaccagaaaaaauugacuuaauuuauuuuuguuuuauagcucuguguuuccuauuguuaauguaaaaaauaagugaauagaauguuuuauaaccucuuaaguucaacuaacuuuaaguugcuuuuuacuuacugacuccuguuugauuagugaccucuauuaaauguuucuuggaguuacuggagugaaaacaacuggacaagucuuuguguuauguugauuguuauugaccuauagaucucuaagaaauaggugacuagucucugaacucuuguagacauuucuagaaaggaaggaguauagaagguagcaguccuuacccucccaucccuugucauucuugccuuaguccugccaacacagcaaauguauuagaguguaugugucuguguauguauauguguauauauaaaaccugugaauuauaaaauaguggucucagaaguaacacccuggggaaagacuaggaauucuuggacaaaaagguagacagugcuacuaaaaugucagauagcacagcuaaaaauaguaaaaauggauugaagagaaaaacuguuuauaagccuuuucuuucuuuucuuuucuuuuuuuaaaauuucuuguagagacuggaucuaaguuacccacgcuagucucaaauuccuggccccaagucauccuccugcauuggccucccaaagugcugggauuacaggugugagccaucaugccgaccaagccuuucauuuuacacacacacacacacacacacacacacacacucuuucucucucucucacucacucacuuuuuuuuuuguuuuuugagacagagccucgcucuguugcccaggcuggagugaguugcgcaaucucggcucacugcaaccuccgacccgcagguucaagugauucucuugccucagccucaugaguugcugggauuauaggugccuaccaccacacccggcucauuuuuuuguauuuuuaguagagaugggguuucgccauguuggccagguuggucucaaacuccugaucucaggugauccgccugccucagccuucuaaagugcuuggauuucacucacucuuagaaugcuguuucugaaacauuaaguauuaaaauauagucauguggcacauaacaggacaaaccucaugagguuaugauaugcauuuuuacuguaucuauguuuagauacaugaauacuuuguuuggauacacgaguaucuuucuauguuuagauacaguugccuacaguacucagcacaguaacaugcuguauagauuuguagccuaggagcaauaggcucuaccauauagccuagguguguguagguauacuguucauaugacaaugaaaucaucuaacacauuucucagaauguaucccuguuaaauaacucaugacuauauuuaauauauuuucuuaccagggcggggaauuguuuagcauguuuuagaauuauuucuauguauuuccaugcaaaauuaggugaaauaaaaccuggaugaaauaauuguuguaaauuuguuucucccagucauauuugaucauugagauauuuguauuuuuuagauucuaaauuaagauccaauugccauucaauaggauaauaguauacagcugaguauuuaguuuuaggaugcuguuuauacuagcaaauaugagguaaaauguaggaugcagaaauauacauaugacugauuauuuuaugaaaguauuaguuguuaaaaucaagcuuauauuuaaguggcuacuagguuaguuaaguuuugagcuucguugcuauugaaacaucuacuuuauuugauuggaauaacuagccauucucuacugcugaaaguaaaaggauuggccaggcacaguggcucaugccuguaauccuagcacuuuggaaggccaaggcaggcagaucacuugagcccaagaguucaaggccagacugggcaauguggugagacccuaucucuacaaaaaagaaguaauaaauuagcuggguguuggccaggcgugacggcucaugccuauaaucuuagcacuuugggaggccaagguagaaggaugacuugagcuuaggaguucaagaccagccugggcaacacagucagacuuugucccuauucuaucaaaaauuaaaauuaaauuuagaaaaauauuggaaaagaauaaagaaaaaguuaaagaaaaaaaagccaggugucauggcacaugccuguagucccagcuacucaggaggcugaguugggaggaucacuugagcccaggagguugaggcuacagugagcugugauugugucacugcccuccagccugggcaacagagggagagccugucucaaaaauuuaaaauauauauauauagggagagagaacgagugucugauuuuauuagaucucuguauuuuuuugguaacaggaugaaaaaucuguucagaugcacuucggacccuaaacgguuuaaugcuucuaaguaaauuuuuguuuuuuuugagaggaaucucacucuguugcccaggcuggagugcaguggcgcaaucuccacucacucccagcuccgccucccggauucacaccauucuccugucucagccucccgaguagcugggaccauaggcguccgccaccgugcccggcuaauuuuuuguauuuuuaguagagacaggguuucaccauguuagccaggauggucucgaucuccugaccucgugaucugcccgccucggccucccaaagugcugggauuacaggcgugagccacugcgcccagccaaguaaauauuuuuaaaagaaaguauuguugauaguucagaagccacuguauucucaccauuuuaaauggaagcacacacauaaguugacauucaaaagacuagauuccuuuguggucauagcauaagcauugugaacgucagagaaagacaagauuacauaccaguuauaaucuaggauaaugugcauguaucugaauguucacucuaugccugguauuacuguauguagccagcacucugaggaauaaacuggcagcugaugcagaauuauuaagcugaagaccucuguaagcauuuccuuggugucuacaggcuaccugcgucagauuuaccugagaugcauguuaauaaugcagauucacuggauucugucaagcauaacuccauccuggguggcacucaguugauucuuacgcacaguaaaauuauuauuuaacaauaauaauuauuguauuugaaguuacuaguccagacucuuuucuuauaucuauggcuauaggacuuguuuuaggcagaaaugucuaguaauguuuccugugauaauuuaaaacaaauaggaagauugggcugagcuucuuuaaauacuggugcaaaccauuuuuuuuacagucaguuaaaaaggaauaagaauaaucauucaaguuagauauuuaauauaggauucugaacucauuuuuuaaguguuaauauuuuaaaacuauuccacauuauuuuauguguuaggccauacauguuucaaaaggaauuuagcauccugucuaaaaaguauucauaccuucagacaucucagaaucucagaacuugauuguuaagcuaaguuaugaaucuuuuuuuuuuuuuuuugagauggagucucgcccugucgcccaggcugaaaugcaguggugcaaucucggcucacugcaaccuccuccuccuggguuuaagcgauucuccugccccaaccucccaaguagcugggauuacaggugcacaccacuacgcccagcuaauuuuuguauuuuuaguagagacgggguuucacuauguuggucaagcuggucuugaacucuugaccucgugaucuaccugccucagccucccaaagugcugggauuacaggcgugagccacugugcccagucaugaaucauuuuuauuaggauuacuauguaaguuuacuauuggucaucuuauugaaacuuaacauggccgggugcaguggcucacaccuguaaucccagcacuuugggaggccgaugugggcggauugcuugagcucaguaguucgagaccagccugggcaaaauggugaaucccaucucuacuaaaaauagaaaaaauuagccaggcaugguggcacacgccuguagucccagcuacucaggaggcugaggugggagaaucacuugaaccuggauaagugagccaagauugcaccacugcacuccagccugggugacagagggagacuccaucucaaaacaaaaaacaaacaaaaaacuuagaagguccuuaauuccaaaguuucuuggugcuaguucuaaagugguugaaaauucugcaggugacuggucagaguugaaucagaacuccugugguuggguuguagcauaguggcaaauuuccaaggugugcaaagacaauuuuccucucaucccuggggccacuggagccaccagcuggcuauuggcaaucuuguucuuuuacuuuggguguauugugcaaauauuuucuauaugugccaugaucggaaaaaucuugggaaacuuggcuuagcaaauuuaaauuucagggccuuuuaagaugggaacucaguaaaguuuccuugauagaaauuugcaauaagauuuacuaggaaugcuucaaguauuagcucugugcuguaauuuuuauuaaaaggauuguggugucuauuaggauguggaagcuggauucuuuggccuugcaaaguguguuauaaaagggaagaacuccucuucuuaaaccacaauagagagcuauuuggaauuuauuuuugaugcuuuguagguauucaucaaucuuaggaaaacugaaucaaaguaaaaaucuguaaggcuuuguaguuuauggggaaaauaaucacuagauacauaaaauauuuacuuuuuuuuagccuuuuuuuccccccacagaacauauagaggacagggcuuugcucugccuucucacuuucuccccacucacccccaaccuccagaguguguuuuccaaguaaaauuuuaggccauagagaaauucgcaauugauaggccaaggugacugauaaaacucuagaggucaggauugguaauaguggagcgaggaccagauggaauuuuuguuuaauacuguaucugaaauugaggaugggauagauaggaaaugaccuaucauuucaugaggagaugacuuuucugugauaaugggacagagaugagcuuagaugaaugaauauauauuuuagcacuuaccuuuuuccauaaaacacaaauagacuuggugcaaaauuaccagucucacuccaugguauuucugaugagaucgguaaauaauagagagagacauacuucuuuaggagcuagcugacuuuaacauaugcuggaguacaauugacuuacaacuauuuggcguuagaaaugauuuuucuagggcuuggugggggaaaaauacucgugaaauaccugccuugacuuaaacuucaacauauuuuaaagucauuuuauuaucccacaacucagaaugucuucaauuaaagguaagaaaauaaggugaugggcuacaguggcuuaaucagguguucaguuaaugaaguagaagaaggauacagauucuaauaauucacaguuguagagguucuagacuguucuuaguaugaaguccuggcaguguauguggcagagugaauaauguuucacgaccuggugagucaugugaggacugugaguaacuuuuaucuucugugugucccacauagcauauaacaguacuaugcuagugauuugcuugacaguuauugaaugaaugcuaaguuucaaauauuuauuugauagucacuugauuaccaaguaaucaaauaauuacuuauaguguuuuagggaguuuucagaagauauuugugauuaaauaaaugauuauauauguauauuagcauacuguaugcauuugucaguugggaaagaggggaauauggagaaguggggaacugcauucaguuuuuauuuuauaggcaacuaauaugguccuuugguuuuauuuuaaaaugaaacugagccuugagcauuuugagcuuucaugucaaaugccuugaauggaagaguaggaauuucauguaaguagcuuacaucugcccuguauguuggagaaugugauuagauauacuugcuuuucugcccaaggcacuauuuuuguauuuauauugcuuuuugcagguuuacuucuguuaacaggggucugugagaaauaaggcuuaaaauaucaauacuucucauuuuuccacagccuuccaaggcuuccaucuuugugccaguguguggcucugggugccaucuaaccgcaaaagcagcaguuggguuuggaugagcugugugacauuuggccuacacguaggucuacucaccacccuggucagggaaccuggaacaauccuaaaacucaccuacucuaaugcaggccauauuuuuuaauuaaaauugaaauugucacugaguauuggaauaagaagggacuuugggguggagugggugagcagggcauugucuuacagaggagguguggggaccgguaaguuuuaacuuucauccuuucaaucucucaguuucagcaaagaucuuauaaagaauuuuguugcuuucuuaaauucaugaaagaaauguaagcaauugagguguguaauuuucuugcccguauucucuauauuaaaaaaaaauaagaauaugguucuaugaauuucuugugcuauuuuugcuuuccuugaauuauuaaaauauguugcauagaacuaauauuguuuucuuuuuuauuuuuauacaggaaggagagaaauauuguucauguaauguguuaccuuuuuuugucugugugaucuacaagagcauggcugaaauguuaccauuuuuaacuaguguuuugacugaagauuauuaugaaaaguuuuacuuuuguuagauuccuaauuaaaaaugccuauacucuuuuauaggaguuucaacuuuugcaauuugguaauaacagauuuagguaaguaaaaaaugagaaucucauacaguucugaagaucuaaguuugguugagaauuuaauguuucaucaccaguaaauucaauuaaagacuuuugauucaauuaaagacucaguucugccuacaccugcaagaacugaguugaucuguacaucaacauuucugauguuucuuugguaguugcugcuggagucagaaguuaggaacaaaucuaauggccuuuguaauguccucugucauuucacggaggaaugacuuagaggaacaaagcuuuccugugauuucuuucuucaacagauggcuaauggcacagcauugcaguuagaaucuuguuuaagauacuaggagcacguccuggacuaaaaauuucuacauaagcuuuagcaacaaccuuauagcuuccuuugacuuuuuuguagagcuuacagaauguauggcugccuaaguaauagucucugaauuaauggguaaaaaauauauuaugaguuuuuuauccucacguauggugcuaggcuauacuggauuugggcuaacaaaagcuuguuaacuuuuuuuugucucauugacagaaguauuuuauaucucauauuuuacauuacauagguguguguguguguaugaaauaaaaguuugaaaauaaagugauauacucuuuuuuaaucugcucugugguagucuaucuuuuuccauaaaaacaaugagaucaugacccaacaaauuuauuucagaacucacauauauaccuguagcuuuuucuuuucagguaauggucuucagaaauuugacuugucuucucggaguauugaacuauuuaaacauuuuauuuuaagaaguauacaaagacacauaggacauuaaacauguuauaguuuuguugcuugucuuuuucauuugaguaagauauucuaugcccuuguauuuguuacuuccuuguacuuuuggcccaauaggcuugaaaaauuccaaggcacuacugggacagccaaugaagaaggaucaagauugaaaaaaaugcaucagcaaacuguguuugagcucuguuuucuguauuucacuguccuggguacuagccauagaguaguugugcaagguacuucugguauuuggccuccuuuuacuagucccuauauaaaaauucugggcuuuacuuuauaauucuagccugcuuuccagguaugaaacguaggcuaaguguuagauagcaugggaagggguguguucauaaaugcaaauaagagaguugguugcauauuuauguaaauuuuuucuuuagaauaaguaugccuuaauugaaccucagcuauuggcauauuuuuuguucccaguaauaauuuuuuuuuuuuuuuuuuuugagauggggucucacucugucacccaggcuagagugcaguggcaugaucaaggcucacugcacucauuccugggcucaagcaauccuccugccucagccugccguguagcugggacuacagguaugcaccaucacaccuggcugauuuuuaaaauuuuuuuguagagauggugccucacuaucuuguccaggcuggucuggaacuccuggacucacacaauccucccaccuuggccucccuaagugcugggauuauaggcgugagcuacuaugccaggcccucucaguaacaauucuuguuauccuuaguuuauagucuccuucuuuuaauauuuacuuuuucugagucuuuuuuugagaugaagucucgcucuguugcccaggcuggagugaaguggugcaaagugaagucggcucacugcaaccucugucccccggguucaagcaauucuccugccucagccucccaaguuagcugggauuauaggcaucugccauuacacucggcuaauuuuuguauuuuuaguagagaccggguuucaccaugguggccaggcuggucucgaacuccugaccucaggugauccacccacuuggaccucccaaagugcugggauuacaggcaugagccacugcgccuggccccuuucucagucuuaagagguauaaacuuaacaucauuaugaaacuuaauuuuuuaaaaaaugauaguaggacaagauuaacucccuucugucuuacuucaggacuaaaagaagcaaaaguaaguuuuaggcuaaguuccuuuauguggaugauuagaaaugucauaguaauuuguacacugaaauacauugagaaccuguggugugugagaaacuaaaguuuaggucuguucccuagaaauacuucugugugaguauucaaguuuguaauaguauuagauuaaauauucagcaaguacagaaugucuaauuagguaaaaagugaauguaaaacuacaauuugaaucuuaaaguuaacuuacauaucagaacuccccaaauguuuacuguacuuguauauaauaauuuccaacagcccccaauauccucuccauagagauggggccuuuaggccaaguauccucccauccuugguacugacaauuugaagggccucuuuucaaagagagauacuuaacagauaacaggcaaucuuggacauccauauggcacaucagaagaacaaaagugucaggccuauaccuuucaagcucuauaaaagugacucauguuuagauacaagaugcuagucguucauuguuuuuuuuguuuuguuuuguuuuguuuuuuauuuuauagagacaaggucugucuguugcccaggcuggucuugaaccccucagcucaagugauacccccgccuuggccucccagagugcuagaauuacaggcgugagcaauugcucccagccuuuuuuuuuuuuuuuuaaagcaucaugggucuuugaggcucugaaaaaacucuggauugucuccccagacaaguagacauagauccagugucugcccuacaacucccaagaauauaagaaucugcuuaaggcacaucuuaagauaauacaagaaucugagccuucagauuuuccugcauuggugguggagugaguagauauaggaaaagcagaaauaaucuguuucuuuuaaccugauaccaucauuacauguuaccauuaauccuggaucaguuuuucucuuuuauugcuauugaaauuuguucagaauguggugaagguguuaccugcuauaggugguccagaaaggacagccaucccagcaaagaaacuggcaagucccaaaaaccuguuuacuguagaauuccuacacagaucaaccuguaggaauuagaauucaguguuagccauauuaagggugaaauucuauagagaccuaugccuaaaagggacaaauacuauuuauaucaucucaagcuaugaacagugacuucuggggugaguugguuggcuuuuugcccccaauauugugaaagagcugaggacuaauagcgaacaguaaaugcuaggcaggcaguguuuucaguuuauuaguaagaacacaaguuuuuauuuucauuuuaauuuuuuaggugguucauggguacuuuuucuuccccaaaccuugcugcuuuucucuuauuaggaaaugauauuuacaauaugaauuaauagugauauucuuuuugagacaggguuucacucugucacccagaguggagugcaguggugugaucuuggcucacugcaaccuccaccucccaggcucaagcgauccucccaguuacuuccaaguagcugggaccacaggugcgugccaccacaccuggcuaauuuuuuuauuuuuuguagagacggaguuucaccauguugcccaggcuggucuccaacuccugagcucaagcgauccaccugccucugccucccaaagugcugggauuacaggugugagccaccacgcccggccagacggugauauucuugaauccucuaaggcuaaguaucaaccauugguuuguaaguaaucagauaucacaaggaguuaauuucagcuuuaggaagcuugauuuuugccugcacuucauauaauauccuguagcacuuacgcuaauauugauagaacagaaguuuucuaggaaaucuguuccagcauguuuagguccugguucuaaggagaacccaugagacucccagggguucccagaacacugaaguguuuguauaaguauuuugguuccaucugggucgaggacuuugcgucaguuuaggguaaaaauggagaggaaguauaaaacaauggcccugugaaaguacacaggaccaaggcaauaacuucaagagagaaaccacacuggucgggaaauccuuuuuucucuugaaguguucucagggaucuuuucuuuaagauugugucuuaaaaggagccaaacaaguuucuggagcugaaggagagacgugaacacaauccuaaucuaggagacugauaaguaaaaaggaauccugcugaucccuuuuuugcuuuaauuuuauuccugucccauguggauaguccucucaccaucccuccccacucacacacaagaugaguaacuggacaggauauagcugcagaguuucuaaggucuuugaaaugauuuuuuaaguuacaaaauuaauacaaaauacguauuuuggggagauuguuacugauacuugcuuuuacuaaaugguuuaacaauguuaaugagugugucuacucaccaguacaggcaguaucaaugccagguaaccaccagcaaagauggcaaagcagaugguguaggucauaaguaguggaaaugugguggcuaaaggagcaagcagguuagugaugccgcagaggaugagguaagacuugugguaaugauacuucuuaauccaguuuugaucagcaacccauccagaaauaaucugacugaccgucucaaggauaccuggaacaauauugaaaucuuuuuauuuuccuggucccuuugaaaaaugugaaugcauacagcaucauuucccaaguaauaugaucucauccugaggccaggauaugugaggaaaaaaaugauuugauuuguguaccaguaagcucuauuauauacuuaccuauuccaaauacauuuaauaaaauagcaaaaaagucuccgcuagaguaguguagaagacccauguaguuaguguuuuuuucugauuguguuuggaaagcuuacgucacuacagugguaaucccugguuacagaggacccugggcacagaaggccaugcagucucuucgucuaagagguccugcaagugagaaaaugaaguuucuaaaagacaaauagaccuucaggucagugucuuggggaagucauauuguagaagauuggaguauaaauaagucuucuguuaaaaaaggagauguugggacucauaauugcauacgaaguuuuaggaaguaaguccuccaaaguuuaugcuuaauuugaaaauauguaggaaguuuggaaaugggagauuguauuuuggaccacugcaccuggccaaaucccucuucuagaucaagcauucugucuuuaaacaguuuuaugaguagucaacuaaaauaguuguuuuuauuuauuuauuuauuuuuauuuuauuauuauuuuuugaaacggagucacgcuccgucacccaggcuggagugcaguggugcauucucggcucacugcaagcuccgccucccggguucaugccauucuccugccucagccuccugaauagcugcuacuacaggcgcccgcaaccacgccuggcuaauuuuuuguauuuuuaguagagaugggguuucaccacguuagcuaggauggucuugaucuccuggccucaugauccaccugccucggccucccaaagugcugggauuacaggcgugagccaccacgcccggccaguuguuuuuacuuuuaauuuacauuuuaacuuauuuuaaauaucagacaguccauaagugacuagccuuaaaagucauauuuaucuguuuuacuaugaguucaaggggaaaauuccuuagcuacaaauaauaaaacauuauugaaugcuuacuacaggccaggcacuauucuaaacucuacaugcauugcuuuuuugauccugacaaucuuaugaggguagauacuauuaucccuauauuacagaugaggaaaugaaggcaccaugaagcaaaguaacuugcugaaguucccacaguuaagaaauacagagcaggagguugagccagggaagucuugcuccagaaccaauccuugagccacugcacugugcugucuaccugggguuuucugcuccuuauaguggcuauugccauugagcaucagcuuuuugaaauuuccgcauuuauccaauaaauaaugucuacugugucaaacacuguuauaugaagaugaauaagacuugauuuaggguccacugucuaguaggggagccugugugcagugacagagaucucuuccugggaaaugcccaggugcuccaucuagccucaaaaauuuuacuuucucuggcccuucuacaauuccucuuuuguuuuucuuuagcuuuuuauuaaaauguaauaagcuuguaaaauuaaguugaucuuuccuuuuggguaggaggcugauguaggcuuucuuaccugcuacagaaacaagguaagaggcauccaugaugucaauccccaguguuuuggcucuggcuaccaggugaaagguagggaugaaguaugcuaacugacugaggagaaaagaccaaguaaauauguagaagaaaggauuucuaaagagagaaaugucaaacaguuguuugcagcuccacgaaauaaccuuaucacuuucuucaucacucuuuaauaacagucuguuccuguuaggcccauuguagaacucuucacuuugauuuugugagacuguuaaauuuuugcuagguaguccagccuucugcguaguacuguccuugaugguagacucuucugucucauggcaguguguuucuguugcaugugccucuggaccaugugcagacaaacugcugccuuuaucuuuaauaccagaauuguucucacuuuugauauggaugggucuuaagagcauacuagaaggcaccaaauucaaugcgauagcuccaaauaauauaagggcuccuaaauagggagagauugagcaauuaaaaauagccuuucaguucacaauacugcuuuguguucauaggcucagaagaggccccacuggcauagcccauuaauucuugaaaacauuacuuugucuccgauuugacuuauuagucauauacacugcuguauccguguaauaauguagugcuuuggagauagaaaaccagaaagcugcaccaauagaugggauaaaaggagagauggugguuauuuguguuaagggggguagggggggcaaguuuuuggagggagaggagaguguuucaaaugcuaaaaaauuaaauagaaaauuuaaauauccugaagugagaguacagauuuagguacagaaaaaauagaauaagaugaaagaaaucauuuggaaacagccuuagaagaggggacagcuggccaggugcuauggcucauaccuguaguccuagcauuuugggaggcugaggcaggcagaucacuugagcccaggaguucaggaccagccugggcaacauggugaaaaccugucucuacaaaaaauacaaaaaaauuaauugaugugguggugugcaccuguagucccaguuacuugggaggcugaggugggaggaucgcuuagccugggagguggagguugcagugagccgguaucaugccacagcacuccagccugaaugacaaagcgagagagccugucucaaaaaaaaaaaaaaagcagcgggagggaggaaggcauggauagccuuucaucccaugacauuuuuuagaucuuccuuaaaagaugacagaugcuaaucuugccuuuggagcugaauaguugcuugcauucagcguguccugaucaaagcuaugauuuguauggugcuucuaaagauagaaugggcuauagguucugcuauccuaucauggauuugucagcuggucccauucaccaugagacuacugaauaguuaggaaagauucaacaaaacugccauguagauagcaauaggcauaugaauacacacauauacauguauuuuuuccaguaguuuaggauuauuuuaauccaaaugucuuaguuacaaagaaaauugugaguugaaucauuuuuuauucauuugugaaaauuuauaguugacauuacauaaacucuuaaggaacauacucuuuuuaccaaaguauuuguuucuuuuuuaucuauuucagugaguccgaugggggaggaguuuuuuuaaaugcagauuuuugucuuaaagggaaaaugggaaaagugaggguuuuugauggggcgggggcggggggggaagggggaagccuuauuuccccagaaguaucgcuuuuacugcaagcuguuuccagcugcacggaaugcccuccaucuccucagacauugagcccuauggugaauucugaguugcuugugugagcuggcaaagccugcaaguauuucaagaucucuuuugcguauguauucuccagggaagagaagcauguuuacuuuagaaauuaugcucauuuccucucuugcaauaccuugugaaaucgauugcucugaaagucuuaacuuccauuucucaaagggagaaagcugaacgcuaaaucuugcacaguugauaguaaauaaacuuagaaugacguaccuguccagucauacagaucuaucaggaauuuuguaaagggugccaaaagaaaagucagucccaucccagaacgggcaauagcuguagaaagagccaaucguuuuuugaaguauuugguaguuaccacagcagccacuugguauaagaaagcagaacccaaaccuaaaagaaaaacguaauaguuuagaaucacucuuacauuaaguggcuugguaacagaaaagauaaucuccuggauccgagauaauacagcuaggccuuuuggacccaggaacaguagaagggaagaguccuguuccaucuucuaucuucuauggauggaugcauauauacauacacacacacacacacauauuuugagacagggucucacuuugucacccagacuggagugcaguggcacaaucucggcucacaacagccucagcuuccugggcucaagcaauccucccaccucagcuucccaaauagcugggacuacaggcaugugccaccacuggccuggcuaauuuuuguauuuuuaguagagacaggguuucaccauguugcccaggcuggucucgaacuggacucaagcgauccacccacuuuggccucccaaagugcuaggauuacaagugugagccaccacuccuggccuucuauggucacauaauuacaauggacucaccggguagaagucccauagucacacaaagaaaaggaauacuuguggcccagcugcugaucagauauccaccaguaacaacgaaagccccaagaauggagguaguuuucucuccaaguaugucacaaauaauagcaaccaggggaccuuaagagaagaaagaaaggcaauucuuagguaaauaaugaucuggcaucccuuauccucugauggcgauuuaaaugaaugacaaggaaagcaagaggacuguuuacuuugaaguauuacguauucuucaaaaaagauuuucauaucggguuucuuaauaucacuagugccacacuauuuuaguuuuuggaaggggaguuuaaaaggaaauguugauuguaaguaagguuuggaggggaggugauuugaaaugcauuauagaaccuccacaaaaagauugcaucuaguggucaaugacuagaauaagguugaaucacuuaucugcucuuccacccuguuacagcuccaaauaaaaggagaagaaauugguucuauaauuuguuuugaggcuggacgccguggcucuuuaaucccauacuuugggaggccaaggugggcagaucaccugaggucuggaguuugagaccagccuggccaacauggugaaaccccaucucuacuaaaaauacaaaaauuagccaggcaugguggcgggcgccuguaaucccagcuaguugggaggcugaagcaggagaguugcuugaaccugggaggcagagguugcagugagccgagauagcaccacugcacuccaaccugggcaacagagugagacugugucucaaaaaaaaaaaauaaauaaaauuguuuugaauauacuuagauaacuagaacuucauggccuaacuuccagguugagggccuuacucauugaaccuauauuaaggcauuaacagacuggaaaggcaaugcaugaaauacugaaucauggcauuuaauaauuccucagcuuucuuuguuugaaugcugauucucccaacuuuguuacuaagucaaguggaagcuaaauauugcaauuccuuacuuucucagcguuacauaucaguaaaugaaccuuaauuuuagaaacugaauuccuauucagucuugaauaggaaucuuggaauugcccuuugugguucuucuccuuagacagcaagcuuauugccagcuuuauaccugcacaaaaacgaagagaugacaugauggauccaauccaaccaauuugcucugaggugccuucaaacucuucuugaaagaccacaaagaaaauugcaaaagucuuggucauccccaucacaaacacauucaccuaaaucaaagcagaccagaguccaacucaggugguaagugagccauuacagaggcaauuacggcuacuagaaguuaugauucccucagcuuacuacuauuuaccaguuugccuuauugguugagccucauuauacaucuuauauuuuaugggggaagucauuccuuuuaaaguagcuaagcauuuuaaauggaaacaucucauuuaauccucauuucauggcuuuggaauaggcaugccaauguuguguaccaaauaauuuauaccaaauaaaccacccaguggguucaucuugccugcugccuagauacaguugauuuaucaagacaggaauugcaauagagaaagaguuauucccacagagcccauugugcaagagacuggaguuuauuagaccaaucaguuuccccgagcuuuuggggaucagaguuuuuaaggauaauuuggugggugggaggccagugaguugggagugcugauugguugggucagagaugaaauucuaucaaagcugcccuuuugcgcugagucacuucuggguggaaggguggagggggacccacaaccagaugagccaguuuauuaaucuggguggugccagcugauccaucaaaugcagggccugcaaauuaucucaagcacugaucuuagguuucacaauagugauguuaucccccgagcaauuuggggagggucagucuuguggccuccagcuguaugacuccuaaaccauaauuucuaaucuuauggcuaauguguuaguccuacaaaggcaaucuaguccccaggcaggaaggaaguguuuuuuuuuuuuuuuggaaagggcuguuaaaaggagguuuuuuuuuuuuuuuuuuuuuuuuuuuggaaacggcuguuaguuucucuuucaaaguuaagcuaucaacuaaguuucccccaaaguuaguucagccuacgcaugggaaugaacaaggacagcuuggaaguuagaagcaggauggauggaguugguuaggucagaucucugucacuguaauaauuuucucaguuauaacugcaacagcaguuccaagaucaggaaauugaaguuuagagagguaaaaaguugcuuaaaauagggguacuggaacugagauuugaacccagauuagacugacucuagaccuggcacucuuuuacugcccucaguagcaucuguuaaagacagcuaauuccaguuaccuuugugggagaaaaguguuuguccaaagaggaauaauuauuccugucaguucuuagauuaguuuugauuuaacucugcugcugagcugaguaccuuccuucacuagauauauaaauagguugaccauaaaauguaucauccaaauugagacacucaagagugaaaaggggugcuuaauuuuggauuaacugggauuuguggccaucuuaagguugggccaggggccccauccuuuucuuucugccccaccuaaucuuccuuaccuguacuccacuagaauugcugcuuuggagaugagguuuucuuucuguggaguauuaacuuuuauuucucagaauucuaguuagccggggggcuguuaagugcuauuccuucuuuccguuuuuaaguaacagucaugcuuuaucccacaggggucuagaggggaaccuagccaggguuugcauucacucguaaagcccagguguacucucugucuccagggguuucguagcguuggcuuuucaaggccacuucugcuuucaaccuggccaugcauugcuuaugaaccacaaaaccagcugggcauggaggcuccugccuauaauccuaguacuuugggaggccgagguggguggaucgcuugagcccaggaguucaagaccagccugggcaacauggcgaaaccccgucucuacaaaaaguacaaaaaauuagcugggcguagugguauaacaccuguagucccagcuaccugggagggugaggugggaggaacaccugaaccugggaggucgaggguacggugaguugugaucacacuacugcacuccagccugggcgacagugagaccuugucucaaaauuaauaauaauaaaagaaccacaaagccuuagguuccccuucauuaauuccacuuucucggcccgccuguuacaguucuguacucaucucgcuugauaucugcucccuggacaaucauuuacucucaagguuuuaauuaccaccugcauacuuauggugguguagcugaacaggguucugcaaucagucugccuuaacuugcauccaggcuguucuuccuacuggggcgugaccuugggcaaacaacuucgcacgucacauggguuaagcuuccgcuuuuaugaugggggaggcggcauuggggaugaaaauauuaccuagcucauaagacugugaagauuaauugagaaaauucugauaaaguacuuaauauuuggcacuuaacacucaaacaauuaacugugguuuccauucugcuuucccaagagcuucagacuccuaauugucuaccauaucuuuauaacuucuggucaacuuguccaaacauaaacucacauuucccuuauccuaugccuacucuuuucaguuuuuucuauugguaccauccacccauucauuugagugacagaugugcuuucucuuagacaccucccucccucagccccugcuuuuaaauaauggucaagaccugcccccuucuuuucaccccaucacuacuggcgaugcucagaaauugcaaaagugguaguggugaggaagaagucucuuaauauacuuuuucccauucugauuugauaaaaggaacaaaacuuauuuagaaugaagagugcuauaaacgccaggacuauauauucaaaaguuaaaaagacauuuuaucaggcccccauugaggcaauuuauaaccauaauuuuccucuaaggcacuucugucaggcuagaaauuagguuagaaaauauacacagaucucaaaugacuuagacuuucuucucucaguucauaauaaugugaugauuguguccucucaugagcaaggaauaauacagugcaucauucuguaaaguaaacuuccuuuuguucuauggacguggguucugugcuggugucuagaggauguugaccucuauauucuuagcuaccuaaauuuagcuagcuacuggucccccaguucagagcuuuucaucucuggucuguccuuggugucugcguguagcagcagugaaugguuaggacuugucucuaauaacugaguccguguccacuauguaucaagaagaccaagggcagagccuuugcaccuaccaugcuucccgucccuuaacuugaagucuuccaacuuuguuucaguuuugacucaaagauauuaaaaaucucucccaaggucuagguuuuuccuuaguuaauuuagcagacuacauaaaucugcauuauucuacauaaucccaugucuuagaccaagcuugguggguuuuaguucuguuaccagaguccacgucauacauuguaaauggcucacuccaaaauaaagcaaaaacccuagaacuucuccaguccccucauuuucuuuuuguuuuuaagagcaguuaauuggguugaaccuggcaggaacaccuuaagcaggacuucccccacaccccaccuccaauaagagcuuccucacuagaucauuuuaauuauugucugggaaaggaguuggaucagccucagugacuuauuuucaauacaggcaccaggcuuugucagaguuaguuuuaucuaauaacaacuucuuauccugcguccuuuucuaguaucacccuagcuccuccugaccuucacaggcaaacuucuguaaaaaauggucuauuagguaucuccacuuucugucauucugcuacuccacugaaaacuaaaguucacuaacuuuggcccccacugcuccacuguacuagcucuuaucaagguuauuagauuucuuuguugcuaaaccaauagagucuuguuauuucucuccuauuugaccucucaguagcaucugcucgucacauuucucugaaaugcaaaucuaucacaucccugcuuaauuuuucucauuagcuucucauagccucaagagccauucucaucucuucaguuucaucaacuauccccuucauccuuauuuguuuauucauaaaugugugcagcuaucaauucauccauccaucuauccauccaccaacaguauuuuacugagugccuacuauguuccaggcuguauacuggcacugggcuuacgguaaugagcauauacucaugagcaaugcagacauagacccugcccccauggaacauucagucuaguaagacagacugaauacagaaaacagucauacaaauauauaaagugugguaaguugguuagaaugaaucucucucucuuuuuuuaaguaggaagcucccaaagaacauuguuauuuuucacuuacuaggagcucaucuguuauagaaaagaacaguuguaagucauacagaaacaaaagcacagucauucaaguauccacauuacaacugugggggauuagccccugaauuuauuguuaacauuuugaggauccagugcauuuuuugugcuuaguaagcaguaucacacccuaaaagugggacaguguuuauuaaucugguuauuagaugguuuuuccuaucagcaacuaaauugaucaaaaaccauucuauccucagaggauaauguagaaaaagucagggugguuacuggggagaaaggcaggagaauuagagauccucaccaacagugccuauucugcaaagccuaugauuuagggggguggcccagccccaggaagggcucucagacuuagggcauccuuuaguuucccuauuaguaacauuucuagggggaaaaugagauuguuuaguacugaagcuaauguuuagcaaguacuacuauuauguguuaagaguuuuguauuacauaaauccuggcuggggaccucugccccuaucuugucuagcacgagggaggaggccugauguuuucccaccauccuauuuguagaauucuuagauaucugcaugugaacuauaggauuauuagaaggcaccaagaccugugcuaccuuuccccgugagcugcuuacuguagggcugaguaggggggaagugucggcaagaaaaggguguuuuuuuuugagugcaucucaaaguuaauagaacucuggaaacacuuaagaauugugcagcuggugccacucucuggagagcuguguggggcauagcugggguucaccaacauucuggaaugggcaugcugaugaugcagaucaccacucucacaccucaaccccugggagggugagggaaagaaguuaauuuaaaaaauggaaugccucgucuaguugcuuauggguaaaggagaagaaucaggcucccccuucaaaauccuuguccucccuuuccaaacacaucggaaauauagauagcauaaacuauaguuaguggggauggauugggaaguagacagcaggccaaacagaggaaauguccccaccccuuaucgguagaaggggcugugcccacaguguucuaucuaugcugggcugaacuggggagaucacccccagagcacuuuuuagcaccucccagugcuacuuuugggaugguuaaaaguaugauuguccccaaacccuaauugccaugcagccaguacagaacugcugauugugacugagcauucucagguuuaagagaugauaggaagaguagaugacuggauucaggaacacuucuguuuguuuguuuugagagagucucucaugguugccuaggcugcagugcaguggcacgaucuuggcucacuucagucuccaccuccugauuucaagcaauucuccugccucagccucccaaguagcugggacuacaggugcaugccacugcacucagcuaauuuuuguauuuuuguagugaucggguuucaccauguuagcuaggcuggucucgaacuccugacuucaagugauccacacaccuaggccucccaaagugcugggauuauaggugugagcccccacacccagcccaggaacauuucugcuuuugcucuaggggcauuuucaacuuucuccuggguucggcaugggccucugacuuuagcaguuuuuggcagcuccuggccuuguuccugcccaccccuccacucagaugccaaagauuuccuaagugauccuauucguaggcagcucugagccuuucuccagaaagccugcuuuuaggcaauaggaaagggggaaaaaagugaauucuuaccaggaaaaaaugaaucacaaucauccauccccauccuccauccaggguuuuaguguaagguuggaccuuccccucccucuucagcaugaugccucuucuauuuuaaaugcagaagaucccugugauaaauccaagacaguugauucaguggaccagaaacuaaucuaaacuuuuaaacuuuuuaucugaaagggaacguucauacauuguuggugggaaugcaaauuaguucagccacugugcaacgcaguuuggagauuucugaaagaaccaaaaauugaacuaccauuugacccaguaaucccauuccuggguauauacccaaaggaagauaaauuguucuaccaaaaagccacaugcacuuuuauguucacugcagcauuauucacaauagcaaagacauggaaucaaccuacgugcucaucaacaguggguuggauaaagaaaaugugauacauagacaccauggaauacuacacagccaccauaaaaaagaacaaaaucauauccuuuccagcaauauggaugcagcuggaccauuaucuugagcaaauugaugcagaaacaaccaaauacugcauguucucacuuauaagugggagcuaaaaauuggguacauauggacauaaagaggggaaccacagacacuggggacuacaagauagggagggaggaggguugaaaaacucccuauuggaugcugugcucacuaucugggugagggguucaauuauacuccaaaucucagcaucagacaauaugccuuuguaacaaaccuacacauguacccccugaaucuaaaauaaaaguugaaauguaauacaaaacagaaaaaaaaccucuuucccuaugauauaaaaccacuuguaauuuuuuuuuaaccccucaguuacagaugaagucugccugaugcaacuaaggacuuaguuaccuggaaagccugaucucagugacugugggguggccacuccuagaacuguacucagugucccuccccccaggucugcaagccaguuucuuggagaagcugugcgucacccugcugguccuccgggugaacucuuaagagaaauagaaagggaaggcgagccuugaguuuaggaauucuccuuagaaaacacuugcuaaauguaaauauuuuuggagcuaaacagacaugacaacgaaaugcgauacccgcuuauugaauauauccuagaucagaaaaaaaaguuguaaaagacaguuuguggggacaguuggggaaauuugaauauggacuguauaauacagaauacuguaccaagguuaaccucuuggaaccucuuccacaagagaauauucuuaggagauacaugcuaaaguauucaggaguaacaugacacuaugcuaccuucucccaaucgguuccguaaaauaaacaaguguauauaaagaaugauagcaaaaagaaaauguaaauguucugaggaagggggaacaguacucauuauuuccccugucgggucgaaggcugacuguuucuaacuggaaaggaaagucagcuggcaggguaugcggaauggccaucuggugagcaggcuggguggggagagaugccagucguuguuagaaaaccaacccagcacacagucccauucccaucuuaccuuugaugugguguucagcaaagaaauccuccacagauggggcaauuaaggaagaaaaauaaauuacaccguuuucuggaauguuacucuuuuucuaaggcauuucauuuugcugcauugugaaaacaagugagcauuguaagagccaaggagggcucagacgauuuaggcccuccugcuaguggacuuuacuuccugagggg

SEQ ID NO: 13792 - RNA, 6873 nt, Homo sapiens
acuuuuggagggagcauauaccauuccagucacuaaguaagguuuuaauauucagauuccagaauucugaucaaucaauggcuauguuucacacuucuuuaaauuaaaaaauuuucuaucuuuacauauuuuagugacugaauuaccauggcguaauugagaguuuggauuuauuaugguacauuccgauuucuauuuaauacauaagguaccugauuaaaauuuuagccuauuugguuaaauacuaacaauacagguugcuauuacucuugucuuacuaccaauuagacauuucucagaaugcuaaagcaagaaggaaccuuaaaaacuuaucuggccgcgcccaguggcucaugccuguaaucccagcacuuuggaggacaaggcgggcggaucacgaggucaggagauggagaccauccuggcuaacauggugaaaccccgccucuacuaaaaauacaaaaaauuagcugggugugguggcgugugccuguagucccagcuacuugggaggcugaggcaggagaaucccuugaacccaggaggcggagauuacagugagccgagauugcgccacugcacuccagccugggcgaaagagcgagacuccgucucaaaaaaaaaaaaaaaaaaauuguuuuccuucucauguuacaaauguagaugcgauguguuucuuucaagcuuuuguuuccaaugacauuaguuuagguuuucuuuuguuuagcucucacuugauugcagucuucuuucuuucaggucagacuguuuuuccaucuuucggccaaugguacaaaaaaaaaggaaacugaagagaggagauagcauaugccagagaaguagaaagagccauuguaugucuggguauaaucauauaaccagccuggaaggaaggaaugauuucuguuagggaaggaaauuuugccauuaguaacucucagccaugaauagcuccucaaagcaaggagccuccuguauugugacccauuugaacuuagugaagcuucuuagcugcccuauuuuucacugaugaaguugaaucagcuccaccugaguuagggacuuacaccaucuccaaucuuacaguggaaguuggagaaaauuaggaacacauaccguuuuauuuuaccaugaauuuuauuagaaggccgcuauuaugaagaaaauaaucauaaauuauuguuuuccagagaaaaaaagaagugauaauaaucaguuuucuuuuuuuuccuuuacuaaacaaagacuugaguacuuacuauauuccuguuaauauugcuagguguugaggauacacuagugagccaaaacagauacgguccuugcccucacagaacuuuaguggggagauagguaccaaccacauaaaugauaugugauaagugcuaugaagggaaggugcaggaggcuaucagaagauaugagaaggaacugacugcuugaucacguggguuaaacaaugacaaguuccccccugaaaucuaaaugcuuuuuuuuuuuuuuuuuuuuugagacagaggcuugcucugucacccagguuggagugguguaguggcacgaucucugcuuugcuuacugcaaccuccaccuccuggguucaagcaguucuccugccucagccucccaaguagcugggauuacaggugcccgccaccacacccggcuaauuuuuguguuuuuaguagagacggaguuucgccauguuggccaggguggucuugaacuccugaccuccagugauccgccuaccucggccucccaaagugcugggauuauaagcgugagccacugcaccugguccuaagugcuuuuuaaaagcauaaguuggagggucuucaaagucuuuuggcuaauggcacauacuaaaacuuaagcgaaacacuuuuuuuucuuuuuuuuuuuuaacugaguaggugauagcaaagaauauuuaugcuaaggcacaucauugcaaaagucaacacugaaaaaagcaaauaauguccuuaguauuaucaugacaauaauuuuggccuccuggacuuccuaaagggucucaaggaucucugggggucuguugaccucacuuugagaaguucuuuuccaaaguauaguauguauauuauaucugaucacuuauucaagaaauuucagugcuguauggcagcacaggucuggguuucagggauauaccccugaacaaaauagaugaaaauaucugcccucauggagcuuacauugugucuuugauuuuucccuucuaucuuagaucaugaugccucacuggauauguagaguauacccucccccaccuuuuucuucuggucugcuuguuucaucuccucuuuguucuguuauggacacagaggagaugagacaagcagaccagaaaaaauugacuuaauuuauuuuuguuuuauagcucuguguuuccuauuguuaauguaaaaaauaagugaauagaauguuuuauaaccucuuaaguucaacuaacuuuaaguugcuuuuuacuuacugacuccuguuugauuagugaccucuauuaaauguuucuuggaguuacuggagugaaaacaacuggacaagucuuuguguuauguugauuguuauugaccuauagaucucuaagaaauaggugacuagucucugaacucuuguagacauuucuagaaaggaaggaguauagaagguagcaguccuuacccucccaucccuugucauucuugccuuaguccugccaacacagcaaauguauuagaguguaugugucuguguauguauauguguauauauaaaaccugugaauuauaaaauaguggucucagaaguaacacccuggggaaagacuaggaauucuuggacaaaaagguagacagugcuacuaaaaugucagauagcacagcuaaaaauaguaaaaauggauugaagagaaaaacuguuuauaagccuuuucuuucuuuucuuuucuuuuuuuaaaauuucuuguagagacuggaucuaaguuacccacgcuagucucaaauuccuggccccaagucauccuccugcauuggccucccaaagugcugggauuacaggugugagccaucaugccgaccaagccuuucauuuuacacacacacacacacacacacacacacacacucuuucucucucucucacucacucacuuuuuuuuuuguuuuuugagacagagccucgcucuguugcccaggcuggagugaguugcgcaaucucggcucacugcaaccuccgacccgcagguucaagugauucucuugccucagccucaugaguugcugggauuauaggugccuaccaccacacccggcucauuuuuuuguauuuuuaguagagaugggguuucgccauguuggccagguuggucucaaacuccugaucucaggugauccgccugccucagccuucuaaagugcuuggauuucacucacucuuagaaugcuguuucugaaacauuaaguauuaaaauauagucauguggcacauaacaggacaaaccucaugagguuaugauaugcauuuuuacuguaucuauguuuagauacaugaauacuuuguuuggauacacgaguaucuuucuauguuuagauacaguugccuacaguacucagcacaguaacaugcuguauagauuuguagccuaggagcaauaggcucuaccauauagccuagguguguguagguauacuguucauaugacaaugaaaucaucuaacacauuucucagaauguaucccuguuaaauaacucaugacuauauuuaauauauuuucuuaccagggcggggaauuguuuagcauguuuuagaauuauuucuauguauuuccaugcaaaauuaggugaaauaaaaccuggaugaaauaauuguuguaaauuuguuucucccagucauauuugaucauugagauauuuguauuuuuuagauucuaaauuaagauccaauugccauucaauaggauaauaguauacagcugaguauuuaguuuuaggaugcuguuuauacuagcaaauaugagguaaaauguaggaugcagaaauauacauaugacugauuauuuuaugaaaguauuaguuguuaaaaucaagcuuauauuuaaguggcuacuagguuaguuaaguuuugagcuucguugcuauugaaacaucuacuuuauuugauuggaauaacuagccauucucuacugcugaaaguaaaaggauuggccaggcacaguggcucaugccuguaauccuagcacuuuggaaggccaaggcaggcagaucacuugagcccaagaguucaaggccagacugggcaauguggugagacccuaucucuacaaaaaagaaguaauaaauuagcuggguguuggccaggcgugacggcucaugccuauaaucuuagcacuuugggaggccaagguagaaggaugacuugagcuuaggaguucaagaccagccugggcaacacagucagacuuugucccuauucuaucaaaaauuaaaauuaaauuuagaaaaauauuggaaaagaauaaagaaaaaguuaaagaaaaaaaagccaggugucauggcacaugccuguagucccagcuacucaggaggcugaguugggaggaucacuugagcccaggagguugaggcuacagugagcugugauugugucacugcccuccagccugggcaacagagggagagccugucucaaaaauuuaaaauauauauauauagggagagagaacgagugucugauuuuauuagaucucuguauuuuuuugguaacaggaugaaaaaucuguucagaugcacuucggacccuaaacgguuuaaugcuucuaaguaaauuuuuguuuuuuuugagaggaaucucacucuguugcccaggcuggagugcaguggcgcaaucuccacucacucccagcuccgccucccggauucacaccauucuccugucucagccucccgaguagcugggaccauaggcguccgccaccgugcccggcuaauuuuuuguauuuuuaguagagacaggguuucaccauguuagccaggauggucucgaucuccugaccucgugaucugcccgccucggccucccaaagugcugggauuacaggcgugagccacugcgcccagccaaguaaauauuuuuaaaagaaaguauuguugauaguucagaagccacuguauucucaccauuuuaaauggaagcacacacauaaguugacauucaaaagacuagauuccuuuguggucauagcauaagcauugugaacgucagagaaagacaagauuacauaccaguuauaaucuaggauaaugugcauguaucugaauguucacucuaugccugguauuacuguauguagccagcacucugaggaauaaacuggcagcugaugcagaauuauuaagcugaagaccucuguaagcauuuccuuggugucuacaggcuaccugcgucagauuuaccugagaugcauguuaauaaugcagauucacuggauucugucaagcauaacuccauccuggguggcacucaguugauucuuacgcacaguaaaauuauuauuuaacaauaauaauuauuguauuugaaguuacuaguccagacucuuuucuuauaucuauggcuauaggacuuguuuuaggcagaaaugucuaguaauguuuccugugauaauuuaaaacaaauaggaagauugggcugagcuucuuuaaauacuggugcaaaccauuuuuuuuacagucaguuaaaaaggaauaagaauaaucauucaaguuagauauuuaauauaggauucugaacucauuuuuuaaguguuaauauuuuaaaacuauuccacauuauuuuauguguuaggccauacauguuucaaaaggaauuuagcauccugucuaaaaaguauucauaccuucagacaucucagaaucucagaacuugauuguuaagcuaaguuaugaaucuuuuuuuuuuuuuuuugagauggagucucgcccugucgcccaggcugaaaugcaguggugcaaucucggcucacugcaaccuccuccuccuggguuuaagcgauucuccugccccaaccucccaaguagcugggauuacaggugcacaccacuacgcccagcuaauuuuuguauuuuuaguagagacgggguuucacuauguuggucaagcuggucuugaacucuugaccucgugaucuaccugccucagccucccaaagugcugggauuacaggcgugagccacugugcccagucaugaaucauuuuuauuaggauuacuauguaaguuuacuauuggucaucuuauugaaacuuaacauggccgggugcaguggcucacaccuguaaucccagcacuuugggaggccgaugugggcggauugcuugagcucaguaguucgagaccagccugggcaaaauggugaaucccaucucuacuaaaaauagaaaaaauuagccaggcaugguggcacacgccuguagucccagcuacucaggaggcugaggugggagaaucacuugaaccuggauaagugagccaagauugcaccacugcacuccagccugggugacagagggagacuccaucucaaaacaaaaaacaaacaaaaaacuuagaagguccuuaauuccaaaguuucuuggugcuaguucuaaagugguugaaaauucugcaggugacuggucagaguugaaucagaacuccugugguuggguuguagcauaguggcaaauuuccaaggugugcaaagacaauuuuccucucaucccuggggccacuggagccaccagcuggcuauuggcaaucuuguucuuuuacuuuggguguauugugcaaauauuuucuauaugugccaugaucggaaaaaucuugggaaacuuggcu

SEQ ID NO: 13793 - RNA, 9070 nt, Homo sapiens
cuaaaaacccucuuaccuguuuacaagaguuuauacagcuguuugccacuggaacaccaccuugcagaguauaaccguggcauccuuuguugauaaucaccuguugccuagcaaucaucaucccgcauggagacagacagcacuagggcucuuccauccgagguuaaaauucaaaacaagcccaacaagccugcauuucaagguggucuucgucugcaacuaguuaaguuuaaaacuggcaaacaacaacaauggugucugaagccaauggugcagcauugcuggcuuccucuugaacuccagcguugucaccgugcacugaagucuccugcugcaaacaggggaguuguucuccuguacugggaacaggcuuccaaaacucaggagccccucuguacaggauaaugcaggaacuaaaggcaaacauuuuuccuccuuaaggaugccuccaucuuuuuccucacaaucuguacuaccaaccgaagugacugggccugagugugcguucguaccuaugaaaccgucacggugcaugcacauccaaggcauguggaaccaaaggucaaauaaggcacagauaccaaguaacgguucuaauuacaaacgcuagcucucaggaacucuucauccauucagaacuaaacccaucacugcauaacucugguaagaagccccuggagacggaggagcuccucaaaugugucaggaaaggcuuuauuaacaucaucauuaacauuuaaaaagcaaacggagcauuucuccuucuuuuggcaauuuggugcaaauguuaagugcaagauaaagcaauuucaaacuuuucuucaaauuaaaaaugaaacuaaggccaaacgugaugggugaacaaaauaaaucaaaacuuaaauuucagcaacuccagcucuucaaaccagcaaaagcccccgacucaggcacuguggugaggcuuagggugccugccccggcuucuugcgugccagcaaacagcaccauuuccucaucacguugagaaccgagaagcaaaugauccccuucacugcaaacaaagggggucaacaguaacacuagugauccuucagaauugacacaccgugauagucaaaaugaaauugauggucucccugcuucuugcucaagacauacaagaucugagcagcagcaagcacccccucggcugcaaacaaaggggucaaagguuugccgucaauucacuuccaggcagaaaaacauuuuccucaaaagaaacaauuuauuuagaauaaaacaaaagcagcucaacugugagcgcacguuugagagacagcuacucuuaagcugugugagccauaaaaaggguuuuucuuuacuuuuccagaaaucuuguguacacagcacaaaucaaagaggucauuuuuuuuccacuuaaaacaccggcauuggcaucacaauagcagauacacaacuuuaagcugccauuuuaguaaaaugcacaaauacuaaacagauuagcuuucuuccaucagaggcccauguaaacuccacauaagccacaacuucucuucaaaaagguccauuagagcuuugaauuccauaucuucauccgcuguucaaccaguuuugcuugcggagggggggaaaaaaagguuauucaguacaaauguuuacaauauuaaaaauauauauauuuccccuaugccauuauagaugaacauaacauuaacaagaccuuccuggaugguucaccucaacuucaaaaagcaccaauaauacccacuggcauaaaccuugaaaugaauuuacuguaugaauagacauauaacaaguagaacaauaggguggguuuuuuuaaagacugcaauugaagauaacaggacugaaaauauccuuuaacucauguaacugaguaaaacauguugaaaaaauucagaaaaaaguuucacaaucaauuuauaaucuaucaauauauucuaaauauaacuuaaaaagugaaacuauaaaaagguaaaguuuagucaaacuuuugccccaucuauuuucauucuguaauuuauauggagcaacauagacuacuccauuauuguagaaaggggucgauacaaagccauuuaaaaauccacccucaucuauguuaccaaagacagcagccguuauuuuaauaaaacacucauacaaauaauuguuaaacagccaaagaacacuucaggaaucucacuuuucaacucuguuuaaaccauacauauaaaacucuucauucagcuuaacauuucacugugguuaccugaaaucauuuccucccuuuagggacaccacuauaaccacuauaacagggucagcgccaaguuuucucucuucuuguucucauaccuaacuccuaucugaaaaccaaacccugugagagagacagaaaaaaaaauguccagaaauucucuccaaaauuuuuuucacauaaaaggucauuaaggcccucuucucaagaggauuuccuaauucuguuaccagaguuuuuggugauugguuccuauauggacccaaacuauaguucaagcuguauaugcauaaugaacaaucugccuuaaaaaaguggauuuacauuuuuuauuuuuaaaaaagcauugucagugaaaaccugcuaauaguuuuuaaauaaaccuaaacaaugucugacucugaaagcaauaaccaaacaccugacucuuauuacuggaccuaaaaugaccuguaacugagucaagaagggccagaguauauuuuaccuucaaaaggugacaaaugcuuauaaccagccaggcgauggacauuuuaagauguaauccucaaaagaaaaacucuauccacucucaguugagagucaaaguacaccagaaauuuaaaacuuugugugaaaaauuauuuauaggaaucccaacaaaauacuuaaccaaaaaguuaagcagaacuauuggcuagguauugcuugcuuaauuuuccauaaaauuugaagcugugaucuaaaagucuuaucuucacguuuuuaccaauaauacuuaauagucauuaaaugauauccugaaguuuucuuuccauucauuuuaacugaguuccagaaaaaucaacuacauuaaaauaauuaaagaagaaagauagaaaaaaauugguuguuacaaagaacauucaacguugggauuauuaaauccuggcuaaugagaaguagaaccgguuuuagacuuuugcuuucauuugaauucuuaagguuuaacuagauacuuuauggauauuaugaaccugcacaaaagaaugggcaguacaaauaugagguucauguggacuauggcacucuguagguaaugaccaacuaaacauaauuaguuuuuuauaauacauacauuuagaaaugguaucaagccauuguuucaaaaacacugaagcacaaauugcccagaccuaacaaaagcggcaaugucagguaaagauucaaacaaacauggagcaaaaacacaguacucuucuguacgcugucacacuaacaaaaaacaaaaaacaaacaaaaaaaaagaaaguaaaagaaaagaaauaaaacacacauuuuggaugacaguaaaauuagaugucauggacuucacucuccaaaagagcaaaaucauuuguccaacuaucucaacaaaagauauucaaaaauuaaugguuagugaguuuauuuaaacuggaaaaauguagcuggccacaaauuauacuaugagcccacguauguagacuccacacuugcauuaguuucugaacaggugucuacuccaaaccaaccacagcuuuuugaaagcaagaagcaucaaaagucuucauuauaggauuucagguauuuucccaagaggcacaaggaccuucaugcucauagccuagaaccuuccuucucucaaaauggcuaguuuuuccaguuuaaaaacaaacaaacaaaaacccccacaaaaccugcaaacuuaaaaaauuauagaugcauagugaaaaccaagagggaugacacagcagugaugacacuuuugugcugacaugcauuagacaccugucauaauggaaaauaaaaauuacaugacauuucccuggguuauuauuggugcuauuucaaaacuaccagcuuugauaacagaaagaaaacaguuggguucugccaggcuucaaguuaagucacuuucauagaacagaaacaugaccaugauccagaagguccaaaagucucuaaucauaauuaaauaucaagggccuuagcugaagucuucagcacuuaaaucaagggagaaaaauauacuuacuaaugaccugacaaauuaggggugggacagaggggauagauuaaaaaaaaaaaauccauuacuguuaagcagcaaaaguccuuguugagaaccagagguugauaucaucucaccuuugaaaaaaaaaaaacugugaggcuaaguuaaaugauccuguauuaauuccgggugucugggaaaauaaaacaauuaaaaaagguuuuccuacacugacauuucaauuccguagcuggacagcagugagaauauugaacauaaaauuuccaagauguucaaaacauuuucaauaauguaaugucacuacuguuuaaauaugaaaauaaaaagacaagcaaaauuuuaaaagagcaugucaaaggcauuuuaugaugacuuuuuaagaaauucugcaauccaaauauggcugauuuaaaugcccacugaaauaaaagaugacuaugagccugcagacaacucuucuuucuauuauugaaaccagaaauuugaauugauacaaaaacaaaaacucaucuuugaugaagaacacuuaguuucgaaauaugcacgauuagaacuguaccugcuacaccucucugaaaaagucaguaaaaacaccaccacacaccaauaacugaccaaagaauucugauuuuaaaagcaccuacucacuucuugcauacuaguguaagcauaagacauauaugguuuguaacauaguccuuaauuuuuacugaacaguuacugcuacaaaccaaaagugcauauaugggauacagaacucuagaacaaaugauuuaaaaaaugcauguuaaagcaaacucucugggaauaaacuguaucuuaagaaauacucaaauaccugauuaaaauaauuacauugcuauacaauuuaccagcauaucuuugagaucccugaucaaauuucagucacacacauuucugguaaaagaauuauuuaccuacacaccaaucgagucauuuuuagguggcuauuacucucuuuauauggucaguggacuccuuucuccaaauucugacuuuucaaaauuuugguuuuguaacucugaggauuuuuuaagcucaagauuaaaaaaaaaacaacugaauagagaaaaaaaauuacucauaagggugggaacuccuaauuaaagcaaaucugucugccugccugcuaccuuuagggcaucccuuucacuuaaaauaauagcuaaacaaacaaaaaaauagcuaaacuguccugauuucuauuuuaaagacguuuauaaaaauauaaaaaagaaaaugcuacaacuaacaacuaaaaagaaaauugcaucugaugcuguaucccauuacacaucacaaaacaggaaccaugucaaaguaguaaauacaaguuacacauggacuuuaggacgcaccacggacaaugaucaugaccagguaaucuucuucagauuuggccagugccuuggcaggggaauccaggaacugcugggagaacucacaaggugggaaggcaugaaggaccccgguguuuuccuugucuuuguugccccccacagggaggcugaucaccccggcugccugcuuuugcuuuaaauaggacacaagguuccuaaguggccucugaguagaaguggcagugucugaugcagcugaggaagaggaggaccggcugucagaacuuccaggcacagccaaaagaauggcauaaccauugggcccugcuacuuugaugcgucgaguuacuucauccaacuugggcugguccaaacggagacgcugagugaucuugagcugggccacuuugccuccaguugaacccuccacaagaagacuacuagccacuuggaggucacccugcaacagaugcauguuggaaggaaaguugcuguucuucaguagaagcaugcccugccaggccaaacagaguuugggagaggcugaugccacaggggcuguccccccauccuguuucugggacggggacuucagcuuggaggaagcagugcuggugcuaggugcacucccaucagagcggucuucuuuuuucagagggcuuuuucccucagugggagcaguuguccggugcuuccuaucucguucagcugaugcagaguuuuuacggucucgcuugucacccuggcucuucuccaaacuaccucgucugucucugauuggagagggccuuuccaagagaagacgggaagaucgaucauugucgcuguuguaacgaucccggcuacugcucaauucuggacugcggucaggagaaggagcgcagugacguuuucgugggcggucacucucaggagaccuauccagaugacguccuccacucuccucaggcagccuucgcuuccuaggcuggucucugcugcugggcagaucucgaucaccucugucccgguccaaggaccaaccaucccgccugcgaucuaggcuauccaguggcucguaagcaggcacagaaguagcugcaguccgagugcugcguucucggacuggggguggggguggcacccaaucagagucaggauaaaggucccuaucacgaucucuguauaguaagggugguguccuaucccgagcaccccucaaagggucuggugcccgauguccaaaagcaucugucaccagcucauaaugagucaagggcagaggcugcagauacugcugcugguaacgauguucggugucggcaaagucuacucuaaggcgucgaucugggccaccaagugggaagccccgcauauggguccaggcagcaugcgcugcauccaggcuuucauacuggauauaugcccaacuaucaccuuuucgguagucuauggugcguauggugccaaaucgaucaaauucucgugccagggcagcaagaggaacccaaggucccaggccucccacccagaggcgggugguggguguagcuuuaccauaaccaauuuugauaggauuccgaauuauaauuuugccagacauugcuaauuuggcccggugagacauaucuaaguucucaaauuugagaaagccguaaguacuagucuggccgcgagaaggccucuugauaucuacuucugugaugacuccaaagcgaucaaacgcccuucuuaaaucacucuccguuacagugaugucuagguugcccaagaagagcguccgguuagcucgcugaucauccucgggugaaaucucauccacuucucugaaaggagcagcaccugcuccagcucccacccuuggcucaagacuguaugcagggcgcacucucucauagaacggguagucucuuucucucuccaggucucgaggcaaugguggcggagguggagggggcaggcggccaagagccaacugcugcagccgguagucucuguaucccaaagcagcgccaccaggggaaagugaucucuggccuccaccaccuccaggggggugccggugaccaccuacagaggccccgaccacacuggcugauggaggauaaguaucuuugucuaaaggggagcggcugcggcgccggcucacauacacagcuucuaucuucagaggccggucauagagcaccaggcggccucuggcaugcuuggccgcccgcgcguccucuggccgccggaaguucacaaaggcuacccgcucauccccgcugccagaacccgacagaugacugauuuucacacuuacaucaccgaagcguuugaacucaugaaacaggccguccuccaccgcuucgucacuaagcugggaccccaacucgcuuaucuucagagucuuguauuccgcgccguccccgccgccgggagcugaggaggcggccccagaggaacgugacuccccgccuccaccccgggagcugcugcgcgauucgcccccgcccgaagaauuuuuggugcucggggagcuauaacuaugcaagcggcuacuggagcugcccccaccgguaucauacucgcggcugccaccucgacugcuggacuuguccagguggagacuccgccgcgacccaccgccgcuaucggucuuuccgcugcugcucccauugcugccaccagagcccccuaacuucuugcuccgcucaccgcgggaagucgaguccucaccaccacgggagcguuuggccuucacuggcgagcgcucuuuucccuucauuguugcgggucgucggaggucgucuccgcggagcugaguaacccgccgccccgcgcucguuucacacagcggaaccgcacgccgccaucuuggacuccgccgcggcacagggucccgccccgcaguccucauuggccaauugcucucucuucuacagucucauugggaaaauuauuugucuaucuuuacaucuccccgcgcuccaggaaggcgcccgcccaaccacuguuauuggguucccaacccccuagucggaguaccucauugguuacauuuguugucuaucuuaacgguuccucgcgccagacuguagcuccgccccucgcacucugcggucacgugacccaaaguguugagguguugauuggacaaaaagucugcccuguaacgguacuucuugcucagugacagcagcaacccaccuccuuaucccuuucauuggcuuauaaacccguccuuuaaaccacuauuugggaggucgggccaucaguuucggcguuuuuuccagagaggcaggcucacagcgauaucgcgagagacgguaagcucccucuuucgacccccuuuuuccaacuccuccggcggcuaaaagaaguuuaaaucugauuggaugucggcaaggaaguugauaggcugaaauaacuguccaucacucgcuuaaagggguaggccuguauaacggaggaggcugacugaaggugaaa

SEQ ID NO: 13794 - RNA, 1056 nt, Homo sapiens
ucgcacucugcggucacgugacccaaaguguugagguguugauuggacaaaaagucugcccuguaacgguacuucuugcucagugacagcagcaacccaccuccuuaucccuuucauuggcuuauaaacccguccuuuaaaccacuauuugggaggucgggccaucaguuucggcguuuuuuccagagaggcaggcucacagcgauaucgcgagagacgguaagcucccucuuucgacccccuuuuuccaacuccuccggcggcuaaaagaaguuuaaaucugauuggaugucggcaaggaaguugauaggcugaaauaacuguccaucacucgcuuaaagggguaggccuguauaacggaggaggcugacugaaggugaaagacuagaacacgugcuugcugugcgacgucacuuagaugucgcgagagggugacugugcgccagccccgccuccccgcguuuucggcguucuccccacaaacauuuguuaaguuccgugggguguuuggcugugcuucggcccuuggaguucgaaacuucugagcuccccgccgucguaccugugccggccaaggggcggggcaggcuuuccggcugucggggcccuccagucccucaggaagccguccugggacgccuagcggacaccauuuuacgucgcugugguagcugagugaacagccggggggagccccgccccccgcgcgcgggagagcgccgcccgcggucaccugggcccgcggggcagagaguucacgguuccugcagccucgggucaugcugacgcccccgggcggugcuaacacguaacacgcgggaccucgagagcuaagaagcagggcgacuaagacgcagcccucgcccaggagcccgucucucccgcgagcuacccguucccgcccaaguacuccggguaaccgaggggagugaccgucgcuccccgccucguggcccgcgggcggagccggaacugucgggacaccgcggacgugucuuugggcggcauguuuuauguugcgaaucuguguggauuuuuaaauucuguauuccccua

SEQ ID NO: 13795 - RNA, 1056 nt, Homo sapiens
uaggggaauacagaauuuaaaaauccacacagauucgcaacauaaaacaugccgcccaaagacacguccgcggugucccgacaguuccggcuccgcccgcgggccacgaggcggggagcgacggucacuccccucgguuacccggaguacuugggcgggaacggguagcucgcgggagagacgggcuccugggcgagggcugcgucuuagucgcccugcuucuuagcucucgaggucccgcguguuacguguuagcaccgcccgggggcgucagcaugacccgaggcugcaggaaccgugaacucucugccccgcgggcccaggugaccgcgggcggcgcucucccgcgcgcggggggcggggcuccccccggcuguucacucagcuaccacagcgacguaaaaugguguccgcuaggcgucccaggacggcuuccugagggacuggagggccccgacagccggaaagccugccccgccccuuggccggcacagguacgacggcggggagcucagaaguuucgaacuccaagggccgaagcacagccaaacaccccacggaacuuaacaaauguuuguggggagaacgccgaaaacgcggggaggcggggcuggcgcacagucacccucucgcgacaucuaagugacgucgcacagcaagcacguguucuagucuuucaccuucagucagccuccuccguuauacaggccuaccccuuuaagcgagugauggacaguuauuucagccuaucaacuuccuugccgacauccaaucagauuuaaacuucuuuuagccgccggaggaguuggaaaaagggggucgaaagagggagcuuaccgucucucgcgauaucgcugugagccugccucucuggaaaaaacgccgaaacugauggcccgaccucccaaauagugguuuaaaggacggguuuauaagccaaugaaagggauaaggagguggguugcugcugucacugagcaagaaguaccguuacagggcagacuuuuuguccaaucaacaccucaacacuuugggucacgugaccgcagagugcga

SEQ ID NO: 13796 - RNA, 20135 nt, Homo sapiens
caagauggcuucuaacacuggccgccacacuuaauauggcggccagggaaauuuccuggagaaaaucacgcgagaguugcaucacggcggcugugcgcgaguuaagcuggggguguggagcagccaagauggagccggcagucggcgguccgggcccacugaucgugaacaacaaacagccccagcccccgccaccuccgccgccggcagccgcacagccaccacccggggcaccgcgggccgccgcgggccuccugccugggggcaaagcccgcgaguucaaccgcaaccagcgcaaagacucagaggucaggagcuucggggggcgaggcucgcaccgggucgggcggcgccgggggucccgggcccggggccacucuaggggccagguugggcuucccggagggcucgguagaguccggccgagaacugucacuauacagcgaaaggagcaggaagcgaggcuggcagcuccuggggucuggagcaugaguccuugcucuagcuccgccgcccgggagagcuucccguggccggcgacugcugguuugcuccccugggccccgacugugggcguggccucgaggcccuagccccuggggaagccgcucucgccccagcucgggggugaggagucgggggucuuggugcacuccagggcgcugggcugccgcgcccccaaccuaaucaucucgggcgucugucccuggcacgcgggcuccagcuccuggguccugccgcucgcagaggaaggcgcgugugggcagggaaggcgccggcgaggaucuggaaggaacuuagagccggaccgagcuaauuaucauugagaguagaguaggagggggaaacauguccuguucuucugaccugagccagaucaggccauggguuaacaguaccuguggugggcuauugugcccagugcgccugauacugaacuguuaaagaugagaaauagacauuuuaagcaugcguuaggacccaacauuccuuccugucucgcuagugagccguuccugccguucuggagauggcauagucuggaacugacuaguaaccucaccccaaguuaaggaauuccucccacugccuccuuuugcagaauucaugaaugaagauacucaugucgcggaguuuuagggcuucuuaaugagcagguucccagagcacuuacuaugccaucuccuagauugaucagcagccaaacugaucagccaaguuaaugagagggaauuccuaguuguccaagcauaauguaccaauucauaccaaagagcaaugauacuaccuuuagaccuguggaaucaguuccucagaagcuuuuauuuuuuguuagcaaggcuaaaccccugagaaaacaugucaacaauuggcaagcccgaaguagacguaauuugagcuuggagugaauuauuugaaaaaaacaaaaacacugaccauuuaggagcccuggcauggugggaugacggacaucaguguuaacuacucaguuuuucaaguggaagauuacgaaagugcaggggggugaaccuaccuucaucaugagaggaguuaucauuuugaaaaaugguuuaaaauuuuccagaguagcuacgaauggucaaauagauacccucugacgaauuguaauuucucuuuguacccuuuaauuuccacauagaggccgggugcaguggcucacgccuguaaucccagcacuuggggaggccgaggcgggcggaucaccugaggucaggaguuccuguccagccuggccaaugugaucaaacccugucucuacuaaaaauacaaaaauuagccgggcgugguggcuggugccuguaaucccagcuacucaggagccugagacaggagaauugcuugaaccugggagguggagauuugcagugagccgagauugcaccauugcacuccagccugggugacaagagcgaaacucuccccgucucaaaaaaaaaaauuuccucauagacucauuacaugaaagaccagucaaauggacacauuuaagcagagaccugucuaaauccauuucuuuauagagagucugaugccaugaucuuucuuuagucauagcugaaaucgguaguuugggagccugaucagugaaugccuggaggacagggaggcucacauuugaugagagcccacuauguacuacauaauuuugauuaguccuuaaaaaucuucaaaguagauuuucaucauugccauucaaugaaugaagaaaccgaagcucaguaacuugugaaaguguacacuguguuaucucugaacacaacguggaguucuuguuuguggguauguuuuuuguuuuguuuuguuuuguuuugagacagagucucugucugucucccaagcuggaguguaguggcgcgaucuuggcucacugcaaccuccacuuccggggcucaagcgauucuccugccuuagccucccgaguagcugggacuacaggcacgccccaccauguaaaaauauauuuuuaaaaaauuuuauauuuuuauuagagacgggguuuuaccauguuggccaggcugguuucaaaguccugaccucaaaugacccgcccaccucggccucccaaagugcugggauuauaggcaugagccaccucgccuggccauuguggguauguugugucauuuuguggcuggucuuugucuucccagguagacuguaauuaaaccuaaggacuuuaccuauuuguuucucacuucucucuucccaguacaaggcuuccaagaugguguguucucaguaaucaccuauuuccagcaggaaaaagauugucuuugucacauuuucucuuaugugugggagggaaguugaucuguuuggcggcugccuucuuugucaguucucacugaaauuugagacaaaggugggaaagcugaggguuucaauacucauuuuuguccugagcuguugacaguccacuagccagaaagaaguuaagacuucuggaaucauagcaucauauggaauggucauuuacugcacaaaauacauagaaaccuuguauuuauucauuuaacaaauauguguguauagaccauucauucauucacuuauucaugccagguaccaugcuggaccuugugaaaucauugguaaguuaaauggaugauguucuuguucucagggaacuuacagucuuguggaaaggcagacaguaaacacauccuauaaugauaaguuaugauaaaugcucugaaggaaaaguauaggauacucugagagguuuuaggaaacaaaaugugaaaaaacauaaaaaaguggaggcagugguguccuguaacacaacagcaucucgaagcaugaguuucuuugauaaauagaaugauccuuuuuccuaaagcucucuccucuugucagcagggcuauucggagucaccagaccuggaguuugaguaugcugacacagacaagugggcugcagagcucucggguaacgcacagaccuuuguguuauuugggggugguuuuuuccuuauuggucuuuaauaaaauuaauaaugaauaucauuuagggcuucauugcuuucccuaguucuaucaaauauauauauauauauauauauauauauauauauauauauauguauaaaacauguuauuugauucaagccuuguguaucuuauaacuuuguguuguccuuuacuuuuaugaagcuggcuagagcccagucccauugugagacagugauguuccuuggcuauccacugugacccugacaguggucucuccuccagcaaugggucaugagggaugccugcaucugugcccaucugcugcugccacugccacucucauguaaugcgaggucggugugagcugcuucuccagccucuacaauacacauccugcucaagagguagcagccauuugagagaugcaucccagguggccgucagcccuggcauggcauggugggauggaugcacaucggacuggaaguguccagauggcauucuggcacucugguugucucuauugugcacaucagagcacuaagauccccuucauaauuagagagcuuauuccaggagucacuaugacucaggggcagaguugagaguggaagcaaaugccuugccuucucugcacuugugagaccuggugugcaaugcagacauggaaccaauggugacgagacuuuguucugacagagcuuuacagcuacacggaagggccagaauuccugaugaaucgaaaaugcuuugaggaggacuuccggauccauggugagaugauuucccacacuucuugcuuccuuugcccugcauaacgagagcugcagguuucuuuuaggcaucugaaugaccugagucauccuggaacagccugagaagccugcugaacccugaugguucaaagccagauacauguagagugggcuuguggcacaucggugggggcuuuucagaaugugcauauuaggggagaaaaaaaaaucaugugauuaaaauugcacccaaaauaccagcguuucaguuuggaaucaaauucauagagcagcaguaugaucuuaccacuuacauaggguguaacuuaucuuucugguccuauggcaguccugaauuuggugaguuaacauggguccaugccauugugaggauuuuucuaggcucagguguaacugguuucuugcccugcagugacagacaagaaguggacugagcuggauaccaaccagcaccggacccaugccaugaggcuccuggauggcuuggaagucacugccagggagaagagacucaagguggcucgagcaauucucuauguugcucaagguauugaguggaccuccccaggguucccuggcaccucugcccacucagaugcagggaggggcucagugaguugaacccugcauugcaggcacguuuggggagugcagcucggaggcagaggugcaguccuggaugcgcuacaacaucuuucuccuccuggaggugggcacguucaaugcuuugguggagcuucugaacauggaaauagagugagcauuuuugagaggcugaguagggaaggggaggcugggaugggaagggggacagagcuugcagaacuaacuggcuuugagaggguuaaauggggcagaaguucuggucccaggcuguguucugaccaccuggguugaauaacggaguuggucacuuacaccuugaagauuaauggagacuaaugacaggucccugcagcucccugaugccagaguuuuuacaccagacagugcaggcccugcccaggccuggggugcuccucagaaggagacucuucacuuugagcucucuuuugaaccugcagacacugcuguguucgcccugcaguuuccgccuuggcaggaggccaggcacaagacugacauaugggcucaaccagugccuggccuugccugugucaccuuuguccaguggacaggucagcugcugcucaucuaaggauaacaccaucaaugauaaagcuaagacagcucauugagugccugugugucccgggcauuguucucagaauauuacaugugcuaauucauguuaaggauauagguacuacugucauccccauuuuacagaugaggaaacuaaggcgcaguuagagccaggauucaaaccguggcaguccagugcauggcuggguuuuuuguuuuuguuuuuguguuuuuuuuguuuuuguuuuuguuuuugagagagagucuuguucuguugcccaggcuggagugauauggcgugaacuuggcucauugcaaccuccaccucccggcuucaagcuauucuccugccucagccuucugaguagcuggguuuacaggugccugccaccacacccagcuaauuuuuguauuuuuaguagagaugggguuucgccauguuggccaggcuggucucaaacucuugaccucaggugauccacccgccucggccucccgaaguacugggauuacaggcaugagccaccaugcccagccauggucugguuucuuaaccaccguguccuguggccucuugugcaguccaagcacguaucacagcauuuuguuuccccauuggucaguacuugucagggacaucacuuaucuuccuucuuggaggaagaugcugacucucaaaaucuccugcagcaacagugccgccugcagcagugcugugaggaagccugccaucucccuggcugacagcacagaccucaggugaggcgagcagcaagccugggcuccugagcguuagucagagaugagaucagagcagggugugggaggcugucugugggugucauugcugugugugcuucuguacacaucaucugcaugugugaugggcucagugugaaugauuaguaggaacugcugagggcucguccuaggugggacucuggguugagacucccaaaggcaauccagggucaagugacuuacuagagccacagcuaaguguggccuccuacucacacuguuacucaggaccuggucgugggguauuuuguauuuggaugaaacacuugaugguguucccuggacucccaccuucuuguguacacagcuugaugcucaucuucauuggguuagaccugacagcuuccuaauguuucauggcugcccaggagcucacagcaacugcugaccaccaagaucaccccucaguuuuugaggguugaaaucuggcucuuuuuaugaauuuggaaguuuuuagacuaggugguuguaguguugccucccggguguuaggaucccugggcgucaccucucagcuccugcuuuccauuuccucaucauaaacccuguuuuuguucucacugugacccuguucugcuuugacccuacagcucgcuaccaccucugugguuuuuuucuuuucaggaagcuuagggugguaaaugcuuuuggccauucuuguucauacucauuuauucagauaccauuuauuaauaguaagccccugcuuuguguaagcacuuuguuagacacuagggugcuccuuugacccccccaucccacuccauugugagcuggcucuuguccucaggguccugcucaacaucauguaccugauaguggagaccguucaucaggagugugagggugacaaggcugaguggaggaccaugcggcagaccuucagagccgagcuggguaggacccuggggauccucucuagaggcccugccuggaagcugaggcggaaggcuuugggaggguccugauaccuuugugucaccuccaggcuccccgcuguacaacaaugagccauuugccaucaugcuguuugggauggugaccaaauuuugcaguggucacgccccucacuuucccaugaagaaaguucucuugcugcucuggaagacaguauuggugagcaccuccuuggaggaggagaacggugcuaugggaugggcaguagggagacuguuccuugaauauccuuuugaauauugaauuaugugacuguaaaacugcuuugguaaaaaaaauuauuuaaaaagcugcuaaaaggagaugacaaaagaagggccacuauugucccauugcagccaacgaggacauaggccuugagucagaguaggcuguuggcucucugaccccggaagcuguuuucugucauagaacagcucucccccagacaaguugccucucagcaagcagcucuggaccuggaguuuguaaagggauuugaggcaaaguuacagcugauguaauuggggcccugguuggauaucacuuaaaggggcaagagugagcccugagccagccuccauuuucuucaggguauggugucagcccgacucugugucuagguagggagggacugggugccagagugggccguccagcacacugggcuuggagcguuguuagcagccaggccaugccaggaggccuucccaggaggagugacauggggaggcgguggaggugaguugggccucugcuacacuggggcucauccuuccuuucagaaugggucaacucuggagccagggcucaguaaguauaggauuucuuaaaagucauugacacauuuuaucuuggccacacauucuguucuucauaaagccuugcuaaggcuagagaggaaagcugaauugcucagaaacaguaaaacuaagcagucuaaagcuggauguugcuggcguuucugcuucuugggagauguuuagaugaagcuuuuuuucuucuucuaaaguugagcaaccaacaguauuucuaauuugacuuugaaagacuugcauguacaacuugugaaacaugagucucaccaacuuuucuaggaacuugcaggguuaggcucuuugcuucuuuuuaaauugaagaguaugucauaggugcagaguuaguguaucugcacuagggucagucagccugcaucuccacucuuuccuuguuccuuuuucuccuuucccuugcggaugucacggaauucuccuugggaguggcuucaguccauuguucaggaguugccugggucucuauaaagacaugggucaugaugucaugaauguuucugagccugacacaauggucaggggccagccuguggacacauugacccuggcucugcuucccugucugugaugcagugcacgcuaggcggcuuugaggagcugcagagcaugaaggcugagaagcgcagcauccugggccuccccccgcuuccugaggacagcaucaaagugauucgcaacaugagagcagccucuccaccagcaucugcuucagacuugauugagcagcagcagaaacggggccgccgagagcacaaggugaggacgacagaggucccugugacuccugagggcccucaaggugcaugcuugcagcagcacaguccuuggaggagcagggcugcuggaaaugaucucugaucagccagucagaaucaugccuccacagcgaggauacuuuguccccagcucugguccaguguauggugagugcucagcacguggugcuuuugagggacuggagcaagaaguaguugaugguuuggcccccgucuugacucccacugugguuuuuccacuguucuugccucuacuggacaccuguaugugcugugucuccucuggcugcacuucccuggucugcguccucaguuggcucuugucucaucucccuucccugguuucaggcucugauaaagcaggacaaccuagaugccuucaacgagcgggaucccuacaaggcugaugacucucgagaagaggaagaggagaaugaugaugacaacagucuggagggggagacguuuccccuggaacgggaugaagugaugccucccccgcuacagcacccacagacugacaggcugacuugccccaaagggcucccgugggcucccaaggucaggugagucucagaccuccagagcacucauaguuccugaggcagagcccucacacccucaggccugccaccuggccugugucaccaugugugguccucugcagggcaggcugaccguggcucugggaugaggcucucuuaaagcacccugugcuguccugagggucucagggaggccggccuugcuggucucacacaacauggcccucauguggcuacugaggcaguaauuggaguuagcucuugguuagaugugcuagugaagggggauaggaaacaaauaaaaacaaaagcauuuaagcaaacaugucuccacccauccugggguuguguaugguuuuuaacaaaaaugauagauuaaggaagaguuucuuuagagccauaaugaaaauguuugagauauauguggguaaaucgauggaugggacgguaccuggagauauauaaauggugucuguuugauaggcagcagcuuaagaaauagaugaacaugugagaggauauagaagucgcuuucuugauccagguaaagccucaguuuucagugaucugugaagggaaugcaaaacagaucaucagaaaaugcaagguaugcugauuguuugggauaggaaaagugagcuauaugaaaaaucaguagccuauagcuuuaauuguuuaaaaguuuuaauauuuaagaaagucuguugacaaacuuguucauacuaucugaauaaagcauguuuuuaaguuugauauaucccuuuaauuuuaugaauaaacuaguuaacauguauuuccagguuacugauccagcaaaauuauaagaaacauuaaaauucucugaaaauuucaguuuuuucccuuuuuucaaagagaaaaacaauuauaggagacuucuccuggcuucacaguuucuggaugcuguguuuuuguuaacuguaacacuuugaaauagcauuugcuaaaaaccuuuuuucuuucucucuuuuuuggugauguggcagagagaaagacauugagauguuccuugaguccagccgcagcaaauuuauagguuacacucuaggcaggugaguaaaagccgaguucauuuugcuguuagcucucccggccuuugguguuugggaucccaggugauuugaugucgaggcucaacacagggccuucuuuauucuccagugacacgaacacagugguggggcugcccaggccaauccacgaaagcaucaagacucugaaacaggugaguggcuuugggugagcuuuuggcuuguuugguccuaagugaguagagugaaaccagccuguagggagaagccuuuuaagacuguugucugccugcaagaaccugggguagaggccgggguggacuuugcaauaaccuugcaaacagucuuucguaaguuuugcuuguuuuauuauaaguuuuacuuguuuuagcugagcuuuuguuugggacugacugggaagucuuuaaagauuauauuaccugaccaccgggcaccaaggcaugcaccuguagucccagcuacucaagagguugaugcaggaggauuguuugagcacaggagaucaaggcuacagugagcuaugaucaugguccugcacucuagccugggccacagagugagacccggauucuuuaaaaaaaaaaaaaaaaaaaaaaaggauuauauuacuugacaguuguugaaauucuaaagagcucaauaaauagcccuccuuuuccuugcccacguucucaggcgguugaaauagaggaguaggcagauggagauuguaaugccaacuuuauagcucauagagccauggagaaugaggcuuaagaacacagcaguaguguccuaauacguuguuccagaauuaggcagaguuaccuaccagucccaggcaguguggggaggcucugccaagcuugguggcggggaggagaagagagcagacucucagcaggcagacagguucuaaagagaaaagagaagggugaggacaaguccgcccuguguccccucccauacucuccgaucagagaagggaggagugaguguguggacggggcagagagagaugagggguguuucgcaaaccccugucccuccacacgggagagaacauuaagaguggggaagaggcaucuccccuaacagcuaucuggagugaaacuguuuuuauguuuuugaaauauauuuuuggaauuuguaguacuaaguggucucucugcagcuaggcuuuuugaguacuugauuuugcuuucaguuuuucuccuguugcuguagcuaucugaaaggccauuucccuccuuuaauuuacuuuuuucuuaucuaccaugggcuucuuacuguaguugcaagaggaaggggcccuuuuagaaaaauauuuuggggccaggcaugguggcucacgccuauaaucccagcacuuugagaggccaagguggguggaucaccuaaggucaggaguucaagaccagccucaccaacauggcaaaaucccaucucuacuaaaaauacaaaaauuagccaggugugguggugcacaccuguagucccagcuacuugggaggcuggagcaggaaaauugcuugaaccugggaggcggagguggcagugagccaagaucaugccacugcacuccagucugggcaacagaggaagacuucaucucaaaaaaauaaaaauaaaaaauaucugggguuugggauuuuagcuagggauuuuuguggugacuuaauccucuuucagaagacuguguuugaagacaaauguguggggauuuugcuagagugcagggaguuuggccagagaauguuuuccccagcccuucuuuucccaucucucccaccagcacaaguacacgucgauugcagagguccaggcacagauggaggaggaauaccuccgcuccccucucucagggguaaguuggagguccucaguccgggcgcgguggcucacgccuguaaucccagcacuuugggaggccgaggagggcagaucaugaggucaggagauugagaccauccuggcuaacauggugaaaccccgucucuacuaaaaaaaaaaaaauuagccagccgugguggcgggcgccuguagucccagcuauucaggaggcugaggcagaagaaugacgugaacccgggaggcggagcuuguagugagccgagauagcgccacugcacuccagccugggcgacagagcgagaccaucucaaaaaaaaaaguuagagguccucuucagcccccgggauccccagcucuucccaggcauugugcugggauuagaccacaagguugccccaggcccugcccucaaagagcucccaguccaccucccagugcacaggcugagacacgucuagugcaggguuaagaauacagacugagucaggaaccugccucugaugccuggguccaccacuuuauggauggcaacuuaggcaaguuacugggucucucuaugcuuuauuuccuugucugugaaauaggaauaauaauaccuuuauaggguuauaauaauaaggaugaacugaguuauuacaaguaaaaugcuuggcacauuguuuguguucaggguuugcuguuaucaucauuaacaucauuauguacaucacuguuuacagguuuuccuccagccagcuaggaagcuggcucaggagauuguauucugggcugggguuuuaugcuuguacucauuauguuaaaagggagaagaagaaguugagcaagucccugcagaaacccucuaccaaggcuugcuccccagccugccucaguauauggugaguggugccugcagugggacacucccacuacacuggccuuagagcaggcccugccguccuccugccaccugcagaccaacaggaggacugcucagagcuuaauuuugacccugggcucucagaccugugucugaauggucuacucuucccagauugcccuccugaagauccuguuggcugcagcacccaccucaaaagccaaaacagacucaaucaacauccuagcggacgucuugccugaggagaugccgugaguaucauucugugaaugaagcagguggggcagaagauagauggagaagggcaaacauuuuccucuugucagguugguuguuguuggcccagcucuacagguuaaauguagguauuuuugacccaaaaaaaggaaacuacgagauuaaagaguuucacugguuggggagauggcuugguccuguuggccuggauucuaguguagacucuaccacugagcaaacuccugagugaauuggggaaagucauuuccuccucuguaaaaugaauggggccacccuggacauuuccccaaagccccacucuccagcugugauugagacacccaggaugaggaggguuaguuuguagacagcuugccagcaacagcugaaccugugccagguauagagacaucccuuuucgccagugauugggcacgcagaaugcuggcaaaugucucagggcgauagagugagauucuucagagcucuucugcccugugcccuguacuugucuuucaugugagaguccagauugagaucauguucuacuuugagaaggaccuggaccuugaccugaucuucugccugccugggccaccagcccugagcccagcuccuggguggcuguggccccggaguauggcagugauggccggcugagggaggaggcagggguuggcuaacaccagagggaggaucacagaacacuaggccaucaugugaugguccuuggaaaaaagguucuagagucaaauacuguauauuugauucauggauuucucuuauaaggaggaauuccucuuacaaagauguacaaugagaaguccugaauuaagaaaccaauguaacucagugcuuccuaaauuuaucuuacuccaaaacccuuuuuuuccaugacaugaaacuugccaauauccugguauuccacagaacacauuuggagaacucagguuaauauggcagcagaagcuuaggggagaucuuggaaaggagaagaaguucauuuuuggaggaaaggcagagaaacagacugagaauguauuugagggcaucauggggaagaaauaaauugugcgaggcuacauugcuugggagguggaugggggagcccucggcugacuucugagauguccuuggggugaguggggagguaggagucuuugcccagggaggcuccggaguccaucuuuucugugggcaccuagaaaugagguacugcgcaugcugguggcuuacccaggcaauuauguuuccagcaccacaguguugcagagcaugaagcuggggguggauguaaaccgccacaaagaggucauuguuaaggccauuucugcuguccugcugcugcugcucaagcacuuuaaguugaaccaugucuaccagguacccacagggcuuucccuccuguccugugggcuggggccucgggcacugcugcuccuccagcccacaagaacgggggccuuggccuuugacccacuugaacucugcaugaauguucuaagacauggcccuucagccaaggccuuucaucccuggaggaaagagggcaaggucccaagggccgcgccuuuuuuuuuuuuuuuuuuuccuguuggcuucaguuugaauacauggcccagcaccugguguuugccaacugcauuccuuugauccuaaaguucuucaaucaaaacaucauguccuacaucacugccaagaacaggugaugagggccagggaccaugaagggguggauauggucagacggcagaguucccagcugguauuucccacuguguccauuuuuccagcaccuacgagccagcacugugcuaggcaucaagacauaaagauaaaugagacauggccucugccuguggagagcccacugugucaaaucugagucuagcuaguccugccccaggugacuuggucugugccugggcaggaggguuuucaucccaggaucuaguacuuuccucccugucccuucuguacuuuuuuuuuuuuuuuuugaggaguccaugggcugcuugcugucucuaaggggcucggccaugugccuuguaaugcccuaucugcugacucuuagccccugcuguuggccuggugccagcugugcuugacauuacuugcucgucagugugauauaccacagggcgccggccagacccugucuccagaaagguuuggcauaaauuaguugcccugagcuaucuccucccccgccccacauugauugcugugggggaagcugugagggucucuuccccuuacaagaucaacaagcuggccucuggcuacaggggugcuuuacaaguucucuuguaacagauauuuccucaucuuauagguggggaaacuggggugggacacaucagguagauuccuacuucugcuccaacaagugagggaggaaagcugggagcuggcucaggcacggcugcuccaccaggcccugggccuuugcucauggugggcaucugguuccucuccccucugcagcauuucuguccuggauuacccucacugcguggugcaugagcugccagagcugacggcggagaguuuggugaguggcugggcucuccucagcuguccuuuuggcaccagggucaguggguagagagccugccuaccccaacacugcaggaauagaggugucucccgcaggugaaaucacuguggagugcccggcuuuuaaagcacuguaaguguacagaagggccaggaggagggcucuugcagagcagagagauuuggauuuagggauuagucagggaguguggucuucaggggcugcugauccagagcucaccuaguagagggcuucucucccucaacacuggacucggcaguaggagcucuggggcagcccaaggccacagcucccaguaucaugguucauauuuccugcaggaaaagucuagggagccucccucuuccccuaguccccugccagcuucugggauggaguccuggggcugcucugagagcaggggauuccugguagaggccuggagacccggcuguccugagaucaugugugagggacuuuuggaaacugcugcacacacugcagccaugagggcugauuguuccuggguuuacccugcaggaagcaggugacaguaaccaauuuugcuggaggaaccucuuuucuuguaucaaucugcuucggaucuugaacaagcugacaaaguggaagcauucaaggacaaugguaagugagucaguguagucagcaggcuuggaacuuggagcucaaagaagagugcugggagcagggaguccccaggguggggcucacugugccuucucacuuaacuuugcuguagccguauccuugcauuuuaagggccaauucccaguuccuugaugaauugaacuggaagcuggaagaggcccagucaugcacugaaacaaaucuacauuuauagaagaacuuuuuccaugucgucuuaaucuugauugguaacauaaucaggguucugagaaucuuccuuaacucugggucuguggaugccuuugggguggggagguccuugaauccucugauaacuguguguacauguacaccggaauguuucuggaaggaauccauagcuuucuucagauuccaaagugacacauaguuagggugaccaaccauccugguuugucuggaacucuacugguuuuagcauuuaaaguccuauguaucaggaaacucuucaguccaagggaaacugggaugguuugucacccugacaguaacuuccaaaggguuaagcagcagugugaccugggauguaugcauuuauuuuugucuucaacuugggcugcuugcuuguuucccuucccagaugcuggugguguucaagucagcccccaucuugaagcgggcccuaaaggugaaacaagccaugaugcagcucuaugugcugaagcugcucaagguacagaccaaauacuuggggcggcaguggcgaaagagcaacaugaagaccaugucugccaucuaccagaaggugcggcaucggcugaacgacgacugggcauacggcaauggugagacucugcacucagccagauuugggugggagugugucgggaaaagugacaucuuucacucccugcccgugguacucagguacuucucugcccugagcuuccccccaaggaacaggaaggagcccagcuccugcuuuuguagcaucaggaugggcacucuaggaaggacuuugagaagcuacccagccuuggcaucugcgaucauccccaucucuccuuguaccuccaagucauuccuuuucuagaaauugucauaagacuguguccccucuuuucauccccauuuuggccaccuaaacucuuacagcucuugacugacuucccugccucuaauuucuuccccuccaucagugucucagauuucccuagugauccuuuuuuacuuugauguuuuuuaaagauagggucucgcucuguugcccaggcuagagugcgauccuggcucaccacaacaucugccuccugggcucaaacuauccuccugccuuagccuccugaguagcuggaaccacaggcacaugccacugugcccaccuaauuguaucuuuuuuauagagacaggguuucaccauguuucccaggguggucuuuuuuuucuuuugagacagagauucugucgcccaggcuggauugcaguggcacagucucagcucacugcaaccucugccccccagguuuaagcgauucuccccccucagccucccaaguagcugggacuacagcugcacgccaccauguccagcuaauuuuuguauuuuuuguagagaugggguuucacuguguuagccaggcuggccucgaguuccuggccucaagagaugcacccaccucggccucccaaagugcugggauuacaggcaugauccacugugcccagccuucucaggggguucuugaacuccuggguucaagcgauccaccagccucggccucccagaguguugggauuacaagcgugagccacugcgcccggcccccuagugaaucuuuucaacaugcagauccugugcuguuaccucccugaguaaaauccuucauuagcuuccuauuucccuuagaauuagauucagacucaggcagggcaugugaggcucccucguccuuuuucauucuccuccucuguaaucugacccagcuuccuuuucaaccuuguuacgggcugucaguccagccuccaucauacccagagcuccaggcacagggagugcucagucccugaacauagccgugugguucccacuacuaggccucugcaggcacucuucuuucgcccacagugugucuccccugcccaccugggcugcucugugugugcguguugcugcguuguugcguuucuggaauauaccaccauggcugaaugacugugucuguacucucaaugcccugugaaugugugcaggcccacaguggcacacgguaccugguuggggaguugagagagaaugagcaaaggagaagaucuccagguuccucccucugaccccagagagccagggagaaugccacuuugagagaaauguguuguacacaugguucucccucucugggucuacauaaucccuacaguauaagccucuuucucaguaccucuggcuuuucugcuuguacuugacucuccuuuggaucuaggaaggaauuccuggcaucuuucugaggaugagcucggagguauccugcucuuaguugacacucaauauuccuggccagugaauccauggggagcugcuacagggcauggcuccuaacgguguuucuuccugcuuugucucagaucuugaugcccggccuugggacuuccaggcagaggagugugcccuucgugccaacauugaacgcuucaacgcccggcgcuaugaccgggcccacagcaacccugacuuccugccaguggacaacugccugcagaguguccugggccaacggguggaccucccugaggacuuucagaugaacuaugaccucugguuagaaagggaggucuucuccaagcccauuuccugggaagagcugcugcagugaggcuguugguuaggggacugaaauggagagaaaagaugaucugaagguaccugugggacuguccuaguucauugcugcagugcucccaucccccaccagguggcagcacagccccacugugucuuccgcagucuguccugggcuugggugagcccagcuugaccuccccuugguucccaggguccugcuccgaagcagucaucucugccugagauccauucuuccuuuacuucccccacccuccucucuuggauaugguugguuuuggcucauuucacaaucagcccaaggcugggaaagcuggaaugggaugggaaccccuccgccgugcaucugaauuucaggggucaugcugaugccucucgagacauacaaauccuugcuuugucagcuugcaaaggaggagaguuuaggauuagggccagggccagaaagucgguaucuugguugugcucuggggugggggugggguguuucugauguuauuccagccuccugcuacauuauauccagaaguaauugcggaggcuccuucagcugccucagcacuuugauuuuggacagggacaagguaggaagagaagcuucccuuaaccagaggggccauuuuuccuuuuggcuuucgagggccuguaaauaucuauauauaauucuguguguauucugugucauguugggguuuuuaaugugauuguguauucuguuuacauuaaaaagaagcaaaaauaauuc

SEQ ID NO: 13797 - RNA, 4871 nt, Homo sapiens
auguguauuuucuauucucauuuauuccuuaacauuauaugauuagcauuuccuauaucacucaguauucuuuaaaaacuaugaccgguaaugauugcauaaaauuccacuguaaaugaugaacuauuauuauauaacuauucuccuaguaucagacauuuaagguguuuucaaggagaaacugguuuuauauaaccuucugaucaaaguauacaacagcaccuaugaaguguucuuacaaaaaaaacugauccagaaccugauuaaaucuauagauugaauuuccaaauuuguagaaaauauaagugacagaggaacauguuagugacacuuugaggcugcaaccaaaaaaauucagauucugggaaacucuaugggacaaauaaacaaguuuuucaucagauaaacugcugagggaaagagaugaggggaaggggaccuauagaugaaaaguguuaagaaacauauugacuaauugcaauguaugaauauuggauccauauucaaacaaacuuaaaaaaauuugagacaaauuauuggaugacauuaagagaucauuaauuuuuagaagugaugaguauuguaguuauguuuuuaaaaaccaaucuuuaucuuuuaaagauucauacugaaaucauuauguuugaauggguauaugugggauuuguuucaaaauaaugagguagcgguagggaauagugugugguaacauagauggaugaauauuggcuuaauuguucaagcugagugaugaguacaugggauuucauuuuacuaucuguuuauuuugguacuuuuuuuuuuuugagacaggaucuugcucuguugcccaagcagaagugcaguggcaugaucucagcucacuguaagaucacaugaucuugcagcucacugcaagagccuccugggcucaaaugauccuccugccucagccuccugagcagcugggacuacaggcaugcaucaccacacccagcuaauuuuuguauauuuuguagagggagguuucaucauaucacccagggcuggucucaaacuccuggacucaagcaaucuaccugccuaagccucccaaagugcugguauuacaggugugagccacugugcccagccgguacauguuuuauauuugccacaauuaaaacuuagaaaagaaacaaaggaaaagccagcauuucugauagccaugugcugagcugagcuguggaagaaagaguccugaguaagauagaccucacucuaaucccaacucucacauuaacuggcugugugucuuugagcuguuuaccuaaccucucugagccucagagcccucacuucuaaaacugauauuauaaagccugccucacaagguuguugugaggagaaaacauauuuucugggaaagggcaugcaaagcuaaggaaugcuggauauuuuauguuaagguaugaguaaagcguagggcugaggaacaaagaggauaugcauaccuccccuccucagggaguucaggcuccccauuuuuugcugguuccucgagagugagguuuucauagaaaaauacucuggugcaccauuuuaauuuucuugucauuucuuuuauuauauauuuuugaguuguuuuucuagugguuucccugaagauuaccauuagcaacuuaguuuauaacaaucuaguucaaauuaauaccaauuuaauuccgauaguacacaaaacuuugcuccuauuuggcucuguaccucucucuccuuuaugcugcuauuaacacaaauuauaucuuuauacauuuuucccauugacauagauuuaucguuaaugcuuuaugaauuuuuuuaaucaaauaagaaaaaauacguuuauacugucuuuuauguuuaccuacguaguuacguuuacuggugguuuuauuucuucauguggauucaaguuacuaucuaguguauuuucaauuuagccugaaggaccuccuugguauuucuuuuagguuggaucugcuuagugacaaauucucucaguuuuuguuuaucuagaaaugucuuaauuccuccaacauuuuugaagaccaguuuugcuggauauagaauucuugguugacacuuuuuucccuucagcgcuuugacuaugccaucucacugucuucuagccucucugguuucugaugaaaaaucagcugugagccuuauugagcauucuuuguauugaaugaguuacuuuuaucuuguugcuuucaagaaucccucuuugaugauggucaccagaggcugugaacaguagucagggcaggggugaacagggauggguaauggguacaaaaauguaguuagauagaaucaauaagaucuaguauuugacagcacagcaggaugacuacagucaacaauaauuuauaguacauuaaaaaauaacaaaaaguauaauuggaauguuuguagcaaaaaaacaugauaaaugcuugaggugauggauaucccauuuacccugaugugaucauuaugcauuguaugccuguaucaaaauaucucauguaucccaaaaauauauacaccuacuauguacccacaaaaauuaaaaauuaaaaaaauauucccucuuugucuuuugaaaguuugauugugaugugucugugucucucuuugaguugauccuacugagaguacauggagcuucuuggauguguagauuaaugucuuucaguaaauuuggaaaguuuucaagcauuauuucuucaaacauucuuuuuuuuuuuuuuuuugagauggaguuuugcucuuucacccaggcuggagugcaguggugcaaucucagaucacugcaaccucugccucccagguucaagugauucuccugccucagccucccgaguagcugggauuauaggugccugccaucaugccuggcuaauuuuuguauuuuuaguagaggcaggguuuugccauguuggccaggcuggucucaaacuccugaccucaggugauccacccaccucagccucucauagugcuaggauuacaggagugagccaccacaccuggccgaaaucuucuuuuuauuccuuucugucucuccucucauucuuggacucccauuauguacauguugguaugcuugaagauguuccacaggccucuguggcucuguuuauuuuuucugaucuucauuguuucuuuguuauuucucuuccucagacuggguaaucucaguugagauuaacuucaaguucauagauucuuucuuuuggcuguucaaaucuacuauuaagccccucuggugaaaugcucauuucaguuauuguacauuuggcuccuuuuuuuuuuuagacagagucucacucuguuguccaggcuggagugcaguggcacagucuuggcucacugcaaccucugccucccagguucaagcaauucuccugccucagccuccugaguagcugggacuacaggcaugcaccaccacgccuaguuaauuuuuguauuuuuaguagagacaggguuucaccauguuggccaggauggucuugaucucuugaccucaugauccaccugccuuagccucccaaauugcuaggauuauaggcguuccuugucuauauguucuuaucuuuauugauauuuucuauuuggugagacauucuuauaucuucuuuuaguucuuuauacauguuuucuuuuagucuuugaacacuuuggaauaccucauuuaaaauauuugucuaguaaaucuaauguuggggcuuccucagaagcaguuucuauugauuguuuuuuccccccuguguauagggaauacucucuguaucuuuacaugccucacguuuguuguuguuguuggaagcuagacauuuaaaauaauauaaugcaucaccucugaaagucacauuuuuacccccuuccccaggauuuguuguuguuguuguuguuaauacagagaaauacucugaacauagcagaggacuugggcccaaauacccaaagagcuucaaacuugaaacucuucuucaggagaguagacagagacaguuuccugcaugugggcauggagcucuuuucaggaaaaccaacauggaaagcguaccaauagugcccucugauagucacaccucuuggaagaucccccaaauaucacaggccaggugagggcccugcuccuacccgugagauuccucagccccuagucuuuggccugucuccccagaaucacuagagcauauugagccugcagaugucacacuuggugguccugauccagccuugcccaugcaaccccagcccaggccuggacaaccuccccuggagaucuggcugggugugggagaacaaauuucuagcccuuucuuccgggaaaucguaaucaggcaaaauaagaaugaugacaaagcugcugccagcuggagugaucaacggccaggugucaccuggcucaauaauuaaccaggugguugggauagguccaaagggugggcaggaaggaaacacaugggucacaaaggacucaagccaagagaagccagaaggagggacugacagucaagagaggccuuuuucagaggcccaggcaguggacacaccacccaggagaggucccucuucuuuccugguggauuuagggauagcagcaagacugagaaaacaggagucugucauaagcaccuuuugcccaguuucagacuacacaauccuuuugaggggaggaagaaggagaauucuaaggcccuggggacccucaaagcccaccaagcuggcacgagcuguccauuuugugcaagaagcauuuguuaaaugucugcuagagugugauguuaugaugcuguauuugaaaacagccagaucuggcuucaaauccaggcauugcuacuugccagcugcugugaccuuggcugaguuaaguuucu

SEQ ID NO: 13798 - RNA, 20512 nt, Homo sapiens
cauagagcgcuagcacugaaucagccuggagagcgcggaaggaaagggucgguccgcagagggcgcggggaaggcaggguggggacgcgguggagcccgcgcucguuugcugaaggcuuggaagugcagcgcagaagacagagggugacuaggaagacgcgcgagcggggcuggccggccggcgggugggggaggggaggcgggggaaggcggcugagugggccucuggagugugugugucugugucaguguguguguguguguguguaugugugugucuggcgccuggccagggugauuucccauaaaccacaugccccccaguccucucuuaaaaggcugugccgagggcuggccagugaggcucggcccggggaaagugaaaguuugccuggguccucucggcgccagagccgcucuccgcaucccaggacagcggugcggcccucggccggggcgcccacuccgcagcagccagcgagcgagcgagcgagcgagggcggccgacgcgcccggccgggacccagcugcccguaugaccgcgccgggcgccgccgggcgcugcccucccacgguaagcgacggccgcggcgcugggcccgggacgggcuggggcgggggcucggcggccaggcggccgggagcggccccucggagccgacagccugggcgcgccggcugcacuggcccggcguucccgccgcggacgaaccgccuuugcgcacggacugggcccuggcgccagggcggaggccgguggcggcccugcagcugcaccgggacugccaggcuucccugggaaacggagggcugcucaccccauugcacggaggggaacacugagccaccugcaggcaggagcccccgcucagccagggugcccugccucucucccuacccgccaccaccaaggcacgggcggaguggcugugcgcugagugugugcccuccccggugggcaccuuccucaucggccacacacgugcuuccaaggcccugcugaggagugggcgcuucugggcagggaaaguucagggggucaaccagcuuauagaacgccagggacuugcuggcagagggacggagaggggcaagccacugcuuguuccagcccacaggcaggagcuacggaggacuuggguggcuguuugggggguggggugggggacggcaacagccggcaaacagccccccacccccggggcugcuuggggcuagcucagaaucucuuuuucuugcaaauucugguuucaucgguuggggagauucugggcuuuguggugguuuauggugguuugcagugcuugaggaaaauggaaagaggguuugguguugcagagcuguguccaggggcagggucugcuccugacugcguaagggacgcccugccccaacuguggcgguagcagaugcagccauagaaagugaggguggcacuguucaugaccagucagugggcucauaauagauuugcuucugaggaguccuggaagaaaaugagaggggaaaccuggggggaaaagagcagaaaauuauuuggggguagaggagagcgggcugcaggugaggugagagagaaagggaagaguggguccacagaaagaaagugccucacugagagagaggagauagaguugagaggggaagggagaaggguuagccauaggcagaaagcaaagcuucggggcugaaggggagaccaugaggaaagaagagaaagacaagggggcuguguuuagacaggggaaguccaagggcccgguucugccaggucucuccagaggccuuguugagggggaagaugaaauggaauaggauagguggcagaggaggcuggacagcuggacugagguguccuagcaucucugagccugcagcagagauuccuucugagggcugcuccccaggcagaagccagggcuaggggugggaggaagaggcagucagaggagagccugcccagccagaugcaagccagaguguuaaccccccacugucuguccagauccuccugaggcagaauggaggccccagguccagggguauccccuuuggccagcuucgaagucagccucucauguaguggcugcacuuuccccacacugaugccucaaaugucaucaaagccagacagcccuugggguuaagcauugcucccaccuugcucuccuccagggagguugucuuccugagcggucccuuucauccauaccauucacuccagaccuugaguggcagccagucugggguagauacaccgucuaguggcccaguuuccuccaaucauuccugaaccuaagguuucugaguaccugggccauuauucccacccagggcaaccuccccaacagagccugaaguccccccagcccccgugacugccgucccccucuuccacacuuucccucccucagaucagccaggauccucacagucccugugcugagugguaugaaacuauccuuuggcucuuccuuccauggcucccaccccucuccugccaucaccuucuccccaucuuucaaggccucacugaggucccugcucucugcagucucccuggucacccagccagagcugccuucuccuccccagaagagcuggcaagcauuugggcuuuuggugauauguagauuagcacauuguugugggcuguuucauagccucguuguguuuuuccagugagcaacuuauuugcaguauuugucucaacaucuggauuauugaggcaaaacccagaguccaggauagugucaaccuucacccuacccugccagcauuucccugaaucugggggcaucagccgccaggaggcuugggagcucucaggaggugaccucaagcuggagaaagaaagcccaagagucugucugcuuuuggcugaagaaggagagaccuagggccagggguagggaugaggagaccccagugaagagaaggaagagaggaaggaaggggaaagacagggcaucaggagccagucccaucacucuggggcugagcaacuacugggccagguaggugcugggagagaagaggggucucagaaaacuucucugccaugauaagagguggcuggcuggaggcaaagccugauggugcucaaauaggcaggugccaggcaagggauggcccauuacuggcacuggugccucugauuaaucagcugggcuccuuuugaaacacacacccagggcuccaagaugucucuggcaagggaugaguuccagugaaacugaguuugaucccacaguuuuuccaguggcagagccagaucugcauggaaccaggugggaggaaaugcugggcccaggggagcugucucuggcuugccaucugaaagccggugcaugaacaugaacuugagggcaguucaaaaagugcuuggcucaguguugauguugcagagacagaaaaaaauggguagaugcaaguccugcucucgaguuuccugugucauuaaaauuuaggcugguaggcacaccaucugugucaguauuaguucaauguauaguuagguuuggcuggcuuaaucugggaaggcuucuuguagaaggugacaucuggguuguuuucaugggagaacaagguugugcuguggcugcuagaaauccugggaaagcuggauuugagggaugcuguauccugagguaaggggcagagccuguagcauuguagauaugaggccuuuguuuuucugcguugagcagggcauggggauaacuggggagagugagaccuggggagaaaugacacccucucugucacagacauggcugggcucccugcuguuguuggucugucuccuggcgagcaggaguaucaccgaggaggugucggaguacuguagccacaugauugggaguggacaccugcagucucugcagcggcuggugaguguguggccaugcuguauucuaccuucuccccacuggggaaaugaaggcaggagccagggagcaggucaaagagagcaguugcaggcaggaaaauagggcagugcgggacauugcuugugguucccacuagcuccaccagugauacccuucacuaaccuucccaaaguuaggaccucuggucuccccagcucgaagcccucucugacugcccugcaggcaguggaugcugugggcuuccagcugcuugccuggguuagugauugcccaggaacaucaaccacugauucugaaaaggcuucugaggucugcugucccucagugggaugccuccucugggaagcuagcccaggcggccugcuguguccagauguugcaucuagcuccuggacucucauauguggcgccagucuggcaucagagccccacccagauuuggaggggaagcgcuugccuaacucccagccuuccacacucacuucccuggcucuugcccauacccugaggcugggauggccugcucaucugggccaugaaggagccuguaucucauucuaaucagacccauacgugguccagccaggcagaaucagguugcugucauggcugcuguccugcucagugggaauuuaccauuccucuggccagccaggcaggguggggcaucacuggcuaacgccagcuccagggcccugagcuuggggccugugggcugugccuuccgccucucuugccccagcacuacuucuccuguauguaguugcuguagcaauccaagguagaccaagagccccagcauucucugaggcuuaaaauccagaacugcugcucuggggcuaaagagggcuuuaagggcauccagcuccaaccccuacagguguucaauccccagagcuuguccagccucugcuugaauuccuaccaugacagggugcucacugccuccagggaagauuauauccuauauucuucuauagacaucucuuccuuaaaacaaaugggcauuugucagauuucguggggugguagaaggaaagaagagacuucuuguucuucuacagccuuccccugggcaucuggaaggcacugaucuucuccuagacuugacucugucuuuccacgugugguuggcagggaugaaguucaaaccccaauccacucagaagcuaagguccccguuuugaagaaggcugaaggcugaguugagcuguagguuacccugcaaucguuggccugcucucucuuacagauugacagucagauggagaccucgugccaaauuacauuugaguuuguagaccaggaacaguuggugagugauggcuuuuuacaaaauccaugcaccagccugcaugcaacucccaggguggggugugugggggagcaugaaagcggcagaaugccuacugcuggaaagggugagagugugaggauccaugggugcucaacucuggggugccaggauccagggcucaaguccccugccauucccuucuccuggccugauacauaacaagcgcucacuagguaccaagcacuuugcuaauguaguucugacaguaccacuaugugguacacaaauacaguuuauuauccacagagaggugaaaggagcauagcuaguaggugcuagaggccugauuugaauccaggaagguuggcuguagggcuugaggcaaaucaauacuucuuccaggucacaagcuuugcuuaaggaugucacuucucuucaccaggccaaccagcaggcagguaggcaguccagcccuuccuggacuugccccacacccaaccagccaccaagugcugcugguucugccucucagcaucucuggguucugucuccuccauccccaccuucaccccucaaucaguugcuuggacaauuucaagagccuccuaacuggugucucccugcuuucuaguucacuccucaucuuaccacugggggaaauuuucugaaacgccaaccugcugccuuuaccuccuucucccaaaaacaucagggcccccaucacuccagaagaaagccaagguugucuagucuggguuacaccaggucuagccauucuccaccacacaagccucuauaccaccuccccauucccugcuucuuccugccucccaucuuugcacaagcucuuuccaaugacugucaugccuuuccaccugccccccaaucauuauuccacaucuauucaucuuuaugccucaugcaaaacugccuugauacccagaaguugccccuguuucugagcuuccacacaccugacccauaugcaccucuguuaggacuagagaucaccucaugguccaaagaauagccucaguauuuuaugcacucacucgcuugcucuagcacucaugccugaacuagcauuugcuaggaaccuacuggacuagaugcuggggguagagagcuaaagcagagugggucuucaaggcaacuaccaucucuuuagggagacaaaacacagagguuauucuuuggaccaugagauagucuucagcaccccuauguccuggaggauuugaaggggccauaugguaaaagauauuugugaaagcaagacaagaggaagacagaaagaaaggcaggggaagguucccuggagcccaccuucccuauauacauccaucgugauuaaagccucauauuccagaaacccagagaacucucuaaucagaauccacauuuccuucacucuagcccagucuccaguggcgcuagaucccaaagagagagaaagacaggcaagcugagggcggcauucuccuaguugcuggcaugguguggucccuccccugggggaagggggagagcaagcugcaacccuccaucugccugggguuggggguucccaggccacaauggccaggccauaagcuccagguuccuguuuuucagaaagauccagugugcuaccuuaagaaggcauuucuccugguacaagacauaauggaggacaccaugcgcuucagagauaacacccccaaugccaucgccauugugcagcugcaggaacucucuuugaggcugaagagcugcuucaccaaggauuaugaagagcaugacaagguaggaagcccugaggccuggagcacugagugagggcagaggguggcuguggaggcgccgcucuauccacaggcacagaguacauucgcucaccucgccucacgccauugcuugcucacucucauuuauuugucaucccaccaaccuuuaccaggcaggaggcaggagggaucaugcugggcccugacaaugucaucaugagcaacaaauacauggucccaccccaugcagcuuauagucaagugagcuuggcagcuguuaaacaaaccaugacaccaguaaauagaauuacaaacuauaaggacuguucauuccaacagcaagcaguuauugugugucuguuguguaccagacacuguucuagacaccaggaaacagcugugaugaaaacagacaaaaauccccacauuccuggaacuuacauuugggggugacgguagugguggugagacaguuaacaaaauauguaaguaaaauauacaacauguagcauggcaauaacagcacuggagaagaguaaaccagggaugagacgacccgaaggaaguggaggagugagcugggaacaagaaccugaagggcucaaggagagcaacagggaacucagacuuccauggaguuggggaagcagagacaagaaaggcuucugaguaagcaaauauugauuugagcuccaaagaugaguaagaauugaaagcaguaaggcuagaagaacauucuggaacaggaaaagcuaugcacaaagcccuaagguaaacaaacaggaaagugcacauucagggacccaaaggguuaucagcauggccagagcaugggaagugaaggagggggaggagagaagucaggagccagaucacaugugguuuuagagaugugggauuuugucuuaagggugagggaagcuguugugaacaggcauguggcuuaaucucagguuauaagacugaccugguugcuauguggaggauagaccacagggggcaggaauggaggcugggagaccagcagaaggugugaguccaggcuagacacauuggcggcuuggaccaaggugggacagugaagguggaggcaaguggacuggacauguucccguggguuuaggggcagaaucaacaagacuugguacgugcaguggaugugagaagcugagggaaagaaaaagccaaggaugguuuuugucuugagcaccuggauauuccaaugaugcugaaacggggaugauccaugggcagagcagguuugagggaagacaguucagucuggggcacagcagacgugaggugcucaugaaauggugaguggagacguugaggaggcagcuaggugugcgggucuugagugugaccagcaaugcacagaucuaugaggcauggggguucggcuuaucugugaagccaugggacuggacagcacugccacugugagaagagaagcaggcccaggaacccagcauuuggagggcaagcagaggaugggggaccuggcaaggggcagccugaaggugggaggaaaagagggagagugcagagucgaggcacugcauuccaagauggauaagggauggagauucauaaaaaagcguugagaaaucaagcaaggugagggcuaaaauuguccauuggauuuggcaacgugucacacaugcuggaucagggugaacagaaagagaggaaguagagacaccacuguggaagaacuuggauccgaaugggggcaggaaaagagauguagcuggagggaguguguaauugagggaggacuuuuuguucuguuuuuguugucguuguuuugagacagggucucauucugucacccaagcugaaguucagcggcgcaaucacgacucacugcagcccaaccucccaggcucaauugauccucugacuucagucuccugaguagcugggacaacaggcacaccccacuaugcccagcuauuuuuuguagagauaggguuucgcaauguugcccaggcuggucucaaacucccaggcucaagcaaucugucugccuuggccucccagagugcugggauuacaaaugugaguuacugugccuggccaggaaaacauuuuuaauaagagagguauuaaaucugcgguuuuccaacauuaagauuccuaagaaucacuuggggaauguguugaaaaugcauauuccuaggacacaccccuagagagucugauacacuggguuuaagaguggcuccagggccgggcgcggugguucaugccucuaauccuggcacuuugggaggccgagacaguggaucaccugaggucaggaguucaagaccagccugcccaacagggcgaaaccccaucuuuacuaaaaauacaaaaauuagcagcuggugguggcgcaugccuguaauccaagcuacucgggaggcugaggcaguagaaucgcuugacccaggguggcggagguugcagugagcugagaucgaaacuccaucucaaaauaaauaaauaaauaaauaaauaaauaaauaaauaaauaaauaaauaaaagacugaacccaggaaucugcaucuuaagcagcugucgcacugaugauuaugacccccuuggauauucacuuguagacaugugugaaugcugaggggcaggcuccaagagagagggugggugaagcuggaggagcuagcucccagcaagucucuggagaagacagugggagggauucagagcuccugagggagagugagagugagacuucaucucaaaaaaaaaaaaaauguuuaccagauagacguacgaaugagaagacugggcucagcuccaucacuuaccagcuagguggcagugaccaaguaaacugccggagucucacucucucccaggcuggagugcaguagugccaucucagcucacugcaaccuuugccucccggguucaagcaauucuccugccucagccucccgaguagcugggauuacaggcacgcaccaccaugcccagcuaauuuuugucuuucuagcugggauuacaggcacgugccaccaugccuggcuaauuuuugucuuuuuaguaaagacaagguuucaccauguuggucaggcugaucucgaacuccugaccucgugaucagccugccucggccucccaacaugcugggauuacaggugugagccaccgcacccggccuaucugguaaacauuucuuaagggcugacugcauaggccagggagaugcggcgaugccuucaaggacuucacagccuagaaaagcccauguuucuucccugugaagcucaguuuaaggaaaaacuugguaucugugauucaguggcauuuaggcccuggaugaagcugugagcaugcauggcauggccuugugugaaaggagaggugggcccgggagugaacccugagggauggcagcauuuggauaucaggaggagaaggggagcuugguaaggagacagaaagagcagcuugaaaggugggagaagacccaggaugaugcagcuucucagagcuccagugggugugggaagccggggccccuugagcagcacagaagacagggcugggaccuccucagcccucccucuaagacacaccaaugccagcaaaggacccauaugccuggcggcugccccguucccuucuccacaccacagcucaaugauuuuucucaaacucaacucuuaccaugccacugcccaccccuaacaccccuucagauguuuucccuuugcucuguggacaaaacuaaaaguucuggucuuggcccacgaggcccucaagaccuggcccuugcuaaccucucuccaugugcgucucuugccacgcuccuccuagaugguagugcugcagccacaccagccuucuuuuagucuuugggcuuuucaugcauuuucuugccucaggacuuuugcacggucuguucuugcagccuggacagcucucugggaucccaucucuuuccugguuucucuugcucaucuuuuaguugauuccuuggggaaauucucccugaacacuuguuuaguuccccuuguugcacaccaucggauggcccaguacuuauucauaggacucauugcacuuguaacaauguguuuagucccugcuggauugcuggacucaguguccaacucagccaggaaccaccucucucuuguucguugcaugauucccagguaauuaccauaugccuggcacauaaacauauguugaaugggucugugaauaaaugacauaucucauaaccucaggacucauucugcugcaaaccaggggaaaggggagcaaggaaacaaaagggaaaaagaagacagaugugagaaaggccaagggaauuugacaaauaagauggagacauggggccaauggucaugcucacaaaagggggcccugaucuccuuccaggccugcguccgaacuuucuaugagacaccucuccaguugcuggagaaggucaagaaugucuuuaaugaaacaaagaaucuccuugacaaggacuggaauauuuucagcaagaacugcaacaacagcuuugcugaaugcuccagccaagguaagcauggcaggggccagcaagugugugggggugguagcauauggaauggggauugggaggugagaugugaagcuggggggaccccuggggaggcagccuggcugcuacucguguucccgugugcaugaaugugcuuguucuguguauauauguggcuucacguaccucugguccugggcacaugucuuuucugacaugugugugcaugcacaccuacauaugucugcauguggcagcgucaagaaggaucaugcuggugccuugagauuagggaguggaaaugggagccugucuugggagcccuguagguauggaagcuuuccccacuggcucugcaggcuggcugaacgugugggggguucuguggagacagcugacacccaucugggagucagggcccuugcuccaggagcucugcugcgaaucaccaugauacccuggcuccagaaguccccaggaugccuuggguguuuccucaagggacaaggcuggauuugaagucugagcaucauuggaacucccagggcuggcucagcugcauacauguguacacugcguguccucgucucugcgucucgugccacacgugcccuccuacauucaaccuugcuucccaaggcagggucuagggcccugcaaccugccaguggccaaguccagucucguugcuucaaucccaaguccucaagccuuggcugcauucuagccccagccuguuccugccuguggcuguggcuguggcuguggcuguguggcuccuggcuaugcaugaaaccagugucucuggggcuugaaguugucuuguauuggucuggaaggcaaccguucagccuccugaccugacugcugcucaccccuagcuuggccuguggccagugggaaccccugcaugggcuguucucuuaucuuccuucuccccaacccccagugugugcaucucaacccuauucuuugucacugcucaugagacccugcauacggcaccuucccugugucaugagcacccacucuagucccauccucuucucagccccagggcugagcuaggagaugagggccccccagacucacauuccccucuugccccgcucugggaaagcugugcuggaggcuagugacucuaucuccuccccaucuuucucucuccuucucucugugguucuuucagauguggugaccaagccugauugcaacugccuguaccccaaagccaucccuagcagugacccggccucugucuccccucaucagccccucgcccccuccauggccccuguggcuggcuugaccugggaggacucugagggaacugagggcagcucccucuugccuggugagcagccccugcacacaguggauccaggcagugccaagcagcggccacccaggagcaccugccagagcuuugagccgccagagaccccaguugucaaggacagcaccaucgguggcucaccacagccucgccccucugucggggccuucaaccccgggauggaggauauucuugacucugcaaugggcacuaauugggucccagaagaagccucuggagaggccagugagauucccguaccccaagggacagagcuuucccccuccaggccaggagggggcagcaugcagacagagcccgccagacccagcaacuuccucucagcaucuucuccacucccugcaucagcaaagggccaacagccggcagauguaacugguaccgccuugcccagggugggccccgugaggcccacuggccaggacuggaaucacaccccccagaagacagaccauccaucugcccugcucagagaccccccggagccaggcucucccaggaucucaucacugcgcccccagggccucagcaaccccuccacccucucugcucagccacagcuuuccagaagccacuccucgggcagcgugcugccccuuggggagcuggagggcaggaggagcaccagggaucggaggagccccgcagagccagaaggaggaccagcaagugaaggggcagccaggccccugccccguuuuaacuccguuccuuugacugacacaggccaugagaggcaguccgagggauccuucagcccgcagcuccaggagucugucuuccaccugcuggugcccagugucauccuggucuugcuggccgucggaggccucuuguucuacagguggaggcggcgggugaguagauccccaugaggaagaagagcacgucccuuagggcaggggcagagccuggcgggggugcagguggggggacagcuugggugcggccugaguucuucagacacagagagauaggggcuggcucagcacagaggaugagagguggaaauggaggauuacuucgagaauugggaagguucaagcuauaaggucaaugggaagggacuggagcagaagggagcgggagagaauauucaugggcugacagcaggaugauauccagacgggcagggagcuggaggaggagagcaaugcugugugagcgugucagggcaggcguacacuggaagcucugcagagccuggggcaggaggacccauagggaacagccugcaaggguguggggagaggagaggggacaccaucagcagagagaccucacaaaucucccuugggccucuggcugauccccacuuuugggaaguugggaggacucuugcaacucucucauaaauaccuggggcagcccuuacuggggaugggccaccgcccccccacacucccccagcuccucagugagaugcucuuuccuguccucagagccaucaagagccucagagagcggauucucccuuggagcaaccagagggcaggugagagcuugagguggggcucugggaggcacugggggccuggcuugggaucuguuuccccucuucguggugguggggcucuccugcuugcucugaggaaauggagcugcagaacaggaugggggagagaagaagggccucuguccuuucccagauaucugggcuuuuuccugauuucuccguagaguuagacaguucugggucuuuucaaucugagagggccuagagcaugucuggggcuuagggguaaacuuacggaguccccuuauuccccugcuccugcugaugucuaauaccagcccugugcucugccugcagcccccugacucaggaugacagacagguggaacugccaguguagagggaauucuaagguaagauucugacuuugaucuccacuccuaaaacuuaccuauacccuuuuccagucacguucaccuguuggugacaccaauuccccugaggcccccacacugacucccaugccucucuccaguucccuuuccauacaucgccagccagguccagccacccucuccuuuccagguccucagcuaucccccugccccuccauuccauccacccccgcugaggccagggacuauuaccucugcauugggcuucuaguguugcugccaccugugaccucagagcaacuaaaccccccuuuuucaaauguggccuuuauaaggucuuuacccuccuggagaaucuucaguagcucuguguggcagccacugcaagcccuauauucuuggcuuggcugccaagccccuucgacagcagcugcuugccagaucgccacccccgcaccaguuaacccuccuccccagcugaggucaguucugcuuccuugcuuuuaggaucauguugacauagaaccugagucuuggaagggcucucaggggucauuuggcccugguucccaccccaaagggacugccccucuccauguccccaacagggagccagccagcuggcugucacacacucccagauccagcccagcucccugccuagccacagcccaugccaucuuccagucagacugggagaaacgucuuccucaugcgaggcaaaacuggcuucccugcccccuccauacugcuccucccuccuguucucaugaaaacccucagauauuucaagucagguauccauguccccuuugagaauucucuaagcuaaguauggccaagucccucaaacguuccuuauaugauaugguuuucagaccccucaccauccuggacacacucguuugucaaugucccucugaaaaugugacgcccagccccggacacaguacuccagauguugucugaccagcucagagagaguacagugggacuguuaccuuccuugauauggacaguauucuucuauuugugcagauuaagauugcauuaguuuuuuucuuaacaacugcaucauacuguugucauauguugagccuguggucuauuaaaaccccuaguuccauuucccauaaacuucugucaagccagaccaucucuacccuguacuuggacaacuuaacuuuuuuaaccaaagugcaguuuauguucaccuuuguuaaagccaccuuguugguuucugcccaucaccugaaccuacugaaguugugugaaauccuaauucugucaucuccguagcccucccaguugugccuccugcacauugaugagugccugcuguugucuuugcccauguuguugauguagcugugacccuauuguuccucaccccugccccccgccaaccccagcuggcccaccucuucccccucccacccaagcccacagccagcccaucaggaagccuuccuggcuucuccacaaccuucugacugcucuuuucagucaugcuccuccugcucuuuuguauuuggcuaauaguauaucaauuugcacuuauuuggauguuguuuucauauuuuuuaaaaucuuauuuuauauguauuguacauuccacaucccuaagauuguaagccccuugagggcagggacugucuuccacuuuuuuuuguguuucuuuuuccauccuggguucuacuaagagagggccucuccacauuugccaaacaugcaauaaauguugacugacuggcuucagggcugacucacggacugacccuggccagcugucucuaacugaccagccucuagcugaccaguuaaccagcuaacugacugacucugacugacuggcugaccagcuggcugggugaaugacuaaccaaccaacuaucuugguaacugccuaacugaccagcuguugcuuggggagcccauugagcaacugacuagcugauugccugacuaauuggcugguuggcugacuagcuggggugacccagucaaguuuccagucacauccuuuaccaagugcaagccagugccgcagggcucucccauguguggagugacaggucugggccccuucuagagagauagggaauuuggcaaaugcucaaaaccaggggaaccuauuuagacaagaaccagcaguaacaacauaucuggaauccuggggucuaccuugucaguggggugggcuaagaugggugagugggucagcuggggcacuggcaagacugugaaaugacccaggccuccucagaacugguugcugguggcucagugccacaacacccuucccacgggucgucuguccccaaaccccucgccguggucuuggcccucugucccaccccucuacacgcccacccuccuuuccccacuugcuuauucucaggcccgucccaagcuuuccucuucccccucaagauuucacuuggagagggaauccagggcaggggcuacauccagaucccacuuggcccggcagguccagcccuaagguggucuccaggccaggcaccaguggccuuggagagauugagugccagccccuagagugacugcugcugugauuugagaagugagagagagaaacauagaggcagagacugagauagggacucagagccacagaaaaugcagacaccagcaccucagcccuaagcagcuagaagauggggcagcaggcuggaacucgcucacuggguccuucuccccuccugggcccuagcugggccuguggccuggcuguacccagcauggcucauguccaguuuaugguuccccuucuuucccucuagagcaugggaaugggcagggagccagaggcugugguuccaucuucccuccuuacccaguagggccuauggauguuagggagggaggcuccacacaagguccaaagucaaacuguuggaugggguccaggggauuucugcucugggaacaaagcguccugaggaugcugggcaagaggacaaggauggggguggaaggcgagaggacaaggcccugacucccauggaugaugcgggaggcaaggcccucggcccauccaggaggggcuggguugcuuaggggucgcgugccaaaugacagugugggaauuuccuuguccuggcacugccucuagacuuuuccucucuggcccaaguuguuccucuucagcuagcucugcccuacugucuugaacaucauaugugaugccccucugaugaaaugaaagauucuucuuugcuaguguuagcaggaaucacccuuuguucacuggaccaaggccaaugagaugaccucgccugaggagggguccaaagacauucaagugcccgcuucgcuccuugucagagcccucugcuugagcaguaaccccucuucccagcccugcccagaccucucccgggccccguuaucuuccacugaggcccugauuccccaggaggagguaggaggugaggccaguugggccagaggccugggcuggugccagagaaagcugccuggucucucuguggugucuggaaaggccagggaagggaggaaaggaaguccugccugcagcaccgccagcagcccacaggaaugccacaccucccaauccauguccucaacgacccuccccgcauucccacucugcugacuagccuuuccuucucucccacagcuggacgcacagaacagucucuccgugggaggagacauuauggggcguccaccaccaccccucccuggccauccuccuggaauguggucugcccuccaccagagcuccugccugccaggacuggaccagagcagccaggcuggggccccucugucucaacccgcagacccuugacugaaugagagaggccagaggaugcuccccaugcugccacuauuuauugugagcccuggaggcucccaugugcuugaggaaggcuggugagcccggcucaggacccucuucccucaggggcugcacccuccucucacucccuuccaugccggaacccaggccagggacccaccggccugugguuugugggaaagcaggguggacgcugaggagugaaagaacccugcacccagagggccugccuggugccaagguaucccagccuggacaggcauggaccugucuccagagagaggagccugaaguucguggggcgggacagcgucggccugauuucccguaaaggugugcagccugagagacgggaagaggaggccucuggaccugcuggucugcacugacagccugaagggucuacacccucggcucaccuaagugcccugugcugguugccaggcgcagaggggaggccagcccugcccucaggaccugccugaccugccagugaugccaagagggggaucaagcacuggccucugccccuccuccuuccagcaccugccagagcuucuccaggaggccaagcagaggcuccccucaugaaggaagccauugcacugugaacacuguaccugccugcugaacagccugcccccguccauccaugagccagcauccguccguccuccacucuccagccucuccccagccuccugcacugagcuggccucaccagucgacugagggagccccucagcccugaccuucuccugaccuggccuuugacuccccggaguggaguggggugggagaaccuccugggccgccagccagagccggucuuuaggcuguguuguucgcccagguuucugcaucuugcacuuugacauucccaagagggaagggacuagugggagagagcaagggaggggagggcacagacagagaggcuacagggcgagcucugacugaagaugggccuuugaaauauagguaugcaccugagguugggggagggucugcacucccaaaccccagcgcaguguccuuucccugcugccgacaggaaccuggggcugaacagguuaucccugucaggagcccuggacugggcugcaucucagccccaccugcaugguauccagcucccauccacuucucacccuucuuuccuccugaccuuggucagcagugaugaccuccaacucucacccacccccucuaccaucaccucuaaccaggcaagccagggugggagagcaaucaggagagccaggccucagcuuccaaugccuggagggccuccacuuuguggccagccuguggugguggcucugaggccuaggcaacgagcgacagggcugccaguugccccuggguuccuuugugcugcugugugccuccucuccugccgcccuuuguccuccgcuaagagacccugcccuaccuggccgcugggccccgugacuuucccuuccugcccaggaaagugagggucggcuggccccaccuucccuguccugaugccgacagcuuagggaagggcagugaacuugcauauggggcuuagccuucuagucacagccucuauauuugaugcuagaaaacacauauuuuuaaauggaagaaaaauaaaaaggcauucccccuucaucccccuaccuuaaacauauaauauuuuaaaggucaaaaaagcaauccaacccacugcagaagcucuuuuugagcacuugguggcaucagagcaggaggagccccagagccaccucugguguccccccaggcuaccugcucaggaaccccuucuguucucugagaagucaagagaggacauuggcucacgcacugugagauuuuguuuuuauacuuggaaguggugaauuauuuuauauaaagucauuuaaauaucuauuuaaaagauaggaagcugcuuauauauuuaauaauaaaagaagugcacaagcugccaugugag

SEQ ID NO: 13799 - RNA, 13499 nt, Homo sapiens
ccggcccggggcugccgagucccugcguccugccggggcggugguuaagcggccccuaggcccggcuccggcguggucuccuccgccccuccccacagggcccgcgaucccagaggcugggcaggggucgacauccguggcucggcagcucgaaaaggcucccgcguagagcugcuccugcuggagaucgcggacccagagacccgcccucuccgcgucagucucuuugaccgagcggcucuaccguugagacggcacucaccccacgaauaucccaguacccgagaaccauagacgacucgcacgacauggugacgggcuuccgagccuucgaggacuagggaaacugugagcgggaggggcuuuauacccgacauaagggggcggggcccacgcgcgggcgcccugacuccgccuccgccccguucuccgucccuugccuccgcggcuccacagggccgugcgcaggcgcgacuaaugccggcguugggguucagggccuggcgaccccgaggcgggacccgggcaggagugcugcaggagagcaaaggacccgagguugaggcuccucccuuccccgcgggugggagccagacuucauucauuaauggugccagugaagacgcgaaaagcaccacuagccaggcaguggggacccuaguuacccagggagagcgagauucgcgccguuuuuaccgagccagccggggcuggaugaaggauaggaagacuggggcaaggccggagagucagaccagccucugaccacacagagcagaagauuccccacagaccaagcuccccucucugucagucaaggaccucugcaaccugaccccaacgugcuuuuccaguccugucucucccucagcccgucacaacuucauaagccagcccaacccaacaauacuugcuguuccuucuacacacacuugcauuucccaccuuggaguguuugcucugugauccuccuaccugcauccuaauuuccacagccuauccuuccucagcagccuugcugaaaugucugccuauuccuugaagccuucucagaaccaaccucuauccuggccagaagaggucucuuaucuugaauguuuccuaccuuuguuuuaugggcuuaaguaauuuauggauuccuuauuauaauuuccuccuccaaucccucccacuuccuaaugcucacgcauuuagggaaauuaaucuugccucuuuguguaggauggacuggaggaggaaagguacuaccauuuuucauucacucauucaucuguccaacaauguuuaacaugccuguuauggacaggcacuguuuuaggugcuggggauacagaacugaacucaacagacaaaaucccugcccucaggaaguuuacauucuaauggggaagaaauaaacuaauauauaguaaauagcuaguaagucagguggugauacacauccuauggagagaaauaaaaucgagaagagagauagggggucucagggugggaacugggggagucccaguaggaaggggauuuauguuuuuaaagguuauguucauagaaggccucauggagaaguuaaucuuuaaacaaagaccugaaggaggugagagaucaagccacucugcugugggggccaccaugggcugauauaaauauaaaacagaauaauugcuguuccuuuuacaagcauguuugcucugcuccugccugcacccuaauguccauggccuagccuuccucaaguagccgugcucaaaugcucacuucuuccuugaagccuucucagaaucacccucuauccuggccagaagaguucucucccucucuuaucucgaaucacuuccuaccugcaggaggcagagagaacuccaggaaaagggaaacagcaaguacaggagugaucacucuguguuugaaaccagagacuagaugagaucaccaugggagcacgaguagcagagaugaggucuaaggguuugaggugcucuggcauaucaacauguaaagguuagggaaaaaugagagcaaaccagcaaaggagucugaaaaggaguggccagggagguaggaggaaaacaaaaggucccagaagccaugugaagauguuuaaagggagaagugaucaacuaugucaaguguggcugaucaaguaagaugaagauggagaaucaaugguugaauuuaggaaaguagggguuuugaccuugacagagcaagagaccugcccgaggccccuauagucaugggaagaacuaagcuucugaauuucggcagggcccaugcaaaugaaaaggggcacagauuugcaacagggucaacucgggagacauaggauucuaguugaauguggaggagugacagaggaaggaguccggagcugcucugaggguucuggccaggccucugcagcacagcucucagggcagucugagagccuagauccccuagcucaggugugggaaaucacauuugcccaucaguucaacugaagcaagguugggacuuuuuaaaagggcauuuugcuaaacagaagaaaggaagaguacaaaccacauggacaggugaaauuuauaaugccugugucucuccucccaagaaagcaaaaggccagucacaaauucaccugagguauaagauuaacauuuauugagcaccuaucauaugccaggcaauaucuaaguguuuacguauguuagcuaauuuauuccaauuuaagcuucacaacaacuuuaggaaguagguguuaugcccauuuucuuuucuuuuucuuuuuuuuuuuuugcaguuuuugcauuacuuucuuuuuuuuaaauuuuauuauuauuacacuuuaaguuucaggguauaugugcacaaugugcagguuuguuacauauguauacaugugccauguuggugugcugcacccauuaacuccucauuuaacacuagguauaucuccuaaugcuaucccuccccccuccccccaccccacaacagucccuggagugugauguuccccuuccuguguccauguguucucauuguucaguucccaccuaugagugagaacaugcgguguuugguuuuuuguccuugcgauaguuugcugagaaugaugguuuccaguuucauccaugucccuacaaaggacaugaacucaucauuuuuuauggcuggauaguauuccaugguguauaugugccauguuuucuuaauccagucuaucguuguuggacauuuggguugguuccaagucuuugcuauugugaauagugccgcaauaaacauacgugugcaugugucuuuauagcagcaugauuuauaauccuuuggguauauacccaguaaugggauggcugggucaaaugguauuucuaguucuagaucccugaggaaucgccacacugacuuccacaauguugaacuaguuuacagucccaccaaaaguguaaaaguguuccuauuucuccacauccucuccagcaccucguuuccugacuuuuuaaugauugccauucuaacuggugugagaugguaacucauugugguuuugauuugcauuucucugauggccagugauggugagcauuuuuucauguguuuuuuggcugcauaaaugucuucuuuugagaagugucuguucauauccuuugcccacuuuuugaugggguuguuuguuuuuuucuuguaaauuuguuugaguucauuguagauucuggauauuagcccuuugucagaugaguagguugugaaaauuuucucccauuuuguagguugcguguucacucugaugguaguuucuuuugcuguggagaagcucuuuaguuuaauuagaucccauuugucaauuuuggcuuuuguugccauugcuuuugguguuuuagacaugaagucuuugcccaugccuauguccagaaugguauugccuagguuuucuucuaggguuuuuaugguuuuaggucuaacauguaagucuuuaauccaucuugaauuaauuuuuguauaagguguaaggaagggauccaguuucagcuuucuacauauggcuagccaguuuucccaguaccauuuauuaaauagggaauccuuuccccauugcuuguuuuugucagguuugucaaagaucagaugguuguacauauguggcauuauuucugagggcucuguucuguuccauugaucuauaucucuguuuugguaccaguaccaugcugcuuugguuacuguagccuuguaguauaguuugaagucagguagcaugaugccucuggcguuguucuuuuggcuuaggauugacuuggcaaugcgggcucuuuuuugguuccauaugaacuuuaaaguaguuuuuuccaauucugugaagaaagucauugguagcuugauggggauggcauugaaucuguaaauuaccuugggcaguauggccauuuucaugauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuauugguguauaagaaugcuugugauuuuuguacauugauguuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuucauuuccuucuccugccuaauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugagauacgucccaugaauaccuaauuuauugagaguuuuuagcaugaaguguuguugaauuuuguuagaggcuguuucugcaucuauugagauaaucauuugguuuuugucuuugguucuguuuauaugcuggguuacauuuauugauuugcgaauguugaaccaaccuugcaucccagggaugaagcccacuugaucaugguggauaagcuuuuugaugugcugcuggauucuguuugccaguauuuuauugaggauuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaauggugccagcuccuccuuguaccucugguagaauucggcugugaaugcaucugguccuggacuuuuuuugacugguaagcuauugaucguugccacaauuucagagccugucauuggucuauucagagauucaacuucuuccugguuuagucuugggaggguguaugugucgaggaauuuauccauuucuucuagauuuucuaguuuauuugcguagagguguuuguaguauucucugaugguaguuuguauuucugugggaucaguggugauauccccuuuaucauuuuuuauugcgucuauuugauucuucucucuuuucuucuuuauuagucuugcuagcggucuaucaauuuuguugaucuuuuaaaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugugucccagagauucugguaugucgugucuuuguucucguugguuucaaagaacaucuuuauuucugccuucauuucauuauguacccaguagucauucaggagcagguuguucaguuuccauguaguugagcgguuuugagugaguuucuuaauccugaguucuaguuugguugcacuguggucugagagacaguuuguuauaauuucuguucuuuuacauuugcugaggagugcuuuacuuccaacuauguggucaauuuuggaauaggugugguguggugcugaaaaaaauguauauucuguugauuugggguggagaguucuguagaugucuauuagguccacuuggugcagagcugaguucaauuccuggguauccuuguuaacuuucugucucguugaucugucuaauguugacagugggguguuaaagucucccauuauuauugugugggagucuaagucucuuuguaggucacucaagacuugcuuuaugaucugggugcuccuguauugggugcauuuauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccaucccuuuguuuugagccuaugugugucucugcauguaagauggguuuccugaauacagcacacugaugggucuugacucuuuauccaauuugccagucugugucuuuuaauuggagcauuuagcccauuuacauuuaaaguugauauuguuaugugugaauuugguccugucauuaugauguuagcugguuauuuugcucguuaguugaugcaguuuccuccuagacuugauggucuuuacauuuuggcauguuuuugcaguggcuggaaccgguuguuccuuuccauguuuagcgcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauguuggcccccacucucuucuggcuuguagaguuucugcggagagauccgcuguuagucugaugggcuucccuuuguggguaacccgaccuuucucucuggcugcccuuaacauuuuuuccuucauuucaacuuuggugaaucugacaauuaugugucuuggaguugcucuucucgaggaguaucuuuguggcauucucuguauuuccugaaucugaauguuggccugccuugcuagauuggggaaguucuccuggauaacauccugcagaguguuuuccaacuugguuccauucucccccucacuuucagguacacuaaucagacguagauuuggucuuuucacauagucccauauuucuuggaggcuuuguucguuucuuuuuauucuuuuuucucuaaacuuuccuucucgcuucauuucauucauuucaucuuccaucgcugauacccuuucuuccaguugaucgcaucggcuccugaggcuucugcauucuucacguaguucucgagccuuagcuuucagcuccaucagccccuuuuaggacuucucugcauugguuauucuaguuauccauucaucuaauuuuuuuucaaaguuucuaacuucuuugccauugguuugaauuuccuccuguagcucggaguaguuugaucgucugaagccuucuucucucaacucgucaaagucauuguccguccagcuuuguuccguugcuggugaggagcugcguuccuuuggaggaggaguggugcucugcuuuuuagaguuuccaguuuuucagcucuguuuuuucccuaucuuugugguuuuaucuacuuuuggucuuugaugguggugacguacagauggguuuuugguguggauguccuuucuguuuguuaguuuuccuucuaacagacaggacccucagcugcaggucuguuggaguuugcuagagguccacuccagacccucuuugccugggugucagcagcaguggcugcagaagagcgguagcuguagaacagcggauuuuggccacccacaaaugcugcugccugaucguuccucuggaaguucuguuucagaggaguacccggccgugugaggugucagucugucccuacuggggggugccucccaguuaggcugcucaggggucagggacccacuugaggaggcagucugcccguucucagaucuccagcugcgugcugggagaaccacuacucuccucaaagcugucagacagggacauuuaagucugcagagguuacugcugucuuuuuguuugucugugcccugcccccagagguggagccuacagaggcaggcaggccuccuugagcuguggugggcucuacccaguucgagcuucccgccugcuuuguuuaccuaaucaagccugggcaauggcaggcgccccuccccaagccuggcugccgccuugcaguuugaugucagaccgcugugcuagcaaucagugagacucugugggcguagaacccucugagccaggugugggauauaaucuccuggugugccguuuuuuaagcccguuggaaaagcgcaguauuagggugggagugacccgauuuuccaggugccaucugucaccccuuucuuugacuaggaaagggaacuccccgaccccuugugcuucccgagugaggcagugccucgcccugcuuuggcuugcgcacggugcgcugcacccacuguccugcacccacugucuggcacucccuagugagaugaaccugguaccucagauggaaaugcagaaaucacccgucuucugcguugcucacgaugggagcuguagaccagagcucuuccuauucggccaucuuggcuccuguguuaugcccauuuucuagaagaagaaacaggccuggagcaguuaggggaguugcuccucuaagcuucaggucccacagauggucugggauucaaaccuagaucugucuaauaaugcaguuggugcugguuuuccugcacuuggccaucugaacagccucuugccacauggcagucuucuugggaagucuggggaacaccaggugaaaacacuuuuuucggauccuggacgguuucucuguuucuaggcuccuuuagcucugggaggcaacagagggugauggguuaauaccuccucccccaucccaagaaauuaacuuuucuggguaacuuuugcccuugacaagucacacccaaaaagggucucaccuuuucucucuuuugugagggaaaauuguugcuuuccuauucuguuaacagcuaugagagaugauuuucugaggccaggaacuuaagggaaugacauaggcugucuaaaaauagggcagucuggggcccagacaauguuagggucauggacacauucagguaagagagauuuaagggaacaucuuaagaacccucaaauccauaaguacauugggccuuaucuguugacuaaaucaauaaaaguauagcuacugguauguagagaggggacuccacugagauuaaagaaagcuacuuuuacugaaaaauguaagaagcuauggacaguccaaacucuuugcuuaacccuugagaaaacagggacccaaagaguggaaugacuugcuggaguucacccagccaacuggugcaacugaccaaagccuacagcugucgguccuagugcacuuugcuacugugaaguggugugccugcagcugugcugggugccuuggaauguacugagagacaugugugugcaaaaaagauggugagcauagcuuuauuuugcaguuuguuuagaaagagagucaggagagcuuggaccuuaauucucaaauucugauucccagcuccagguugcugugugaauguccacucacauucaaacaaucuggcucagugauggauauaggcuugcugcuguuuucaugccaaaugucccagcccuuccugccucccugccuuuggucucccucaggcccagaagaagcugcgagggaggcacaugacaagcuugaagaugcuuuuauugagaaggagagggacugaacagauucuugacaagccuaggcauaaaugcuccagguuugggaaagagguaaaauaaauaggugguuacuggggaggcuccaacacagccagaagggacacuguuugcuucagccucugggccuguccauuguuuuugcugugugagcuggggugugggguuugcugcaaacugggauccagaagaggaauucucggggcucuaauggguaucagaucugccaucuugcaucagcggggccugguucuuggaggugucuaagcuggugccuaagggcuuaucugaggaaagacaaagauucagaugaggcugauggcaggugagggaucugcagagcuuaugccaccaauaagcuuggagccucaagguaagccugaaugcaugaagcuaagccccugggggaauauccugugcccagcacccgccacacucaguucugccccagggcugggccugcaggcuuuuccaacuggcccucucucucacccaggagcaccagacacucccaaugguugucaggaccccaggguguccucacccccagcauccuucugacagccuccagccgggacaggauucguggggccuccuguggacauagcaucuguagcuccccaggucuuaugcgaaguagcuggcuccccgucagggacccaaguguccucaccgugcugugaacaaaacagcaaaagccauccguggugggcuggaaggacccugggccugagcguuugggcagagacagggcucuuugggcucggagguugggguuacagaaaaauucauggaguaggcuaucugagauugaaggaguaaagucagcauuuggcuucagccaauuucagaacuuccagauuugaaagaagugcucugggagagaaucuucuggcuggggaggggcggcuaagcuggcagcugggguucuucccgaguccacuccccugauccuugcugccuuugccacagcagagcuccccacuuaaucucuaaucuaggcuuggacacgccucugcucuguccucuaacucagcagagacggugcuggaucggggucauguacaauguaggccagguuguauguucugggucucuggguuuccuugguuagcccuuuacaaaguuucucccuccauauccuguagggccaggcacucacgcaguggagaaguucucugccugcagccagucugugaccucuucaggccucgagcuaagucgaagcauuggaaccuagaaucagggggaaccagggaucagaguccaucucaucucacagccaaccacagccccuaacaucugggucccuucuccagguucccaucaaaucacuucucuuacucuguggcuuucuggucuggcagggagcuggucuuguucucugcucuggccccaugauaaaguuggcacacuaagcaugcaauaauacgguccgaaucaaaccaagacuaucuccucugcuugccacugaauccuccccaccccgaccuccaacucaagacuuagggcucuggauaguccaggcuggguaguacccgagagggugacuggcccugggucccagggguccccggcuguaggggcuccaggauguugcuuggaauguagccgcuccgucccgccucauucuucaccagccaccaccgcuugcugugguccagaaccugccaagagucaccaccucaguccccugagccucuuuccagccagccuucccuccccacacaaggcuuucucccuccagcucuuuccuacccuccuucucccucucuaggccacccaccuuggcagcuccaucccuggaccauccacccuuggcugccuguagcucccaccaaccaccaccuccuuuucuagccuauggcccaagccucaccuccagcuucucucccuggaccacagucaguucccguggguuccuagcuucaaacucguacaagacuugcauuuucagggcuggcugggcagguuuggggcuggagggccuggaguugggguccccaggcugagggucaugguugugugucuucuccugaggaaagugugaggugcucccuaaccuaugacuuccccgccuaagaaacagagucaggauggcuggagaauggggccucagaaauuaagccuaugucccagcccugagauuccccucagguaucuccggccugcagucugauggugacuuuuggguuucuuuagaguuugcuggcaggucaguguuagguggggcuuucugcaggcaggaggggucugaaaugucauugauuucugaagacauuuccgggaguggaauuuucuacaucugaguucugcccuaagcacuuuauacuugaguaugggaaaucagaagcauguguggguaguaucaugagaagaagcaaugggagccuaggaggguagaacacuguuuuucacccaagguaggagagggauguccuuguacauguuuuucuggcuaaaagagacccucuuggcucucuuaagauguagagagccagagauccaaaggaacagcccugucccucccuccccaggaccacgcagucccuauuaagcucagagcauaccgaagggaaacaggguccugguauccuaagggugccuguaagggacagaacagagagugaguaagagcaggaggcagccagcauggugggagggagcugggguauccgaccacaggcauaagcagcucacacacagcugccuccuauccccuuuccugccucccccaguuuacagauacagguacccacaugcacccacccacccacuacuuggagauggggccucagaaauugagccuaugucccagcccugagagucccccagaauaucuccuguuugcagucugguggugacuuuuggguuuccauggaauuugcuggcuugccaguguuaggucacacuaguugugugaccaugguuuggauggggagggcagaaacuagccagggacuagggcuguggguagggcucuaugccaagcuccccuuacuuggcuggagggcucuggaaguugccagucaucugagaauguggguugguagggcaggggcucaucgccuguccagucggcccugaagagggaaacaaagcugaguucacauccacucugugaacucugaugccaggcugugggacgcggacagggaggggacgacagggccuagccucaggaaucuuuuggcuaauaggugacaugguccaugugcacagaugaaaggccccaggacacccacaaaggagcaagcaguuaagccuggacacaucccacggugcaggugucugggggucaaccucaccucugcccaugagguaaagauacaccaccuccguaagaacaugauggacacuu

SEQ ID NO: 13800 - RNA, 3461 nt, Homo sapiens
uggagccgcggaggcaagggacggagaacggggcggaggcggagucagggcgcccgcgcgugggccccgcccccuuaugucggguauaaagccccucccgcucacaguuucccuaguccucgaaggcucggaagcccgucaccaugucgugcgagucgucuaugguucucggguacugggauauucguggggugagugccgucucaacgguagagccgcucggucaaagagacugacgcggagagggcgggucucuggguccgcgaucuccagcaggagcagcucuacgcgggagccuuuucgagcugccgagccacggaugucgaccccugcccagccucugggaucgcgggcccuguggggaggggcggaggagaccacgccggagccgggccuaggggccgcuuaaccaccgccccggcaggacgcagggacucggcagccccgggccggggaacguuagcgggcggggguugggaaugggugggagcugcgcagucgcugaaccgcugucuuccccagcuggcgcacgccauccgccugcuccuggaguucacggauaccucuuaugaggagaaacgguacacgugcggggaagguaaugccgcuccgcgugcccgugcagccaagcuggcccuccaccugcccuggucuucuuacgcccagagggugguggcgucgcgccaaggccgggugggacguuugccccaaucugggugaauagagacacauccuuuaucuggaacuggggguucucuuuuuaacauagcccaaacccgucuuaaugcuuaaccaaauagggcucagaggcucaaugguuaugcuuuuggggccugggaauuugagguauugggaccaagucauuucuuuagaucuuuugcucuugucaggugggguauuaaggagguugggucccacuuaauuccgucucuuacagcuccugacuaugaucgaagccaauggcuggaugugaaauucaagcuagaccuggacuuuccuaauguaaguggcuuuaguagagguggcgggcagaagggaaagccuucaaguauauccauccuugccucucuccugccugguacagaaggaugcaaaauaggggaucuuaacccggauagaauaaauagaauucagggguccuugaacuggauggauauguauuuucauucccauuaaccacuagcaaaaguuauuuccuuuuauugugaagagagacaauaagugacauugguuauuagccaugucugucacuuugucacuaguagaaaucagguauuuucuuuuuuguguguuucuuguucuuuuguuuugagacagugucucacucugucgcucaggcuggagugcaguggcgcaaucacagcucacugcagccucaaccucccaggcucaagcaguccucccaccucagccucccaaggagcugggacuacaggcacacaccacuaugcccagcuaauuuuuguauuuuuguaagagacgggguuuugccauguuacccaggcugauccugaacuucugggcucaaacaguccucccaccucggccuuccaaaguguugggauuacaggcaugagccacugugcccagccugaaaucagguaguuucauauucuauaacaugcguugcagauauuuuaagugauauuuauauacauguaaguaaauauauacauauaauguuauuuacuuugagauuauguuagucauuacaucugcuugcuauuuaaugcacuaauaggcacauguuacucuuauuugaauuuuuaaaaauauuuuuugauuguguaaauuaucuauuuugcuucaugcauuuaacaacuuuauucugagaaaagguccauggcaugcacauacacucacacauacacacaccaauuuaagaaccccugucuagaaucuuguggacccaguugcuaccuucuacuuauuuucuuuuuucuccuaacacagcaucuucucacucuuguucacugcccugcaaguguucuuuuccccuggagagagagguagggaaucaagagagaggcagguuguucauuuguccuguccuuuuccuuucagcugcccuaccuccuggaugggaagaacaagaucacccagagcaaugccaucuugcgcuacaucgcucgcaagcacaacaugugugagugggguagggcuggugagggaccccaggcugguaguuugucugagaguggaugaugccaagggugauuuguugucauuuggccuacagguggugagacugaagaagaaaagauucgaguggacaucauagagaaccaaguaauggauuuccgcacacaacugauaaggcucuguuacagcucugaccacgugaguuuccuuagcacacaucugcugaauggaguaucagaaaaagggguauuuaggaacccaaggguuaucucuguuccauucugcugcugcuaccuucccaccaauccagauuguuagaauaagaaacagaacuuauauuuuuugguuuguuuugucauguaauucuggugcuggugccucuucuuucuaaacuccucuuuccccacccugccauccucaagugaaggcaaugagaacccaccuagagaaggggcuacuaaguguccaucacuggccugugcccugauuaacuacaaagaugaucaccacuauucucauucuguuuuuuccucucaggaaaaacugaagccucaguacuuggaagagcuaccuggacaacugaaacaauucuccauguuucuggggaaauucucaugguuugccggggaaaagguaggaagaagggaaaagaagaggauacuucucuaucucugcaggcuacuacuccucagaccuaagcaucuuauugcuuuucuucuagcucaccuuuguggauuuucucaccuaugauaucuuggaucagaaccguauauuugaccccaagugccuggaugaguucccaaaccugaaggcuuucaugugccguuuugaggugacguuuccugcaccuuucucuuauaaaaacacucacaggcuccccugggaccugcaggaucccauaguggaggauucuuccccggcuuuugccuaaugggaucaaugguuggacaccucuagaccuuuaagucuugggaagagccuaacuucuauaccuuggaggcacugucuacaaaaaaauggaggagguagacgcaggcaacacgugaauguugcuguucugguaugcaucuguuggacuggguuggggucguuauaagauuugguguauuuuccuuucaggcuuuggagaaaaucgcugccuacuuacagucugaucaguucugcaagaugcccaucaacaacaagauggcccaguggggcaacaagccuguaugcugagcaggaggcagacuugcagagcuuguuuuguuucauccuguccguaaggggucagcgcucuugcuuugcucuuuucaaugaauagcacuuauguuacuggu

SEQ ID NO: 13801 - RNA, 3461 nt, Homo sapiens
accaguaacauaagugcuauucauugaaaagagcaaagcaagagcgcugaccccuuacggacaggaugaaacaaaacaagcucugcaagucugccuccugcucagcauacaggcuuguugccccacugggccaucuuguuguugaugggcaucuugcagaacugaucagacuguaaguaggcagcgauuuucuccaaagccugaaaggaaaauacaccaaaucuuauaacgaccccaacccaguccaacagaugcauaccagaacagcaacauucacguguugccugcgucuaccuccuccauuuuuuuguagacagugccuccaagguauagaaguuaggcucuucccaagacuuaaaggucuagagguguccaaccauugaucccauuaggcaaaagccggggaagaauccuccacuaugggauccugcaggucccaggggagccugugaguguuuuuauaagagaaaggugcaggaaacgucaccucaaaacggcacaugaaagccuucagguuugggaacucauccaggcacuuggggucaaauauacgguucugauccaagauaucauaggugagaaaauccacaaaggugagcuagaagaaaagcaauaagaugcuuaggucugaggaguaguagccugcagagauagagaaguauccucuucuuuucccuucuuccuaccuuuuccccggcaaaccaugagaauuuccccagaaacauggagaauuguuucaguuguccagguagcucuuccaaguacugaggcuucaguuuuuccugagaggaaaaaacagaaugagaauaguggugaucaucuuuguaguuaaucagggcacaggccagugauggacacuuaguagccccuucucuagguggguucucauugccuucacuugaggauggcaggguggggaaagaggaguuuagaaagaagaggcaccagcaccagaauuacaugacaaaacaaaccaaaaaauauaaguucuguuucuuauucuaacaaucuggauuggugggaagguagcagcagcagaauggaacagagauaacccuuggguuccuaaauaccccuuuuucugauacuccauucagcagaugugugcuaaggaaacucacguggucagagcuguaacagagccuuaucaguugugugcggaaauccauuacuugguucucuaugauguccacucgaaucuuuucuucuucagucucaccaccuguaggccaaaugacaacaaaucacccuuggcaucauccacucucagacaaacuaccagccuggggucccucaccagcccuaccccacucacacauguugugcuugcgagcgauguagcgcaagauggcauugcucugggugaucuuguucuucccauccaggagguagggcagcugaaaggaaaaggacaggacaaaugaacaaccugccucucucuugauucccuaccucucucuccaggggaaaagaacacuugcagggcagugaacaagagugagaagaugcuguguuaggagaaaaaagaaaauaaguagaagguagcaacuggguccacaagauucuagacagggguucuuaaauugguguguguaugugugaguguaugugcaugccauggaccuuuucucagaauaaaguuguuaaaugcaugaagcaaaauagauaauuuacacaaucaaaaaauauuuuuaaaaauucaaauaagaguaacaugugccuauuagugcauuaaauagcaagcagauguaaugacuaacauaaucucaaaguaaauaacauuauauguauauauuuacuuacauguauauaaauaucacuuaaaauaucugcaacgcauguuauagaauaugaaacuaccugauuucaggcugggcacaguggcucaugccuguaaucccaacacuuuggaaggccgaggugggaggacuguuugagcccagaaguucaggaucagccuggguaacauggcaaaaccccgucucuuacaaaaauacaaaaauuagcugggcauaguggugugugccuguagucccagcuccuugggaggcugaggugggaggacugcuugagccugggagguugaggcugcagugagcugugauugcgccacugcacuccagccugagcgacagagugagacacugucucaaaacaaaagaacaagaaacacacaaaaaagaaaauaccugauuucuacuagugacaaagugacagacauggcuaauaaccaaugucacuuauugucucucuucacaauaaaaggaaauaacuuuugcuagugguuaaugggaaugaaaauacauauccauccaguucaaggaccccugaauucuauuuauucuauccggguuaagauccccuauuuugcauccuucuguaccaggcaggagagaggcaaggauggauauacuugaaggcuuucccuucugcccgccaccucuacuaaagccacuuacauuaggaaaguccaggucuagcuugaauuucacauccagccauuggcuucgaucauagucaggagcuguaagagacggaauuaagugggacccaaccuccuuaauaccccaccugacaagagcaaaagaucuaaagaaaugacuuggucccaauaccucaaauucccaggccccaaaagcauaaccauugagccucugagcccuauuugguuaagcauuaagacggguuugggcuauguuaaaaagagaacccccaguuccagauaaaggaugugucucuauucacccagauuggggcaaacgucccacccggccuuggcgcgacgccaccacccucugggcguaagaagaccagggcagguggagggccagcuuggcugcacgggcacgcggagcggcauuaccuuccccgcacguguaccguuucuccucauaagagguauccgugaacuccaggagcaggcggauggcgugcgccagcuggggaagacagcgguucagcgacugcgcagcucccacccauucccaacccccgcccgcuaacguuccccggcccggggcugccgagucccugcguccugccggggcggugguuaagcggccccuaggcccggcuccggcguggucuccuccgccccuccccacagggcccgcgaucccagaggcugggcaggggucgacauccguggcucggcagcucgaaaaggcucccgcguagagcugcuccugcuggagaucgcggacccagagacccgcccucuccgcgucagucucuuugaccgagcggcucuaccguugagacggcacucaccccacgaauaucccaguacccgagaaccauagacgacucgcacgacauggugacgggcuuccgagccuucgaggacuagggaaacugugagcgggaggggcuuuauacccgacauaagggggcggggcccacgcgcgggcgcccugacuccgccuccgccccguucuccgucccuugccuccgcggcucca

SEQ ID NO: 13802 - RNA, 1334 nt, Homo sapiens
agaugccgguggccgugggucccuacggacagucccagccaagcugcuucgaccgugucaaaaugggcuucgugauggguugcgccgugggcauggcggccggggcgcucuucggcaccuuuuccugucucaggugaggggcgcgggcggugaucucugggcaggacaaccagaccuuccggcccugccccauucggccuggagccugaacacagccuccuucuuucgacuucccucucuguccccucgcgagccagacucauuccaaaccaccuucaaucuguaaagucagguuggaagcgucagugcuuaagaauuugagcuuuagagucaaaaugcuuucuggcccuuuucuuacugguucggugacuuuaggcaaguuggagacuggguuuccuuaaguguagaaugaagacaguagcaucuaacuuauagaguuguaaaaauucgaucagcacacuuugcacagcaucuggcacauauuaagugcucaguaacuaguuacuacuguugcuuuuauuuuuuuuuccaauugcgcauaaggaaagaaacucguucagcgguuuuacuauucuggauacaggauacagagauaaagcaguuaaacuuuacacucuaaaggucauuuucacauuuagaggcuguuauugccauaucccuagauuguaaauuaucauuuacagagcacuuacucuauguuaagcacugugcuaaauacuguaguuuucaaaauccuguaaauaauguugagaugcccauuuuacacuugacacuauguguaaauuguagagcugacucuugaacccccaccuuacuccaaaaucauuaacaccaagaaacuaaaagacagaugucuuuauugggucuuaaacugcaggcaacaccagucaaaaaagcugguuucucuauguauuuuacacugcaucugcugccucccacaaacugaaggcaguuaauacgacauccaccagaaaaauacccuggagacccagauggaucuuuuuccuucucauuacccaccccagguaguaagauauaauauccaguaaguggaaaaucagauguagggguugcuagacuaguguuagcaaaaaauuggaaaggagcaguuaauacucuuucugauauuuuuguuaccaaauagcuccaucuugguuuccuccucaggaucggaaugcggggucgagagcugaugggcggcauugggaaaaccaugaugcagaguggcggcaccuuuggcacauucauggccauugggaugggcauccgaugcuaaccaugguugccaacuacaucugucccuucccaucaaucccagcccauguacuaauaaa

SEQ ID NO: 13803 - RNA, 1378 nt, Homo sapiens
cuucaagcgacagcagugcaagauggcagccaccacaggcucaguaguaaaagucccuugcaauuuccaacuguuggaagaacucgaagaaagccagaaaggaguaggagaugacacaguuagcuggggucuagaagauuacgaagacaugacacuuacaagauggacagggaugauaauugggccuccaggaacaauuuaugaaaaccgaauauacagccuuaaaauagaauauggaccuaaauacucagaagcaccccccuuuguaauauuuguaacaaaaaauuaauaugaauggaguuaauaguucuaauggagugguggacccaagagccauaccagugcuagcaaaauggcagaauucauauagcaucaaaguuguccugcaagaguuucggcgccuaaugaugucuaaagaaaauaugaaacucccucagccaccugaaggacaguguuagagcaauuaaccaaaaagaaaaaccacaggcccuuccccuuccccccaacauucgauuuaagcagucuucauuuuucaguaguaaauuuucuagauaugucuuguagaccucagaguacuggaaaggaagcucccauucaaaggaaguuaagauacuguaaaugauacuaauuuuuuguccauuugaaauauauaaguugugcuauaacaaaucauccugucaaguguagccacuguccauguaguugaacuucugggaucaagaaagucuguuuaaauugauuaccaucauaacugguggggcacaucuaacucaacugugaaaagacacaucacacagucauuuugcugcugauuacacggccuggggucucugccuucuccccuuacccucccaccucccacuuucccugcaacaacagccgucuagccuggggggcuuguuagaguagaugugaaggcuucaggucgcagccugugggacuacugcuggguguguggggugcuuugccugcaccccugguuuaagucuuaaaugaugccccuuccaagccaucauccuguccccacacuccuccacucccaccuuuggccaaagcauagauuguaacccuuccacucaccucugagauuggccuuuggugaggaauucagagcuuuccccauaucuucucucccccaccuuuaucgaggggugcugcuuuuuauucccuccucaagauccuuuuugcaccaucaccacccaacaccuuccaugagacuuccuugcuuuggccagaagacaucagguaagguuggaaagagucuuugaccucccuuguuuaauuuuguaaccauacuuauucacucuccaccagccugggaaaugaauauuggguccucagcccugccacccucugcugucauuggcugaugcguugu

SEQ ID NO: 13804 - RNA, 12233 nt, Homo sapiens
cgggggcggggccaagggccgcagagccuggcgcggagccggcgagauuuugguggggucucaccuguugcgugacucccccacaguccggccgcgggaguccgacccugaaugcccagggaguguugagagaaaucuggacgaguuucgggucccgcucccuugggagcacguggccuaccagccucucgauugcaggguuggguggucgcgacaccggggucgccuugaggccaguccggcugccgaggucugcgggaguccaccuccggccagcuggcaauuuugaaagacugccuuacuuuccccaucucagugccagggcaggggcccuuggagugacuuggcuggggucuguggcccgaucccccugccgucccucaggacccgggcuuucugcuguacagacuucucgugggcagccuccccucggaacucgggcaucauggccucaggugaguguguguacguguguuggagggagggucucugggacagagaagugcuguggccagagugacaagagggugggagucacagcacagcagcaggaccuagggaaggcggucagcuccucccaggagggccuggggagcagagccagagugugcagagacagaggaaaaauccaaagaggcuagggucucugucccagacccccagacaagggggucuccuggccuuccugccuuccugggagguagcuauuuggcgacgguggaauuuucccgggacaggccccucccuccugggcugggauucucgguucuucccccuccucccagagcugggcuaccccgggagcugagggucagauguggaaggaaagugggugcuggguuuucacggaguaugccugcccugccccgggaggacuguguuugagcuuggacucgcucgcugcugaauuccuguuuguuauucuuuuuucuuccaggcuagcuggaaggaccagcuagccuggacuuuggcuucuuugcccgggagcccuggcaugauggggugagggcucuugguggguuaguggagagcugggggcuggcccuuccccaucuucuuuucuacccacccccuccccgccccccgccaggcccagccaccaucagucacgucacuccugggacugaggaggcaggggagggauaaggggcagagauggaggccccacuccccgagguugccuagacaacaugagaaaucguggccagggccucuuccgccugcggagccgcugcuuccugcaucagucacucccgcugggggcggggcggaggaagggguuggauguggcagagccaggccccagccggugccgcucagacucccccgcugucgccgccguggucccagccauggcauccuauccaucuggcucuggcaagcccaaggccaaauaucccuuuaagaagcgggccagccugcaggccuccacugcagcuccaggugagugugugcuuccuggccucaggauagaugcugggcucugucuugccaccucucgcccaaggugcugguccccucagagggggccaccuccuccggcauccucucugugguggugccccucaaccucagucccagggacagccggcuuggaagguggggugaggggugguggggggcgggggguggaucugagauaucugugccagggaugcuguccucugucacaaggagugggcauggugugggugcagcaagagguguguaugcacacgugucagcgugugcaugugcuaagacugcgugugaagcaugugugaauggagcgggggugugugggacugacuguuuuguggacuggccacucugacuggcgccugugccuuuaccaggcaggcuuaggcuguucuguggcuaguuccacuuuuuaggaccccacaucuagaucccccucacugggggucugacaucugggcacaaccauugcuggcuggcaucccacaacugggggcuugacuguaucuaucguuugcuauuugcucauuccuggucuauauugugagccuccuuaggaguaugggguguccuuggucagguccgugcaggguucaggcuggggcugcugcccgcacugugugugcuucugcacccuuugguucgucucucacucuaguaagcaucucugcaucauuuggagcaggcagugaggugcggcagugccugucucagugagggcuuggcugccuggcucugugcuugcagagggauaucugccugcugucugcucccaggccuuguggcuaaggaaagacccacccugacuuugaugaccagaucaugccgacugcccccacccuugcagcugucuguagcuauagcccaaguaucaaccuccuauauuuuuuuguuucauugaagaugacuggugcaaggucucuacuguccugaggguguucucugugcccaggucugugccauccagaaaggguguccccuggguggggcccuuccuggcccuguuugguucagcaauagggcaacugauacggaucuagcccagagcuggagacccuucgguggucagaugguaagagcaucugauacuuguggggucaaagccguggacaccccugugccuacugaggcagucguggcagugugugaggggcuccuggucgagaggggagauggggugcucagaaucucagaguuggugggaguggcucuggagcagcccacucuggcuuuugcuugacuucuccguaaguguggguguauguguguggugcugaccccuagagaaaggaccaguaggcagcugagucuucuaggccuggccucugagaacguagcgguuacugcccgugugccaccuucagugagccugcggcagcccuggagaguggucuggcaggcuggggggauggcacuggcuguuggaaucuguccugcucaccccaggauugcuguggagccugagaccccccugcuaggagaggggguugagauuugagccuuugacucaacuccugcugacccaauaugaaccagccauggaggucuguggucggccuccccuagaaggagucagaaguggucuggggccauauguagggaggagguguguaaaaucaggguucucgggcaagaaaagaucuuacacucugggggugagacagcuuccccucuuuucuuccucuucccacuuuguccuuuuccaaguaagagauagagucaccccaucuccacuccugccaaguucacuucacugcccuuuacuggccuauugccuuugcccugcacugggcccagggaaccucccacuguccucagugggcggggcuacagguagaauguauuuugagggucccaggaguucauaauugcaggccuugccucaacacagagccugguguuuugcagaacacuugcagagccauuaucucugugagccuuauggcaguuguggcuaggcagggaagggaccacuuaucgccccacuuguagaugaggacccaaagccucccagagguagguagagacaugcccggaagcaggaacagaaucagauccauguucuccaaauucuagcccccuuucucccaaacuuauucuggacaguuuguccugucccugaugauaggcuuggaucagggguugcaggucuaggggccugcgaaccagcccccugagcagcugggcagcggggaagccucagugacuggccccuaccuagacugggccauuuccccagcugccagccagcuccuaccccagcaaaggcccugucucuccugagggaugccauaaucagggcccagaggacaguggugagcaacaaggccacugccagaagaggccaaccuggggcugugggugugaugaagagcgcuguuccccuccuuuuucuccccucuuacucuuuggccagccaggcccugcccacucacuguccccuagggcaguggauuuuaaggaggcuuggcuccucccugucggccugcccugcccaagucagccuacccugcuacucccccuuaggagccucacaucuggcugggucuucccuggcacuguagagguggaggcccucuucaguucuggaguucgucuuaucucccaacucugaugcuccuucccuugguuucugggcucccuugaacuccccuagcuccgugcucacggccaucucagggucuccccugcuugcagcugcacuugguacagccugugccagccccugagggaccggcugcagcuucacuggcaaacaggcgggcaaggggcacagggcugcuggccggagcugccugcacucugcagguaggguucaggcaggggccggggugcgcaggggacgggguccuggaucuggggcaggccccucccucuucccuuuguccagcuuugggaccaguccuggaguauugggaaaugggcgcagagacuuuaaggccggcuaccuaggcagauccuguaauccuucccuaagccaggguggagggugcuggaggggagcacuccuuacagccggcugagagaggcaguuuggguguggaaagcuucucacugaggagcuggggcugcugagcccagggaggguccuucgggguaggcuggaagccuuggcagcccccauagaccagcagcuucacggcccucuggugccagccuccucgugguacagauggaaagucuagucuugaugaagaaagaccccuggcuucugacacucccuuccccagggcccucuguggugcccccgguccagauccuggggccugaguggcauagacuguuuguggcagcuccuuuuggaggggcaggcuaaggccaggccacauuuuggcagcccuggggcccugggggacagggcgggccuccagggaggagguaggguucccuugccaaccaggcccuccacuuccucuccucuucccuugagggcucgucccuaggucagagcugagcagcagcugcggcuucucuugugcugcacaggucuaggaugucaggcacagggcccugccccuuugaguggagaaucugcuaguccaggggcgggucugauccuggguugccugcccugggagcugcaggcugggggucccugguguggccgccugguccuuaccaagcaccuggugugugucucugagggugucugugugcguacgugcaugugugugcacacguacacacgugcaccugccucugggagguagucacguggagauucucauggccugagggaucaggcucuagucucauuuguggagguaaugaaucuacuuguucuaggggcagacucagaauccccaccccaagccuggaaugggugaggggucccugcguuagaggugagggugagcccuuugggagccacacacacaggccuacuccucagcuacugaggagggacugcccucuuucccgacccugggcucucucgggagcuggccuaggcagggcaggggcccagggcuuucaggggcugccccuccacccuuugacccuggcaucacugucucugcagaggcucgggguggucugggggccccuccgcugcagucugcccgaucccugccgggccccgcccccugccucaagcacuucccgcucgaccugcgcacgucuauggauggcaaaugcaaggagaucgccgagguaucaccuggcaccacccgcacccucaccccgugucuccaugcccugccucugcuccccacaccccucaccucaagcuguccccucaccucacgcuuggcugucuccugauccucagccucucccagguaccccugguccugcugcccucaccccauccccagacucuguaggagagugcccgagggcggagggccagccaugcugaccuuccuucccuccccccaggagcuguucacccgcucacuggcugagagcgagcuccguagugccccguaugaguuccccgaggagagccccauugaacagcuggaggagcggcggcagcggcuggagcggcagaucagccaggaugucaagugagcccggcaggcagcugcuuagucucccuccauacccuuccagacccuuucagagccccuuuucugccucuuucccucgcacccugccuuggggggucugcacagggagcauagagugggcuuuggagucgggcugcuggguucuguucugucuucuagccgccgguguggcugggucauguugcuuaacuuaugggucugcuuucucaucucuaaagugagugagaacagcacaggguucugcagcucugccuuugaggaucacaugugacaacaugugcacagcaccuagugcggugcugggaccugggagcaagggccgucccucgggaucugccugacuucucaccccucuugccucuaggcuggagccagacauccugcuucgggccaagcaagauuuccugaagacggacagugacucggaccuacagugaggagggcagaggggcacaggggaugcggagcugcagccugcccuucugccggcucuaaaccccucccuugaaugcacccccugcaggcucuacaaggaacagggugaggggcagggugaccggagccugcgggagcgugaugugcuggaacgggaguuucagcgggucaccaucucuggggaggagaagugugggguaaguaugggguguauguugggugagucgccaucaccuaugucuuaguggguucccccagccuggagagcugggggugggggcuggaaagggcguuucucuuuccagcagcuggaggggcggaggggcagaggggcugccuaggagccacuugaugugcuggaccagggugaucugaguguuccugggggucagggccugugggagguggggauaguuuggguucuaagauaaggccuuagggaggaggucucugaguccaagacugaggagagugaucgcauauccucaucuccaggugccguucacagaccugcuggaugcagccaagaguguggugcgggcgcucuucauccgggagaaguacauggcccugucccugcagagcuucugccccaccacccgccgcuaccugcagcagcuggcugaaaagccucuggagacccggaccuaugaacagggccccgacaccccugugucugcuggugggacuccccaucucugccccaugccaugugcccuagccuccugggcuucucagccuggugccugggcaccucugcccugccugccucucccuacaacccaggcucauuccaaccucuugggguacagggguggagguugggcaggagcugucugaccuacugggucuucaacaucucuugcccucuguggggccuuuggguugggcaguggguggcuuggaagagcccugcucugacuuuacccuccucaccccugcagaugccccggugcaccccccugcgcuggagcagcacccguaugagcacugugagccaagcaccaugccuggggaccugggcuugggucugcgcauggugcgggguguggugcacgucuacacccgcagggaacccgacgagcaguaagagggguguggugcauguuggggggaugcagcgugggagguugcguuggcuugggagaggccacagggcucggcuugcucuccucacccaagcuccccuccaugccaguugcucagagguggagcugccauacccugaccugcaggaauuuguggcugacgucaaugugcugauggcccugauuaucaauggccccaugugaguccccugccaucccagacacuuagcuccccucccagcccagauucuccagccccaguucugccccagacucccaucaccuggugucuugcccuuccuaguugcugagcccucgacuuccccgcagucuacuucccucuuggcagccuccauccuuacccucccaccugcucccucugaucugcuacccaagcccuccccaggugccucccuucagggccuaagucccugccuuguucuccucaugcccagaaagucauucugcuaccgccggcugcaguaccugagcuccaaguuccagaugcaugugcuacucaaugagaugaaggagcuggccgcccagaagaaagugccacaccgagauuucuacaacauccgcaaggugggcccucaccccguggccgucuccauguccucaucccacaccucugcccagccuccccuucaagggccaggccccccacacagcauccaguacagaggguccuuucccauugcacugccccaggccccagaccuuccuggccucugguggaucagcagugcccuguuccauuccagguggacacccacauccaugccucguccugcaugaaccagaagcaucugcugcgcuucaucaagcgggcaaugaagcggcaccuggaggagaucgugcacguggagcagggccgugaacagacgcugcgggaggucuuugagagcaugaaucucacggccuacgaccugaguguggacacgcuggaugugcaugcggucugugccaguggcgugggcugugggacugagucagucaggggaccaggagucacgggugaccugagccuucccaugucccccaggacaggaacacuuuccaucgcuuugacaaguuuaaugccaaauacaacccuauuggggaguccguccuccgagagaucuucaucaagacggacaacaggguaucugggaaguacuuugcucacaucaucaagguaaggaggcagccuucccugccaagccucgagccugaggaucugggggcuuuuagggggugagacucaaggaggguaggcagaugacccccugaagagcucugacucagcucaccucaugucugacucagcucaccucaugucuaggaggugaugucagaccuggaggagagcaaauaccagaaugcagagcugcggcucuccauuuacgggcgcucgagggaugagugggacaagcuggcgcgcugggccgucaugcaccgcgugcacucccccaacgugcgcuggcuggugcaggugccccgccucuugugagugucccuggagugggaggggaaccugcggggucauauucaaggggucagggccugccuccugcccuccuaggauggcugagccucccuugucccugccaaccccucugagugcaaggaagggcuuccuggucccauccauggucuguccagccuggcccaccuggguauccuugcuuucccaauaugguucagaugcgccccugcgcucuugggccaagcucugacccuugcuggaccgcuggguuuccucccacuggcccugacuugcacauaccugcauguugucucaccugcagugauguguaccguaccaagggccagcuggccaacuuccaggagaugcuggagaacaucuuccugccacuguucgaggccacugugcacccugccagccacccggaacugcaucucuucuuagagcacgugagcaggcagcgcagagcuggguauggggagggcagccggcuucgcauccagcugcagcucugguucugaccccaggguucuguauuagguggaugguuuugacagcguggaugaugaguccaagccugaaaaccaugucuucaaccuggagagcccccugccugaggcguggguggaggaggacaacccacccuaugccuacuaccuguacuacaccuuugccaacauggccauguugaaccaccugcgcaggugccugcaccacccugugucugcuugcuaugccaucucucgcccaacaaaccucacucuuggcaccuugggccagggccacuagaccucugacccaccuguugccuggacuggauggguucuuucucugcccuuggagcuacaucugucaccccucacagccaguaaucuaccccugucccccuuaucccaggccugcauaguuauuggcuggaggacauaugcgugcugggugggggucaggggcuccggugagcccaggugaucccaggcucaggagcugacacugucuucaugucccccaggcagaggggcuuccacacguuugugcugaggccacacuguggggaggcugggcccauccaccaccuggugucagccuucaugcuggcugagaacauuucccacgggcuccuucugcgcaaggucaggaucugcaccccuagccuucccucccaauuguucaccuuccucugaaccauucgggccccuucagcaaccgauccuccucccacccagcccucagauuggauucugccuucccaauguaacuacccuuccccaccccagccuucagccuggggccccaacuuggauuuugacuaauucacccuuugcacaucaggccaagccuggauuccccucccccugcccucugcuguggccuggacccccagaaccacugugcccugcccagccucggggccaccugacaggcccucccucccuguugccugcccaggcccccguccugcaguaccuguacuaccuggcccagaucggcaucgccaugucuccgcucagcaacaacagccucuuccucagcuaucaccggaauccgcuaccggaguaccugucccgcggccucauggucucccuguccacugaugaucccuugcaguuccacuucaccaaggucagagcccagcaggcagccaggcgggcgggcgucccaggacgcuggggucucccggguuggguggggggcgguggggggggcggucucucggguuggugcugcccccugcugguagagcauagcuggccaauugacaagucuuauggaguugagggguugggggguuggggggaugggggggcggggguggggagagugagugaggaggcuggggaagggaggcaggggcagcuggccagggcgcacucgucugagggaaccuggcccgugcaggagccgcugauggaggaguacagcaucgccacccagguguggaagcucagcuccugcgauaugugugagcuggcccgcaacagcgugcucaugagcggcuucucgcacaagguacuacagcgccugccuggaccuuggcauggcaucacuccuccccuccucugcauuugggguccugaccugucccugggauggcuugggguggggcaugaccccucagcacuggcugcagcccugcccauuacccccgcuccuugcagguaaagagccacuggcugggacccaacuauaccaaggaaggcccugaggggaaugacauccgccggaccaaugugccagacauccgcgugggcuaccgcuacgagacccugugccaggagcuggcgcucaucacgcaggcaguccagagugagaugcuggagaccauuccagaggaggcggguaucaccaugagcccagggccucaaugagccugguccaugaagugcccaccacaucgcagcacuuuuaccacguuuuguccucagaccccgcccaugcuguguggucucugcaugucuccauucuucucugucucugucuugcaugucuccuaccaugucacugucccugggccacccagugaaagcaaagccugggaaucugcucauuguuguuugggcucagguauugagccugauggcccagguauugagggccuccccugcugguggcccuguccugggauccucagaagccugacuguccuaugggcuucuccaguguccacaggggcuugggaugguuguggggggcuggccccucuagccuuuccgguccuuccugggcaaaucuaagccuuggccagggccgaaguuuaggccccugucuuguucauguagccgaggggcaggcgggggaccucuacaccucugcugugggcacggggcugcugagggucuguggaacuccagcagcucugcacuggguagagcugggccuagagcucagucacaggccugggcuuccuggccugaguggguagacgcaggcggcagaggugcuggaccacaucuccgccaagucacugcccagcagccuucuccguccuguccccagcccacgugcuccuugggugucagcuuccugugccucugugggagagggcagcugccuuguguuaugucuggggccacaguugcugcaaaguccuggaucugccacucaaccccgggagugguguucccaguguggcucccagagcuuugaccagauugugaucccagcuggccccuauguuguguucuggacugaggccuuugcugugaacugcaguguuucauacgaaccaucuuuccuagugcaugagaaauaaagauuauuuaaguaaugagg

SEQ ID NO: 13805 - RNA, 6886 nt, Homo sapiens
auauuuuggcgauguccuuuccuauucuccuugcucuuaggcauggaggaagcuuguucccugaacaagacaaaaugaggugacaggagacagugcacagccagggaaauccaguacuacuagaaaucggcuccaaacacuuguuucacagucuugguucagcguaccaagugugugauuugggguuucacugaaaucguuugccacaaaaguaauuuccacaggcugcuugggauuuaggcccuuguagacagacacacagauacaaaugaaggugggcugggaacuguucgguccccuucugccuccgggcucucgcgggagcgggccucuccggggcacucgcguuucccccccagcccccagagggcgcugugggccacuccgccgcacugccggcggcguccccggggaggagccucuccugcagccgccaccgccuccgcgaucgcaaacccggaagacguguucgggcagcuggaguguacgggcccgcgggccacggccaugcagccccuggagguaggucugguucccgcuccagcuggggagccgagacugacccgcuggcugcggagaggcagugggaucuuggcgcaccugguagcuuugggcuucaccaucuuucugacagcgcugucccggccaggaaccagugagugugcggggcgggguugcggaagggggcggaguggagaugcuggaggggcagcgcuugggagccccgggagacuuggaggagggaccccagcaguaaaggggagacagaaacaguggagggauuuugagggccugguggggcggggccccagggauccuggaauaaugggguuuugggugcugugggggaagggcagacgauugaacagaccgaacuacuuccucagaaacagguccccugauggaggauagaagugaaggaggccgggcgcggugggucaugccugaaaucccagcacuuugggaggccgacgcggguggaucacuugaggucaggaguucgagaccagccuggccaacauggugaaaccccgucucuacuaagaauacaaaaauuagccaggcgugauggcgcgcgccuguaguuccagcuacuugggaggcugagggaggagaaucgcuugaacccgggagguggaggcugcagugagccgagauugcaccacugcacuccacccugugcgacagagcgagacuccguaucaaaaaaaaaacaaaaaacaacaaccaaaaaaaacaaaaaacaaaaaaggggcagaggacugggcugccagcugagaggugcugaacggggaacccgggccaaacuguuguauguguguggauaaggaggcccucuugguugcucacccuggggcuccuuggcugcuccacuuuguccuuaguuccugugcccgauuaggauuggggaugguacuuuucuccuguggcuagauucuuuggguuccaccuagcuacaggggcaggaacaaugguaccaagcccucagccuguucucuuugauucuuaggucuuuucuccuggcacccuguauucauggccuuggcggugaguuuaggcuucuaucugauuuguuuggguauuccucaccucauucucccagggaagcacccagcuuucagaaagcucagccuuucuaaggcuaagacagguggaggaaacaucuagggcucaucuuucccugcagccuaugggauugggaaaccuggagggcugggccauaggcaguugucagaugguugaaaagggcgggagggcauggaagauaauuucuuucuccauuggggccggaaaggagaaggggggagagguguuauccggucaucucccgacuuguccccaaaguucaggaagaaguuuaacauuugcuacuccacuggucaagaaaugggagucauuguagagguugggauggggagaugucaaccugaaugaggagacgugcacucaagugcugauucccaaauguucccagaaauguugagcugugaggcuggugguccugguugaacuuauuuaacccuuacccuuuguccucuuuguuaggauguaugagagcaccuccuuuuucucaggccuccaagccagacaugaggcuuacuggcucucuccuauguucacaguucugccucugcauggcugaagccauccuacucuucucaccugaacacucccuguucuucuucugcucccgaaaagcacggauccggcuccacugggcagggcagacccuagccauccucugugcagcucugggccugggcuucaucaucuccagcaggacccgcagugagcugccucaucugguguccuggcacagcugggugggagcccugacacugcuggccacugcuguccaggcacugugugggcucugccuccuuuguccccgggcagccagggucucaaggguggcucgccucaagcucuaccaucugacauguggacugguggucuaccugauggcuacaguaacggugcuucugggcauguacucaguaugguuccaggcccagaucaaaggugcggccugguaccugugccuggcacugcccgucuauccagcccuggugaucaugcaccagauuuccagauccuacuugccgaggaagaaaauggaaaugugaguuccugcgaacgcugaaucuaggugggacgcuugccuugaacaucaugguuccuuuggugaucuauaagggaucuauuuaagaaguggucagguuuucgcacuucuuggcugguccagggacugcagaaaccaaagcugcuauuguugaggaauaauucagugggucaaaauggggagauguacuggguaugaguggaaggugauggagagccugauccugaagccucuacuugaugagagacagaguuuuggguggugauagugaugugcugguggucauuucuugcuugugugccugaugaaaaacuggguuccuguaaguuaugaauggcauccagggauauuuggguuacuuuuaagaaagcagugugauguaguggagagagcccaugggucuuauuuaugggauaugguccucuuaggcucuguuguacaaccuuagguacauuccauaucuuaagaccacuguuucuucaucugugaaauguuucuaaacaaucucuaagucccuuccuucucuaauauacagcgucugucaggucgaugucucagaacacucucccagcuguggaccacguggaccacuuagcagacucaggggguaguucuuuacucucccuuuacuacccuggagggacagcucugcccuugaggcccuucagaaauuugugcugauuuggucccugugccagggcacagggggucaggcacuguggaaagaagggacucaggugagggucuucuggacucuaagacgguaaaggcacuaaagucacuuuaaagcuuuuggagaagcaggagggcauuggcuuaaccaagccgaaggcugcuggcugggcugccuagcccagcuaagaucuuccuucagcccaccucaggauccgggcuugagggcugcagggccugcgugcgcucccucccccgaaaucacuucucagggcaaaggagccccaggcaucucaugcuuugcccuucuuagggcucagguucuugccuuagcacauagcuucugggagcuuuuuugaagcauuucauaagggccaaggaaguggggcagggcuuuucugauccaaagaaaacaaaguuucucugguuaccccucuucccuuguuaucuaagcuuuccucaguugucaucucuucccagcucuuugguccaagagggggcugaguuuggugccagcuggcaaaugagggcuggacucucuucccuccagagaccaccccgcuccuugcugcagcugaaaguaguuccccaggcugcccucgguggugaggacuggaugcuagacugcugagcuguggucugggcucaguugagaagauaggaucucccuagaucauggcaaggccugacaacagcugagccaggaaagugcugcugaggcaagucgacauagcucacagggaacucugggaagccugggauguaggcgcuggagcuccaguucccaggagcaggggcagguguuccuagauguuaguguuguggauguccuuggucuucugaagauucagguccuccucuccggguagcuuagaaguaaggagguugguuugauucaauaguauggggacagaauggggacagcaagggcagaaguguccucuccacguaacucauuaugccccuccugggggagauugcaucuccaggacaagcaucuaaaggaggccccugcugugcagagggguauuguuccugucucuuucauuguccucccuccucucaaacucuccaguguggugugaacucagaagaaacgguuacuggggcugcauggagaauuucaccugcggugauuuugauccagggacugcaucuccucuuuccucaucacagccagugcugagaggcuccuucuaccugccgcaggguaggagggccaggcaaaguucaccagcuugcucuaagagcaagcaggcaaugccguaaagccugagccugccugaggugcugccuccucccagguggugcgggggcuggugggcgggcgggcaggcgugcugacagccggcaguuugcgugggcugugccaucugaugucuauucccagcccugggaggaagggggagucauuuauauucugcaggaggaaggggccccagcugucgccuuucugaccagcaggccuggagggcaggggcacagagcagagaggagggcacugguggucuccugcuuagccuggucugacugcaguguagggaauaggucaccaggaggagcccuucauccuggcaggccggauuguggagggacuucccucccccucuuuuccauuucucccuccaucaccaccugcccucacauccuggggcagcagcuggacagccauuagaccucagugccagggcacucuuccuccagcugggaucucaguggcucccagcugcaugggcuccugcuuguguguucccuccuccgccauccucuguuccccgcaccucccuuauucugcucaugucugggguauucacuuggcuccucagcaaggaagcaaacgccuuggaggagaagcacaugguugcccuuuuguccuugcucccuggcuagggaaagcugcuaguggucagccuguuuugccuuuuuuuaaaaaaaaaaaaaaagccagggcagggugcuuagauuuuaaaaauuugcgugucauuugcacaaauuuucauaucaagcuaaguccugauuccaaauuugauuauauuccaaauuugauuauauuccaaauuugauuauauucagauucaaccuugaggacauuagaaauauagauggcuucuguauccaaaucugaauggaaaugagauuacccuucuggguucagauaccccucccaagcccccgucuuuucuguaaccaccccuccucugagccccaucauggcugggguugguauggaaugggagcagcucuguaucuggggaaguccuccagccucaccuucuuggcucuuaagugguaggcuguuaccacuugccagccugggccuccucucuccccacccuuucacaaggcaggcugcccuuccgcacucacuggcccaucccuucuuucucaucgucccacccuuccacccccgugcauggcugcuguaggucugguuuuuuugguuuuuguuuuuuuuaagacggagucucacucugccgccaggcuggagugcaguggcagaaucuuggcucacugcaaccucugccucccagguucaagcgauucuccugccucagccucccgaguagcugggacuacaggcacgugccaccauauccagcuaauuuuuguauuuuuaguagagaugggguuucaccauguuggccaggaucucuugaccucgugaucugcccgccucggccucccaaagugcugugauuacaggcgugagccaccgugccuagccaggucuuguuuugaaaaccucacugugggagauucaggcauccucccuaagccagcuggccgcugugcuaaagccuguucagaguuaauaauaaucauuagcugaauggugcuggggccuuucagcuucagaucucuaagcacuugcaggcugagucagucagcccucaccuucccccuccuuccugggcugcagaguguaacagaaugggaaggcacugugggaaggaagucaggaaucuugcugcuagccacgccuugcagugacuucucgucugggagugggcacugaguccucucaguaaacuaauaagacuugcaccugacaaaggucaagauauguagggaacacaguguaugcuaggcugagaccuauggugguggcagggguggcuguugagccugaacuuccaguacuccugcccuuccuucuguuuaccuggcuuggccuacagggggcaccccuggucuugaugccucaagcccagcauuucuggguccccucugcaagcucagagagcagggaggcuucugguagugcucuugaugcuccugugucugguuggcacaaagauccuguguaacaugaaaugaaaggugcaucagcuugggggcugggaaaccugcaguauggguuuacuccgucccuaucacugguguggcugugggcaaaccacuuauugccugaccuaccucacagggauguugugaggguuugaugagagaaugaauguuaauaggaauuggaaaauucaaagcauuaaacacauguaaacaggugguauuauuauguucuuguccuucucuuucacugagccaggcuuugggcuuuaugcuucuuaggcaauaaacaguuauggauaauga

SEQ ID NO: 13806 - RNA, 9258 nt, Homo sapiens
ccuauucgaucuacaggggagcggagucgcuucguggccgccagcccgggaaggggcgccagccagcuggcggacgcacggcuuagaggggcgucugggcagagagguuuggggcuggggagagaugcagugagcuugggagaguggacugguagcacaaauaaugugugcauaaggguuagaagaggagguccuggagcuuuggucuucucuuuucccccugcaauugugcauuucggagggacucuugcugcaagcucgguaggcaauagcauccgcuccaagacuacacuucccagaaggcugugaguggguggggggggggggggcgcggggaacaggcaaccuguguugcgcuugcgcaaagacugcgcuggaaaggcagguggggaggaggggaggcgugcccgcgacggggcgagggggagggggccgcgcggcggcggcgccagggcgggcgcgcguccgcggcggugauggcggugcgugaacgcgcggcggcagcaauggccgcucuggagcggcgggugccgagucucgaugacuucgcgggacagagcuggagcucguggguggagcgggccgaccugcccgcggcugacggugaguaaagccacccuaaaguccggggaccccaucacuaucuccccuccccccuuccgggcccccgccagcugaggggagccgccgacuggagccgccguccggcuccccggccccccaaacaaaggacccgccggguccuagugcccgcccgcuccgucaccuucgcgccuccggguccuagcgccugcucaccgcucgcagcccacccugccaaccucugccucugccagucgcuaauaccugcccccauauaggcuugccuuuaucuuucuccuugccugcugccccucagcucgcgacccuccugcaccugccuccagcuuucccuguccgcaacaguccuccacguguuucccacgcaccccacuucugugcccccuuccucaccccccuuguuccuucgccuuuugccccacaccuccugcuccuuuucggcauuugccugcagcugcagugcuuuuagacccccgcccucuccgcguuaguucguccguccauccaucuauccucccucccuccauccuucgguccauccauccaugccuccaacccacuguccuuucccaggccucuugcccugccucuuggcucucugcucuuacucucaccuucucuaggccccugagugccuuagugagcgggccuacagccccuucuucugaucuuugucuucugggccccagggagcaccuggccucguggccuuucggggugacagcaggcaucacgccccugaagaaguuugcaagugagaagagguggaggaggagacugcacggaggggucucuaaugacacuuguucuccucugagacauccgacucccaguuucguucuauccaucauuccccgcacuugcauuuaacggacuuagagugggagcugccccuugucucuugcgugccuaacccacgaccccucauaaucuggauauuauauaagauugucaacaaucuucucauccuagaaaggagcauaucuguuaaugggcaucagagagcagaccuaagugggagcccaggccacccuggggcugccccaugcugggugggcaaagauggggccauugucagggucugggugcauugagaaccggaaauggagucagacggguuuggugacucagaauugauuuuuuuuuucccaagggacagggagggggcguagaggagggaggggggaggagagagguagggggauggggaaaaagcugcuuugcacagcuaagauguuuuugucauuaacccagaaacugagguacaagggcaaccccugcccaaaggcccucuaagaaggggagggacuugcauagcugaccaaggagacuuugaagaugcucaaggaccaaagacagcaguuucucugcucugugaccauccuaucagugcaggaccugagaagcuggguguaacuuugacaaugcuaugguaacccagguggagcaaaauugaguucauggggguggggaccugggagaguaucuauuugggaugccacauaguagcagaaaggacccaucgagaaaucucaagaagagacucagggacuuauagaaacauugguuaaggacgguuuccccuuuaaauggggaagcaggcccagaaaagagaugauacuuacccacaaucacccaacuaguuagcaguggaacccuaaacugcaccuugaagugaagggucccauaagaaagguggauggauucuucuuaguggggccaucuuaguccagaugcagcaggugaaggaagaugggcauuugagaauggacccacugaaagguuccccaagugguccuagcaccaggagcuugucacggagugugggcuucauacuguugagcugcaggcccugcuuggggcuucuggaaaggggacaaccucuggguugucuucugggaagaacagucucugguaaggagaggcuggagacucucuaaaacuggcccugacccuucugagcuguguuucuccucuaggggcugagcuggaggagaguagcaaaaacacgaagaaguuggaugccaugacccucauuaaagaaggugggagucgacacacauuagggcugggacccagggcagacaggaccacgcuccacuuuuccaccacacuacagaaggagguggcugcuugaagcagcugucuggggacccucauuuugauagguccgagucggccgguuguucuggcuccugugaccugucguuggagaucauaaucauaggugauugcccacucaccugaaagcguauacccuuugggacugcuuagaucgaacucuggaagcuggaagcauucagcauggagcuuguuauaucagcggggaggugaagugccuucugaguguggggugggagugcucuccgaucuuccagagaaacccugggaucuucagccccagugacaugggcuucugucauugcagacauguccaucuucgggcacugcccugcccaugaugacuucuacuugguuguguguaaccacugcagccaaguggugaagccucaagcuuuccagaagcacugcggugaggggagcccuagggaggagauaaagggacaggggaagguggagcauggaacucugaggacagggucaguugggaggucucguaggguaauggagggugguguugaggauaggaagguuguggggguggcuucagagcauuguggggagucggguuauuguuugaacaaaauucuagcauccaguggaauuacgggaggaguuaagacauucaggaagcugggucuugaauuuugaguccuaaaggcucagauucaaaugggaaggaggcauguuuacaaucuaauuuauggaaacucagauucucucaugugagucuauggacaugguuagguuggggaaggaaguggugauaccacucaccuugauuauucuuuccaccuccuggugacagaaagaagacaugggccccucagcaagcuuuauggccgggccccacccccaccuccagccccugccagcucucagaaaugccauguagugaaugggcagggcccagcuuguagggccccagguuccacgaaaaccuccuccagggagaagggccaggggucccggagccguggccaccagccuccugagaagacccagaaggacaaccucugguaaggagaggcuggaaacuuucuaagacuggcccugacccugacccauggaugggcugacaucaauacagacagcccugggucaaggcauacuccucacagcaggaggcagccguccugucugcagcuuccuuccauauauuccagggaagauggggucuccucuucccguguuucacaccccugcuggagcccacccaaauuccagggcugggaaagagauggcucugggcuagaguccaggccccaggccucgccuccccuccccucccucagccaacccccucucucuguguguagccuuuucgugccuguggugaaucuggagaagauguccagucucccgaagccugauggacauggaaucaggguggccccacccucugcuuuucucagccagccagggggccucaccaaggacuccccuggaaaaccucccauggcucccccuucuaaagaaccuccuggcagagagaacaucgagaucauccccagugagggguccagucacugggcugaaggcagcccuccugaaaaggagcccagugggaccaggcugcccccuaaaacccaccggaagauggcucgugaguaguuguggucuuggggguccagaauguagaguggggacuccuuugggcugcuuuguccuugggcuggaugaggaggaggucagguuuaugggccuggccaucacagguuguaggguauaggagccccgucaccucuugaccugcuugcuuccugggaagcuucucuccauccugugucuccugaucaaggcugagggagcccaugcccaggaggugaaguucuuucucacucuuuucucaccuagauccagggcgccagccagacacaucucacagcuggcuucucuggccucccagaugcccauggcugcuuuuguuucuugauguguguugcccugcuuugggcuugaagucccaaaaggcgcaccugaaauugggauagggaugguucucacacccagcaaggagauguugaugcccagaaguuuaucuggaagguacagccccaggcugagggcuggagucucuucugccuuaguaccaguucucaggcccuuggcaggaagcggccaaauccuccuguaaacuccuggaaauggucuugagguucauuggaagugcuuuccccacagggaaggagugcgaccucaacaggcagugugggguaauaaauccagagaccaaaaagaucuguacccgccuguugaccugcaagguaacccccuucccacugcacggugagggaggacagcacagggcuugcccacuccuucccugggcaaagagaggaaugucgauguuacugaagguccagcuuaagggagggcaguuaggcccacccaagggaaggggagauggguaugccccuccugggcagaaggugggaacagugggaaggagggaguuuccagauucccccaucccaaaggaggguuuuggccccaugggggaaugaaacaaagacacaugaacacagcugcaaauaugcccaccucucucccugccccccaacuugcccgggccaaagcacccugccgucccucaccccuucucaguucauaccuacuccccagcucuccacucugcuguauucuagauccacucaguacaccagcgccgggaaguccagggccgggccaaggacuuugacgugcugguggcagagcugaaggccaacucccgcaaaggggagucucccaaggagaagagcccagggcgcaaggagcaaguucucgagcgccccucccaggagcuccccuccucaguccagguuguagcagcgguggcugcucccagcagcaccuucucuguucgugccaagcagaccuacccauacugugcacugcccagguacgucuagaauccaaccccuaccucaccuggggguacuuggccccuaagccaucaggggccccuggaaacaggcucagggaguguccuggaagaggcacucccucagcccugaguguggggguauuccuggggcuccugacagugguguggaagcaggagacuccccuguuuccaaccaggcauaccacagcaccccagccucucggcagugugccagauccaacacucaggauaugaacauuuucccagcugccuccaacagaccgaaacuugucacuggggagcugaaagggucacacuccugggcaaggcagcccuauguguauucacucacuggccccuucgcgugcagaggcuaugccggaccccagggagagccugacuugcugaaggagacacacaugcaucucugccugucacacaaggggcagacacgaaacacaggcucagcucacagacaggcucacaggaauaugugaugcaagaaggggguugagcgaguugacugggcugaccagagcuggguacaguuuuaacugugaagauuuucuggaggaggcggaucugcagcagauuauccccugaggaggaaggggcugggaggugaaggggcuggggagagaaucccuugggagcagucucucugucucuuacucugugagcugugucguucccuccuguccuucccuucccucuguccucuucugauugcccugcagggugucugcccuggugcccugcucuuugagcucggcagguucaaggaugccccuacucugaccccacaacagucacauuccccuggcaucccuuuuggcccuuccaggucccgggccuccuccgagagugaauuggaugaugaaggccccugugguggugauggggacccaggccuguuccccuuccccaugccccggggugggacccaggccuccagcgaagagagugaggaggaggggacaucugacgaccuccacccacccccugacugccauuaugcaacccggcccccacggccacaggcgguaaggaccuggaauaggggccuauggaggggguggcccagcacuccuggccaacaacauggggaggaggccagauccugugugcagaugcugucugugcaccccagacccugccaaccaugcaccuuccuucugccuuuaguucugcaccuuugggagccggcuggugagcccaggaugcuauguguuuagccgccggcuggaccgguucugcucagcacucagcuccaugcuggaacggcaccucagcacacacauguggaaguaagucucucggacccagaauggaaguucuagaauggaaauuccuagguuccagacauacuugggcuucagaagcccugaucuuuccuguauacccauaggugugccuuggcuauuugccagcaggaccccagauagggaguagcaugaaaaggaggugggaaaacuuggcagccuagaguuuggcuaaggcagggcauggaaggguggucugggggugaaucuagacuuucauccaucacuuccaguaccuuuuggguaacuagggauaggggaugcccaaaccaagauuuaaaaugaaguuccuagugggcugccuccuaguuaguagguacuagcuaauuccucuccacaggcaccccugugucuucuuccuaacccucaguuccagcaucucccagcagauggcagcaacucuggggcucugcugaccauuucuagguggggcagagagacuggagugugucuuguguugggggaagcugucuuguuucuuggcagucacaguggggcuuucuuuuugcugcaggaagaucccaccggcagcugaaccuccagcucaccuugucaacuccccguuaucugcuccccugagcccauccucuacaggcaccugcccccgccuuccagguccaacccugagaccugccugcccagccuccaugccccccaccaaggacaaccuuguccccagcuacccugcaggcucccccagcguggcggcugccuguagccaggcagagugcaugggcgggagccaggcuaucaccucaccacugccugccaacacgccauccccguccuucagcaagcugccgccuuccaaggccagcaagucauccaaaggcaaggacgggguggagguggaggccccuucucgaaagcggaaguuauccccuggcccuaccacucuuaaacggaccugcauccuggagcccacuggaaaagggaaacccucuggcuguaggggccucucggccaaaacuaaaacagcccugagcauggggcuuaaugggacaauggggccaagagugaagcgggcagggccccuggacugucguggcuccccucaucagcuccccacaccagucaaggcuucucagcuggagaaccggggagcagcuggacacccagccaaggcccugccaaccaacugccucucugaggaggagguggccaagaagcggaaaaaccuggccacuuauugccggccagugaaggccaagcacugucaggcuggugccccugcugauguggccugcucugugcgccgcaagaagccaggcccggcccuggccuuugaggagaagugcucuacacugaagguaccagccaggcucccugaagauugaugaggguggggcacacaggggguaccugauacagagaagaugcuacauugguguuugugcagggaaagggaggaaggggaaguugagagaguuccuggacuguuuucuuuaggaagagguaggucaguucuuagcaaagugacuccagcuuuuugccuggugaaccuuccccuaucccuaacccuuucccuugggcugaggagaugcggcaccccuccaccccugcuuuugcuauaaucaaagggcuacuucuuucugaauuggcugugacccucauuccagguacuggagcuaccucuguucccugaaggaaagggaguuugagucccugggucacagccuaacaugccgagcagcaaggugggugggcuggucucacugguuuuuccucugggcaucagggccuugaagggcaggcacacaaccccauguccacuuaugcacaugugcccaccuccaggugugcaggugacaggcaaguucuccaggguuuccaguaaagccugcagccaguuuuauuugccucuucuggugggagcccugguguagugugcuaugugcucuccauaugaucucugccaggagggacuuacuggaggugggacgggggugcucuccuggguuagaugugggccuaaucauaaacccuguguguucuccagcuucacuacccaggcugccccuggugagcuggcauucaucuucccccuugcucaguuuuacucaccaggccagcagaaggaaaucaagcuuuagccucuguagugcacacaguucacuggguaggacagcugguaggcccccacccugacccuuucucucgccucuugucuuccugcagucaaaagcccauuaacgagaaagugccugcccacugcaacggagccgccagcaccuccuccccuccagauccgggccccaggcugcugccgcuuuuuauaacuuuauauuauuuuuuuuuaagaaaaaaagcucuuuaaaauaccucaag

SEQ ID NO: 13807 - RNA, 16417 nt, Homo sapiens
ugcuaaggucuggaaaguaccuuaaucauccauuucuuucaucuucucagcugauaacauuucuucccacccucacacaaucagacaaaagucugccuacuccauuucccgccccccccccgccgccaucgcauuaaaaaaguaauacuaauccuuuuuccuccucaaccucucacaccucacccccgacgcuugacccuuuagcuaaggggaaaacaaguuggggagcaagaccucagauuuucuucuccuuuucauccagggaagguguaaguacuucaagaauaaucucugagggcagggaaucucaaccugagacccacagaugaucccuagggcauccaggaaucagguaaaaauuaaauguucaauuguacccaagguauuuuucuaggggauguaaauguagugugugacucucugaagagggauagaggugcaaguuuguucaacaagaagcugauaguuaagaaagugaagcauauggcccucaacuccugacaggaagccuguuugggucacagaugguaggagaacaaauggaaacagcuuuguggaagccacuaucucucaccuuuugaguuugcuccagaauugcuaaugagucccaguuacuuuggucuaauugggugccaccaaaagaggagaugucacuagaccagagccugcuaggaauaacugcucuccucucugcaccccaagcaacagagucugacuuuguugcuuggggugcacaguggaaagcaguagaaugauaucuuggugaaaguccugauauugguucaagaacuuaaagcaagggagaggaagaaaaaauaaauccccggaaggacuccagucucagauccuucauggcaaguacuugcagcacuguuuauucaaauauauaauaacaagcaccagaaaacaacaugcaacauucuccccccaccccugaucugcaaucccagaaguaggaggcucaugacuaugauagugaaggaaacucauguccaggaaagguccuaggugggcacccuggugcuggguuagagucuagugggacaaagggcaaguacccugcccauuagccuccuacagcagcuggagaaaccagacaccuucuucuaccucaggccccacuuugcaaagcagugaugccagcccugguuggagagaacaugaguccuaugaggcacuuggcccugcccagcccucuggagguaaugaggugaaguagccuuuccucuuaggguggccauagagagugaggccguagccuaaaucaaggcucuccugauggagaacaagagagccucuugagaagaaagagaacgaggcuuccuugcucuaaagagaguccugggcugggaguccuuggcaggagugaauauaaucuccccccacccccugcccgcaacugcuuucccuagcugaaggcccaguugcuaacuucagcccccaaaugagaacacuacccagcacauuucaaauaaauuauaaauacagacacagaauccaaacaaagauccaguagaagcugcucacagacccccacagaggccggcuugaagaaaaaugaaggucaccccuuuguucucugugucucuggagcuguaggcaaaacuguccccccuuguccuugaguaaccauggggacagcucaugacagagaguuucagacuuaaaaacccucucaccccaucuccuuucuuuccuccucaaaucucuuccccaaaaucuuaaacaaacaaacaaaaacuaauucuuucacugagggacucaagcauuuggggauguaaaucucacccuuuccccaucgggaggaaaugacuggccugaagucaaaaguccugacuccuagguaccccaguaaugcacauguuacuauggaugguguuuagagaggugaggagguugaaggggguugacucaguccugaggagagauuggcacagggcacauucaccuuuaggaugcuuagugggccaauuggcacuggauuggaaaguggucggauucuucccucuucuuccuucccugggaagcccuauggccagggcagauugagcuggguaggaagcaaaugauccuuacccaguuaacacugauucucagccuuggggcccagagagggacugaaggagguaucaggaagaggauauacacuaaagacaaauauggaacugggucccaaagugaagaagcaccaauagcaucggccugcccuggacuugagaggggauagagacugggagaaauaaggacacaggggagaaaugggacagcaagggaagagggaacauccuguuuucaagaugagaaggagaaauaugaaagaaggacuagagaaggagcaggggaaaaaacugagcagggaauaaggaaaaaaugggcccauccauccuggggcucuggggcaacuuagccucaugaugguccuuuggcccuuccuaagccccugucuggccccacaggaauaaaaggaaggccuggacagacuucaaaaaggaucucaaaugccucagaugcacgaugcuggggaagggagauggacagagaaguaaggggauuaggaggcagguccugacuccacauuuuugagucccaagugugagaccaagaaggaggacagggaggaagauagggcguuucuaaaguagaguuuagaguguugguggaaagugccccagccuggugggugggaggauugaggggauagaagaaauugauucugccagcaagcuuacuggcuuuacuuucuugaagcugcaacucaguugcaauuuaucuugcucccagcugaguccaggaaggccucaucaggacccucugaagggcuguuuucuaggcugguggaccucucugguucacacaugguggauucugugggcaggcagaggccagagaagacaguggaaggcacacugagucaugggaugacuggagaucagacgcagggacuagaugacagccacugaggaggggucgccaaaccacuauuggggccuccacacaagggaccagaggggaaggcuacuagcugauuucccuucccccuaauauuguugaagccggacagguugacagaaagguggcugcuaggaaccagucucagagcacugguuuccugcccccaacccucaccugcagcagaggcugguucucagagacuguaaggguacaaguaagaccccaaguaagauaccuggguccaggcacugcacaagaagcacugagcuccugccauucauggcuccagcaagaaggaggauaggaagccacugagagggcugcccagguuuccaacagcugaugccugcccaucgucucaaagcucaaagaccagaaugaugggggaggggaauuggaggaggaggaagagaaagguccuggaagccggaggugguugaagaggugcuguccaguucgggaauagccagguggggggcugcuuacugcuucuccacugcucccugcucagcugcacucuccuggcugggacccuggcccugguccugguccugguccugguccuggcccuggcccuguccaugccacggggucuccuugaacacaaaccaacaguucccggcccacaggaagaaguugauaaagccaaagagcugcaaagacaucaggggaauuugugagaauagucagggggucauugugggaacagggagggggaguuccuauugcaguugggguuggggcuugugcagggaagaagcacagaggacuagaaagacuaagacagagagcucgguauagaggcagggcucaggaccaucaacuguuuaggggaaucccaggugaaagugucuaauucuguccacaccaugcacccaagcuguagcuuggucacuagcagaaucugacccuuuagaggagcaucgugcaaagcauagcaaggagccaagcaaaagucagcccuggggcgccucccacagcacgcgugaggcccuguucggagcaccuuccgccagguagguguggcaggagcuguccaaggugcuccuucccugugaucaggcaccuagccagggcuauguucaaauaguuauucaacauauuuuaaaaaccucacagcaggaaguacuuagagggaaguguacugaugucccaaauuaucuuugaaaugcacuaaaaacaagacggauugauggaugaagaagugaauaaauaugugauaaagcaagucuaguaaaaaguuaauggcacagucuagguggugagugcauggguauucacuguaaaauucuuucaacuuuguuguaccugugaacauuucuacaauaaaauuuuuuugggggggaaccauaagcaggguuccagcaaguuccagacguguguuccuggugugccagccauuaaacauuucagaugugggaacaagucauuuucagagcagggcugagguggcugggaugacgggcagcauuugagaagcucaagaccucagcucuuuaccaauggauauggacauauuucaacauucuaacaacugggauggccaaauccauaugcauccagcagacccacuacugcuccaaagccccuuuccaggcuggagggcugagugacaguaagccccuucccacucaugcugggucugcucgcagcuucaagcucagccacagccccaggcuccccuuuauguguucacacacauuguguagaacaggcaggaggaggggagacaucacagagagcgugccuagagguggggaaaugagaagggaauuggaggcagagugcagaaggaggaaggaacagaaggcuaaguggcuuuuggguuccccucaucccaaaauguccucucagggucagccaggagccagcagccagcaugaagcgcagugagggcaccagcuccaggugcaggggacaccagcucugggacacccucucuuuccuuucaggaccugcuagcugggacaggccugggcagcagggcuggugcugcuuccugcaguggccacaggucucaccacggagauguuggccaggcccauagagggcguggccccggcacugcacacugcuuccucuccauggcacacugacauggcugcugucaagcuggauggucguguggcccccuugacaucggucaggcccuugccccaggcagcugcagcuaccagccagaagaaggugaaggagacagucacacagaaguccugggaggagcagagggaugggaaauacacucagaaaggccccaugauucccuugcuucuuuuccacuugccaugauacuggcaaucccagggugccaggacaguugccucuucccauccuacccaacaccuagaacccaggugguccugaggcaucuguucacugcccccaaaggaguccugccacucaggcuagcccugcuaaugcccucagaucuaagaucuggcaacaguguaccaaggcaucguuggucagccucaccccaaaacccacucaucccaaguggagccuaaauuccccacucuucccucccagcuuuuucuuugaucaccauugcucagauacaaguggcagacugcaggacgcaaauggggucccuuaaggcaccccuuccgccuugcaugccugggauaggaagagaguaaagaggaauaauauuaauaaucgcuaaugcuuauugagacuaacuauguacuagauacaugcauucucauuuuuucacauacacacacaaaacuaugaagcagguauuauuuuauccccauuuuauaguuaaggaaacugcgauuuagagagguuauuuaacuuguccgagaucacacagcaaguaaggggccaugcugggaucugaacccaggcagucuaacuccagagccugcuuguguauggugcuauugugccuccugugaacaggagcaagcaacgggagguugauggaggcagagguuccaccauggggguggaagccgccaugcuuguccucugcuccaguucugaccucaacccccucacaaacaucuguuucuccaccccauuccuucuggccugugcugacucaccaccagcgggaagcguuuguucucuguguagagguuguggaagcgcagguagauaacuagggcagccaugguauagaagaaggaaaagaugccaagggucacgaagaacucggcgggugcagagaagucccccaugaggugcauggucuuggagcuggacucuucaucgcagaggggcaucucauauuggauccggugcaaccugcagguggcaggggaggccauccugagcucaggcaauccucucucucccuggcccagaaguaguccugugcuaguucucagcaggggacucuuacagagccaagaaaggggucauguaaggaggcaaguuucuggaaggaaccuugcaguuaagaugggaacucccccgaaauuuccaguaaaacucuaccuuccccucagcugcuccccaacccaccccacucaucuacccugcccagacauggugaccauguauucccaagugucuccagggcccuuuaggucacaacugcaauauauguaguucuucucuuucugguagccaaaccacuaggcagaucagcuucauucugccucuggaaagugcaggcccagaguggccaagauaagguuggaaucacccauucucaggcuuuauugggcuuuccaaugagacaguggacaaauuaaagagaaaaacacagccuauuauauaugagacaguuaauauaacuugggugcugauacuagaaauuucugaaaaggugagccucauccccauuuuccccugaacaccugggcucccuacuuccuaagcucucaaauacccagaaaagagaucacuucuaccucccugucaaggugugcccacuuguauccuggucguacuggcugaggaucccacaucaacucuuuaggauguaaguacuaauaagcuucccuaccuucaaggcagagaggaggcuacugagggucagagagaccuguccagcuuguccagguuccuguaagccuccaucccaaacugcauuggcucuuucuguaugagcuggugugaccugccauggguuguccauggacuggaacauuauuauaacagugaucaaucuguauuucccuuacguuuugcucuggucaaugugucugaaauugcuaaaaagcagaaaggaucuaaguuuugucauucuauuugaaucuggaguggcacgcaaugaaugguuuuuagguuucuggaggaggaagagaccaagcagguccugccagucaagugagagaugaugugcuggguuggaaccaauucuugcucaccugaagggauagccaaaugcaacgaugauggagcucacguccuuggcuucguuguugcagcgaaccauugcuccugucuccccgcuguaggagccacaggacccgaaggcgaaaauagcaaagagcugagagagagugaagccucuuugagagucagaaggccucaacuggccaaagucgagaacuaaccgugacuccccgcaggugcagacauuaagugcgggagugggggagagugaggauccccuuuaaucaaguucuuccuagguagaaacccauggcuuccauuuaucuuccagccucaggcugcuggaccaaauagccaaaugaauacaagguugacugaguggugucugcaagggagaugaagaggcaggaaauggacaguugccagaucucuccauugggcaugacuuggggaccacagguagccuccuuaagaugacuaacacaaaaccucugcaauucaggcuuuaggaaacuucuagcuuacagauagacuugaauuuccuucccaagggagagacacacucaaaaagauuccccugcaucaaccuagaucagacaugccuagaacgcuuuucauuucuccuuugaacuagucaucuaaucuuguuuccuaguugcuaacuuccaguggcuuccugccuugguggagguauagcuggaggggccagcuucuaccaagccaccccagaugggccauacuacugucccauaguacugacagccuaauuccucuuccccaaaaggcacauggccuucuagcaauagugcuggcugggccaaugugacaaucuuggcucaagcccagagaaaaguacccuccacuugccuuaucagucuccacuguuuccccacugguauuucccuuugucaucuguugaugcugccauuucucaguguuaagauccagaggugucucaggucacucgaauuguuuucuucuccaccuuuccucacauuuuacuacaccuucucucucaagugaaauaaaauuuccucauccuaugauuuucagauuucuuucugggaaacacacuuugguuagaaaaggaggugagaggccaggugcgguggcucacaccuguaaucccagcacuuugggaggcugaggcggguggaucauuugaggucaggaguuugagaccaaccuggccaacauggugaaaccccauaucuacuaaaaauacaaaaaucagccuggcgguagagugucgcaugccuguaaucucagcuacuugggaggcugaggcaggagaaucacuugaacccgggaggcggagguugcagugagccgagaucgugccacugcacuccagccuggcaacagaaugagaccuugucccucucccgcccaccgccaaaaaaaaaaaaaaaaagaaaagaaaagaaaagaaaaaagaaaaggaggugagaaauugaaaugucuuauccuccacaucaucugcucagauuggauuuccugugcacuuaccuuugacuuguacacaaugucauguucuuauuaagcaaugagcuuauucucuuaauuguucacucucuguaucuuucuucgagacucagugucuuggacauuaagcacuuggaagacagcugaucuguaugucagcccugcauccagagucuagaauagaagcuauaugcacuuuauuuugccaaugcuuguuagcauuauggagugaaaggagaccugaacuaggaguauggaaaccuagguuccagaccugguccugucacuaauuagccaggugagcucugauaagucacucugcucucugagucuguuuccucaucuuuuuuuuuuuuuuuagauggagucuugcucugucgcccaggcuggaguguaguggcgcaaucuuggcucacugcaagcugcaccuccugcguucacaccauucuccugccucagccuguugaguagcugggacuauaggcgcccaccaccaugcccagcuaauuuuuuguauuuuuuuuaguagagacggguuuucaccguguuagccaggauggucucggucuccugaccuugugauccgcccgccucaaccucccaaagugcugggauuauaggcaugagcccagccuguuuccucaucuuaaauggagggguuuggaguagauaaucuagaggcccuuuccagcccuggaacucucucacucucugagaguaacacugucaguguacucuugacugggcuugccaacagcugugcuuugccccugcgagguguccagugccacugcccccggcuugcagcgccuggccuugcagaucuccaugcuggagccauuggccucucuccaaauaaugggcaccucucuguuuucaggagguuuauuccagacaaaugagaauugucuccauguuuaaagauaucugggaaagaagacaguaaaaccucccuccaaugccuaaauacccuccucuccugaauuaaaugaugaagacugcaguagagcccugucugcccgccuucuucacagagguagagaagagucacucgaagccucugcaucauuacccuuuacuuacucaaaguggccucaccauuguaauaguggaacuucucuaacucuuccucauaggaauucgcuaaucuuuugucaguucuguggccaucugauuccucuuagaaguuucuuuauuccucuuagcuucuggugcccagaacuggaugugauuagggugucacauucugggaagggcagcacaguuggaaauauuuuuacccguuggcaguuagucagugaauggcuccuuauagguuccuuaagaaagcaggggccgggcaugguggcucacagcuguaaucccagcaguuugggaggccaagcaggagaauggcuugagcccaggaauuugagacuagcaacauauaggcaacauagcaagacccuccccuacagaaacuacaaacaaaaaauuagcugggcaugguggugccugcuaauagucccaguuacucaggaggcugauggggaggaaucacuugagcccaggaguucaaggcugcagugagcuaugaucaugccacugcacuccaggcugggcaacagaacaagacccccaucucaaaaaaaaaaaaaaaaaaaaaaaguaaagaaaaagaaaguagguacucaaaacuugggggcagugaacggucaguuauggagccuucucuucaccagcacucuccugaaaggcacuccugagcaucuacagaaagauaaaauuuaagagcauguacuaugccuagcauguacagugccuacuaugcaugguuccaggcacuauuaucuaguagugaacaaaagagaaaaaaggccaagcauggugguucaugccuguaaucccagcacucugggaggcugaggugggaggaucacuugagcccaggaguuugagacuagccaacuuuuuauuuagccaagaaaaauuagccagguguggugaugcacaucuguggucccagcuacucugggggcugaugugggaagaucucuugagcccaggaggucaaagcuacaugaucacaccacuggacaccagccugggugacagagcgagacccuaucucaaaaaaagaaaaagaauaacaaaaucucuguccucauggggcucauacucuagagcugcacuauccaaaacaguagccccuagccaagcuugauuauuuaaguuuaaguuaaucagaauuaaauuaaauaaaaaauucaagccgggugcagugucucagaccuguaaucccaacacuuugggaagcaaggugggaggaucacuugaggccaggaguucaagaccagccuggguaucauagcaagacuccaucucuaccaaaaaaaaaaaguagucgggcauggugguacaugccuguagucccagcugcugaaguguguggaucacuugagcccagggguucaaggcugcaaugagcuaugaucacgccacugcacuccagccuggaugacagagugagacuggaucaaacaacaacaaaaaaguucaggccgggugugguggcucaugccuguaaucccagcacuuuaggaggccaaggcgggcaaaucacuugaggucagggguucgagaccagccuggccaacauggcaaaaugccgucucuacuaaaaaaaaaaaaauucaguucagucacgcuaggcacauuucaagugcccaauagccucaugugacuagcagguacuaucuuagagagcaccgauucuaaaacuuuuccauuauuaccaaaaguucugcugugucuaaacgacgguccugagguucugacaauccugaaucaugcuuucggauuccucagagggcaaaauacacccacaauaacuuuaguauuuauuguauucugauucuuuucaagucagggaucuuacacgaugauuuuuuauuuaccaaaauauauguuuaaaucugaacacuauacagucggaugguaccagagcaaaaugagaacaucugaggggaaucacagguucacagaacagcagaacaaaagggaccucaaagauucucacacccaaucaucucaugucacagagggggacugugaagccccaaaagauuaagucacuuucccaaagucacauuuaguuaaugugagagccaggcuuagaauucacaucuccugauucccuguccagugcucuuuccauuucauuugcucauuaacucaacacugauugagcaucuaccuugugccaggugcuggagauaugaagacgaauaacaccuaucuccugcucuugagaauucacaucaagaaaggagcgucauagcaaaacaaacaaacaaaaaauaauaaaaacaaacacugcaucccagaguuauugaggcuaaagaagagaucucuaccaugugcauugaggauuacaaggagggaaggaguagcucugugccuuggggugcagaagcucagaaagacacuuucucccaacccccuccaugucuccuaacccuccaucuuuccacuccagauuugcuuucuucccuaacuuugccaagugacugagacacagagaagagaaggaaagaacuaaaaucaccccugucaccaagcacaaggcucugagaugagcaaacugguuauaaagagcagccaaggagagguagaggaccugagacaagggggaguucuagcauucuggugccaaccagccuuucuccucuuggaccuccauugcugggacagcgacggucauuuucugcccuccgccuccucuugcuucugcaucucuuuugcaaccuuaaaccuuuccaguuuaaggaugaggcuccccuuuggcacugacaugcucgcuggugauaauccugugacaguccugaggacacuaacaucaccaguuagcucagagcacaaggaagacaaauucucuccccagguccuacucccacgcuuaucucauuguuuuuuguuuuguuuaggcgagguaacaggcucaugccuguaaucucagcacuuuuggaggcugaggugggaauaucaccugagcccaggaacucaaagccagcuggggcagcauagcaagacccgauuuuuacaaaaauuuuuuacaacuuagcuaggcaugguggcaugugccuuuggucccagauacuugaaaggcugaggugggaggauugccugagcuuggaaauuuaggcugcagugagauguguucguaccacugcacuccagccucagcgauagagccagucucuaucuuagagccugucugaaaaaaaaaaaagauuugauauuuacucacucaagguuccagagcuagaaagcaagaaagcagaggggacucaauuuaaaccgaagccuaucugaccucaaaaaucugucucuaucuuccuuuuucuuuuguuuuauuuuccuuuuuuuuuuuuuuuuuuuuuuuuugagacaaggucuaguucugucacucaggcuggagugcgcagcucauugcagccucgaccuccugggcucaaugauccuccagccucagccucccaaggagcugggaccacaagcaugugucaucacacccaacuaauuuuauuuuuuaauagagacgcgaccuccccuuauugcccaggcuugugucaaacuccugggcucaagcaauccucccaccucagccucccaaagugugucuuuuucuuaaaaagaaaauuuuuuuuaagauacuucuuuucuuuucuuuuuuaucuugaacuccuaugauuugauguccuuuucuuuuuuaaaaaaaaacuaguucuccaauaauuggucuauguccagguuauuuuugcuagcuuaguauagacuuagugagacuccagaauuggaauugaggugagauuaguugauuucucaauuaaaaaaaaaaaaacucuaagauaagcuccugacaaauaaaagaauaacauuacuuucuuuucacaaagauuccaguaaaaucuuugcuuuuugguaauaaugacaacaaaaguucucaauuaccauuacaauaacugcaagcuuuguguuuucuuuuuuccuucuccaaucaggagcauuugaucccuccaaacaggaaaugagugaaaaacucaaaugacauuuccacugucauuucuggugcuaaugccuguuuacuuuuuauguuaccucaucugcagagcuucaaagcaagugaaacuggcgcccugaauucaggcuaccugggauggcaauaaaagcaaagcacguuucuuugugaugcuacccugugaaugaaaucugaauucagagucuagcccagggcccagguuuuagcauucugagagaaaagggucucuguuuugcacaacccccuuucuaaguacuugaagaucauaaaagucuaucagaucuuaauuccuaggucauuagugcugaccccaagacugcaucauuucccugggcauugcuuuguacagccuuuacagaaauguuguggguauuuggagugcugcguggagggaaggauggcaggauugaagaaggaagcuuuucagaaucccuccaagggagaggaguccauggucuaauaaccucauuguuucccuuauccuuugacagucugucucaaauucuguuggauccauuugucuaauuuaaugguaaaauugcuuauaauggcucuuccaguucuggaugccagucacucagagccuuaauaucauuuuuauauggcucccucuggcacuugagugguggaucagaacagggaaggggccaaaggcaaaagagcucaaucagcaauuggucuaaccacucuugaggcaguaagaaagguggagaguccccaccaggucccagaguuugcacuugggagcucccaggcuggcccgauaaucccaaaugcacuuuugccccuggguuccagauuugauuauucucauccaaaccaugauuuaagaacuggugucacagugcuaauucuugucuccaaagcccuguagaacucaauccuccucaguauuaaugguaacuuauucccuagcugaauucuguacugagagcacauuaauuaaguuauucacacaccauuugguauguggauugucuaauuuaaaaucucuucugcaauagugcacuaaaugcccccuacaagucuuuaugauuugagaaauugacugcaccuguccacauuccuaauuuauacccaggaggccuuaggcacuggccuagugaagcaagauaguauuuccacuagacuguaacaggggaaacugaggaccugagcaagugacuuuuucaaggucacaaaguaagucuaaccuagggccauauucuggcacaccaaacuauuuagagcauaaggagacccuaggaagguucugaucaacaucuaacuaguguuggaaauugaaguccagagaaaugaauugcccaaggugacauagcuggaaaaggccagucuaggucuggaucccagggccccagcuucucagaucaguguuccauuuuauucuacaugccacauuuuagccaugccgugauuuuuauucuuauuuuuuucuuuuauuuaaucauagaaccacaagcuccguucauucauucauccacucccucacucauuuacaggaacucggauuacuccagugaccucaaaagggaacggcgagccgagagccuguccccugagcccaguacuugcaggaucauccaggcccugguggguuugggggcaggacgguuuccaucgccugcuuccuucccuccuuugcccucugcggcuucccucuuggugaagagcggaccucguccccgucguccuucuccccccucccgucaccaaggagugguaugugcaggaucagaguucuggaaagguuacacccggguccucucgcccgggugaaaugugagcgcccugggcaaaggcuccuugcacauagaaggaccgaauccgggacuccgcaugccucgcucuucacccuccugccacuaaguccggagaagcagccccagcccgccccucccccgcccaccugucgccgccccccacccuuccgccguggcccggccgcagcaccuccccagcccccacccuggcuccauugcuucaggucagcgucacagcccaggcucccgaaauagcccggggccggggcagcgacucacccacuggagaacuuugaugaagcccagcggcuccuccagccgccgccagcgcagccccacgaguaggcgguccaccugcggagacacagccggccggggggucagggcgguggggaacccugggaaggcgcugguccccuugccccacucacacgcgguccaggggugggauaagugugcagcccgacaucuagguggagaggggcgggugagaguccugggcgcgcagggacuaccugcuggcgcggcgacuuguccgccgugcggccggcgcucucggucgaggacaugcuggcgcggcgagcgcugggcgcggcgugguggcuuggcucucuggccgggaggcggcggacacggcgggggagcggggagcugcagguccggggcagagcaggcgagcggggccggagcgcgagcggccgucggugggccggaguccagucuggcuggcuggcuggcugggacgcgggggcgcugcuguucgugcucucagaggcugcggccgccgcggugccccgccggcagcagaaagcccccgacucggauucaaacuucugucaaacucgca

SEQ ID NO: 13808 - RNA, 6464 nt, Homo sapiens
ugugcaaauauaaagagguuuauucauucugucauuaggauacaaaauagaacauguaaaaggcaccccucccgucgaccccacaguucagugugaacaccgagcgcucguccagggaaggcugccaugcacggcguggcucccggugaaggcagccggcuugagccagccucaggucucgaacauggcacagcuggugcacagcacuuucucguacaugucacugcagcugcgacagcgucagggaggggagagaaaagcugcugucaggggcugaauuguguccaccaccccccaccauucaaacgucaaaguccuaacccagaacaccucaggacaugaccuuaucuggagacaggaucacugcgggcaucaucagucuagaugacggcacugacaugggggcccuaaggcaacacgaccagcguccuaaaaagacuacgugaagagaaggacacagagaaggaagacgacaugaagauacagggagggggcagcugucuacagggaacaccaaagauaaccagcagaugccaggagagaggccaggacagguuuuccauugcagccucagaaggaaccagcccugccagcaccuuccucucagacuucuggucuccaaagccacguggcaguaccucuuugcugucuaugccacugggucugcgaacucaguuacagcagcccuagcugauucccacugccgaucaauccacauggggcccaaccuggguuuccaguaggauagaagcucuccaaagaaaccuccagaugaccugccagaauucaccgaaccacaaugguuuacacugaagcacaucaaacagugcuuuucugauauaucaagacuaaggguagggccgggcaugguggcucacgcguaugguguggcuuaccucagcacuuugggaggcugaggccggaggaucaccugaggucaggaguucgagaccagccuggccaacauggugaaacucugucucuacuaagaauacaaaaauuagcugggcgugcuagcgcacgccuguaacuccagcuacuugggaggcugagacaggaaaauugcuugaacacaggagguggaaguugcagugagccaagaucgcaccacugcacuccagccugggugacagagcgagacuccgucucaaaaaaaaaaaaaaaagaaagcucuaaagguaaaggcuagggaacccggcaaaacacagggagaaagugauuaagagagauguugcgaggaaacgggacuggcaauggcuaccccaaacacgacagggccguggagucaacaaggcagccagaacugcuugccacuugguuugcagaguuugccaguaguauugugggugagccgcgaagacagccccucaccgccaccggcagccagcuggagagcccugcagaggacgggccaggcgugggccagugcaggccaucagcaggacgccaaaggcugcugggcugcaucuguguuaaaccagagccguguggacagaucccuguuuucccccacuccugcgacgccugguccugaaguaggaaauggcaggggaggggguaggagacugcgggugccaccagcugggcugccuggccugggaaugccacuucuggcuugugaccuggaacaagucauuuauuugugaaagagggcagagcccaccuccugugcuguagcugcgauaaaagaguguguccacaguggggacaguggcccacucagcucaacgugaacucuguggguaugggaggaagcagcagcagaaaguagguagaggccaggaggaaaugggcgcaagggagucccucaaggauggugugcagggcaggagugggaggccagccacgcagcgcucugggacccaccucuccgcugaaccugcccauggcuauguucacuucugcuuuggugagagggccaccagacaaugagaaaacccugcccuuuucaguuuacuucuaggaaagaagaugaacucagcgggugaaaagcaaagacagaguaucccacauucauagcuagcccugcagaugauucccaaccuggauggggugcguuaccccacuccugcccaugcugaagccaugggagccgaucacuggcacgcggcgcuucucccuggugcugcccccccugcccagggcucuccgucuccaaugagucugggccucugccccgacugaagaaaggcucgagagaaaggacucgagauguaacaugugguuucuauuuuagauggacaauuucagacauuguuuggacuaagcuugcuuugggucuauggagccaguuccacaugugucuggaugaagucaucuuucucacggggcagggcaaacaggcuccacacuguccacucccauccaccaggugaguagccccuagggugagaacgccccuccccaccuuaggaguaaggacgggauccagccagcugcagcaaacccacccacaaaugggagacuacacaaacacuccacuuccugccugagagggucuacaaccaaacggcacgcaugacuguggugaagcugcggugugcaccugugucaccaaccaggggcuccucggacggggggagggggggcucaaagaccagaggaggaggaggugggggugcucaaagaucagaacaggaaguggcugaagacagggacuagagccggauacagagcaggucaucugugagguucagcuuucccuuagagaggauuacuaaccacuaaaguugggccaagcaucuauugccaccaugucccguuaggcaaugccagauggcacugcaucaggggccacacguguguguucugggcccacaugggugacccacccgucccccaucacggcuugcuggggcuaugggaucucagcagcuccagggacugaaguacuuacuccacgaggccacacaggguacaggccacggagccgcagccccagcaggugcgcacacacugcccgcacagggcucgcucacacugaccgcagaccgccuucccauccacggcucgcacgcaugaggaacaggcaauggacgcuaccccagaugggucugugaggaagaaacgccaagccgucaggcugcaaggagacuggaguuuccgggacugccgggcuaccugccuccaugcauaccugagggcagagggcucugaccugccuaccccauccccaccuacacuggauccuucugacaacccgugagccugguacagugcacaggacccccguuuuacuacagagauccaaggugagauaugccuguaguugacuccaaguucagugcucuuucccuuaccaggucccucugcuaccuggaggcuagugcuggaaggaccauucuuccccuguugcuugucagaacuccaugugucccaucugggucucaguguggcccacugccuuacugguuaacaaagaggugccugggcuccuccuagacacaccaaccagacuugagguagagucggggauugcauuucuaaccagcaacacaggugaugcucugagaccccacacugcauagggaugggacuggcauguuuccagccuugugggacuaucugagggggcugcaggcggaaagcagacgggauacccggggagucucugcugcuuuuuuggcccaguacuuagaagcuguuuaacaacuuccagucuugaaugugagaccuccugauaacaggagccuucugagccagaaggccaagcucugggucagaguccugcuuacccagggaggaaaagccugaccuugcaaaucaagaaaaaugcucgugccaccaccugcccucagugccacagccacaaagggcugcuggugccacucaccagcuucggaggccugcccaaggcuccugaucaggcggccgucugguccaaucagcaucugcccacgugcagcccucggggccccuguagggccaggcuuuggggacucuggcaggugaacgacggcacagccuucaucccacacgugguccagguaggccugggccccgaggaacaggagucgcuuggucuucucugggggaagauaaaucauucucacguccuucacuguguaccaacgaagccccugcauggccauugagucuuucuagccucacaugaaccccaucguccuccugugugcccucugucucccaguaaccccagccuguguugugcccuggcgagcuggguccugcucugccucuaugcugagaaugcuugugcguccuuuccuuaccuggcuuagcugucaucuccuccaggaaggcucuggcccugcagccccaccugugucugaugcaaggguucccucuccuaucacucggcucauuuucugcaauucacggcuggccucgccucacuaagcuuguccccuuucucccuuuucugcuuccccagcacuccccaccuggaaaccaggcucuguggaaugcacagagggagcucugcacuguggagcacuaauucacaaaacucguccccugccaaggaagcagccagaggcuuggagcugggccuacagccucuggccagagcacacccccuucaccugcuacagaguugcuggcaagacaagcaucccagaaccuuccagaccucuuguucuagaacacccacccaucccugggagcagugguuuuccaucaggccacaguucagucaccuggggagcuuugaaaaaucagaugcccagggccagacccagaaaugcuuuguuuuuuguuuugcaccucaccauaacacaguaaaggcagagaucccagaaacucuauguggcucuacaugaagugggcagcaauaauagugacaggguaacucacauggaguagcugaugccagcccacaacacccugcaccuuccuccuggccccccacaccuucccccaucuauaaggggaaaggaaugggacagacacguggugaggcuaauccuuguccucaaggccuuguggacaauucgagguuaagagaucaggguaacagcuguggccuggaauuuggaaacugucacacaguucaaaguagguguccugcauuuaccauggaaggcccacugcacccagcagaccucccugaccugacccggugaguggcacacaccugccaacgcccaggucaggacacucgggaagaauaaagggccauacugagccaggccccauuuccaucuuccucuucuugccugcacaguguuugaauuuuucaacuguccugagagggcacacgauugcgguccugccacaguucccacggcaucauuccccuuaccuccccauggcccagaauagcacucgcuuucacagcccuagcacacuggagacaccgcacagaggaaccucgggaggcagagucuuucccucauucccaaggcacaagcggcaccagguaaaucacacaccccgggucauccucuaacugcucuacaggugcagacuuugugucccaaucacuaggcaagguaagcuccacuuuuuaccugccccaggguauuaaucaccccagucagagugaugaucaauaagaucaacacgccugaaauccacaggagaaagccagagaaggccugggagcucacugcccucacaucccacccagaacuggacacugcagccacacggaguccuauuucgcucuccugcugccuggcuucugccucgcccucuuccuucccuuccucugccuggcuaacuccuacucgcccccacaggauuccgcucagacuguucuuccaagaagccuuccgugccaucccugcaggugcgccugcacaaaccugugccugccccgaccaccuguggcgacuccuccugcuggucuccccaacuaggcuggggagcucccgggagacggggcacaucugucuugccugccuuuggucucccgagaaagccgccgugccuggcagggccgcgcgcuccaugaauaccucuugggacaggaggggcacucuucggguugacuccaugcaggacgccccgcuccccaaccucucccaggacauccugcacgggacaguccugagaaagcaccaggcgggugccgcucacugcagggcggcgacuaaccgggaucguggaagagggcgcgggggcuaggggcagggacccuuuucuuucaggcuguuggacagggugggcgaacgcugggguccucacaucccccucacugaccccagcccugggcguggccagcuuguguccccgcggccucccagcuuccgggaacgcggggccagaaagcagggcccuccagccccccgcucaggccucagaggggacgcugaggcccggcccguuccaggccccgacgcagcggacccucggcagcccgcccgacacucaccgaagaccuccugcgaguagcgcucggcgcacacgccgcggcucaacucccucuggcucacgcggaccuugagcuguagcggggccacguccgcgaaggggcagcuccgcuugggcauggccgcggg

SEQ ID NO: 13809 - RNA, 6464 nt, Homo sapiens
cccgcggccaugcccaagcggagcugccccuucgcggacguggccccgcuacagcucaagguccgcgugagccagagggaguugagccgcggcgugugcgccgagcgcuacucgcaggaggucuucggugagugucgggcgggcugccgaggguccgcugcgucggggccuggaacgggccgggccucagcguccccucugaggccugagcggggggcuggagggcccugcuuucuggccccgcguucccggaagcugggaggccgcggggacacaagcuggccacgcccagggcuggggucagugagggggaugugaggaccccagcguucgcccacccuguccaacagccugaaagaaaagggucccugccccuagcccccgcgcccucuuccacgaucccgguuagucgccgcccugcagugagcggcacccgccuggugcuuucucaggacugucccgugcaggauguccugggagagguuggggagcggggcguccugcauggagucaacccgaagagugccccuccugucccaagagguauucauggagcgcgcggcccugccaggcacggcggcuuucucgggagaccaaaggcaggcaagacagaugugccccgucucccgggagcuccccagccuaguuggggagaccagcaggaggagucgccacagguggucggggcaggcacagguuugugcaggcgcaccugcagggauggcacggaaggcuucuuggaagaacagucugagcggaauccugugggggcgaguaggaguuagccaggcagaggaagggaaggaagagggcgaggcagaagccaggcagcaggagagcgaaauaggacuccguguggcugcaguguccaguucugggugggaugugagggcagugagcucccaggccuucucuggcuuucuccuguggauuucaggcguguugaucuuauugaucaucacucugacuggggugauuaauacccuggggcagguaaaaaguggagcuuaccuugccuagugauugggacacaaagucugcaccuguagagcaguuagaggaugacccggggugugugauuuaccuggugccgcuugugccuugggaaugagggaaagacucugccucccgagguuccucugugcggugucuccagugugcuagggcugugaaagcgagugcuauucugggccauggggagguaaggggaaugaugccgugggaacuguggcaggaccgcaaucgugugcccucucaggacaguugaaaaauucaaacacugugcaggcaagaagaggaagauggaaauggggccuggcucaguauggcccuuuauucuucccgaguguccugaccugggcguuggcaggugugugccacucaccgggucaggucagggaggucugcugggugcagugggccuuccaugguaaaugcaggacaccuacuuugaacugugugacaguuuccaaauuccaggccacagcuguuacccugaucucuuaaccucgaauuguccacaaggccuugaggacaaggauuagccucaccacgugucugucccauuccuuuccccuuauagaugggggaagguguggggggccaggaggaaggugcaggguguugugggcuggcaucagcuacuccaugugaguuacccugucacuauuauugcugcccacuucauguagagccacauagaguuucugggaucucugccuuuacuguguuauggugaggugcaaaacaaaaaacaaagcauuucugggucuggcccugggcaucugauuuuucaaagcuccccaggugacugaacuguggccugauggaaaaccacugcucccagggauggguggguguucuagaacaagaggucuggaagguucugggaugcuugucuugccagcaacucuguagcaggugaagggggugugcucuggccagaggcuguaggcccagcuccaagccucuggcugcuuccuuggcaggggacgaguuuugugaauuagugcuccacagugcagagcucccucugugcauuccacagagccugguuuccagguggggagugcuggggaagcagaaaagggagaaaggggacaagcuuagugaggcgaggccagccgugaauugcagaaaaugagccgagugauaggagagggaacccuugcaucagacacagguggggcugcagggccagagccuuccuggaggagaugacagcuaagccagguaaggaaaggacgcacaagcauucucagcauagaggcagagcaggacccagcucgccagggcacaacacaggcugggguuacugggagacagagggcacacaggaggacgaugggguucaugugaggcuagaaagacucaauggccaugcaggggcuucguugguacacagugaaggacgugagaaugauuuaucuucccccagagaagaccaagcgacuccuguuccucggggcccaggccuaccuggaccacgugugggaugaaggcugugccgucguucaccugccagaguccccaaagccuggcccuacaggggccccgagggcugcacgugggcagaugcugauuggaccagacggccgccugaucaggagccuugggcaggccuccgaagcuggugaguggcaccagcagcccuuuguggcuguggcacugagggcaggugguggcacgagcauuuuucuugauuugcaaggucaggcuuuuccucccuggguaagcaggacucugacccagagcuuggccuucuggcucagaaggcuccuguuaucaggaggucucacauucaagacuggaaguuguuaaacagcuucuaaguacugggccaaaaaagcagcagagacuccccggguaucccgucugcuuuccgccugcagcccccucagauagucccacaaggcuggaaacaugccagucccaucccuaugcaguguggggucucagagcaucaccuguguugcugguuagaaaugcaauccccgacucuaccucaagucugguuggugugucuaggaggagcccaggcaccucuuuguuaaccaguaaggcagugggccacacugagacccagaugggacacauggaguucugacaagcaacaggggaagaaugguccuuccagcacuagccuccagguagcagagggaccugguaagggaaagagcacugaacuuggagucaacuacaggcauaucucaccuuggaucucuguaguaaaacggggguccugugcacuguaccaggcucacggguugucagaaggauccaguguagguggggaugggguaggcaggucagagcccucugcccucagguaugcauggaggcagguagcccggcagucccggaaacuccagucuccuugcagccugacggcuuggcguuucuuccucacagacccaucugggguagcguccauugccuguuccucaugcgugcgagccguggaugggaaggcggucugcggucagugugagcgagcccugugcgggcagugugugcgcaccugcuggggcugcggcuccguggccuguacccuguguggccucguggaguaaguacuucagucccuggagcugcugagaucccauagccccagcaagccgugaugggggacgggugggucacccaugugggcccagaacacacacguguggccccugaugcagugccaucuggcauugccuaacgggacaugguggcaauagaugcuuggcccaacuuuagugguuaguaauccucucuaagggaaagcugaaccucacagaugaccugcucuguauccggcucuagucccugucuucagccacuuccuguucugaucuuugagcacccccaccuccuccuccucuggucuuugagcccccccuccccccguccgaggagccccugguuggugacacaggugcacaccgcagcuucaccacagucaugcgugccguuugguuguagacccucucaggcaggaaguggaguguuuguguagucucccauuuguggguggguuugcugcagcuggcuggaucccguccuuacuccuaagguggggaggggcguucucacccuaggggcuacucaccugguggaugggaguggacaguguggagccuguuugcccugccccgugagaaagaugacuucauccagacacauguggaacuggcuccauagacccaaagcaagcuuaguccaaacaaugucugaaauuguccaucuaaaauagaaaccacauguuacaucucgaguccuuucucucgagccuuucuucagucggggcagaggcccagacucauuggagacggagagcccugggcagggggggcagcaccagggagaagcgccgcgugccagugaucggcucccauggcuucagcaugggcaggagugggguaacgcaccccauccagguugggaaucaucugcagggcuagcuaugaaugugggauacucugucuuugcuuuucacccgcugaguucaucuucuuuccuagaaguaaacugaaaagggcaggguuuucucauugucugguggcccucucaccaaagcagaagugaacauagccaugggcagguucagcggagaggugggucccagagcgcugcguggcuggccucccacuccugcccugcacaccauccuugagggacucccuugcgcccauuuccuccuggccucuaccuacuuucugcugcugcuuccucccauacccacagaguucacguugagcugagugggccacuguccccacuguggacacacucuuuuaucgcagcuacagcacaggaggugggcucugcccucuuucacaaauaaaugacuuguuccaggucacaagccagaaguggcauucccaggccaggcagcccagcugguggcacccgcagucuccuacccccuccccugccauuuccuacuucaggaccaggcgucgcaggagugggggaaaacagggaucuguccacacggcucugguuuaacacagaugcagcccagcagccuuuggcguccugcugauggccugcacuggcccacgccuggcccguccucugcagggcucuccagcuggcugccgguggcggugaggggcugucuucgcggcucacccacaauacuacuggcaaacucugcaaaccaaguggcaagcaguucuggcugccuuguugacuccacggcccugucguguuugggguagccauugccagucccguuuccucgcaacaucucucuuaaucacuuucucccuguguuuugccggguucccuagccuuuaccuuuagagcuuucuuuuuuuuuuuuuuuugagacggagucucgcucugucacccaggcuggagugcaguggugcgaucuuggcucacugcaacuuccaccuccuguguucaagcaauuuuccugucucagccucccaaguagcuggaguuacaggcgugcgcuagcacgcccagcuaauuuuuguauucuuaguagagacagaguuucaccauguuggccaggcuggucucgaacuccugaccucaggugauccuccggccucagccucccaaagugcugagguaagccacaccauacgcgugagccaccaugcccggcccuacccuuagucuugauauaucagaaaagcacuguuugaugugcuucaguguaaaccauugugguucggugaauucuggcaggucaucuggagguuucuuuggagagcuucuauccuacuggaaacccagguugggccccauguggauugaucggcagugggaaucagcuagggcugcuguaacugaguucgcagacccaguggcauagacagcaaagagguacugccacguggcuuuggagaccagaagucugagaggaaggugcuggcagggcugguuccuucugaggcugcaauggaaaaccuguccuggccucucuccuggcaucugcugguuaucuuugguguucccuguagacagcugcccccucccuguaucuucaugucgucuuccuucucuguguccuucucuucacguagucuuuuuaggacgcuggucguguugccuuagggcccccaugucagugccgucaucuagacugaugaugcccgcagugauccugucuccagauaaggucauguccugagguguucuggguuaggacuuugacguuugaaugguggggggugguggacacaauucagccccugacagcagcuuuucucuccccucccugacgcugucgcagcugcagugacauguacgagaaagugcugugcaccagcugugccauguucgagaccugaggcuggcucaagccggcugccuucaccgggagccacgccgugcauggcagccuucccuggacgagcgcucgguguucacacugaacuguggggucgacgggaggggugccuuuuacauguucuauuuuguauccuaaugacagaaugaauaaaccucuuuauauuugcaca

SEQ ID NO: 13810 - RNA, 778 nt, Homo sapiens
cagagaggacacaccuuugcuucugcgcagcccaacuucugcaagcgcucaagaguuaauuacuccuucaccuuccuggggccuaacagcguuacuggguccugauuauuuauacagacgaaaaacgauguucaagagauuuugacaacuuaaaaaaaaaaaaaagaaugcgguggaagucuaagauugccuccccuaugacaaaacacagccccgccggccgcccgggcccgacuccgcccgcccgcccgccgcaguuucggggcugcggcccgggggacgcgggcgcggcagggcuggggucuccuccgggagucgcggggcgcacgggccgggaggggcacgcgggcggcaccucgcacccgagcggcucccgggcccggcgcccgcucaccuggugcguguuguuggccagcuuggcgacgaagucccggacccggccgcacuccucguccucgcccggcgcgcugcgacgccaacggccgccgcggggaaacgcgcccccggcugcggccgcccgcagcccccagcucaccccgauggggccagaccagcgcggcagcggcgcagcgggcggcggcggcgcguccagccgguccuggcugagggucgacggcggcagcagcugcaggaggaggaggaggccgaggccauggggccagcgcgagaggccguccgcagcuccccagggccgcuccaucgccgccgaaugccgccgacgccgacaccugccgcccggcgcgcccgcccacccccgccggcgcgcgccacacccccg

SEQ ID NO: 13811 - RNA, 10825 nt, Homo sapiens
uggaauuagagauuuacuccaaauuuguuagaaauuggagcagggggcugggugcgguggcucacaccuguaaucccagcacuuugggaggccgaggcgggcggaucacgugagguugagaguucaagaccaaccugaccaacauggagaaaccccaucucuaguaaaaauacaaaaugagccagaugugguggugcaugccuguaaucccagcuacucggggcggcugaggcaggagaaucccuugaacccgggagacagagauugcagugagcugagaucgcaccauugugcuccagccugggcaccaagaacaaaacuccgucucaaaaaaaaaaaaaaaaaaaaaaagagaaauuggagcaggggcugggugcgguggcucacaccuguaaucccagcacuuugggaggcugaggcggguggaucaccugagguuaggaguuugagaccagccuggccaacauggugaaaccccgucucuacuagaaauacaaaaaauuagccggacguggguggcaggcgccuguaaucucagcuacucgggaggcugagaaaggagaauugcuugaacccagaagguggaaguugcagugagcccagaucgcgccauuaaacuccagccugggugacagagcaagauucugucuaaaaaaagagaaagaaauaggagcaggaucgacuuccagauauacagagaauauaaaaauacauucacuuuauuuuagaaaaaugaagacucauagaguaagcuuaucacaaacuggccuauuaggagucacagaauucacaggaaacaauuucugaagaccaggugccugcugccaccucuccaagcaggccagaguccaguagagaaugcgauucaggaagauggcuccucagagggcagggagguuagcuacggaggccgcucacguggaaauguccagugaaccaaugccaaggaagaagauaaaauucucuggggcugaccacaacaguggggguggauaaagacaaaccacuugccuguacuucucaucuucuauuuguucauuucacugcuggaaggugaccucuuuuccccuaaucuucuuucaacccagagaguuuaagucuucuccagcucaauccuaauccaccccauuucccauggucucuacuccugggagaccagcccugguggcaucucuuccuccugucccugggccagaaucugcuggagucagggucugcuggguagaggcgaguccagguacugacuguagugguuugcuacugaagucuugcuugcuguccugaucucuuuaccuaaagaaauagaaggaauaacugcuuuaaaaugcccuucuuccucaagcccauuugucacccagcagaauucaagcuccucagggugggaagaaaugggaucccccuuccccugccccaggcuccccuccucucuccaucuuuccauacaaaauucagggcugaugugcauaacagcuuggaaucccagaugauggcgggguagggagacaggaugggcaagggaggaccagacugaccugguagguccugggacugccacuuuccuggggggcugcagauugcugcgaguggcacccaugacaggaagauuuagucgcugggaaacaggaacuucauggggguuaacaaaagaaaugaguuagcagcaaguuuaacugaccucgaaaagaaauacuggaugaagggagcgagugugggauuaguacucucccccugaccaugagguauuugaaaacuaagacucagacucuguccagccccauauccucucuguaacucagucuccccaucuuccaauugaauugcaauaaggauggcaaaaguggucacuguugacagcucugggagggugaggacacgcugggcaagggcgggcauucuuccuccugaccucuuacccuuguguccacuuucccgcacucuguguccugcagugcuuggucuuggaagcccuuuucgaguugacagagaauccggagguagggcaccucugccagguggcacacuccggcuggugaguggcauucggcuggcaggccuggggauggccgagggaaugggcaguugacuggaagauuuagcagcugcucccugcggccggggcaggcguugagaguugcugguagaaggcuguggggccaggacggaucugaugggggugggugggccugguggagagggguggagaaauuucagggucaaucccacaaacuccccacucccacucacccgcaacuuggcugcucuggucuccucacuggcugcugcucucccacugggcccggcucucccccggacugggggagucgaucggguaagaggagaagaugcugggcuuuuggaugcagggaacagauugcaagugggugacuccugaaacacaaagagagagagaaaaaagacuagaguggaaaaaauaucuguucuguggcuuaaggaauuaagaaauagagguggagaguugucuacaucccaguaaggaaggguagaaguuagcugcuaacaucaccacaucaccaucaccaucacuauugccaauaccauuuauugaguuuaucauagacauauacucagacacugugguaagaguuuugguucucuuuuuucaugguucucauuuaauuccaacaauucuagauguagaaaugcuaucccuguuuuaccaauaaggaaaccacucccugcaucauggcacacaccaugucuggggcacaccuccaacucaacucucucaacucacccucuucauguuggagggccucuuuccagauguagcccggagagcccugacugaccccuuccuaucauuacuccggagucgaggcgucaggcugcuuggggagggggugcuccgcgucaaagaguucacagugggcagcaggucucggacaggacuauccuucagcacaaaggucucccgccgaggacugggcuucacucggcgaggccccaggcccucgccugcgcucucccgauccugcagggcacacugcuccagcugagcggccagccgguuggccucaucgaggaucuccuccagcuucucuggacugagggggccuaggcugagccucacacccuggggggcaggugccacugcauuugggucacuucggugggagaggccccgucgaagugguuucucuggagucaccaacacuguuaugucuuccuccucacggcugagacaggaaacaaaccaggcaucaugcccaugcaaaagggaacaggagauuaugcaagggagacugcauaaaagccccacaacagagccagggacaugacccuaggccccgaugcccaugcuggcugugagauguggccucugggcgaugagauaccugguucuauggggccuaauaggccuuuagcauuuacggacaucagaaaugaugccaggauggagaugcagcaaauccacuuauccuucuucuuaacacccugaaaucuaacuccagcuucucccuucucuccccgcuaccaauagugucauagaggcccgagucagccagccgcccagcagccccaagugcgccaaaccuugcuaaguuaccaacccaagccaauaauucagcaguaagggauucgagacaaagagguacuguuagaggaaaauaagugggauaaagaggcugguaccugucagauggugacagccccccaaaguccaaggucucauccacaauaaaccuuacaucugaaggggaaagaagaaugaaagccagucaugggucccugaugcagcucuccaucgcugggucucacuccucccuuucauucuucccucccuccuuuccuuaccuuccuccaaauccuccauguccagccagcaggagcgagaguccaguuagaucugagccggagagaaaccauaccuuuccucagguauccauucugcccaaggcucgcagcuagauucagggugcaagccagggucgggggucaugcuggaggcaaagcaagcgcccaggaguggcaccucccgcacagcuacuccugcuaccuccgggaacgauacggagggcucccccaacugcccagauugcccuggagccgcccugcauccuggccucuccucacugggggcggccugcacgccccaucuuccuccccgccacuauccucaggguucugcacuccccaagccaccuuuccacuccccuggcaucacacgcgaagcacaccuccagcccacccuguguccacuucccgcgccgccuuaucuuccacgcaacaggcuuucucccgcaaccuagucccgggaaucagcuccgagggggcggggcuccuuucgaaucucucaggccccaccuacucaagccacacgcgcaccgugauuggugaauccucagggggaggggcugaggagcugccggccggaagucagccggugggggcugggggagaaccguucccagaagacugcaucccgguggcggagccgaggguugaggcugcgagugcgcgugcucgcgugcgcggagacucucuuucccguaggcagaugggagcagagcgcggcuggccaggagggaagaaacggacccacgaguauggaacucgcgccccgccccgcucccucugcugggccgccgagcacccagucuccagaacgguugugcugccuaacguggccgcuaaccgacgcucuacgggaggaaauucguuuucuugggcgcacucaauaugcaggcgccgcauuggccgagguuccucaguuguggguuuuuuccaaguuaagggagcaccuaaacacuuauauuguagguauauugagguucucuuagaaguacauccuccaucgccucuucaagaaccugaggcagcugaggugcaaagaaagcaacgggcuuuucacgcaggcaggcuuagguucaaaugcaacccaaguuuaacugaccucagaacccaaguuucgguuuagaggcggcugccuugaguauauuugcccucuuuucaccucucuucgcuuaucugugaaaggaggauguugguccucgcaguuacgguguuacgaggauaauuaugaaggcguuuucuaccgugugcccuuaggggauuuagaggggguguuuguaaguagcccccucugaacuaaaagcaguauuuguaaaaugcuuaaaccaacuuguuaggaguguugucucuguuguuucuaaauguugcccgggccaccagugaacuugucagaggcuucaaaccagaacgacuccaucuggaauagaggcuggguaaaauaagguugagaccugggcuguauuccuaggagguuaggcauucuaagucacaggaugagauaggagguuggcacaagauacaggucacaaagacccuggugguaaaacagcaugcgguaaagaagccagccaaaaccuaccgaaaccaagauggcgaugaaacugaccucuggagguccucaguccucauuauacgcuaauuauaauguauuagcaugcuaaaagacacuccagacagcaucaccacgguuuacaaauaccauggcaacaucaggaaauuacccuacauggucuaaaaaggggaggaauucuuaguuccagggaguugccuaccccuuucccggaaaacucaugaauaauucaucccuuguuuagcauauaaucaagaaauaaccauaaaaauggccaaccagcagcccuccgggcugcucugccucuggaguaggcauucuuuaucccuuuucuuucuuaauaaacuugcuuucacuuuauggacuugcccugaauuauuuccuaugcaagggccaagaacccucucuuggggucuggauccggaccccuuucugguaacaacaggaggagacagcagguccgcacaagauacagaucucaaacaucccucuaauaaaacggugcaguaaagaagccggccaaaucugccagaaaccaagaugguaaagaaaguaggccaggcgcgguggcucacgccuguagucccagcacuuugggaggccgaggcgggcgaaucacgaggucaggagauccagaccauccuggcuaacacggugaaaccccgucuguacuaaaaauacaaaaaauuagccgggcgugguggcgggccccuguagccccaacuacucgggaggcugaggcaggagaauggcgugaacuugggaggcagagcuugcagugagccgagaucgcaccuccgcacuccagccugggcgacagagugagacuccgucucaaaaaaaaaaaaaaagaaagugacagcuggucauccucacugcuuauuauaugcuaguuguaauucauuagcaugcuaaaagacacuccugccagcguccugacaguuuacaaaugcuauggcaacgucuauaugguauaaaagggagaggagccuucaguuccaggaaaucaugcuccuuucccagaaaaccuaugaauaauccaccccuuguuuagcauauaaucaagaaauaaccauaaaaauagcuuaccagcagcccuuggggcugcucuauggaguagccauucuuuuauuccuuuacuuucuuaauaaauucacuuucacuuuacucuguggacccguccugaauucuuucuuuugaaagaucaaagaauccucacuuggggucuggauggaucaagaccccuuuccaguaauaaacugagcuccuagaaagguucugaauauuuaaagugaaaaagcccuaagggaaugguugaggagcuuucugguaaacagaaccugagcuuuaguccucagaguucaugcccauuuuuuuggccauuuauaggcuuucuuguuuacuuucuaguuuuuggcugugacguugagguggugaggucugcaggagugagaugucacuguaauaaaugccaccagagaccaagaagcuggaaaccaaaaauaaaauucuaagccccccaaccaacugaauggaccccuucucucugacaagggcauuccagauuuaaccuggaaaacuaguucaggccauaauggaaaguggggguuggacaugccucauuauacucucugcccuuugggaaucaggcacagcugaccaacauuaacauuaaaacagagaucuggccagggggcgguggcucacgccuguaaucccagcccuuugggaggccgaggcaggcagaucaucugaggucgggaguucaagaccagccuggccaacguggugaaacaccaucucuacuaaaaguacaaaaaaauuagccgggcauggugguaggcaccuguaaucccagcuacuugggagacugaggcaggagaaucgcuugaacccaggaggcgggggucgcagugagcuaucacgccacugcacuccagucugggugacagaacgagacacugucucaaaaacaaaaaaaacaaacaacaacaauaacaacaacaaaaccacaaagaucuuaaggcuaaggaaacagacuuuuuuuuuuuuuuuuuuuuuugagauggagucucacuuuguugcccaggcuggagugcgguggugcaaucucagcucauugcaaccucugccuccugaguucaagcgauucucccgucucagccucccgaguagcuggaauuacaggcacacgccaccaagcccagcuaauuuuuguauuuuuaguagagaugguguuucgccauggccgugaacugccucaggugauccgcccaccuuggccucccaaagugcugggauuacagggaugaaccaccacgcuuggccagaaacagacuuuuuguagcaauaauauuacuggaaaggggucccaauccagaccccaagugaggguucuuggaucucacacgagaaagaauucaaggcgaguccauaaagugaaagcaaguugauuaagaaaguaaaggaauaaagaauggcuacuccauaggcagagcagcccgagggcuggugguugcccauuuuuaugauuauuucuugaugauaugcuaaacaagggguggauuauucaugccuccuuuuuuuagaccauauaggguaacuucuggauguugccauggcauuuguaaacugucauggugcuagugggaguguagcagugaggucacucucaucaucgucuugguuuugguggguuuuagccggcuucuuuacugcaacuuguuucaucagcaaggucuuuaugaccuguaucuugugcugaccuccuuaggaucucaucuuguuacuuagaauuccugucugggaaugcagcccaguaggucucagccuuauuuaaccagccccuauucaagauggaauugcucuggucgaaacgccucugacaauaagacgccaaauuccagccugauucuaguauaguaucacaugacagacaguaggcccugaaagaaauuaaaguauuuuaccucaaaauauauuuuucuuuucuuuuucuuuuuuuagaagcaaaugaaggacaaaguuuacuguucuuuuuuuuuuuuuccuuuuguuguuguuguuguugagacggagucucacucuguugccuaggcuggaguccaguggcacgaucuuggcucacugcaagcuccacuucccggguucacgccauucuccugccucaaguggcugggacuacaggcaccugccaucaugucuggcuaauuuuuuguauuuuuaguggagacgggguuucaccguguuagccaggaucgucucgaucuccugaccucgugauccgcccgccucggcuucccaaagugcugggauuacaggcgugagccaccgcacccggcccacaaaauuuauuuuaaaagaugcugcaaauucacucaucugcuucaaauaacuccuguccuuugggauccaguuaugggcaauguacacgagacuuuaccagugcaauauauauauuuucaauaggucuuuggggaacaggugggguuugguuacaugaauaaguucuuuauggugauuucugagauuuuggugcacccaucacccaagcaguguacauugcacccaauuuguagucuuuuaucccucaccccaucccacccuuucccugaguccccaaaguccauuguaucauuuuuaugccuuuguguucucauaacuuagcucuuaccaaaauauauuucuuugacauauuuugaaauggcccugcagagcugugucuuguggggaagaucuacauucuguagagaauuccuguuccuucccaggucuuuucccugauccaggagagaacuaggagucuggcaccuuuuuaggucugauaagagcucugaagucugcuaccuggaggcuucaccugcauaauaaauccuuggucuccauaacuuuuuaucuuaacccagacauuccuuucaauugguuccaggucuuggauaauaacucuuuuaaccaauugccaaucagaaacccccccuuuuuuucuuuuuuuuuuugagauggagucuuacucuguugccuaggcuagagugcaguggcgugaucucggcucacugcaagcuccgccuccuggguucacgccauucugcugccucagccucccgaguagcugugacuacaggcgcccgccaccgcaccuggcuaauuuucuguacuuuuaguagagaugggauuucaccauguuagccaggauggucuugaucuccugaccucgugauccgcccuccucggucucccaaagugcugggauuacaggcgugagccacugugcccugcagaaaaccuuugaaucugccuaugaccuggaagccccuccacccaugcuucaaguugcccggcguuucagguugaaccaauguacaucucacauggauugacugaugucugaugucucccugaagugauuaaaaccaagccauagccccaccacuuugggcacauguugucaggaucuucuggggcugugucaggggaccuuggucacucauacuuggcucagaagaaaucucuucaaauauuuuauggaguuuaacucuuuucauugacagagccuauuagaauuuagggugggaagacccagaacuugcaaguuuaugugaggaagagcagagagaagaggauugccucuucugcuaaugaagauggaaugucaguugcuugcaggauuuaggguacauggagggugggagaauuagagccaaguagggcuucccucucuccaggcaaguaguagcaaaguggagaucagaggggaagaagcuguuaaugaacugcguuccuucuuccccuuggagcagccugaguagagaaacccuacacuucauccauccuuagaugaguagaggaggaaguuuuagcaaacuggaaguuaauuucuccuaaggaaacuccaccaguuuaugauuuuuuuuuuuuuuuuuuuuuugagacaagaguuuugcucuguggcccaggcuggagugcaauggugcgaucucaucucacugcaacuucugccuccuggguucaagcaauucuccugccucagccuccugaguagcugggauuacaggcaugugccaccacacccagcuaguuuuguauuuuuaguagagaugggguuucaccauguuggucaggcuggucuugaacuccugaccucagaugauccgcccuccucggccucccaaaguguugggauuacagacgugagccaccaugcccagcccaaauuaugauuuugaaagcuguugcaguaccaggaaaaaaaaaaaaagaaggcaacagaacuacuuucaccuccauuagaaagacagcaaagccagaauguauagcuuucaggcacaaaaauucuucgcgcagccaguaaucugggaaauauugauauuuguuuuccucaucucaaccccaaaaugacauguaggaacagguguuuaaguuuuuggauaaauaaugaauuaauga

SEQ ID NO: 13812 - RNA, 26252 nt, Homo sapiens
guaccacacagaagcggacagugacagugcuguacccgcacagaacuaguuuauucaguaguauggggcaugaaaaaacaacaacaacaaaacgcuacccuauuuacagcaacaaccaaacuguacaaucugaugguuaguaccaaguuagcauccagcaucuuuguauuuuuuuuaaaucaagucaucaguaguaaaaaccaguuaaauuuuuaacccuuugcaggaauugcugaggggagaagacgggggagaauccacggcagaaaagccagaggcuggccucacaaaugagaaacaggagccuuucuuuccugcccacagccucuuuuucuagccaccugcuccagaaggaaagucagugacaagucuggaauacaugcuuggaguaaauggugacucagaugaaaagcagucggcaaaacugaggagaggggaggagagguggggagaugauggccuggggcaaggggaagggcgucaagcccccaagccagggcugcugggaacacccagccugugauggccauaucagacccccgggacuggacacgaacccaucccaacacaaaaagcaaauaaauaaaacaaauauauuaacucucucuucacagggagcugggguggagucggggagaaagaggaacaggaccugguccuuugaagaagagagccaauuccaagaagggguuaaaaauagaacaugucucagaggccacagcagguuagacaaaguagcauuugucugauuuugggggguggggugggugaguggacaccagaacccagacuugaaaccugugcuugauugagcacccucagggcagccgagccagcacuguguuuacucuuccucccccacccacaucacagcaaagaagcgcaacuuaacacaugacuggccugcccggggcgcggggcgggcacgaaaaaugaagcacuuuugggucagcaacugagcaaacaccugggcugccgcgcacggccagaguccaggaaaaggagaggggcuggggcugcccgacccccgccugggggcacaggcuccccugaaaauguguucaugcagcauuuggggguccaggggcgcugaguccuucugcccccucaccggacagggcuuuuccaguuccugggagaggcagugcgggcaggacgaggcacacccuuugcccuggccccucaccguucugaggccugcccgggugcagccugaagggugugaagcccuggcugcguguggcuuuguccuuuccuuuuggugauggcguaugaggggcaggccccccaggagucccucuccucccagaggcacagcagaugggaaacugaggagaggcugggaagcauccugggagguccuauccucuuugggaagggaaaggggagucaauuuccagcguauaaaaaaaaugaaucccugaagucaugaagaguggagauccuuuuuuaaauucuuuuuuuccucuuuucugaaaaacuuugucuuggagauguuggccccagggguccaaagugcagugaggggaaugguggggggggaguuggcacuagauggccuuagguggggugaguaccccucccggcaaggcccaggcuccucagauggacguuucgucgcugcugcgggcaggcgauggggagcggggcaggauaaagcacaagacaggagcagggcaugagugcggcuggggaagggaagggagccucgggcguaggaaccacggcccaggguuaaugcaggaaguuaaagaagagaaaucuggagaggcaggaaaggaaaguggcagaaaaggcagacagaggguuaguugaaacagaggagagagugaaagcuuucaccagacgaaggaaacaggaaagcacccccagcuccccauccucccgcacucugcccuaggcugggcugcgccgcguagagccuaggagggguggcccuccccgcaaggcaccaugguuugugggcacggcauaguaagggagcugggccaguucugcccauuuguccuccaaaugccauccagagucaccuggggaggcccggaggcagcucugggcccaggugaggccuccgaggggcugcaccccgucccgcccacccggccacacucacucggagccugacgaguccucauccaccgugccugccuugaugcucauggcgaugggcaugaccccguucagcugcuccuggaggcucugccggggcggugggcggggaggggggccuccccggcugcccucacuagcggaggagccccgggaagacccugugcauugcuccagggggagccgcaggaggcugcucuucucgcugauggugggcagacacuucuucuuaaggaugccugugggccggggcggggcugugaggugcggccacaggagaaugugagguaugaggcugcugacuaggggagcucggcagcugggggugccccacucaccuuugugaggcugggcagaagagccuggaagggggccuagggaccccucucgagacagggcaucuccauucucccgcagccgcuccucaggggccccguugccacuacucucuuuugcuguggucccaaagucuccuggccagggggccuugccaggcccugggcccccaucugguggggaaaggaaguagaugaggcccacagagggcagauagccaggaggccaccaccccaguccugcuucccaagaaccccaggcccacuguccucccacuggccccaaaggccacagccccagugcuggcccacccuugggaguacugugcaggggcagucucucugcuccaggccccagcaggcuaucccagcccugcucuccagggaaggcggccuccucuuccuccuccucuucuuccuccucacugucugaugaguggguagaggcauaggagccacucuggucgucuucuaaggacaggucacugucggaguccgugucaggaucuaggaggccagggagagaucacagccagcccagccaccuccacccaccuucaguaaaagccagccaacugcccugcuggguggccagagcguucuguccucaccaugcugcuggucuugaccuuccaggaacaggcugccuggaucccccaggccagggggcccuuggccaggguucagugcggacuccucccuaggaagaugagaccaugcuggaggggucagccuggccccuugcccagggucccagucucuccucuccccugggauccugguuccugcugugggucccuuacagcuucuaauccaagcuggcccccacgucagccacagugugugcuccucaacucccaacagcuggcuggccuggguccagcaugcgugggccccuccuccccuccuccacccucccaucuccgggauucaccucagcaagaaggggauguagcugggcugacucuugcccgagcgacuggugcugugcagagagccggccgagucuccguagggcugguacagccgcccaucugcguaggggcuggggcaguuguaggacuaggcagggaacagagaggucaguaaguggggagugggauggcuggccccaggcugggaagaaggaggguggagggaacuugcccuaaguuccaccuuccacaugcucaggucugaaagagagggcccugcuucuccgcuguccccauauugaggccuggcaguggucacagcucugccacagcugugcuaccccugcaugcccccagggauccuggacucacuauauaauggcucuguaaaagaugagaccagaaauugucuccugagagcaccuugggagacagaaaauuuacuaaaauucaugagagauucucaggugcaaggcacuuauuaccugauuaucugucucagccccaucucccucaagucaaaauccuacacacccuuuccaacaucuccuccccaggccgaacacagcauuucaccuccccuuccaccuuccaggaagggauggagaaaagagaaaggggaguggggccaaaaguacaggcucacugggccuccugccucucccucccuucaccgcccuccugagaccccuggcucccucaccgaggucaggguggacuugguggucagagcagggucagggcugggcuugcggcugcaggcaagcuugagugcuuuccggaccuccuugcuaagcaccacauaggagaggaagaugaaggggcccuggcaggcaagaggcagcaacggucugugcauauucaggcauccacagcccaggugccucccuucuccacaggcugggccagguaccuggaugcaauugcagguagcaaagagguaguggaagaggagggugucgcuguugacagagagcagugccagcagccacguggcgcucagcagcaggaggacggcgaaggagggcugcaggcccgagcuggggauagggacaggccaugaguccggccaugagaccucccaugcuggugccugcccauggcccaggcaccccaacccuauacucacacaggaccuuucuucucaaagcccugccgcugggcagcacaggaggcccgggccgccaggauguacaggaagacacucaucuaggcaggggcagagggcauggggugcucaguggggacaaacagcuuccacccagcccacagggccccguggccucagcuguuccuaaagggaguccugaggacacgcggccccagcagcaggaggacagcaaaggagggccacaggugacacccaacccaccugcuagcacucaccgagacggcaaaggccaccgggccagcaaaacuccagaugagcgugucauagauggagagccagcagaagucaggguucccguagcccucgggguccaggcccacggcuagcccuggagcauggagacagacgggagcaguggaggggugaugaggggccugggaaguagggcugcgggcaggugggcucacagggccaggcaugaagcauggaaaaggguucugcccaccaucggccccuaccgaucuccccaggauaagggagugacgccuggguggcggcugcagagucuggguuaaaccagagggacaccugugaauaaggcggccuggggcauggggauguggggccucagggccuguauguggguggagagaacauggcacaaagguggacccagggaugugggaccccaagacugggaaugggugggaguaccugugaugaaggcaggcacgccccagcccagcauguaguagaagcgcauggggccgguguugacaucgcgcaccucagugagugcccgguacaggugcaaggccuccagcagagcccaggaaaaggugcagagguacaggaagugcagcaggauggcaaugacugugcaggcaaacugagggcccaggccagggcaggucagcgaccggggcccgcccagagcacaggcucugcuucgggucaggcauggaggagggccuggguguugggaacugcuuccagggaagccugggccagaggcaggugcugggggaucccgggggagccacagaagaggaaacccugggccaggugcugcacuaggcaccuuauuagaguucauggugcaggagcagggguugccagugggggcuggggaggcggccugagaagguggggacaguuucugggcaguaggagcaucuuacagggaggucagccugguugauucccaggaggaagaccagcugagccaggcccagggcagcugucagguuacgucggaugccguguugguuggagcgcaggauacgcaagagagugaggaagaagaaggugagcagaagggcagccaaggugacaccuagagccacguaugucagugucuucaguggcaggaucuccccauucugcagaguagguggcagggggccagggaauuaggaagggcaggaccugagcacccagccccgugcccugggugcccacccacggcucugcagcugccccugugggcccgaccucccgccgagaaacguccaugagcacagcgaagcucgucaugugguugcacuggcagcugacguggcucucauugcggaagacgacuucacagccucuggccgaccagccaccugugccacugacccugugugaggaaggcagggucagggagacaaggagggugaggcaugcaggggccuggacuuucagcccgaagccugagggggcgagggcagugcaggcucacaggauugaaugguuccagaagacacagaugggcuugguccgcuccucugucuccagcaggcggaacugcaccgugacggguuuguccagggcccggggcagaagcuccucaucaucauggacgcugaugcucaccacggguguguugaugaucgggcguuuggggacucugauguggggcagucaggugcacagucaccacggcagucacaugacuggggagacgcccccgacccccuccaugccucagcacucaccgcccgacccauaccccuacccacaccuguccccuagcugcugaccucaagcugcgcuugucagggucauaguuaugaggcaguagcccggccagggugcgguagaugaugacgcuggccacagccucacccuggcucagcuccgggugccgucgcugucgccgugccagcuccucuggcuccugggccucuccggggccugcgggccugaccacggggggcgucucugggaggggacacugucacacuuagcugggcccugcucucuguggagucugcacagacacugggguccagcucccaacucaauccauggccaccacugaccucugaagacagacucaggcagaaugacuguugucucaagguccgggggcugcuccccacgcagggccucguagcggggcagcuuggccccagcaaaguucccuuuguccaagcgcacuacggagaugacuaaggaaggggauggucacagaucggaccugugaggcaggcaggaccccagcacagccgcucuugucggggacucccuccacaaaccccuccccaacccaggcaccagccuuaccaauguugggcgugacgauggugaaggggcuuagguaggugugccgcauguucugggccagggcacuggcguaggccucauagugcuggagcagccaggcggugccacccucugucugcuggaucagcucccagugccgcuuguuggcuguguccaggagggcgcugcccacccgcagcagauucuggggugggcaaggucacggugggugugcucacaacccacaccugacauccccaccauggagccccggccugugcccgggccagucccugcuccccaccaggccccucccucugugcucacuguugccuccccugaaaugcuccuggaccgcacugcccacucaggucacuggaugcucugccccuaagcccuccuccucauucucuacauaagagcuucccagcccugugccuggacccacacacauguccugagauacugcuuccucccagcccaugguaccacaggcaggccucugcucugggucagaccaugccccaacacacauauguuacuaugagaaggguugggaagagggcugggccaggggucacaggguuucauggaggccuccugccagcagggagcuccuuguaggugggaugggagggcccccucugccccccagguugccaugagcaggcucacucaccaugaccccuaucuaaccagccagcccugcauccuccaagccccaccucagugaagugcacguccuguguggcagacagcccaaagccccgcugggugcucucgugggccagcagccgcguggccagcugguaggccaccuugacgucgcugccgaaguagccagcugugugcugcguggcguugcgcaggagcagggcuagcugcugggagcgcccugagucuaggccugacucauuccgcuguagccgcucagccuagacaggacggagcggaggagcaggagugagggcaggaacucuggagcaaaaggaccucaggaggugagagacggccucuccagcugggagcccaggaacacacaggcuggaauuccagaagccccguucucaaagaugggagugggggcaagugagacucaggacgaaggacagggaaaagauggagaugaggggguucacuuacgaagcccuucaguucugagaaggugauggacgugcaguugaagagguuuggggggagccacccccugugcucaucacaguggcgcacagcagucccugggggaaggaagccaaaagggccggccucagggagacacacaggaagccccugagacuggcugagagguucugcuggaggccagcaccucaugggccggggacaguaacuagcaaacaagggcccuggugaaacaggaagacagguauguagaacaccagggccaaaaaucuccgcaagaucaguccacacaugggcucuaggggaacagggcauacgaccuccuugagcccccauccugccugucuccagccaccacuuugugcucuccgccacuuccugccuaugaaccugcucauugccaguccaggaccagcgccagcccccauccugggcuggguguccugggucagcagccaacacccccuacuccccagacugucugccuuugugguggcguaacuccaggacucgguggugagcugacgauuggaacccugcaugauucaucuuugaaucucuagcacagcccuaugccaagcacagugcagguuuuucagcauuuuuguuaagaguccaagaugugggcugggcacgguggcucacgccuguaaucucggcacuuugggaggccgaggcgggcugaucacaaggucaagagaucgagaccauccuggccaacauggugaaacccugucucuacuaaaaaaauauaaaaaauuagcugggcaugguagcacacgccuguaguaccagcuacucggaaggcugagguaggagaaucgcuugaaccugugagguggagguugcagagagccgagaucaugccacugcauuguagccugaugacagagcgagacuccgucucaaaaaaaaaaaaaaaaaguccaaaaugugguggggugcaguggcucacgccuguaaucccagcacuuugggaggccgaggcaggcggaucaugaggucaggaguucgagaccagacuggccaacauggugaaacccugucucuacuaaaaauacaaaaaaaaaaaaaaaaaaaaaaaaauuagccaggugugguggcggccagaggcuuaggcaggaaaauugcuugaaccugggaggcagagguugcagcgagcggagaucacgccacugcacaccagccugggugacagugacagacucugucccagaaaaaaaaccaaaccaaaacaaaacaaaacaguccaagauguaggcacaccugggcaacauggggaagggggaaugugaaccaaggaagaugggaaaugaaaucccaggaccuggaggccagaaagugggguccccggaucuucagccaggagcuuccugcccucaucccacuaacagcagaggccauguccucgacaucacaucggggccuccaacaccuaccaaaggagccuuugggacagggagcagcagcaggcagcccgaagcggguacggggccaccagaucccagccucaaucgcucgugggcagcugucauaauucacugcggggaagagcacauggucacccaggagcagcucucccucugcuguccugcccaggcuccccagcccucccuaggccuccccaggccuccccaggccugcaaccagccccuuccuggcuuuccuggggugcaggugccuagcacacuguaaggagggcugcccacccaucccaggagccccaccuucacagccauugguggugaccucagcaaaaggguugucacagcggucacacugacgcccgaugacaccuggcuugcauggacacuggccauccucagggucacagacucuggacaaggagccugugggguagcagucacacaagaggcagguggggcugccugggggccgguagugguucuccugagaaaggagggaagaacggugucacuggccaggcucucuucccaggaugcucauggguccuucucagcuguggccccuguggagagggucccgaccucagguccccucaggagcaguauucaaaauaauuaacacuagcaaugcuuuggaguugagcccaucagcgagaugucacagaaucagaacaggcugcaaaccaccaccacaccaggccagagcucauggguuacacauuggcccagggucccccugcgccucagacacacgaagguaagcagccaacugcccugccugugagagcaaaggcacaaggcccucagcucuacaggaagacccaucccuacagccugcccucuagggcccaggagauguggacagaggcccaaguggccacaguggaggcuugcuuggggcugucaccuugcaguggcacucgccgcuugucuuguugcagucugggucaaagccuuugcugacaucacaguugcaugggccacaugugggauguccccaccagccacggggacaaggcuggucaauccugcagagagggacccagguaggcaugagcucccccugccacucccaccuaaccuaggugagcccuauguggcccuucugacccuggcuguggaucagccaggcuuucggggcucugagggacacaccagagagaagcagcagccacugggaccugcugccacaugcccuggucugcuuaccuggucucacaguauggcccaagguaauuugggggacacucgcagguauagccauggggggcacugggcuugcggguacacacagacuggugcucacacggguucaggucacacacauuaguacaguugucaccauaguaaccugggaccagaaggaccagagaggcucauucccccacccuccccuggcaccaucuuccaucaaacccuucaucuguuucuuuccacauagcauccuaucagcuggcuauggcuuuguuguguaggcaacuaagacucagagagguggugugaugccccaugccccaggucacacagcagagccagcauguggccccaggcaccugauaaccugcccguugcccuggauccuuagcauaccuggaucacagcugcaggaauagcugucccagucguugcugcaauagcuguuagcaggacacggguuugagucacaagggucaggcaggcuacagccuugcuccacguugaugcucuccccauggcugggauccaggcuguuaacccccuccggcguaucgcucacccgcacacccugggagggacaggagcaguguugcccucaguggagcggggcugcagguggugggggaggggaugggagggcagggcaggacacucaccugcaaacagccccgaaagccacgggccacaccgccggcuggcccagguauuccgcccacuguuauguugcucaggugcagaccaugcagccgggggcccagguugcccucugcucucugcugcccauaaucgaaggacagaauggcauggccgggccccccgcuggcucccagugccagcugugcauggugccagucaccgucauuggcccggccuggcuccagacggagagaggaggccugaagcccugugcccuccacgcucagcaucacguggcccucucguagcugacaccaggaggaaagaaaacagggucagcagacggccuuaaucacuguucuccagcucacaguuccccuuucuggaccaucaaacccaucccgcugcccagcugaggccauagagaggaaagcguauuuauuucccucaggcccaacagguggcagcauugaccuucccaacggauccagcggccucuauauguccccaccccugcccaggaccugcccagccacuucuguccagccgccuagaggcuaccagggcccuauggccaggccagggccagccgcccuuccaugcaucaccuguagggugauggugcugcgcccccuggugauggccugcagcaggacaccgucggccuggcgcgugcggaacaugaggcugagguaccaggguugggagaugggcagcgagaggccaugccaggccaccaggcugcugcccaggaagugcuguggauuggccauuucuggggaggcaggaaaaggcagacugugacggguggagccucagagggcccuggggcugugaugcucagcgguggcggcugcacgggaggcagagcccacuccccucaucagccccgcccuccaaagugcguaccugcccugggaccgccccacgcugugcccaggccugccucugacuggccccuuugucuccuguguugcccuuucagggcucugcccagacacgcuuuuccacccacagccccgcucagcagagcccugcccagugccugccccaacccugccaguucccagacuguugauggcacccaggcuguggccucuaacagccgccccuccuacccugggcgcagcucuugcccccaaagcccagggggcacucgcagcugaacgcgucccacugguucacgcaagugcccccauuguggcaaguguugcugucacacacguucuucuuggcagggcagccuggaauggagagaaggcagcucaguggaccugagcuggggcucuaaagagaaagccuguggcagcaguuagagaggccucugagacccuccauucuggcauccucacaccaggcacagccccuccucucagcacugggaucccagccuggcuccaccccgggcccccauaccaggcacggugccauuguuggcaaugaagucagccaugucuaugugccggcuguccaccugcagguuccgcaugcagcccacgaacugccgcauucggacugggaagcucucgggcaggucaggcaccccgccuaguagcaggggccccgucagauccagagaccugggggagcaaagaugguggcggcacaagggagggcugggagcuucugguccuccgcucgcucugccgccaggccagagacacgaacggcguaggcagguguccaagaggcccugcagagcagugcucaggaagggcgucaccccuaccuggaacuguucuugucgaacacucagcccccuccccagacugccccacagggccuugcucugauuccccagucuugaccccauccccagggcugagcaggggcuaagagaggcaaagggagagagaccccaaaagcccacccucuccaccuucccucccugccuggcccugcccucacuucaccccaucccuggcccuuuccccugcucacuucuugcugccacccugggugcccugggcagcacaggaguaguugcccaggacagauccgaagcgcaaggccacuccugugucacagccauccacggucaccacagccaccuucugcucugaugggcccugugggagcccugucugacccaacaguggcuguggacaggaaagagcagagaagggggacacugaguacagagcccacuagguucauggccagcacacacugggugccucugugugcacccacaugcccagacacacguacacacaugcauauacacacacgugugcucacgugguuuaugcauguaacuaccuuccucaguguccaaguuugcggcugccuaguggaacagagagcaucgagcagugcccaguggggugggaaugcccagcaagguggcaccuucccagccgcucccuuccucucagccagaaaugcccugaccagcccacccaagccuggaggcaaugccacucagggcuggguaagcaccugaggcaagaacagaacccccaacccucugugcccuccacacccaccuuauuguaguauuucagcugcaccguaugccacuggccaucacugacuccuccgggcacgaauggggacaccguggugguugacuccccuggggaaaggaccaggugagcuggaaugccugacgagggcuaggaauggcaggguuuggggugccaguggcuggggcugggcccagauuuggcugauagaguauguggcuuggggucaggggcuggaagacuuggggccuuuggaagaugggcaaggauggggggcaacugugaucaccugcagagaaggugagcuggaccugcuccuggaucaccucgagggccacaaagucaugcuucucauugaaacgcccauuguacaacagcaacccgucgcgcuccuuuguggcaaaccugaacaggaguuggggaugggggcagggaaugggguacccaccuggaugccagcacccccgccaccuaaccagcgcaggggagggagaucugcuggcagaaccacaggcaacuccaagagcagaccuggcucugccggcagccugcuccacgcuuucacugccugaccucuuacuucaaccacagaacaggaggcaccucagaugcccaccaggcccacuccccacccccagugcccagccacucacgagagggccagggugaaguggaaacgcuggcgcaggccgcgaaaggugaugaaggagugggcggggaagcugcgcguggucaccuggcaguagggcuucucgaagucuccagaugggcaaucgcacuugaaaccgcccaccagcagguugacacaggugcccccauucuugcagacacccggggugcaacggccugagcgagcacucaccucacagugcucaccuggacaagaggaaaggcaggugaguaccaaguaccugaggacaggaggggaacugagaccccccacaacccagugauagcucccauggccucccgugacccucguaauacuccccaaaccucccaggcauccccacuuccucucgugugccaucuucucugagaccuaugguccccagcccuucaugggcacccuguuuggcucacugagccgcucucgccacagcuccacgcacugcuccccugcaaguuccucggaguccccagcaccuucccuaccccauuuggguuucauaagcacaggccugcugggacacuugguuguaaggcccggaucccgggagccuucgaugucacacuaccaagcacaccuggggguguccuggcccccaagaggguaaaugugcacaagcagaugggccugcaggacagcgggagggcugggagccucccuccucccuccuucccacuggugcuuuugucccucucaggcacugagaucaguuucccucccuggggaugggaccaggcuuccacuuagauuugucuggguuauggaagaguaugagagagaagcuggggagcccccaggaauggggcagaggacucccaccuugagcccugcgguccagacuaaggaccucugugcaccugggacaugcugagagugggaaacugagcccugagagcagacaagaauucaacagaggagcugaaaacuccaacaucagaugggaaaauccacccuucucucccuccccauucccagauucuagagauagguucucagcuccugugccuagugacuggcucuuguuuccauggaaacuguuguucgccugcucuaacccccccccucccaaccccccccaccauccuccuggacaaagacuucucuccccucccccaagcccgucccuccccuuccccccaccccuagcagcagcagagagaagucaagucuggcaaguucugggcaggaagaugcagcggggaaggaguggggccugccuauggcugcuggcagagccagugggcauggcccuggaggacaaggagcagggccugggcaucuaggaaggaaaggcccacagggaaggggagcaggggguguccugagaagacacaggagccugaagggaggggucaggagcauagagcagagacagugagcaucccagggagcaggauguguaaagaccuuggcugacaggccaacagggaagccgccuagccaggauccucuuuuaccagcagcugggcggaggcggagccauucugcccaggcccauacaggugcaaugguuuucuggagcaccccaucucagaacucaacccccuccaguucccccagcucuucugugucuuccccuuaaugccuggggagaaaaguacuugcugcagcucagaaaaggaacucgcucagugggggagagaccagguucuaggcccagccucaccucuaaaccgggugugaugagaccaggagcaagucacccaaucucagcguucccuuaaaucaaggccaacaccuuccaugccaccagcuguuuccaaguaucaaauuaauuacauuaauccucacaaccaacuuaugaccuaaguacggucauuaucuccauuucaaauaaccgagggccagaaagguuaaguaacuuguucaaggucacacagcuacuagcggcaaagcugauacacgaacacaggccgacuggcucuggagccagcucugcccacaauggcacugccuguguguccugugcacagcagggagaagcacuccuugcacugccuuccucaguggggugcugucagggagcaggccggauuuaugaccucucaguguagcugcaccucacucgggaagagaaugaggcagccgccagcauuuguccugauuugugccugcaccacacagucagccuuccagggcuggcccaugaguccccucccuuggcucacccguguagccaucacgacagaggcagguguagccgcccucgcggcugcggcagcgcccgugggggccacagggccgcgaguagcagagguccaccucggucucgcaguagucacccgugaagccgggcgggcagcggcagcgcagcccuccgacgggguggaugggccggaagagcacggaggaggaggcgaugaagggcgcggaggagucgaagcgcagcaccgacacgcagcgcauguaguucucgcagggcucccgcaggcagauguugucgucgaagggcagcacgcgcugugccgagauggccgucagcaggcugcgguugagguauaggcgcuccugcagguccucagagggcaggaagggcggcccgcccccgggcccuggcggcuggcccaccgacaggcucacguugaggauguggcccccgggggcgucggugucccgcuguacguugaagaccaccacgugguccgguggcguggccagcguggcggccaccgccuggaugaagaggccuagcaguggugacaggaagcgcucgggugacauguccuccaggcgcagcgugaugcugugggugagcaucucaucggugaugauggucacacgcagcgcgcacugggcggucacgcuguguacgccgucuguggagagggacacagucaggacccagccuggggcugcaauucagccugcauauuccugcaccacccaccaagaaaggcucuccuuuccaacuggcauaagggugcugagccagguaugucacgugugggccaaucacuccuucagggcucaggggaugagauuugcaguucucuuugcauccuuucccaaaaccuucugucgcugaugcacggcacaccucuuaauguuugugcaccuuucccugcccaagccaccgcuccugcucccuucccccagagucugugcugccugcgcgggaacccuauguugucuuuuucauacuuuucuacagggcccagagcauccugagacccacaaaaaucaucccccugcccccucagccucuacaccucaacaccacgauaaucgcaaccauggcuguguuccccacucccccacagcagcagggaguuggcgggggugggggggaguggguaaacugggucagugggccaccuagucccccucccacugagccccauggcugcuugggcgcgcagaccugcuauccccauggcaacauccaacacaaagcauucuucccgcccaacucucugggcugcuguggguagccuggggggccccaccccaggaaauccagcugagccacguuaaccagugacaucaucacccacugccccaugcuggagacagggugagucggggugggggaccggaaggcagagauagaagggccugggcagcucuccacucugagaccccagagccccacugagucagucucuucucugguccuagggccucuagcuacucaucacccacuuggcucaaccauuacacccaaaugccugcuaugcccccaggcaacacacucacuuauaaacagcuaagcacuaaaacacacuugcuggugucucauuccacccacacacccuaagcccagaaauaccauacacaccugaaugcacauacacaugggaaugaauuuuauuuagcuaaaaaaugaaagcuggggccuggagaaggaggaaauggcuuuacagggcaagaagggauagucuuuuuuuuuuuuuuuuuaagagacagacucucugucgccuacacuggagagcaguggcacgaucauagcucacuguagccucgaacuccugggcucaagcgauccucccaccucaaccucccaaauagcugagaccacaggugcucacaacuaugccuggcuaauuuuuguuuguguguagagauggggucuugcuguguuguccaggcuggucucaaauuccuggccucaagugauccuccaucucagccuucuagagcacugggauuacaggcaugagcuacuggcauauucauauuuguauuuauuacaaugccuuacacauaguagguguucagaaaacacugagauguggaugacaaucuauucagucuccacaaagaauaaacggacuuuaaaacauagcagggggccgggcgcaguggcucacgccuguagucccagaacuuugggaggcugaggcggguggaucacgaggucaggaguucgagaucagacugaccaacauggugaaaccccgucucuacuaaaaauacaaaaauuaguugggcgugguggugggugccuguaaucucagcuacucaggaggucccagauacucaggaggcugaggcaggagaauugcuugaacccaggaggcagagguugcagugagccgagaucgcgccauuguacuccagccugggugacagagugagacucugucccaaacaaacaaacaaaaccacauagcagggggagcccaacuagauauaaaaagcaaaugcuuacccuagcaguaacggggcaggagcccauguuucugggguggggugggaguaggcaagggacaugggaacaaauucugcaucuguguuguaccuacuugcgguggcugacuguaccagcgguggcucagcugaagccgggaaggcugaaagcagacccccaucucagccauguccucagccgacugcccaccuacccuccagccucaucacuugcuuauucucacuagcucucaccagcaagccugcuugucaucacccacuucuguuccuccugcucucgucucaaagcugcugcacaggcuguuccuucccacccagacaccagcccacaguccucugagucuucuaaccugcccuagcucaccugcuccaggaagccugcccagauuuaugucaucaggcucuacuuuccucuccguuucagacuuccccgcaccaggaugcucagcuggcacagagcucuuguauaccugguauaucugccuaaugauuccuugacgggauauucccuccaggcagaaagcagcccaagacuccacacacagugcccauaacugauuaagagaggagagggggcaaccaaggccauggagcgggagaaacuuugccaccccucagcccugggaacaaacacuucucccugugucccccaccgccaucgucuuaggccccgccugggccccucucccagcaugucucuguugcuucccaucugguccaccaucuguggccaccugcccccucugcuguugucccccauccccaacagucaacccacugcucucuccuuucuauaucacccuccccugccuugaccuaggucaccccucaggugcaaaggcaggaugggaacagggguggggaguacguugccugagcugucuuccuggacagaaaaggaacagcugggauggccucugaccccaggaaaugccaccugugucccaagcuuagccaggcacaccuggaaaagugccaggucccggucagccucccagccucucuuccccuggcagaugugccagcggagacuggaggccaagagggcucugcuguucugggagcugcccagaccauggacaggagcugcugcgugucugagcagaggaagaaagaggcgaggagaauucagccuccaggggagccaucggcccaggcuggggcagcugcagccauagggaagagaguggaggcacaaacacggagaccaaacaggggaagacaaagccucaggagaggagccagcaaugggcaagugggagagccggagagccgcaggagcagggagagggcaccggagagaggcagugcugcagggcuccgcaugggcaggggcgggaaagaaagaagagacaaagaacaagaggaggaaaacaaaggggcagugggagucagcucccccucaccccggccucccugaacuuugggguugccguggugacugccuccaagggucagggccgaagggagaggguggggccagagcugccgggccaggaggagccguccuggauguugccccgagccuucucuagacuagggaaccaaggucuagggcucugcccuggugggagaccgaaggcuuaaugggggcgcuucucugccagugccuggccacgcucaccaaaggcaggcuggguguggaggaccagagggagaggcccuccuucccaccuccuucccacuugucucaagugcccaggcacaguugaggacacaggagcuccagccucccucuuccgccuccuggaggggaaacugaagucucaggaggcucagaaccucagccacagucccugaaaagcuccugcuuccugguuccuguggcuacuuugaaggguggggcagggaggcaucuguccagcaaggacccugagugaggccacgcccugacucuggcauaccccuccuuccccuucaggccacacucccuggggugggaguaggggccugccagccucuucuuuuccucccuucccugauggauuugaaggcugccuagaggggaugugaccugauccaccccuggggugcagcuaacagcauccccucaugagggucucaguuguucccaggcuuggggaaggcacucagcaacuuggguguggucuucucccugcugcuaccucuggcuccccacagcugauaaaaaaagacagaauacugucaccaacccccuccaacucuccucccccagcccugcuguccagggagucuguaggcugagugcuuggccaagcagcaggaaugccccagccuggguuccggccaggcucccacgcccugggacucuguucucuccucagauaaggugccuuggggucucugcccucaaagcucaccaguccacuggccuguccuggucccuacacuccauuccuggagcuugggcuggucacagcuagcaggaaaggaaggccuggcacccuaagaacagcccaugagguggcaaggggggcccacgaggccucagccugccccccagcuucauugcagccccuccuccaagccagacccgaaccacggacucugaaaguggggucuguuuggacagacaaugagcucuggccucacuuccugugggagcucugaagggggagccaggccaggcucuuucugccuggagggaaaagaaugcgcuagacaaagucccugucagccgauucugcagcucagccaggaggcaaaaggggccagaagaggacuacaggguccugaccccuggguggcggcagcccugugcucccgugguccccagcucugccaaaggcugugugagacugcaggaauaucuugaugggggugaaggggcccuggccucgccuccucuccugcgccacaguccucucugcccuucccccagcucuccuggccccccaggcuuccacgcgccuuuuuucacaauucuuggcagccauagccggggcagccucacaacacuuccccgaccacgucacaggcugguagacagugggggcagccaaccgaagcagcccagcccagcccagcagaagguggggccugcaccagccgccaggguuccuggggcuucuucccaagcuggcucuugccccuccugcucugugccaggcacugggcagggagguggaucuguagcugcuuccuggaucgcacccuaccuccaguggcugcccagaccauccccgcgagcuacccccaccccagcgccaccugggcccuuccuuaccugacaccagcacgcucaugauggccuccagaggccgguuguuguccagugcgcggcuuagcuucagcucacccguggaggcauugagcaggaccaggcugaguucauuuccccgcucaaagcuguaagucagacuaucugagauaucagggucaugggcagguacucggccaauggcacccccagggaagcugcuugagcgauuggugacauaguuguugaaaaggaucucaaaguugcccagcacugguggguugucauugcggucaaggaggcggacguggacuguagcccggcucaccagaggagcugacguggccuggaugaccaggacguacucaggccgguccucguagucuaagucuaccagggcugucagcuccccggagaagauguccagcugaaagaccucagggauguugcccuccacaaucugguacauaaucugggcauuggugccuucaucggggucaguggcugugacccgggccacggcuagcccaauggggcuguucucuuccacaaacacaucaaacucauccugcucaaagacagggggauugucauucacauccaacacagugacugucacuuccauaggugugcgggcugggggcauccccuuguccacugcauaugcccgcaagacauacugggccacguucucucgauccagccuccguagcguucgcacgaugccugacguggacucaacaauaaagucaccgucuccaucgucgccuccuuggaagguguagaagacccugccauuaaguccagaaucacgaucaguggcugagaucugcaggacgcuagugaaggguggcacauccucauagacacugcccugguaggagucucgcaggaacugaggggcauugucauucacgucguucaccaggaucuccagguagguggugucggacuucuggggaaugccauugucccgagcaguaauggccaggguguaagacacuuggucuucauaguccagcucagccuggguggugacagcccccgugucugcaucgaugcggaacugggggaugcuguccuccaugaaguaggugaugcgggcauucucaccuguguccucauccguggcgcugaucagcaccaccguggugccugccggccgguccucauuaacauucacuguauagugggagcucugaaagacaggacgauggguguuggcgucggugacauucaccacaaucugugccguguccugccgagugccaucggaggcgguaacagccaacacauacugccgcucaaguuuguaguccaguggcagggcaagggauaccagcccaccaccacuuuggcuggugauggagaagcgguuucgaguauugccacuggugaucugguaggugaugacacuaugagcaucacgguccacagcugacaccgucaccacgcuggugcccacagcugcauccucauugagccgcacuguguacucugguuggguaaagguuggauuguugucguugacauccaggacagucacgcugacacuggccgaggcagugagugcuggagugccauggucucgagcuucuaccccaaagcuguagaaaucaacuuccucccgguccaguucagcagccacagagauccagccugugccauuguugauggugaaggggaagucaugucccaccccagcaaggcgguauuccaggcgggcauugucaccagcaucagcgucgauagccuggacauggagaaccagguagccuaaggggacacucuccaggacaguagccuggaaaggggugcugacgaagaugggggcauugucguugauauccaggaccuguacugucaccaagccagagacauuagagagugggggacggccaccauccugugcucgcacccguaggguguacuccuuggucgucucauagucaagagggcucaccacauccagagcuccagucugggcauccagauaaaacuguccccgagcauugccacucaugaugcuauagugcaccacggcauugcuccccuugucucgauccgaggcugugacucggaguacuggggccccuggagucacauccucccucaccuggaccacauagcgcuucucacuaaacuggggggcauuaucauugucauccuccacagaaaggaaaacagcggcugugguacuccgaggacccgggucccgacccuggucacuugccucuaccgucagcugguaggauuccaccucuucccgauccacagggccacggguucggaucaccccagagcgagggucgaucucaaagacuucagaggggcugcccccagaccccuccagcaggcgguacagaauauuggcauugggaggggcaucaccauccguggcccugacagugagcaccucauagccaaccuccagguucucccugaggcucuccuuguacuccugcugcucgaacacagggucauggucauuggugucaguaaccaagauggugaguguagccagggcacuucgucggggcaugccgugguccugcgccgugacccugaagacgugggugcucuuggucucacgauccagcuccucggcugugguuacugcaccagugacuggguccagggagaagaacugguuggagcggcuaucaaagagggcauccaugguguacuccagucgaccugccucacccucguccgggucgauggcccucagggaugcaacaggggugccugcuggcugguucuccggcacuguggccugguagcuggggggcuggaacuggggggcuguauuuacauuccuuuuccgacgcccacccagggacucuucuggugaccuuuccccugcccugagcccgggggccugugccagcuugcaggacuggcaucugagccguggagccuuuaagcacgggugcuccucgggcagugugagcuugcccuguggggaaagguggccuccaaugcccaggaggcgacagcuccaggggcagccuucaggagcuggugguaggggaauaugggccucggauucuggacaccaaacccucaggccaucguggugggguaccagguggccagucagcucagugcccgcaucccugcagcggcugguguagagccagagguucgacgcugaggauggacagagccagcccaugggggcgcaggcccccgaagagccucguccccuggaccccaaggaacgacagggccccacuuggucucccaauaguggcggcggcagcagcagcagcaacagcagcagcagcggcggcggcggcguugggagggggacgccgguggccgggcuccgcaucucucccagcucccggccggcggccgggucaacggcggcggcggcuccuccuccggcuccugccggccccgccgcgccucaugcccgggccagggcgccaguccccgggggccucccgugcgccccgcggggccugcgucuggauggcucggcgggaccccgcgcugcacccuccgacgagcccgggcucccacugcccccugagccagacccgcucccgggucacccugagcaccgcgggcugccgccgcgccuccaccugcgcuccgggcacucaccaccugcgcccgggggccccgcggcgccccuggccuugccgggccccggguuccggagccggggugcccccuccgccccuaugggaucgcccaccugcgcccgcguagccgugcgccccgaccccggcccggccccggcggcccccgacggucccgcgccgcccgcucgcgccccgcguccccgccgcggcugcugccugucgccgcggccccgggcccagccccgcgcucccucgccuccccggcgggcgggcgagcucugcagagucg

SEQ ID NO: 13813 - RNA, 8978 nt, Homo sapiens
ccuguacacaaagugugacucuacugacguuucaucaauuuccacaauauaaauaugcuaaaaaaauuuaacaaaugggggaaaagccaagacccaggauaaaggauuuaauccaguauuuauuccacacucaugaugguucuguaaucagaauacaaguuguaagaacaaucuaucaaauaauuugcugauagucuuaaauaaugcagcacagcauuacuuuuaauacuccucuguucuagauuaaguuuaaaaacucaaacagcaaucuccauuaucaauaaaaaaaguucugaauuuuaaaaaaaggacacuauaucaagcuguuucauaauuuaaggauuuuccauuuauaaaaaugcuuuggaagcuugaggcuugaaucuguuucucuacucaucugccccacccucuccccauuacauguuaguauaggguucugcaagaaugcuaggcuuuagacauuaauuuuuuucuuuaauauaguacuuuaaaaucugagaaagaauucaagaaaaaaagauuacaugucauguauuuuuucaaauaaaaaaggaaaacuaagugaauaaauuuuaggcauacuaagugucccuuugagguagaaugcuaaaaggacuuuugaugaaaucacagccuaaaaaccucugcaucagaaacuaacuucucauaaauucucucuaaagguaacuguggagaauauuaaguguaacauauuaacaagagccuuccaagauaauauacaguagacaagaauguuaauccuacaaugcugccuucuuguacauuggcagcacauacuucuccuauaauagacauccaagauccauucucaaagucuuuagcauucuauuacgaaaagcacagccaugcuaacuucaguacacaaaccauaaucccacaccuacaaaacaaaaauagauuaguggcaguuuauugccuuauacaaauuuaaccaacauggcaaccaugccaaaggaauuaaaacauuuucaggacauauguacagacuguacauuucaaaaacaaacaauaaaaaugcaagaacaaucugugcaucauguaucaaacuuaacaauugggugaaaacaccaaugcaauaaauggaauuacaaaggcacuucccuacacgaaagaggaaaugaaaaugcagccuacagggagagcuugaggagugcgaacuacugcacaaucucaacgugggggaaaaaagcagauuuaaucauuuauaggauucaaugugauccacuuuuacaaaauauuuucacacagucucaucuuuguuuuuaugcuguuuuucuuggcucucuuguucuauacuuuggcuccuucgacgaucauguuugucugacugguccuuacuaucacugugaucucguuugugggaacguucuuugcuucuacuacgcuuucuagauuuuucuuugcugggacuauguucccguuuuuuugauuuuucaacacugucaguucuuccuugacugccacuucgacuucguuuauuugauuuuucuuuacuuucauuuuuauguuuacuugauuucucuuugcuucuacuucuacuucguuucccugcauuucuacuucgacuccuacuucuguguuuccuuucucugcuucugcuucuacuguguuuuuucucuuucuuggaaucucuuuugucaucucugugccgccuaucaucuuugucuucuuuauguuucuucucuucuaccucuccccuacuucucuguuccuuggaccuuucucuugaucgcucucucucuuuuucucguucauuuccucuuuccuuaucauagucacgaucucgucuucuaccucucucauuuucuuucucucuuucucgaucccugucccuucuauccccuuuccuaucacgacuucgacugcgacuucuaugccuuucccuacuucugcugcgccugcguucuaacccccggucaauacuucgggaucuucgccguucuuucucccuuucuuuggcuucacgcucuagucgcuggcguucuuucucucuuucuaauucucugucaaaacuagaagacccauggcccucccgaugaugacuucuacuucuugaccuucuuggggaccuccguggacucagagaucuccuuggagaccuaaggaaggcggagggagaaagaaaauuucaaugaauaaaacauaugcaauucuuuucacaguaaaacuuucaacagcauuauuuauucauguccucaagcuuaaggccaugucaagaaucauuaaagcaaaaaauuuuauuguucucauuuacagaugcauaauuuuauagaaaaagcccugaaaggaagaaaauaaucuuugggggguaaaagugacaaacuaauaaaaugaacaguaaaaacaaauuccuaagaacuugcuauuucucagaaccauuaauuuuguauaaagcauauaugaaaaauaagcauaauucaagagugacauuaccuugaacgucugcguucaacaugucugucuauuuccucagcaccuuccuucccaucuuucuugauuuuucuaggucggguuuuaaucuguugaucaauauucuuuugaacuggaacuggaauucuuggaaacaagguagaaaaccacuccaguuuugugagaaaagaucguagcauuucuccaauggucauuacacagccuccaccagccuucacaucuagguccuacagaaacacaaaagauacccuagccgucaaaaaaaguauuuccauauauacaugaauauuauaaaaauauuaccaucuuuggaaucucaauacaaaaaaaacuaacagaaaaauuuuauuuucauauccugaucugacaaugaaugaacagaaauauuugggcuuagugugugcaugcaagugagaacaaacccugcagccucacaggcauaaagggaacugaucucacucaguuaacaauaugaaaaagccccuuacauuucuaaacuaugcggaacgauugacuuaaauuuacauuccacauaccuacuauguauuuauuucuguggacauauuugcacacaucauauaccuugcaccauaaccuagcuacauaugaucuacuuuagauaauuccugucuaaagguuaucuuuuaacagcucuaauauaaaaugaagcccuaauaaaacuggaagcaauagcaaaccaacugccaugaagcagugagguuucuaauuuaguuauguagaaaauaaauaaaugaacaaauaauuggaaacgcauaauccaugaugaccauugucucugaaaagggucauuaccgcaugaaggccuucuugcuaugcccucucacagcucaggacauguuagucagcuauugucagucccaaaccuauagugcaagcacacaaggaaagugagauuuguuaucuaaacaggaaaacaagagcuaaagguaaaacugcuugcacucacacacauuuaaguguucagauauacaguauuuccaaauauaaucgcugcagauaucuaaggaagaaaacaauaaguuagcuuaaauagaggaccucagauuuguaaacacaauaaaaaacauaaaauagaggcauccagaaacaaaaccaauacaacaccaauuaugaagaggaacaugcuuuuuuaaagacagaagggagaagcacuucagucugaaaaacugaucuaaagauaaaaagaccuuaaagauugugauuuaaaacacguuuugcuucuucugagugaaguaacucaguuaacaggcaaaaaaaaaaaaaaaaaaaaagagaaaaauaaaaauucuccaugucuaaaugagauuuuuuuuuuuuuuaggugugcauguaauaacaaaacacaauagauuuccauuagaaccauccuuuaauucaauaaauucuuuggaugaacucuguaaauagacuacugacacauagcacucaaaaagucuuaugaaccuuaaaacacaaaguaguagacuggguagacauagggacaauacagcucaucauuucauuuuugacauguuggacuucaccaugcaaguaaauuaaugcauauaugauauuuuguuuuguuuugagaaagggucuuacuguguuacccaggcuggaaugcaguggcaaugaucuuggcucacagcaaauucugucuccugggcucaagugauccucccaccccagccucccaaguaggugggacuaagaugcauaccucuaugcucagcuaauuuuuaaacuuuuuuuuguagagaugaggucucacuauauugcucaggcuggucuugaacucucgaaguguugggauuacaaugugagccaccacgcccagccaaugcauacacgauuuaaaucuaacuuaguauuucagauuucaaauuagggagacucgaauuacaauuuaaaaaauuucuuuuuuaaaggugugugugguguacuaggagucagaaaacuggaauuaaaauuuugucaccuugaacaagucauccaaacacuuagccuauuuauguaacacccaacucuucaauucugcacuucuaugcaagugggaauacugauauuuggaagaagcuagagggugaagaacugaaauguuccagaagaaaaaaaagcuacaauuaguauucuaugugcauaucuuuuauuaucuguucgaucuugagcaugccccaucuugaaaagucacuauuaacuauacaauucaggaucaauacaauacacagaacauaauuaagaagagaaaauuuuccaauaguuaccaaacacauuuaaacaauuuuaaaacaagaaaauaaaacuucagaaauuuacccuaaaauacauaaaagccaucaggucucaguaaaaggacauuaauuccaaaaguaucucacugaaauaaauuuaacuacaggaaguucuugaagacauuaaaccaccaauaaauaaaagauaauaaaaauaugagaguaaucagaagaaaacaaauuauuacccuuguugacauaccucuucaucaucaaggaaggauucaaaccagucccacagaucuguagggggcuguguauaucuagaauuacaaaagacuauuauuaaacacaugugaauuaaaaugagauauuuacuggaaauguacauaaauguacgcucaccuuauauacauaaauccaagcgcucuaauauauggagagucuguguguguuauaagacccaucacuugcuuucgaguuaacuucaggguaaauaauuuguauaacaggcaaaaugcuguagaaacaauuccuccuguuccaacaccucgaaccuuuaggggaaacgaguuaagaaaaaguaguaaaauaauuaacggacucuuaacaccaauugauuaauccuguuagguaucaauaacaauccauaauccagaacuaaggagcauuaaaaaguaacacuuuucuaacccuauuucacugaacacuugaauuuggauuaaaaaaauugucacucaaguguauaauugacaggccucuaguucucuaaauauaaacuuaguuauuagacacagaaaaacugaaaaaugcacguacuucuacuuaccccuccgcacaucccugucuggcccgcuguuuuccugcuuccuuucucccaugguucaacgugcgugaccugaaaauagaaaagaggaacacaacaaacauucauacuuugaauuuguuuaaaagccugauaaaaguaaacccaaguccauaauagagcagcucuuccaaaauuauuuuggcauuaaguauauguuuacugauauuaaguguguaaaucauuuuuggaaaaacugcuuagacauuuagacagcacccauaaagcuacuaggguuuaacaaaaccuuaauagcuuugcagaggagaaaucccacucaacuagcuuuauaaagagcugauaucuacaucugggagucagaaaauuucuauagucucacuugguugcaaaaacuauuugguaauauuuuaacuuugauaauauuugacaauuuaacuuauggguugcuuaacauuuuccuuuaaaaauggauuuaagucuccaauuuaaagcaaaaaguauuaacguuaagcauuaauuuaaaaacuucaaaacaccuucaauaguucaauuuuauuguaauuuaaaaucuacauuauaaaauuaaggaaaauuacuugaagaaaauuuucuaaaacaguaacgaguuacuugugaugcaaaauuauggaacuuuuuauuuguacauuuuuuccaccagggucagguuuauuccugauuaaagauaaaauuacaaaggccacacuuacagagaucauuguuguaauuaagcuucagccuaauuaugugugaaccaauccaauuauuccccagaauauaaauugugucaaaaacugagugugaauagucacuggcauauacuaaguaucaucaaagaugauacaguaucauauuugcuaagaggaacaucuuacaaaaacuaguccuuaucuaaaaauagcaacaacaacagcaacaacaacaaaagaauauuaacucuaaaauagaauccaaaaaggucuuuugggaagacccaucuuuguuuuuuuuuaaaaacauaaaaaaaaauccuguuuuuucacugcauauuucuaaaauucuauuuccacccacaugguaaauuuuguaguccugaacaauggcuuuagauagaaaagcgugcauguaaguuuaagcacuacacuauuuugcagugcuuuaacguuuccuuucuuccccacagauugccauguaaaagauguuucaauuccuuaaaagcuagccaaaggcagggcuggaugcauacaaaauaaaauuacaaaguuggaaacuuauaaauuucagugaguauuugaucugaaagucuuaagucuucuuaauauuaguaaaaaaacugggucuuuaguuuuuuaacggaauuuaaaaacaauuccugguagaaucuuguuucaaaacacauuugaaacuuaaaaacgagacuuuccucuauuacauuaacauuuugccuauguuagaaaacagaaccugccgcagaaagagcaggaacccaauuuucaacuguuuaaaguuuacugcauaaauaaagcuaaggauuaaauguuauucaccauacuguauccaugcuaaaaaggucuuaccuuuuaaaagcuaaaaaaacuaauucauagaauuacaaucagaccuacucucguaagaggauuccaaauuuauuuguguacuuuaucaacccaaaguugaacuguauucaagagauguuuucuauaaaaagcaacuaaucucucaaaauccuucaauaaccuaauuacucaacugggggaaaaggugggcaagacaaaagagaauguccuuuuguuaccaucucuacacauacguucaaaugauagaaaacacuuugugcggucugucaaguuuuuaagagugaauauagacaaaaauggauuguguauuagaugcuccggauaaaauuuuuaaagaccacuaaggcuauuauuaauauucuuuaaaauagaaauuaacuuucggaggccuggaagguauuuuuuauacuacauaauuugcagggaaguggaaaaagccuaccuaauuggugaaggaccaaaagcaauggccaaaaaaacccacaaaaaucuaauuagucguucauuuaaccagggaaaugcauuuauggcgauugagcaugauuaauagugcauaccucuaccugcgacccugggcugcuccgagccucgcugcaagacugagucaauccugcuaacgaaacaagaacugagacaagagugcagugaggaggcgccaggugagcuccccagcacagccaagccagcaccgacccugccgcagaagcccagggcccagauaauucuaaauuagcccaaugcacagguggcugagaccucuuacuccugacuuccugcugggaaaauuuccaggccuucuguacaccucuugaaauggcaccucuccacccucauccccccaccccacccgacacacacgcacugaccauuucccugccuggaucggauagugaguaccaacaacacgaggccaauacugaagucauuacacgcccuggccaggggugagcgggagaagcaccaacaaguuggcgcucagcagauccacgucaaaaggaauaauuuuaaagcuguaaacuggaaaggcuucuguuacucuuuccuccucucccccaucccucuugcccaacuccccccaggggugggcaggagguugggggaggagagagaucaauaguggcgggcucucccggcccuaaaaaucuaaaauggaaacgagagggcggccccaguccgaccccucccagacacacuacaggccgcagccaccccuccgccgaaccaccuucccccacccacaaaucuucagauuucgggggccgccuucgcccguuuccuccauacccccucuuccgaacuuacccccaaagccaaggccuacacacuucguaccuuaaaguagaucucguccaccaccucgugguaggucuugagcucguagagcuguacuuugaaguaaggcgacgacaggauguuggucaggaucaugggguugagguucauggucuucucguugccccagagcgggagcacauugcccugcuugccggagaccgccggcuugguagcgccgccgccgccgcacugcugcuguugcugagccgcagcugcagccgccuggugcugcggcugcgaguugccugucagcgcggggcuguuguuagccauguugcggcggaaggaaggagggagggaaggaggggggggagggggccaagcucgaucucgcucuucgggacaacggucugggacccuacuccaucgaacgucgucgggagaaggggccgccucgcugugccccagcugggcaagagagggcacccgacgccgacaaaaugaccccgggccaagagcagacagcgaaacccagaccgcgagaacuccacgcagaaggcgagccggcagccagggagcucgaucucuuccgccaacugccccugggaacaagauggc

SEQ ID NO: 13814 - RNA, 1384 nt, Homo sapiens
acguuccaacaaaacacguaauauuuauuauaaaugacagaagauaaaucaagaaaaaaaauuggaguauagaaguggagccagauguaaaguaaaaaaaagcacagcaaagcauaaauuuggcucagcucucuaguagccuaugugagaagggucgucuaugcaauauacuguguucauuagcugaaacaaaccaguuauuuagaggacauagacuuacuuuuggaacuaauaacagagaagacuuuuucucugaggauuucgugaucuaugugauaaguaauauuuuugcacuugggaguuuuuugcacuaaggauaagugggcuggcucuucucaaccuugcuucaacagauuuagucggaaugauguugggacucagcaaauaccccaaaaugaagaccuuggaagcaaaaguguuucucugaucuucucuugcccuccuguuucucaguccaauucuccccuuaggcuagccauagaaacuagaaucgcuuuuccccaaggcaggucguagacaccagaacccccuuuccccaaagccagucauaagaccuaaaaucauuacucacauucccucugccuuucuauauaaaaacuacucauaaagaaauuaugugaccuaccuucuuugacuauggguuauaagacccucauuccagagaugguguugccucacaccaagaaggagggaaugcaugcucagagaggccaagaaucuagacagacaggcccugcugggauccccugcucagucuguuagcaugagaucauacucuuuuugugcaaucauauuucuaaauaguuauccguauuuuauugaaccucagcauaaaaauggacacuuucuccuguaucuuugggucuucauucugagggcucccguguguacagauuauauaaauuuguaugccuuuucuccaauuaauuugcauuugugaguugacuucucagagaaacuucggagggccacagagaacuuuucccuuggcccugacagucuuuccaggcuaaggaugcaaauuacugaacugauauagguaauuuuauuucccauacuguauacuaguuuuuagaggguaggauuugcuuaugauagaacuugaauguuuuauaguugguguuuacuaaaucaugaaaugaauggguaaaaacauguacauaugggaggaggggggccuccuugacugauucaucucuccucagcauugggugguauaaagugugaagaugcuaacaaggauggcuauaagcaaaacguuagccaguuuuguuugcuggaggugucuuucauacucaccuuuuuuucacuccugcccacuuuuagccucaucagaugccucugcuccucagcaccaagcaccugugaguucaucuaccuuugc

SEQ ID NO: 13815 - RNA, 3119 nt, Homo sapiens
gaguggccgggugaaaaggcgagguggacagcaccagggguuucuccgacuccccuccagggaaggucaccuggaaccagauggcaaagccaugcaugggcgccgagccauagcagcugcagcggaagcgcccgcccacuccggccuccagcuccugcuccaagccggcgcgggagagcucuagcugagcaaagcgcugcggccgggccagcacguccucgccggacaaucccugcacaacgaucuccgaguggcccaugagacagcgcguggcgaagcccuccaggcagcucauguccacaccauagugcugcuucaccuggcuccagaagcccaggcgccauuccagcaucuggucgcugaugggggcuaugaagagcucggcggaggccggcaggagaagaccgcccuccuucagccacuugguucgcgcguggaggacggagcucagcauggacucgugcaggaguccguagcccauccacucgcucacgauggcauccaccuguuccggcaacucuacagucuccacuggucccggcaggacgugcacccgguccuccagcccguugaaccgcaccaccucccgggccuguugccagauggcgcuggccucuaccgcguacacgcgccgggccccggccugggcacagaagaugcucagaaugccggugcccgcgcccacguccaguaccgucuugccucgcagugcugcccaguuccgaaggauacccaggcgguaggcaucggugcggacgcgguccgcgaucaucuccucguggaccgaaacguccgaguagcacucguaguacagcuggucccguucccgcuuaguccuccggggucgcuccagggccgccucccgcuccgcgccaucuuccucuucaguucccuccccuccuucgccgccgccccccgacucaagcuuucuuuucuugggcugcgacaucuuggccgcucugcccggcucccggcgggcguagcgcggcacggcgcgggcuccaggaaacgggggcuucugggacuuguagugcgcgcucguccuuccuacuuccugcggggucgcccggccggcggcgcggaaggucuccugugccugcucacgggagcuguuuuguauugcucuucugguguccuggcaucccuuuucccacccacgacgcccacauucugagauccuuucauucccccucccacccuuagcuccucaguuuuuugcuuucacucccuuccugaaguaggcacgcacacuuaagacuaauaauccaccuuuguuucuucugcugaacucaccucuguuuuuuuuguuuguuuuucuguuuuuuguuuuuuuugagagggaguuucgcucuuguuucccaggcuggagugcaauggcgcgaucuccgcucaccgcaaccuccgccuccuggguucaagcgauucuccugccucagccucccgaguugcugggauuacgggcgcaugccaccagggccggcuaauuuuguauuuuugguagacgggguuucucccuguuggucaggcuggucucaaacucgcgaccucaggugauccgcccaccucggccucccaaagugcugggauuacaagcgugagccaccgcgcccggccuaacucaccucugguuuuauuccaccgaauuaacauggcagcaccauccacccacuaccgccuuaacuggacaauuguagcucuuaaagugcuccagcuguggcaauuuagaaacugcacuacgcauuucuuuuuucuguuuucagugcaguuagagugcaaauguaacaaaauuaaaaccuaacaaugcaaaaucuugguucugauuccaguaugaccacuaauuaguugagugauuuagggcaaauaauagaacuucucuggccuuuaguugcccauucacccaccagcgaaucuucauugcaguuggggaagaacuagguuucugguucuacuuagaagaauaguuacuuggcuuucggcucugcucugauaauucuguggcucucuuaagaguuaaauccugaaaagugcagacucaagagccaugugauacaagcaaacucguugcuagguguauucuauauauauaugcguuuuuuucucucagaaauaacggaaucaauuucuuuuaaucacuuucucaaugcaauucauuuuuuccuguguuuucuuguccgggcaauauugacacucuccucuuucucuuauauuuuucuuguagucaaccaucagcuguuacucucuuuuuguuguccauaauggaaauaaaauauguuuuuaaauauguguggcaucuguauggguguccguguuauuaacaaggugggcauaaugccauuuucugccagcuugaaaaaaaagucacucagaguaaaauggauuuuuauuuucuuguggucuugaauuauguccuuguaaccaauaggccuguauuccuugucugggaucaaaguucuuucauccuauuuucucuauuaaucuuucauuagcagaauagguuuauugauauggcauccuuagcuguacucuacuucuaacucaagacucuccauccuggcugcuuauuagaauucucuaaggagcuuuuuaaaaaauaccgaugccugggucuaccucagaccaauuaaaucggaaucacuccaguggaaccugggcuucuaguuuuuaaaagcuccccagggaauucuaaugggcagccagggugagaacaacuguuucucacuaaaaugaucuuaguuaaaucuugcuucguuauuuuaauuggguaaauuguauuuuuuucaguggccugggcucaaccauuuaaggcuaaaaaccuugaaguauuucuucucuuuuucugccuugguuuaauaucuuauuuuaagauaauugaggcccaguguaggacaucagauuagaguuguaaaugugaccacuuuaauauguuacuuuuauuaauagguuguuacuuaguguauacuuuugccauucuuucuuuccucaaaaugucaccuuuuccuuuuaaauacauucauuccuucacccaauuuucaauucacuuccuuauggucucuuuuaagaaaauucugaauauaaguuucacugguucuaccuccaaaauauaucuugaauccaucugc

SEQ ID NO: 13816 - RNA, 7586 nt, Homo sapiens
aaagauuguauaacuuuuuauuucugcuuuauuuuacaguccagaaaaggcuaugaaaagacugucauugaaaucaauacaccaaaaauugaucaaguaccuauuguugaugucaugaucaaugacuuuggugaucagaaucagaaguucggauuugaaguugguccuguuuguuuucuuggcuaagauuaagacaaagaacauaucaaaucaacagaaaauauaccuuggugccaccaacccauuuugugccacaugcaaguuuugaauaaggaugguauagaaaacaacgcugcauauacagguaccauuuaggaaauaccgaugccuuugugggggcagaaucacauggcaaaagcuuugaaaaucauaaagauauaaguugguguggcuaagauggaaacagggcugauucuugauucccaauucucaacucuccuuuuccuauuugaauuucuuuggugcuguagaaaacaaaaaaagaaaaauauauauucauaaaaaauauggugcucauucucauccauccaggauguacuaaaacaguguguuuaauaaauuguaauuauuuuguguacaguucuauacuguuaucuguguccauuuccaaaacuugcacgugucccugaauuccaucugacucuaauuuuaugagaauugcagaacucugauggcaauaaauauauguauuaugaaaaaauaaaguuguaauuucugaugacucuaagucccuuucuuugguuaauaauaaaaugccuuuguauauauugauguugaagaguucaauuauuugaugucgccaacaaaauucucagagggcaaaaaucuggaagacuuuuggaagcacacucugaucaacucuucucugccgacagucauuuugcugaauuucagccaaaaauauuaugcauuuugaugcuuuauucaaggcuauaccucaaacuuuuucuucucagaauccaggauuucacaggauacuuguauauauggaaaacaagcaaguuuauauuuuuggacagggaaauguguguaagaaaguauauuaacaaaucaaugccuccgucaagcaaacaaucauauguauacuuuuuuucuacguuaucucaucuccuuguuuucagugugcuucaauaaugcagguuaauauuaaagauggaaauuaagcaauuauuuaugaauuugugcaauguuagauuuucuuaucaaucaaguucuugaauuugauucuaaguugcauauuauaacagucucgaaaauuauuuuacuugcccaacaaauauuacuuuuuuccuuucaagauaauuuuauaaaucauuugaccuaccuaauugcuaaaugaauaacauaugguggacuguuauuaagaguauuuguuuuaagucauucaggaaaaucuaaacuuuuuuuuccacuaagguauuuacuuuaagguagcuugaaauagcaauacaauuuaaaaauuaaaaacugaauuuuguaucuauuuuaaguaauauauguaagacuugaaaauaaauguuuuauuucuuauauaaaguguuaaauuaauugauaccagauuucacuggaacaguuucaacugauaauuuaugacaaaagaacauaccuguaauauugaaauuaaaaagugaaauuugucauaaagaauuucuuuuauuuuugaaaucgaguuuguaaauguccuuuuaagaagggagauaugaauccaauaaauaaacucaagucuuggcuaccuggauuggucauuuucuuucuuaaauagguuccaaauuauucucaauuucagauaaagcuuuugauucuuucuugaccauccagauuagaacaguuuuacacuucugaacaaacauauuaccauucagagauaaguugucuaaaucccccacaugcauaagauagugaaaaggacaugguaauacugaauuuauaaaauaaagguagauuauacuuaaaauuucaaagagauauuuuuguaauuacauauuuuacauaaugaugaaaguauagcaauaacagaauauuuugcauauuagccugcaucagggaugcaguguuauccauuuaaaccaaauaaacuuuaauuuggcacucaauagaaugaauagauaauugaaugucuaugcuuuuauauucuuuccauauauagauauagucuucuucaggacgucagacuuuuuucucucccuuaugauugauguaaucuagacaaaagaaagcucaccagaauagaaaaaacuuguuagaugacauuuuaauccuggccccagcagguauguuauucauaugaauacaaagaacaguauugaccuugaaggcaggguaaaucauggacuuaaugcacaugaaauuugaucuaacuuuaagaaauaaaacuacaaacacaagguacagaagugacuauaaugaguaaagauauuacaacaaauuauuaauuuuauuaaaaaguuaaaaaaacaggaaaucugggaaaacaauguuuuuucuuucugaaacacuucugugauuuuuuaauauuauauuuuuggcugcagucucuuugagugccucuuuauaagagauuucauaauuuaacuuaauauagaguaagauacucuaauaugcaaggugaaaaaauguuucuuauugauaccuuagaaauauuucuguuucaugucuuguuauugguaaguaaguauuauaaaauuuuuagauuauuuaaaaauuuaggaaaaucucuauuacauauauuucauaugcacuacaaaauuugugagaaauuuccacagacuagcuucugauucuguuuauuucaaaucuuguuucuccuccacugccuauagauuuuauguucugggaaccauaaaacacauggaugccaugguacaaacucagucuucuuugugaucaucauaacauaucauuaguucauucuuccauugcuauaaagaaauacaugaaacugaguaauuuauaaagaaaauagguuuaauuggcucaugguucugcaggcuguacaggaagaauagcaguuucuacuucuggagaagccucaggaagcuuccaaucauggcagaaggcaaagugagaaugagacgucucacauggcuggaauaggugcaaaagagagugagaggggaggugcuacacacuuuuaaauaaccauaucucaugagaacucacuaucacaaaaacagcccaagaggaugcugguaaacucuucaugaaggauccacccccagguccaauuacaccacauuaggucccagcuccaacacugcggauuacaauucaauauaagauuugaguguggacacauaucccaacuauaucaguggaugacaggguuauuccagaaagccauuuacacuaggauugccggcauuaauauacauaaaauaaugacagguuguauaauuauaccccaucauguaaauauaguauacaaaccccaaauaaaugaaucuauauuugaauuuucuccuugcuggccccuuccacucuaccuaacaaaaggcgaaaugacaaagaguaguugcagugguaaaacaacguucuuaacuaaucauggucaaucuuacucuggcaaauuuuacuaauaauaugaccaugcagacauauuucuaggagaccucccagggucuuaaauggagcccaugcaaaagaaguguccuggagcuuaagcuuuaugagauucauguuaaauagauggcuucauacuggauaacuguaaaacauaugaguuaccuaacacaaaaucuggcauauaucagcuauaaagaaauugcugcuacucuagauuucuuugugcugcuauuaucaccacaguauaagucccuuucugaaauguagcuaguaacaccugugcuacccaauaucauauaauuuuuauaaagauuucauuugaacaaaguaaauauuauacaaauugcaugaucacagagacccaaaucaucaaagagacuuacauacaaacuuuacaaaugauuugcaaaagauaccaaaaaagaacagcagccuaaggcauuuuaaauccagcaagucugaauucaccagacauagcuuaucaaaucuucuuuuucuauauauaccaaaauguguuuuacuugccagaggaugauuuuaauaggucuuuggggucucucaacuuugguacuuugcuaguuucauaucccuguacuggcuguaugauuaaccauugcucaguacagcugcagucaggagauccauagauugcagaauuauuuacagaaaauuuuuuaaagaaaaauaucucgcuuaaaccauuccaaguucaguaagcuguacauagcaacccaugcagaauccucauucacuauucaucuaauaaauccaacugucaauauuuagaaggagaugguucaggguuaaaaaagaaacaauauaaaaaaaaauuuacaaauccacgguuaacucuuuccuaaaaccacaacgugaaauaauuucagaaauguuucaugcuauaguaacugugacuuauuuuacaauaacauuauaaugguaguucugucuauaauacuauaaguaugagauaaacaaaaccauggggauaugguuuggcuguguccccauccaaaucucaucuugaauucccccuuguugugugagaacccggugggagacaauugaaugauaggggcaagucauucaaacgcuguucuugugacagugaguaaguuucacaagaucugaugguuuauaaagagguguuccccugaacaagcucucucauuuuuugccugccaccauccacguaagaugugacuuguuccuccuugccuuucaccaugauugugaggcuuucccagccaauuaaagcccauuuuaauugaacuguaaguccaauuaaaccucuuucuuuuguaaauugcuuggucuaggguaggucucuaucagcaucaugaaaacagacuaauaccguaccuugauaccagugaagugggcacugcugaaaugauaccugaaaauguggaagcagcuuuggaacuagguaacaggcagaaguuggaacaguuugaagggcucagaagaagacaggaaauugugggaaaguuugaaacuuccuagagacuuguugaauggcuuugaccaaaaugcugauauggucucagauggaaaugaggaacuuguugggaacugaagcaaaggugacucuuguuauguuuuagcaaauagacugguggcauuuugccccuacccuagagauuuauggaacuuugaacuugagagagaugauucaggguauguggcagaagaaauuucuaagcaacuagcauucaggagguaacuugggugcuguuaaagcauucaguuuuauaagggaagcauagcauaaaaauucaggaaauuugcagccugacaaugugauaaaaaaauaaaaucccuuuuucugaggagaaauuccagcugcagaaauuugcauaaguaacaaggagaggaauguuaauccccaaaacaauggggaaaucucucaauguauccagggcaugucaaagaucuucauggcagccccucccaucacaggcccagaggcagagcaggagaaaugguuuugugggccaggcccagggucgccaugcugugugcagcuuagggacuuggugcucugugaaccagcagcuccagcuguggcugaaaggggucaauguagagauugggccuuggcuucagagggugcaagccccaagccuugacagcuucuaugugguauugagccugugagugcacagaggucaagaauugagguuugggaacgucugccuagauuucagaagauguaugggaacuccuggaugcccaggcagaaguuugcugcagggguggggccuucauggagaaccuuugcuagggcagugcagaaagggaauauggggucagagucccccacacagagucccugcuggggcaccaccuaguggagcuaugagaaaagggccacuguccuccaaaccccagaaaugguagauccaucgacagcuugcacugugugcuuggaaaaacugcagacacucaaugccagccugugaaagaagucaggaggagggcuauacucuacaaagccacagagucggagcuucccaagaccaugggagcccaccucuugcgucagugugaccuggaugcgagacauggagucaaaggagaucauuuuggaucuuuaagauuugacugcccugcuggauuucagacuugcauggggccuauagccccuuuguuuggccaauuucucccauuugaaauggcuguauuuuuuauuuauuuauuuuauuuauuuuuuugagauggagucucgcuccaucaccaggcuggagugcaguggugugaucucggcucacugcaaccuccaccuccuggguucaagugauucuccugccucagccucccaaguagcuggaacuacagaugcccaccacuacgucuggcuaguuuuuguauuuuuaguagagacaggguuuuaccauauuggccagucuauucucgaacuccugaccuugugauccgcccgucucagccucccagagugcguaagcccccacaccuggcuggaauggcugcauuuacccaaugccuguacucuuaccguaucuaggaaguaacuaacuugcuuuugauuuuacggacucauagucaaggagggacuugcuuauucucagauggaacuuuggacuguggacuuuuggguuaaugcuggaauguguuaagacuuugggagacuguugggaaggcaugauugguuuugaaaugagaggccaugagauuuuggaggggccagugguggaaugaugagguauggcugugucccaacccaaaucucauuuugacuucccacauguugcgggagggaccuggugggagguaauugaaucauggggcaagucauuuccaugcuguucuugugacagugaauaagucucaugagaguugauaauuuuaaaaagaggcauuccccugcacaagcgcucuuauuuuuugccugccaccauccacguaaaauaugacuugcuccuccuugcccucuuccaugauugugaggcuuccccaaucacauggaacuguaaguccaauuacaccuuuuucuuaaauugcucagucucgaguaggucuucaucagcagcaggaagaugaacuaguacacccugauuccuauucuaaaauuaccucuauaugucuaugcagaaauaauuaaguagccuuucuucccacaaugugaugauuuccuuuuuguggaaucuaaaaagcaaaacuuacaucucaguagcaggucucauuccagugauaacacaguauaagcuauugaguugacugacuuaauucacccccauauuagggugcaugguguaacuaaaauauuuggcugcuuuuuggcucauagagugaaaugauuauuucuggggcccaaaggaagauucacaugaaaugaugaaaacuucuuugcucaacccuaugugagauguccagacuuugaauuaaauaaaacaaauccacuacuuacagauuccuccagucacugugguucaaaggucugugcaaccaauuccuuaacaacacagguuuuuguaucuuaccuauuucugggaaauaaaauaaaa

SEQ ID NO: 13817 - RNA, 4781 nt, Homo sapiens
uuuuuuuuuuuuuuuuugcuucugccccagaucuuuccuggacagugcgucucagcaguucagauccgggggcccccagcugacagagggcgugggggguuaaggcauuaaccccucccagccucuuccugaagaaaccacccagccuuggcgcggcgcugggugacuucgcguagcaggcagggaacuggccgcggcgagcgggacuggccauuggagugcuccgcugcggagggaggggaccccgacucgaguaaguuugcgagagcacuacgcagucagucgggggcagcagcaagaugcgaagcgagccguacagaucccgggcucuccgaacgcaacuucgcccugcuugagcgagguagggggcggcgaauggcgggggucgcgggcgcggggagcccgguugugguagggcuuaggugucagaaacgaauuuuuaagucgaacgaggcaaacaaaaacuuagaaaacaugcaucuccgggcgcugaaaauuugcaucucugggcuacuaaggagcccaucucgaucagauuguucuugggcacuugugauuuauggaguucagaaaaaagguuaauucccaacuguggaaccuacggguguaggggcagugaaaauugcaguuggucggaggaauaggagggaaggcguuaaauuuuggaaauccuauagacaaagaauauggugggugguguggagcguggguaauggcuuaaauuaguacugcccaggagcaggguauaaaauuaguugggggaaaaugcggagcuucuuggcuugagcagccucugcuguucgcggaguugcugggauuguucucaucucuauuaccucauuuuauugcauugcugcauuaccuugaaauauuuaagcaacuuagaaguagacuucugcugaccagugccgucuuagaaaguuucuuuguaacuuucuaguccuaggagaggagucaacguguugggggacugcaguaaauaaaacugcccacgcaaauuuagcaaugcaccagggagcaguuuaaugugaguuucugaagaguaguuuugcaaucgaaauuagaaaugugguagcauguauuauggcugucaugaguaguuugauuucucucuuuuguguauguuuuggcuaaacuaaacaaagcaaaaaauauuuaugcaaucaacuaauguacgaaacuucugggauuugcugcaaucuguuaugaaugguuuuaacugaauaccuuuaaauuuacuugcccuggcuuggggugggggguggggugggggggcgcggggggaggcggggagaauaagaagaagaaagaaaaggcagucgcuucacggaggcgcuaagcuuuccuguuuacagcaaggcggggcgggccuggcugcccacaccucacugcgcccucggacccuaagcacaccugcuccuagagaguuauuaauagagcccccaaauggcuuacgcuuucaaaugauuuuccugcaaaucugauuucuugcauggcacauggcaauuaggagguggugcuaguaucuuugaacuggggggcugggggugggcaugggggacagaggugugugucuucgcccucagacuggcaguugagucuuuuccgaggagagacgugggcugguauugagcgugcagcuaagcuggugacugcuucagagaaucucauggcuggaaauccgggggugagggggugugggguggugagagggcaggaguggaguuaaaaugggguguaguucucuagguuucccauuccucccacuccuuguuuuccuuuucaucaucuuuuuuuuuuugucaacccacagccaacaucguaauucccauuucccuuugagugaauguggccauagaguuucucccucucuuuuucuucccccucuuccuuuuuugaaaaaagaaaaaaaaggaagaaaaaagauaauuugauuuuuaaaaaaaaucucucucccugagcucuccccaaguuucuuuaaaacaaaucaacaacaacacaauuggagcagugccuuagcuagaaugaauuaugccaguaugcuguggcucuuucccugacucucuccucugacuuguuuaaggcugcgguuuccgaggcccucuccagccaaggaaaagcuacacaaaaagccuggaucacucaucgaaccaccccugaagccagugaaggcucucucgccucgcccucuagcguucgucuggaguagcgccaccccggcuuccuggggacacaggguuggcaccauggggcccaccagcgucccgcuggucaaggcccaccgcagcucggucucugacuacgucaacuaugauaucaucguccggcauuacaacuacacgggaaagcugaauaucagcgcggacaaggagaacagcauuaaacugaccucggugguguucauucucaucugcugcuuuaucauccuggagaacaucuuugucuugcugaccauuuggaaaaccaagaaauuccaccgacccauguacuauuuuauuggcaaucuggcccucucagaccuguuggcaggaguagccuacacagcuaaccugcucuugucuggggccaccaccuacaagcucacucccgcccagugguuucugcgggaagggaguauguuuguggcccugucagccuccguguucagucuccucgccaucgccauugagcgcuauaucacaaugcugaaaaugaaacuccacaacgggagcaauaacuuccgccucuuccugcuaaucagcgccugcugggucaucucccucauccuggguggccugccuaucaugggcuggaacugcaucagugcgcuguccagcugcuccaccgugcugccgcucuaccacaagcacuauauccucuucugcaccacggucuucacucugcuucugcucuccaucgucauucuguacugcagaaucuacuccuuggucaggacucggagccgccgccugacguuccgcaagaacauuuccaaggccagccgcagcucugagaagucgcuggcgcugcucaagaccguaauuaucguccugagcgucuucaucgccugcugggcaccgcucuucauccugcuccugcuggaugugggcugcaaggugaagaccugugacauccucuucagagcggaguacuuccugguguuagcugugcucaacuccggcaccaaccccaucauuuacacucugaccaacaaggagaugcgucgggccuucauccggaucauguccugcugcaagugcccgagcggagacucugcuggcaaauucaagcgacccaucaucgccggcauggaauucagccgcagcaaaucggacaauuccucccacccccagaaagacgaaggggacaacccagagaccauuaugucuucuggaaacgucaacucuucuuccuagaacuggaagcuguccacccaccggaagcgcucuuuacuuggucgcuggccaccccaguguuuggaaaaaaaucucugggcuucgacugcugccagggaggagcugcugcaagccagagggaggaagggggagaauacgaacagccugguggugucggguguugguggguagaguuaguuccugugaacaaugcacugggaaggguggagaucaggucccggccuggaauauauuuucuaccccccuggagcuuugauuuugcacugagccaaaggucuagcauugucaagcuccuaaaggguucauuuggccccuccucaaagacuaauguccccaugugaaagcgucucuuugucuggagcuuugaggagauguuuuccuucacuuuaguuucaaacccaagugagugugugcacuucugcuucuuuagggaugcccuguacaucccacaccccacccucccuucccuucauaccccuccucaacguucuuuuacuuuauacuuuaacuaccugagaguuaucagagcugggguuguggaaugaucgaucaucuauagcaaauaggcuauguugaguacguaggcugugggaagaugaagaugguuuggagguguaaaacaauguccuucgcugaggccaaaguuuccauguaagcgggauccguuuuuuggaauuugguugaagucacuuugauuucuuuaaaaaacaucuuuucaaugaaauguguuaccauuucauauccauugaagccgaaaucugcauaaggaagcccacuuuaucuaaaugauauuagccaggauccuugguguccuaggagaaacagacaagcaaaacaaagugaaaaccgaauggauuaacuuuugcaaaccaagggagauuucuuagcaaaugagucuaacaaauaugacaucugucuuuggcacuuuuguugauguuuauuucagaauguugugugauucauuucaagcaacaacaugguuguauuuuguuguguuaaaaguacuuuucuugauuuuugaauguauuuguuucagcagaagucauuuuauuggauuuuucuaacccguguuaacaccauugaauguguauuucuuaagaaaauaccacccucuugugcccuuaaaagcauuacuuuaacugguagggaacgccagaaacuuuucaguccagcuauucauuagauaguaauugaagauauguauaaauauuacaaagaauaaaaauauauuacugucucuuuaguaugguuuucagugcaauuaaaccgagagaugucuuguuuuuuuaaaaagaauaguauuuaauagguuucugacuuuuguggaucauuuugcacauagcuuuaucaacuuuuaaacauuaauaaacugauuuuuuuaaagau

SEQ ID NO: 13818 - RNA, 1694 nt, Homo sapiens
cuguauaaaucacugcccucgcccagauagacgcugaucccuggcuguggagaggauucucccgagccccugaaaaaaaaaaaagguggagagacuuugaaaacuuuucucucgaaaagucugaggaggcagaggacggcccggagucucguagcgcaccgcccuggucccacaccccccgcagcccuaggaggaucggugugcugagcuuguggccaggagcuccccgagccacuuucgcgcgagcagcagaaaaccugagccgcggcccggcgagugucggcggcgcucuggggaggagaggcugggaaggggcugcgagagguacggaggagacaagcagcccgggagggagaaugaaccgggagguuccuguacuccccccgccaccccagauccucgugcuacucgcaacugcggucugaggggcaguggcuuucccagagugcacagagaaaugaaccagcgccgguuuugguguugggcgagggguuucccucagcugagcacaaagucaggcugugugucccagauucuggccaauggagaggucguugagggggugggcugcugcugaguccugagagauucaaaacgccugggcagcucaggaauuuccaaagggggagauucucggccaggagcugcggagcaacugcagcugcccagcaggagccggcacccuucucucacauucugcuugggagucgacucagaggccucaaaucucauuacuagcacuuugcccacccuuuucuuuugcuuagaugcuacuuaagaacgugaggcugagaggcggacuuggucagaucugccugcgugacaagcucaggacaggacgcuucugcccuugcauuacuguuguaaaaguuuccacccagucccuggucgcacugcguucccaucccggcagaugugaacucaaaaacuuccuccgcugugcaguuucaauuggcagacacacccuguaccugaaugacucagaaggaggcagaaugaacaaacaacagaccccugacuucugggauuuugugaguuugccaaaaaaaaaaaaaaaagaagugacaguuaauucacagcuguuuuaaagcauucaucgacagcgacgcacccaauacauacccacagcuucaacaacaguacagugcauauaauguggaaaccaagauaacgguccucuaagacuccagaguagauccuaauuggauuugaagacuuauuucacuuaaaggggaagagguauauugugucuacccagcacaacaaaacgggggacuuggcauucccccccuucucccgccuccacccacacuaauuuaugcauucuuuaaagccaaaggaaucaaagugaaauuucacaccuagucuguaucaagcaugugcuagguuaauuuaaccuuacugcucugugaaguaaguaagcauugcuggccauuuuauuguugagagaagugucauucagacaacuaaggugacuuguagauuucccagcuagugaguggcagagcuggguuccaaaaccuaaauauugcaaaugccuugccuuguggcucaaacgcuaucagucaauaaauaguuaaggaauugaaauauauguuccuagagggaaacagacuucuagauuuaaaguuuuacauuugcugcauuucugacuguacaagucuacaaaaugcauauaaaaguaugcuaaugaa

SEQ ID NO: 13819 - RNA, 19786 nt, Homo sapiens
cuuagucuggcaccaagaaaucuacauuuuuaucaaguuccuacaguaauuuuaauaauaguagucuaagggucacauuuugaguauccguauuauuuccauaguuugaauauuuuacucuuauaacuuagcacuucagaaagagcuacaaugugacuaaaggaggcaguuuauaauaaauaaacauacaaccauucuaauuccagaaauuaucacuuuacuauacaaaaaaaccuaaacauuuacaaaagaaaauaaaaagaaguugcauuuuuaggccacauugggaaaguugcacaggagucugaugaacaaacuucgugaaacaucuccguaccaugccaguacuauacagagaaacccagucaaccauuauaccauagguugagguauuuaguaccugaaagucaacccagugcucccuuugcuuauuauuugucuauaaaaauauaaaacccggcaucuuuacaaaaccugaaauuauugucaauaaacuauauaggaauaaaauuuugugaaagggaauaaaauagaagaaagaugacaaaggucagcugucagcaaauauuaaugugaaauuuuccuaacaugcauuaaauuauaauaguccaagcaacacuaguuauuuuaacaaucuaaauauagaguguugcuauuuuaagcaaucuugcuauggcauaauuuuauuuuacauauguacaaauuauguuauuguauauacagaucaaggaacuccuccaguucucucaucuugauggcaguuacuguucuucaggcagcaaguuuuacuuugacuucuugcucacagcaagggacauagaugggcauuucuuuccaaguucaauacauucagggaagucugccucucagcucauuguuuuucucaaggaaugaugagcaguaucaaggauuugcacagauaaauagugucuccaguugaacauaucaagcauuagcuacacuuuugacuucugugcuucuacaagacuauaugaccccuucauguuggcuuuucuugcaaaguaaauuaucauuccaauggcagguauuauuaaggaggaugcaaaauagagcacgagaagcucaggagaaaaauagucuuuguuguuuucucuuccuggaaaauaacaaaauggaugcaauuaaugucuaguacaaaaagauagcauuuaauaacaacaguuacauguuuauuauaacaguacaacuaguucuccaaagagaagggaaucaaagcagugauaaggaccaucaggacccaagaugcauguuugucugaauuauccaaauaaucaguuggugguugcuauggucaugauggaucuaaagaugauaguuguuggcuuccacaaacuuggauucaaauagauucagguucaguuguaaaauggaagggaggguacaaguuuuuaacaagaacaggaauuggagagaggcaagaacaggaauuggagagaggcacuugcuuggggaaauaaaaauaucuacuaaagaacugggacucugaugaccaugaauugaaaugacuaaccaguucucuaagaaaauccuuauaauauucagagugugaccauuauagcuaaaugccacaaauaagaucguaagagaaaaaaaaaaucuugccaauggcuuucucagagauauacagaaguuucuauguuuuuuaugucagaaauagggcauauuaauacauuuuuccucuucagcauuuauaucaucuuuugauaaacuagaguucuuuggacaguguuauguuacagcuuaaauguuucuuagaggcauucucuaaucuauaucucccucauucuaaauuaagaaccucaauauauuuucaaaacccacucguuuucccuucaaaacccuuauuacagcuuuuaauuaaacauuuauccauguaauuacuuauuaaguuuaguuuccuccccuaagcuaaaaauuacaucaagacauguauaucuauuuucuuuuuaguccaucacugaacagccagcaccugacucacugcuuggccuaguuggcaccaaaaacaauauuuuuuaaacacuaauaacauuuuuuucucucuacauuuugcuuuugccacuuaguuguaaauggaguacaguagguaacagcauacaaaaacuuuaaaauuaguauucuuucuaaucugcuaaaaaaucaucugacagcugcuauacugcuuaacaucuuaacuuuauaagagcagcugaagaagauagugugucauuuacugaagacucacuccuguuuauacuuugcacagcaucaugugaccacacaaguauuaaguuucacuaaguggcauauacauugucucaguccuggcagaaacuagagaucugacuuuggugauuacuacauucuuuccagagcuuucuaaucacuggaggucaaccaaguaaaaagaaucacgagcaucagauaaugugaagucacuuuuucaaauuauugaagaaaaacaguucacccuaagcauaaugauaauugucucacuuuuugacuuucccuugcuagagcugagcuagucaaaguauaaagguaauauuugaaugggauguccaucaacaugauuauggauaggcaucaauauugaugacaugcugagaaacagaaauacuauuucuauuucuuuucuuucuuucuuuucaauguaauauacauuaucuuuugccuuucagucuuccccacaggcauuggcagaaaaauacaaauuugcugccaagguaguugccagggcaaccuucaaauacaauuuucuauuugucauauaaacacugaauaucuuuuaaaaauccugaugauuucuauuaauggaauacguucaagcuaagacaaaaugaaacaaauaaaaaauccagccaaaugcaaaagaaaucuaguucaaaauacccagaaaaauauccauuuuuuggucuucauuaaaauuuagcuaguuuaaacuauauucaguuugggggcaugaguuucuagcugagcgcuuaauauucuuugauuguucauuuaaauaaugaguaaaaaguagcaacuguguaaguggcuaauuugauaaagcaauuagaaaauaaagcaaugugugugagacagagucaaaaaguagagaagcagguuugaugugucuuuaaaaggucacaauuaauuaacaaaagaauuacagaaauguuaggggaccaauuucccagggcuaggcuuaauuaaagguggcccagaggcauuaaggauuaaagaaaauagggaugaguaaauucaaccuacucauaacugagauugcaaucuguccagaaucauccccaaccucauuggaagcacugauuacauauaccccugaaucauuuugagugacaugauacaaaguaaauguucccuucuuugaacacauaguaacuucauuggcuagaucaauucuuuucaggauaaucacugcagguggaugacuagaaguuucauauauaaucgugauguuuuccccuucuuuaacauuucuagauggauguauagcuauacagcuauucucauguuuugaggagguacugugaagauggaaaacauacauacgguaaggcuugccauuuugagaaauuuggguagacgaacaaaaauuuuaccuguuucugauguagauucaaauuuucucugcauugacaagugauugcucacuccaauagccaagugccagaccucuuaagacuuggcauuuguuugcaguccuguuugcacuccaccgccaaguauggccuccauuacacaauagcagcuaauuggugugcaaggggugugauacugaucagccaaggcugauguauuuuguuuacaccaauaagaucagcagauccuaccuacugugcauucacaagagggcuuaggagauuaaggggccccugaaguuucuccaaugaggauacugcuccucucuuucucuguccaccagaauagaguaggauggcaaguggguuggaauuuuaaugaggcuuuucgauagucgagagauuuuuuuauguuguucaggaucaaguuuacuauucccaauuauuauccugaaaagagucaauccagaaaauugcaguuacuccauguucagaaaauaguguuuccuucugguagaaaggaagagggucuggauagaacccuucuuuuucaaugugccaauccuacuucuuuaguuuccuuauaaccucccgggaaaagguuugaaaauaugguuaaacauuuagcaacugcaagaccucagagacaaaugauaaauuguaaacugaaaaaagcaagcaggaauuccucagucacgaaugauuaaugucaacuuccuggcuaaacuuuauaggauaaagcagcugugcuugauuuuuccaagaauccuuaagaaauaaaccacagcuccauuuugccaacucauucaucaaauauuggaaacucuuaguaauccuuggaaccucugaacuauuaccaagaaaacaaaaacucaaaacaaacucaccuugaacaucaaguguuaaacuucuuaauugugagccaacuuuguuuuuagauucacauucauauacucccgcauccuucaacugggccuuucggaugguauaggcgccaucuauagauuuuaguacugugucuccugucuccgcuuuuuucuucaggauuauccauguuucuggaacauuuccacauguacaagagaugaugacagugucuccuucuuugacacucucagaaggaaaagcuguaaguuuuaugucuuuuggaguaacuguaaagagaauuuaaaagacaucccugauugagugaaauauaaaccaacuccauauuaauuuagcgacaucaacaauagcuucccuggagcuauuugugcuuagcguuugcauuaaauguuaagaagggcaaguaaagaagucaagcauugcuggauuguuggaaaugaucauguuuuaacuaagagaguacauggcuuaugcuucuuucauguuccuuaauauaauuauuuacccagccuagcacaaagaauagguguuugauaugguuuggcucuguguccccauccaggucucaacuugaauuguaauccucacguuuugagggaggaaccuggugagaggugacuggaucaugggggcuguuucccccaugcuguucucaugauaguuaaugaguuuuuacgagaacuuuugguuuuaaaguguggcacuuccucacucucucuugccugccgccauguuaaggugugccuugcuucccuuucuccucugccaugauugcacauuuugugaggucuucccagccauguggaacuguauuaaaccucuuuuauaaauuaccaaucucaaguaguaucuuuauagcagugugaaaauugacaaauacaguguuugauaaagagcuauagaauucagaugugaaauagaaacuuaauuuuuuguaauacuguuuugaaaaaauuuccuugaaguacaaaggccuuuacagguuucugaguuuugaguuggauucuucaaucaagaaguuaagcuguacagauguggcuuuuucacuauccuuaacaauacuacugccauuuauuaaguuccaagcacugagcuaaguacuugacauauaacaucucuauuaaugcaacaaccacuggaggcagguaccauaucaccaauuuuuaaucccuauuaaggucuucuauuuuguaaguugauuugaaauucuuuccccauccaaggucaugacaaccauccaaaagguuuuuuuguuuguuugucuguuuuuuaaggauguguauugucuuuccaauauucuucuucuaaaauacaaaucuuauugaguugagauaacaagaaagucacuaauaucuuagugggaauaaugccaagggguaauagacaaaaugacaacccuggcaaagaaaagaacccugauacccaaaagggaugggauagaggaaauccacauugaucaccugaugauuuugcucauaacuccguauggcuucaaccugcgaacuaauaauugucuuguucucaaucuugggucuccauccuaaagagaaggggccuagaucuguugacuuaaucuacuuuagugcuuccaugcucucaggcugaugaaccaaaggacggagucauggcuacucauaaucucagaauuugcaaaagacuuaagugccagcuuaggcuucuaagcaaauacuacuggccaucuugugagauugccacucagaguucaauucagccagauaugguagcuuuaauccuacauaaucccaaaugcagauauuccucuuccuauucuuauuucaauaccauaaccauugccucauaaguguaacuggaacuucugacacagguccugaaggcuugcauuucacuugaguuuaaaagaaucucaggauaagaaacuuguaacaauucaugagaaaagacaauuucaggagauuucuccauacauuggaaacaucauaaacucuucaaaacccucaucacacuuuuguaguaaaaauuuuguuuucaaagacuuuacucauaaucaguaacauaaccaaaaacauuacuagcaaggauaacucauuacucacacucugcucaccuuggauaauuaauuccacuuccuuucugcuucuuccagccugguuaauuccuucacauaaauaaaccccagaaucuuccauuuuuguagaaauuaaggugagaguugcauucucagaaagaggcuguagcuccccguuagggagcugccugcuccacaggauuuucggagcaggaaagcccuggcucaagcaugucauauucacagaacugccuuccuccaggauggaggaagggcugaccaagacgguuguaucucugggggcaacugaaaaggcagagacgcuuguuagcuugaccuauuaugcccugaguuccaaagaguuuuaauaauguugcaaaacugggcuauggauucagcagacucaaagaguuuguaaaccuugauaauucaccacaagagguuuugguccucauuuacuuuagcugauaccaaaugauagaguagaacauggacacgucaugguguuuucuaauggaaguaaguucaguauacacuuccuugcaaccaaagaaugacgagggucaaugauaguguguacugccauuuaugguagagucaacaugacugugaauuauuugaaucuccuucugugaaaagauguggucuauuuuuccaccccuugaaucucuaggcuggccucaugacucacuuugaccaauugaauguggaagaagaaguaacacuguaggacuuccaaacccaggccuugaagaggcugcuuucauuuacaccuucuugaaacacugagcucuggagaguaaaucuaggcuacuguuccucagggugacaccacauaaagaaagagaggccaagucauccaagauauggcuccagacaugugggugaagucaucugagaccagccagcccugcuaaccuuacugaaaaugcacgagugagcucagcuaauaccauauugaacagaauaacugccuagcuggucccuuccuaaauugccuacucaaagcaucauaagccaguaaauaguuacuauuuuaaguuuagggagggugauuuguuacaaucaucauuauuuugaaauuucuuuucaguaacguuuuuucuccacagagguuuuaacgauuaaccuuauguuaacuauugccuggcaaacacgauaaagagacagguauuaaacuguagauaccucacauauguacuuaccauugacauaaaguguuugcguacucugccuuuguuuggguucgaauuccaugucaucaauauguaacuuagccugacaaacaagagcuuuuccaguaucuucaaugguagggaugaaggucauuuccaaacuuuuguucucuagagauuucauauccguauccuccaaaaacucuauauucuccagaauagucucccccuuaaguaauucaaucuccagccggucaaggggguacacgcuaggaaccuugcagcuuacagugacagagcucccauucacgaggccaccacucaucucgauuucuggaucucuagggaaugcugcaaaucgcaagcaaaaacgauuuuuauucuugauauucaaggaaaaauugagcuaagcuuuauuaaauguaaaggccuaaaaaugacagcuuuaagucaccugggauagaaugacugucaauauauaaguaaugacaguauuuauaaaugacauauuuaugauauuauauaugaauaauguuagaaacaaaaacuacuuaguauauccagucauugaguaauaaauuuucacuuauuucuuuucuucuuaauaugcaaucuugcugugugccauggcuugaccuuuucuaaguauacaucaguuuccaccaucuuauuuaguaaguauauauuucacauuuuaaaauuugccauguuauguugaauacuuauuguaaacuaguccccuaauauucauuaucucagucuucaaagcagcuguguaaaaugaguauuacuuauuuuacagccaggaauacugaaacauauagaggcuaagagacuuucuucacacauuauaccuaguaagucacugagaugggcugcaaauccauauuucucugaccucagagcccagcuuugguuuuacagagcugugcagucucucaguaucaaauaagacaaacaaggaaguucucaacuuaguuuaaauuuuaaugaccaaauuuaggcagcaaguuuuaaauauuucucagauaauacuuguaaucaagaacugccuuaacuguauucuuuauaauacaguacaaaucaguaaaaugagacuaagauagcuaucaagggcaagaauaaugcuuaaacauuuuuuuccuuaaccaaaauguuguuaaagugauacaugcucaaauauuucuauguugcaauaagaccccacugcugguucucauuucugcugggaaugugccuaucucagcagaucauggacucuggguaauaugauaaugcaaauaaaauuuaucuuucuuuggagagacccaaaucccuuuacaggcauacucuaacucauucugaacaaaauccugaaggguaacacaaguuugggcaggguuucugguagaaaaucucuacgauauguucucuugaguucuacugaauaaaacaaggcagagugacccccucaaaaaaaaauaacuuuauggucacuuugcauauuuuguucuucauucaauauggacugaggaacuccagcaaugucaaguucauagagauuugagguugcaaagaauguuuauuaagacaaaagaagagugagagaaaguguaguauauguagguggcauaaaucaacauuaagaucuagcgcugcuuccugauucugcuuuucaccugagccacugacacugaccauccccauccccaaucuaacuucuuaucuuuaauuuuggcuuccuucugcuuccuauucccuuauuuuuuucccauccugcagacagcucaucaaaugugccuuuaaaacagugccuuaaaacaguuuaaaacuacucauucccaacuggaguagcugaacaguagucaccuccacccaguccucugaaugggcacugaccccaaugcacucaccuccagcauggaguguguucaagugcaugaugagagaguauugacaaggcauaaaccaaggauugugggugcuguguacauauguaauauauauuuaagauuuaagcuaauuauauugcaucaaaccauucugauucagauuuaggaacaaaauucacaaggcuaaauuccuuuucuaaacauaaggauuucauugcacuucacagacuugcauucuuuuucuuccaauagaacugaaaaaaaaaaacaguaaacaauucugaaaaccacuuacaguagagcuccaccuggauucccuuuuccaguuucuuauguccacaagucacugugcacagauaagaguguucguucucaaaacucacagggcucagggucagcguggaauugguccccucacuccucaccuucccgcucagagggcugucuaucuggguucuccaggagaaagauggggauucacagcccaugacacuacaugucaacaugacugagucuccaaucugagcagcaauccgggguccaggggagaucucaacaguaaaugguuucucugggacacagguggaaaacaagaugaaaagaacauaagauucuuuucuuuuuucaucacauucugacauaugaucuuuauuuuuccugaucuccuuucagcuaauauccaugccaagaagaaauuacucuuuuccaccuugggaccaucagaaaugagcccacaucuuuuaagaaugaaaccacgauaguuuguugauucauucauuuaacaaauugaauagauaaaaauuugucaagagagguugcuaucucuucacagcaauaauagaguaucugcucaaauguaguuuaucaaaucacuguaagaguggacaaucacucaaauaauuuaagugguucuugugugucaagcacuaucuaaauuacuauauauauauauauauauauauucucauuuaauccucacaacaauuuuguacacuaguacuauucuuucuucuuugccuucucuuucugcuucuacucuuucucuuccuccuuuucccccuccuuuuucuucuugaggaaauuuaggcucagaaaugcuaaauaacuuugcccaguuugcaaguagcaaaauuaggacuugaugccaggugggucugauucaagaucccagcuuuucaguugcuacaacaacuaaaucaagucauccucauauggugauaaaauggucuaaaagagguacuggaaaaagcuacaaaaaaugucuucuaauuagauauaaugcccacaguggacaagcauuuagagcuucuguuccaauaauacaguuauaccacugaaagucacauagcaucauccugaaaucaaagucaaaaucuaagcauuaaaaugauacauaagucaccuccaaaauuugccugaugcaauauaaaaauacuuuacaauuaauucagggucugaaagccgagaugugagggcaaacuccuaagacucaaauauccaggaaugcucuuuggccaucagcgcuaucccggcugggugcaugggcuucuuuuggaugacugcuauuuagggagaaagggaacaccacaucuuggcucuguuucccugaagaaacugggaguguuugggcaacuuuuaaagcaacagauaagacccccccauaaaaaucacugaaaucuuacuuguaaauuacaggcuuaagguaaaagaaagaaaucucaauauauaaauaauccaaacauauuauauuuugcaugguucucaucuaugccauaaguuauuuuucucaauagguuugucuaauuaugacaucuuaguauuuucugaagaagauucuccucaauaaacugauaugcuauuagauuuugaaagagagcucauucacaaaaacaaccagagcuucugaauuuuuuauaugcuagugugagaaugaggaacuuuaaaaaacagaucgacugccugucugugaacauuucucaagucauucuuuacaguggccacauguauugccaugugaacuuggaaccauuggaggaguaacucuuuuagguagcugaagguuucucugaaaguacuuucaguacuuuaggccaguaguaucccaugugaugcaaagugcaaaacaacucuccccagccccaaaauacauguccuuuguacauuuaaauaggauacaguuuauuauggagugacauuauuccagggugaaugauuagcuuuacacacuuuuauuaguauaauaucuuuccuggucacuugagaaugcuaaccuaacauccaaccgagauaauccacuuagggugaguuugauuuuuauuuuaaucauccaaguuuaaauaccauguuuucacauuuuaaaaauuuguguugagcuggguguaguggcacgugccuauaaucccagcuacucaggcagcuagggugggaggaucacuugagccuaggaguuugacuucagugugggcaacauagcaagaucucauuuccuaaaacaaacaaaagacuaugcugcccauguuuauaaucuauucauuaauucagcaaauauuuacugaacauuuauuauguguuagguacugugcuaagaauccaaacauucacacacacacacacacacacacacacacacacacagaauuccugauuuuaaggaguuuacagauuuuuuaaaaauuaaauagaaacaggaggucucacuauauugccgaggcuggucuuguacuccuggccucaagcaauccuuccaccuaagccucccaaagugcugggauuauaggcuugagccauugugcccggagcaggaauuuacaguuuaguggaaagacacauuuaaaaagauauauuauuuuggcucuuacuaaggaauauuugcguuaccuauuuauaugccuguccuuccuuccuaguuuguaugcuccccuagggcaguugucauaucuuuuucauaucuguacccccaguaccaaguacaauucuuggauucuuggacaagggcucuuaauauuuguugaacugaacagaauagcauacaugacuauaaggaguguugaguguacacgaaagaaagaauauguaguuuggucugacacagucuggaacugggaggcugacaugagcuucauauuggagaauggcuaagauuuugccagaugaaggaaggagaaaggccauuucaggcagaaggaacagcguaagcagaggcacugagucaucaacagaucugcaaagguaguuucugaccagaucauaaagaguucugugugacaguuuuaagaaaugugauggaaguuauagaaaaugagcaccuuuuuguuuaagguaauaaacccugggagcagugcauaagauugauuauauuagggacagaaucuuagcagggagacuauuuaaagauaauuagccauaaaauaugugaaauauuauucagccuuaaaaaacaaaagaggaaauucugucauuugcaacaaaagggaugaacccagaggacacuaugcuaagugaaacaagccaggcacagagaagccaguaccuccugaucucacuuauaugugggaucuacuucuaaagucauagaaguagagaguagaauggugguuaccagaggcuggggcgaggaguggaagggaacaaggagauguuggucaauggauacaaagguucaguuagacaggagaguaaguuguuuagaucuauuguacaucaugaugacuauaguuaaugauaauauauuguauauuuaaaaauagcuaagaaagugaauuucaaauguaucaccacaaaagagcaagugaggcaauggauuuguugacuugacuuaaucauucuacauuguauaccuauaccaaacaucacauuguaaucuauaaauguauacaaucaugauuuaucaauuaaaaauauuuuaaaaaagaaauaauaaagacaauuagcuauaaaauuaaaaaggcaaagggguuuucauuaaaaugaaccugcaucaaaaucauaguaaaugcaacuaaagagcuauuuagccccaggaaaaguaugaacuaugcugagccuggguuuuuaauaguguugugguaaagauuaaugagauaaaauauauaaagcagaauacagaauuccugggaaauauuagguguacaaucaauagguggugucauuauuaaucucugggagauuccacucucucaucuguaaaaugaauacaaaauacuuacuuuuuaguuauuucuugaggauggcauauggaaagugccagaaaccuaucugguguuuagcgaaugcuguuauguaagaauaucuugcaggagcccaagugagagaugauaaacuaaggcaauggcaaguggggugaagaagaggucauauuccagggagcauuuugagguagaacugacaggauuuaacagcauggaauuggaacaugaauuugggaguaaucaacauauuguaguccaauuccugggaaucuagugugagaacagaagaggacccagggguguaaacuugaaaauaccaauauccaaggggaaggaggaagagagaaagugagggaaugaagcagagaaaaagugauaugagaugaaaaagaaucagaaaagcagagccauggaaacucugggagggaagacuuccacagaguacuaguaagauaaacauauauuugugcuaaaggauauggcaaucagauaggucaucagugaaacuaagggaagcaauuucagcauugaagcuguguugacuauugcucaaaucccacugacagcaccuuuaucauuccuuuuucacauucuacucaccuugaacaauuaauuccaccucuuuucuguuuuucccaaucaaauuaacuccuucacacacauaaauuccagaaucuuccauccucauagcaauuaaggugagaguugcauuuccagaaaggugcuguagauucccauuaucuaauuucuuacuccagaaaaucucuggagcugguagacccucgcuggaacaggucauggucacagagccaccuucuugcagcuuuguggauggauucacagaaauaacuguauucuugggugauacugaaagggcaaaaaauaauauuagcaauugcuaagcaucaucccagugcaacagagguaauguauuucucuuaguauuuaugugcuuccaccaauuugaugaaauuacucugccaaauuaguauaaagaacugcugaaucauucaaaauagucuauccaguuucugacuaaacugaucaaguuuaguugauguuucauauuuuucagaugguuguagauacucagaaauuaagaaaaaccauguggcuuaaccucccacuuaaggguaagagucccauuuaagcauucuugccaagugcccauucaagucagcuucaacauuuacugagagaaucaacccacugcuuuccaaaagagucaauuugauuuuuggacagcucuacauauuagcacauuucucccuauugagcugaaaucuucucucuauacuauuuuaaacauauuggccauaauucagcccugugcuguuacagaauaagguaaaucacucuuucauauaacugucuuucaaaugcuuaauuagaugucuuuuccagccagguuuuguuuucucuucagaaaaauauccucuaucuugacuauucuucucaaaauauuguuaaaagccuucccagcucauucucuuucagcuaaacaugccguaguuggcaauacucccuuuaaaugugguacccagugcagaacauagcauuuuaguccagaacagagcacagugaggccacuccuacacaacgcugggacuacaagacucccacaaauccccuggcaguaucagggagauuggaggcaaucaaaccccgucauuuuuccccuguccagugcaccuauguauguaugugcauaugcauacacacacacacauacacacacagaauaagugaucaccuugucaaguuucuguaccugugcaacuaauaguucaaggcauacuauaagaguuuacaaaacaauauuaaaauguuuuaucauuugagccuauuucccacuacccaaucaggugguauuacuauuccccuuuuauacacugggaaauagagaaauuaaguaacccaaacucacacaguuaauagagccagaaauuaagcucaagccuucucaguccaaauccaguguucuuuucacugaauuauacuauugacaaacauuauguugugaaugaauacaaauggaauacaaacuauauacaaguuuuuuuuuuuuuuacuuuucugcuaaguuuauugcuauacacaaccaaggugggauucccacaaagacuggaacacaucgcacaaguacuuacuguagacuugcaauucuuuuacagccugccuuacugugggcacagaauccauuucaucaauguguaauuuagcucggcaaacaagaacuuuuccaauauccucaaugacaggaguaaagguuacuuccaaacucuugguuuccagggacuuccugucugcauccuccagaaauuccugacucuucaugagaugaucuccuuucaguaagucuaucuccagccugucaaauggguauacaucagcaacugaacacuugacugugaucggcuucccagccuccagagggccacucaaaugaaucucuggauccuuaggaaaagcugaaaaggccaaacaaauacauggaugggcuuuuugcuaaugugauauaaggucucuuaccacuuuaacacaauacaaaucaagucuagcguuuuuguuaauacagucuuaauacgacagaacuguuugaauagccuuucaugauuuggggugaguucaaggcacaagaauuggaagcaaacauuuuuuacaacauuauucaauucugauccuguauauauuaagaguugcauguuauuacaguaaaagaaagaagaaaaaauaauguuuauauugaaccuuacauguggcugucacugugcuauagauuuaacaugaaugauuucauuuuauccucacaauaacucuaggagauagagaucacauuucacagaaaagaagaccuggacuuaguacauuuacauaacuugucuaaggucacacaccuaguaaaugguaaagcugggauuuaaacucaggauuuccauuauuguguuuugcuacuacagauuuacauuauguuacaucacauuuucuuauuauagucagggcagauauauuuccauuuuacagauaaugacuguaagccuuggaaugucauugcaaagaauaguuauugucaagauauucuaagaaaugagaagaccaacuuuaaguaauuagcuucugaaaauggugccucugacaggaauucauccaccagaaagauacauuugugcaaucuuuauguucuggaacacauauuugccuccugaaaugccuaacucacuaucccaacaaguguuccauugaagcuucuaguacaaggaaauacacuacuucacguggccauugccuccuuugcaagaguuaccuuuuucauuaugcauuaugaugaaguaacauauugguggauucaaaacuguguagcaaaaagaauacaaaggucucaacucuaaccacuauuacaaucaaaugcggaaaggagacagaacuguuauacauaaugagaaacagacacucuuggagaaaaaccucaggcaagauaauuaaaaccagaagcgucuucauuucucuuucuuaaaucuucaacuauuugguacuagugggcaaaagacaaaggagcuggaaauucuuuccuaugugaagaaacaugguauuuuucauuuuuccagcaauaauuucugucccucauauucuguaagaaauguuccucuaauccacacaguucgaugucagguaacauaagaacuugcuacuuuucccuguauuuacauaagggaagcuuucaaggagcucgggaggcugcacagacauaaacuaugcacauacaaccagcauaauugaaagcagccggccaagcacaguuucuugggaagcuugagcaacacaugcgguuuguugcagaaucaauuaagguuacugggaaaaguugagcuccgguacaauaaaacgaaaccaaaguaauuauaaucaaaugaggucuucaugaagacaugaccguaaauggguucaguuuuuuagaaagagaggccaucaguaacaaaaggcaaaugauuuaugucugguuaguuuuuuacuccucuugcuaacuuuguuugcugaauggagaauggagugggaugcauuuugucaggcugguaaacuagggacauccacucacuuucaugaggcaaaucuaguucauuauauaaauaucuuugaaguugagcgguugagcaccaaggcuucauggcaccaaaaaaaccaaaaaaaaauccuaaaugugucaacaccaaagucaaaugauugaaauguuuccagauauuaacaauuaugucuaagaagaacacuuuuauacuaauacauauuacuaauuauagaucuacuuaauguuuaaacuaauuuuaagcaucaaauugcauaagaauaaaugaauagaaaaucccugaaggauggaauucauaaaucaaucagacacauaagcaaguaaacauguaaggauguaaucaaauggaaauauuuuuuaauaaaacaaaaagaaacuuagaaaugaucauuuuacagcuaaggaaaccagagcccagagagguugagucuuauacauggucacuguguuuguggcagagguagaaauagaagccaagauuuggauuccugcucucucucauguuggccuuagcugucccuagcuuuccugauguuguauguucuuuagccaagaaucuguacaugaauauccauuuuaaaacuuuuuuuaaaauaucauuuuuaaaaagugauuuuaaaguaaaauugagagaaaaacaaagauuuucuaaagcacucacaguagaucuccaccuggauuccuuuuuccaauuuccuagauucacaaguugcugugcacagguaagaguguucguucccaaaacuaacaggauucauugucagcguagaugugguccccucauucgucaccuucccauucaguggacuaucuaucuggguucuccaagagaaaaauggggacucacagccuguggugcugcaagucaaugagacggagucaccaaucugagcaagauaucuagauucugggguggucucgauuuuaaaagcuugagcugcaaaagcaaaaaaagacagaagcaaauuuaccacuaguuugucuaguauucuccuccuucuucucuguauaaugucuaaaauaugaucagacugaucucuuuccuaagcugcuucaaacuaacugcaagguagccaaaaagcaccgaagucacugccaaaaaaguuuauggaaucaucuucaguagagagaauucucaguuccaaccuugaugcccauuuaucaaagcuguuuuguuauuugcuaaguuugaccucauugucaaguauaggaaacuaaagagacagaccgacuagagacagaauccaaauuacucaauugccuuuggaaaaaaagauaccaaaaacaucaauuuucagcucuaacuaugacaguacaaugguauauagcaaaacucaauugcauauuaaaaguuagacuaaauuaacuuuuccuacuguuuaaaauccuagugucuuuacuucacuacuaucgcaaaacugacugaagccaaaaccagggcuaaaauugaaugcuaacauuugaaacagaugaagggaaauaacuuacaagcugcaaacauuauccaaaguauauuugaggcuccaaggaucacgaccaucuucccaggcauuuuaaguugcugucgugaugagaaaauagugguuccaaaacccuuauuugugucccaccugugugugccugggaggguauucagcuccugaagccagugaggcccgaugcagauaccgcggagugaaauagaaagucugugcuuuauaaagggucuuguugcagaggcggagggaaaucccuucaaggggaaacccagggcagagccagggaaaaaaguuuaacagacacccagccaaguuccacuauuaaccccuucaguugcucucacugcugaagcuccucucucuguccuggcaaaagaagacacuuccaagacuauaaaauacaggcuuuuccucaucuucgacuccaaaaggcuaucuuuacuggaaagauaaaggacaaugcugauugcagaaugaagcu

SEQ ID NO: 13820 - RNA, 1388 nt, Homo sapiens
auugguuuauuuaacuuuauugaagaaaaauaaaucaauuacuagcagagcuguuaguugaucacucauccauugacaacuugcaucauuuauucagugcuauaucaaacaguguauuggaagauagauuaacuaauagcuccgagccuccuaacaauuuaaaugaaaauuacaaaauguuugagacccuauuuuggaauacaaaggguguuugacuuccaauuuccauucucuguagaacaagaacaggucauuccuuuauugacaugcauaaaauacaucacauuuucuguucugcugaugcuauaaauucaauaccaguucucuagccacaucaguuaugagcauaaaguauaucauguaaccucaaaucuguaacaguggaaggcuuaaacaagaauggaugcugcuggaauaaugcuguauccuuugaugugacaacugagcauccuucucccucccccucagaugauuucuucagcauguuagagcaaugaggaaugguuuuagucucauaaccaaguuagagugaagacauuggcuacauaauacacaugcuccauuuuuuuuuuuuuaaauucugagucuugggcagcaacuguucucuuguaacuacuuuacaguuucuaaaagcaguuauuguccaaagcuggaagaacuuaagucuucucagauaagcaugugaaugaauggagggagguaaaaaaaaauaaaauuaaaaaaggugaggucugauaggggagcagccggauaagaaaaucaaaaaagaaacaguaauuuaaaguuuauuccagcuauaaugcagguuauucugacuuuaagguaacaucacauggcauacuucugaguccauucccgagauauucuguuguacuuaucucugucuguuuuauagauccgugcaaucucuggcacuaggggaucaucuggguuuggaucacauagcagugaacaaauggauaaaagaacuuuagaaaguguuaaagcaggcgaccacugugaucuuagaaugucaagaaaaaugcugccauuacuguuaauauuugggugauaaauucuuguuguaaaugcaaccuuagaugguuugaagggguagucuguaggaaaacgaauuguccaaaagaauacaccgccuugauauggucugucaugaggucccauaauuguggcuugccagugaaacauaucauccccaacuggaccugcagaacauugugcuggagggucacgggccaaaucacuaaguuccuuauuaauccguuucagcgccauagugugugcuugucgucuggcuccucacucucucaguguaugcucaaagguccggccaaaacucuugauuauccuggcggcggggcaggauugucucgucucacaccagcucugcc

SEQ ID NO: 13821 - RNA, 42302 nt, Homo sapiens
ugaccuuaggcaacuuauuuaaccuuucugugccuuaguuucaucaucuguaaaauagggcuaauaauaguuccuaccuuaaauaacuguuguaacaauaaaaugaguuaauauauguaaagcacuucaaacaguaccuaucacauagaaaaugcucaguaagcauuaacuauuaucuuuacuauuaccauuaucauuauuauuacuagauacuaaauucacauaauuguuugauauauguuaagcagguugaggaaaaaaaaccccagcccugucaacacaguacccuaugaaauacaggugcuguguuacuauuaaaaacauauugauaaaucugacagcugugccaguaaucugcucucaagacccuaacuaaaaauauucaagcuuaccucaguucuguuaugaauuaugcuuuuuaucaaauuucaaauucucaauuuucuuugcauugucugaauggauacccuaacaccacaagagcauccagaggaacaccacccacacaaguaaccacauuaaaauaaccaaaucaaaacguucucuuaaauugggggaggaaaaaaaacaacauucaauaccucuucaacaccagaaaguuuugcuuuaaguucucuaauaguggagucuccuuuauauuuucuuucgguuaagucuuuauuagccgcuucuaacucagacagucuguuuuguagcugguggauguuuuguugauggaggauuucuaaaucuuuuuucuguuguucaugcugcuguugauauugaaccugugccuaugauacaauaaaaauacaguaccaaaauucaaagaaaaaaaucagaaauacaaauacagaaagauuugaacaaaaaaaaauuguaauuucuuauuuuuucuuuuucuuuuuugucuuaauuuugucaucuuucuuuagauccccauucugaaaagggucuauuuucaauuaugaauuucaugacggagaaagcaaggucaacaaaagcaaauuuaccaccaugaucuuguucauaauuuuugcuucuucuaaauccauauauguuuaggugcaacagucuucaaguuaagggaagaugcuauauaaguuaaaaaagcaaacugcaaauacuguauacaggaugaaccuacuuguguauuaaaaaaaaagcagauuuuugcuuuaaacaccaucacaguguuucaguuuuuaauaauaaauacucguauauaugcuuuauaauggaaaaacaccuaaaauuguaaaacgagcaagguugguucauuaguccaaucuuauagucauuuuuaccaacaauaaaauuugaacaugguuauaacugugcaauauuuagugccugucugaaucguaucacaaaccuaucuuaguaacuuuuguuaacgaacacuaugaaauccuaaauaucuuuugaaaauaaagcauauuuuugugguuaucaaaguuauacaugcucuuacaggcaaaaaggaaacacaaauaacccauaaucccauccagaaaaaucacuccuaauauuuaggaguacucucuuccacucguuuauauacuuauauugacauccacauaaacacacaauauacauauuaaauuuaaugaaugaauaucaaacuauuuauacaauuuaaucacacuuuuuaaucccuuagcauuugcaccuucucacaucauuaaaaaauucuuuguaaagucuuuaauagcuacacaacauuccauccaugguuacuccauaauucauuuaacuucugcccuauuacggacauuuaguucccaauuuuucacaauuauaaauaaaaugaugauuuuuuuugcacagacauacaucuaaaauucagauuauuucuuuaugaucaauuauagaauaaagaauauaaacaaauauaaagcuugaugcaaguuccaaaacuguaucccagagaaguuauacccauucaaaagucuuagcacuaguacaggggagugucucucucauaaaauaccuuaggaauuuuacauuacuacuucaggaauuuccucauuuucagaaagcugaaaaggagaggagaaggagcaaaaagagauaaaacaggaagcaguccauauaaaauugaaaaugccaucuuggaagaaaacauugaagaagcaaccaagaagaaaaaucagagcaaacugguaaagaugcuaacuguaacugucuaagagaguaaucaaagacacuaaagacaauagaggccaaaagcagugaaaauaaagaacugguuuuuauuccagugcucaucagaaccuuggagauuuuuguuuaaaaaaaaagugugagaacuagcauuauaaaguucacauuuucuacuuuguucccuucugaaucauuucauuauuuuuagaaaaaaauacauuaaaaauuuuccauucuggaggaaaaaaaauaaucauuggaaggacaguuucaaaauaauagagucuaacagaaaagggagaauuuguagagguggaagcaauauuuuucaaaugaauauucuauagaggcuuaaaucagaaaagcacacaguaguuuuggaagaauauuagaugagaaaaauguuuugggaauggaauaauaaugauaugaaugggaaaacaaaaauuaauaaaaaauucuaugaagaagugaugaaauauagaagucagaauuaagaaaauaauacaauaaauagaaggaagaugggugauucuacguguugcuaggacuuuccucacagaaaaaaagcuucuacaaagaaauuaguguagaaacaauucagauuacucaguauauuuuuuuaaauggagguauaaagaaaacaugagaaauaaguguaaacauaaagagaaauaaaaaaugcaagaaucaaauuugcccuauuaaaaugccuuaaagauaacacagguuuaauguccacuugaauagauaagugacaaauauagauaauacagccauuauucccuauaacauuuguagaaaccaucaguaauaauagaaggcaguuuaccugccucagcagauuucuauauagucacaaaauuggccuaauuugagaaagagcacacuauggcagugguuaucaaaguacgguccucugaacagaauaaucgguaucagcuaagaaccuaucaggaaaucaaguuccuggacuccacccccgacuaacuguaucaaagacucuggggaugaagcccagcaaucugcauucuaaugcacccuucaaaugauucucacgcacacuaaaguuuuacauuaucuauuagcaggaagagaaguguugaccugguuuuaaagucccgaagggcugccuaacaauccuaucagaaagugcaauacagaaauacaaacaaauccuucagucacucuggaguuuuaaacaaaugcccuuaugaagaaacuuucagaucuaacuuguuuccauggacaauagacaaggaguacuccaaaaugagggaggaauagagugagguagagauugaaaaacuacuuauugaguacuauguuuacuauuugggugauuaguucaacagaagcccaaacuucaguauuaagcaauauauccaguaacaaacuugcacauguaccccugaaucgaacaacaacgucaagaagaacacaacuugcuugaaaaucaagccaaaaaaaaggccgggcccgguggcucacgccuguaaucccagcacuuugggaggcugaggcgggcggaucacgaggucaggagaucgagaccauccuggcuaacacggugaaacccugucucuacuaaaaagacaaaaaaaaguacaaaaaaaucagccaggcgugguggcaggugccuguagucccagcuacucaggaggcugaggcaggagaauggcgugaacccgggaggcagagcuuucagugaguugagaucaugccacugcacuccagccugggugacaagagugagacucggucucaaaaaaaaaaagaaaaucaagccaaaaaaaaaagaaaagguaguaaauagaaauuaacgaaauagggggagaaacaguguagaacuaauuaaugaaaugaaaaacuaguucuucgaaaacacuaaacaauagaaaaaccaccuagucgcguuaaacaaaacaaauuaagaacauaagagaaauaauauggagauuuuaaaaaucacaagacaauaugcacgauauuguacuaauauauuuaaacacacagauaacagccacauacaauggcacacaccaguagucccugcuacucuagaggagcugaggcaggaggauugccuaaaccuaggagucugaguccagccugggcaacauagcaacaccucaucuucaaaaauaaaaaaaaauaauaaauuuuaaaaauaaaaacacauagaugaaacacauggcuuuuuaagaaaauauaaauuagcaaaacucaagaagagaaaauuuaaacagaccaauaaucauggagaaaacuggaaaagaaaaagauaaaugcuucaacuaggugagugauccaaaugguguuaaaaggcuaauuguaucaggcccucaagguacagauuaauucccuguuauuucacuguuucaaagaauaaagaaaacugaaaaauguccuuauucaucucaugaggcuagcauaauucuaauaccauagucuauaacccacauuugcaauaagcgaacuaugaugugcaggaaaaagacaaucucagaccaaugucacuuaugaauauaaauacaaacauccugggccaggcauggugguucaugccuguaaucccagcacuucaggaggccaaggcagauggaucauuugaggccagaagauugaguccagccugaccaacauagugagacuccaucucuaaaaaaaaaauaaauaaauaaaaauaaaauaaaaauaaaaauaaaaaaaauuaucuaggccugguggucuguaucuguggucccagcuacuccaaagacugaggugggagggucacuugagcccggaaggcugaggaugcagugagccgggaccacaccacugcacuccagccugggcaacagagcaagacucugucucuaaaauuaaauaaauaaaaauacaaaaaucccaaguuaaauaauagcaaauugauacaauaguuuauuaaaaaucgcuaugacuauuuaaguauuauucuaugaaugcaaagaugauuccaccuuuggaaaucuauuguuauaauuuacuacacuauuaaaggggaaaaaugacguaauuauuugguuagaucccaaaacucauuuuaucugacuuagcacucuuugaauuaaaauucucagguagcaaggaagagaagaaaacccuuucucucaaaugcaaagcaaauaucauauuuaacagugagauauuuuaguuauuuaccaaaaaagacuggaaaaagauaaaaauuccacuauuauuuuucugugcaagaaaaaaaaggacacuaaucauaggaagagaaaaaauuacuaauuuuuauaguuuacauaucuaccuggaaaaccuaagagaaucaauuccaaaacucuuagaaacaguauguaaauuuaguaagguggcuggauaugacauuaacauacacuacugauaaacaauuauaaauuuaaccacagugguacugguagggaguggauggucucauuuaugcaguaaaaaucuguaaagucccuagccaaaaacacuguuuaacaagacugcaaaagaaaaagagaacagagaaaaagggagagagagagagaguaaauaagucuguuuucaacaaauaagaccuuaauaaaugaagagauacaucucuccacugaacgagaaaaugagaucaguucuuaacaacaguccaaagacaagcccaaguacauaaagaaauuuaguaugugauaaagguaguaccaggcacaguggcucauguugguaaucucagcacuuuggaaagccaaggaaggaggaucacuugaggccaggaguucaagaccagcgugggcaacauagugaaaccccaucuccacaaaaaaauuuuaaaaucagccgguguggugacacaugccugcagucccagcuacuuuggaagcagaggcagaaggaucgcuggagguugaggcuguagugagccaugaucgugucacugcacuccagccugggcaacagagcaagacccuaccucuaaaaaauaaaaaugaaauaaaauaauagagguaguauuuuaaaucauuggggaacaaugacugacuauaugucaaaaaaauucuaccuuauauuauacuccacaaaauuauauuccaaguagauuaaaaagcuaaauauaacaagaaaauuaaacaaauauuagaauauaggagaauuuuuucauaguccucgggugggaaacacuuuccaaaugugaaaugaaaucuuaagccauaaaggcaaugacugacagauuugaugacauucaaauuaaaaaaacuauauacggcaaaagaugcuggcaaaugacaggcugggagaaauguuuauaauguacaugauagauaagguguauauccuuaauuuauaccaauaaaaagugaaaaggcaagcuauagacaaugaaaauauucacaaugcauacaucugacaaaggacucaugucuagaauauacaaauuccuacaaaucuauaauaauacuaauaauaggcaaauuaaacaugcuaacaacuugaaugggcacuugaaaagagaauauucaagugauaaauauguauaugaagaaguguucauuauuaucagauaguauuacauacccauagaauggcaauguaaaccgguauaccuaccuacuuugggaaacugguaguuucugccaaagcuaaacauaugccuauauauacuacaaccuagccauuccaauaauagauaaauauccaagaaaaaugagugcauguguccacaaaaagauaaguacaagaauguuaauagcaguuuaacuaauaauagcaaaauaccagaaacaacucaaaugccuaccaauaggaaaauaaauuauggcagauucauauaacaauaaaaggaaacaauagaaaauaggugaauuucagaaauauuaugcugagugaagaaagacauaugcaaacauauaugauuccauuuacacaaaguucaagaauuggcaaaacuaaugaaugaugauguaagucagaaguaugauaaccuccuauggacuacuguuaggacuaggaagccauacaagggaaccuagaggggugguccaauuucuuuaucuuaauuugggugaaaguuacacauuuaaaaaaaucaucaagcuguacucuuaagagcaagcaucuaguaaaguacauaaaaacaacaauaaaauguaauauuaaagaagcuauaaggcugggcacaguggcucacgccuguaauccuagcacuuugggaggcugaggagggcagaucaccuaaggucaggaguucgagaccauccuggccaacauggugaaaccccgucuucacuaaaaauacaaaauuuagccgggcaugguggcacauguguaauuccagcuacuugggaggcugagguaggagaauugcuugaaccugggaggcaaagguugcaaugagccaaaucaugccauugcacuccagccugggcaacaagagcgaaauucugucucaaaaaaaaaaaaaaagaagcuauaguacgaaagguagaaaaggaauucauacuacaaagcaguagaaaauaacaaccacagcugggcaugguggcucaugccuguaaucccagcacuuugggaggccaagguggguggaccacgaggucaggaguucaagaccagccugaccaacaggguuaaacucaucucuacuaaaaauacuaaaauuagccaggcauggugguggcaugcgccuguaaucccaauuacuuaggaggcugaggcaggagaauugcuugaacccaggagacagagguugcagugagccgagauagugccacugcacuccagucugagcgacagagcgagacuccaucuaaaaauaaaaaaugaaaaaaaaaacaaccacacagaaaaagggaugaaaagacaauaaaaaauaauccacagaagaaaugaaaugauaaaaaguuauauuaaaagaugcuuaucuucacaaaacauauaagaaauauaaacuaaaacuaguacuaagaucagguggcaaauauuaagaauuaagaagguggcagggcacagugaaaaaaaaaaaauaaccacacagaaaaagggaugaaaagaaaauaaaaaauaauccauagaagaaauaaaaaugauaaaaaguuguauuaaaagaugcuuaucuucacaaaaaauacaagaaauauaaaauaaaacuaguacuaccuuaagaucagguggcauauauuaagaauuaagaacguggcagggcacaguggcucaugccuguaaucccagcacuuugggaggccaaggcagaucaccuaagguugggaguucaagaccagccugaccgacauggagaaaccccaucucuacuaaaaauacaaaauuagcugggcaugguggcacaugccuguaaucccagcuacuugggaggcugaggcaggagaauugcuugaacccgggaggcagagguuacagugagccgagauugugccaccgcacuccagccugggcaacaaaagcaaaacuuugucucaaaaaaaaaaaagaagaauuaagaagguuaaaaacaaugucaagaauauggggaaauaaguauccuuauacacuaccuuaucuuugggauuccauuugguuuagucuuuuuggguggcaaauuugcaguauccaucaauauuuuauacagauauguugcaguuucacuucuagaaacuaagagugcuucuugcaguauugcuuaaaauaaccaaaacuucgaagcauuuaaaugaccaccauuuaggcaaguaguuaaauaauuuaaguuaaacccaaaaaaugaauacucugcagucacuaaaaaggaauaucuuaacugauacagaaugguaucacauuaagcgaagaaaguuacaaucaauauauccaauaagaccccauuaguauagaacaaaaccaaaaacccauuauauggguacauauauaaaugacauaauuuacagaguuauaaguuuauaaacaaauauuuauaaauuacauauuauuuacauauacguagagaaaagucugaaaaaaauacaucaaaauguuuauagauuaucucuagguaguaagacuuugaaagagaggauuuuuauuuuuauuuuauauacuucuguaacguuuggaaaauuuaaagcaagcauauauuacuuuuaaaauuaacaaaaugacuaacagcaauaaaagauauuuuuucaguuuccuuuaauguucuuaccugcaaggcuuuuuccuuuucauuugucaguuccugagaaugcuuguuugucaaggcugcuguaugugacgcccauucauuccguaacuuaucuaauucuuguuuuuuuucugcuaaugucuacauuagaguuuaacacaaaauauuaagauaggcuccuuaauauguaauaauuuugauuagaauauagcaauauuuacaaggauauuaaagaaaacaaaauuauagcuuuucaggacauguucaaagccuuuuccuacacaaaauuuuuuaauuuuaggaaaucaacauuagaauaagaacaaucuuagacccaaaacggcccacaggucaagauuaacuaucuuuuaauuaaagcuuuuaauuaaaucuggcucuuuaccacccaauaaagagggguaaggggaagcaagucgauuauaaggaauaguucacuuacauauaaaacccaguaacauggcccugugggccacauugugcagggguauuuucugcaugaggccaugcagauuaucagauaccgauauaguuaggaugucuguccccuccaagucucauguucaaauguaauccccaacagaggaggcagggccugugguaggugauuggaucaugggaaugguuuagugccauucccuugguguuaagcaaguucucauucaguuaguucauaugagaucuggauguuuaaaagcaugugguaccuccuuccucccacccucaccaugugacacuccugcuccccuuugccuucagccaugacuguaaacuuccucagguccccacuagaagccaagcagauguuggugccaugcuuguacagccuacagaacaaugaaccaauuaaaucucuuuucuuuauaaauuacccagcuucagauaguucuuuaaagcaaagcaagaacaagcuaaaacagauacucuggccuucaauuucaugaacuagggcagaaauguuguagcuaugacugaaaugaugcuaagccuaucagaggaauuaauucuaaacauagcaaagaaagggaaagguuuagagcauaggaacugaaaagccauuuaggccagaggaaugaggcgaacaaguggggaguggagaacuaauauaugacagaaacauacauaucuuauuuaaugaagacucgagggaacauguuauauauuggggauacagaaauguuuguguaaaaucaaguauguacaagagaaaguaucaaauuaagauaauuaagugguaguugaaggguggcaaagaggaauggaaauucaacggaagcaugcuuugaaagaaaauacauaaaagcuuggaacugagucaaggaagcaauucagugccaaugucuggaugacuuacaaagacaaaaugaaauuugaauuaccuuucguguaaaguccaguugcuuaguagcaucaucuagugauugcaucaaugauaauuuuucuuccuauucauaaaaauaauaaaauuacacaguuuacaauguaaucaucuauagccaugcuacucaaaguauagcaucagcaucauccuggaagccuguuagaaaugcagauucuuaggcuccaucucaaaucuaaaucauuuuaacaagauccccagauaauuuaaaguuugacaugcacugaucuauagcauuugacuagaaagacucuaaaaacucaagcagcaucccuauguuguuuccuugugccauauagcacuuuauaauuuucaagacauuuccauauaucuuaucucauuaaagaugggcuagggccgggcgcgguggcucacgccuguagucccagcacuuugggaggccgaggcgggcggaucacgaggucaggagauugagaccauccuggcuaaaacggugaaaccccgucucuacuaaaaauacaaaaaauuagccgggcguaguggcgggcgccuguagucccagcuaguugggaggcugaggcaggagaauggcgugaacccgggaggcggagcuugcagugagccgagaucccgccacugcacuccagccugggcgacagagcgagacuccgucucaaaaaaaaaaaaaaaaaaaaagaugggcuagauaggguagcuauuuccauacaugucuaccaguugaugaaaccaugacagaagaguuuaagugaccuguccaaaaucacacgauugguaaaaacccugagaccuaagcuucucaauuccugguccagauccaucccgacuauaccuugacuaaauaagaaacaguaaaauaaauucguuauauuucauaaaacuuuauuuagaaaacaaaaacuuauggcaauguaucucuucaauaauuuaucaaagaccauugauacuuauuuuguuaaaagaauaacuuaaauuuaaaucuuaccuugcuacauuucaaacagccugcgagaaauuucuuuaucuccacaucauuuccagguaaaaguuuuagugagagguguguaagaugcuuaaaaggauuugucucuaccacauuuaaaaaugcaggugaguuauccaaaauagcugcuggagaaacuaacuguagcaaaaaccuuugaaaagaaaauguuacauuauaacacacuuaagagauagugaaaaucucucacugaaucagaagcuucucuacuuaagaaagcucaggaaagggagcacauugaggacucccaaugguaaaagauaaauugggcaaaaaaaagaaaagauugacugaaacacagugacuacauaaaaguccaugaguucaugagaaacaaaugagagaaaaagcaaaaacuagaaacaaaaauucacugagugccacaaaaguagacuaccagcucuuuacucuaaaaauugacaauuuaaaugcaagaauuaagcauuuauccuuuaugaauuuucugaguaaucaaauagcccuaauugcugaggaaaaguucuucuuuauagaagaauuauacuuaauauagaaaaaauuauacagaagcaucauuuuguucuuccuaaugaaauaacugauucaacaacaaucgucaacugauaaaaccaauaaauaaaagguugauggugaacuuuacaguaaaagaaucaggcguuagcaccauacacacauacaaucuuagucuucccuuuuuccaauaucauuauaaaaccaaauauuugaugcugcuaaauauuucggaugacuuuagugccuuugucaagacaugaaaauuaagaaauauuucugauuuuaaucaagaugccuuaaagucugagauuuaauggaggccuaaccccaguucuaaaaauaaacagggauagucauaauaaacggaaaagauuuugccaucaacuuguguuucaaagaagagucugucuugaauuaaauuuaauaauguagcauucucaugcaacuuaccuuggaauuucuuuggcauguucuugaguacauugcugaaggagaucuauaaauuuuugugggaaagcuaagaagucuaccagaagaccuugcuggaauuuuaaacuauacagaagaaaggaaaagaaauuuuuuaaaaauuuuaauuaacuuuguuuuguuuuggugccuuuuuuuuuuuuuuuuuuuuugagauagaggcucacuccaucacccaggcuggagugcaguggugcaaucuuggcucacugcaaccucugccucccagguucaagagauucuccuuccucagccuccugaguagcugggauuacaggcacaugccaccauaccuggcuaauuuuuguauuuuuaguuaagacaggguuucaccauguuggucagacuagucucgaacuucugaccucaugauccgcccucuucggccgcccaaagugcugggauuacaggcgugagccaccgugccuggccaauuacuaucuuuaauuauaauuagcauccugaaggauucuuuuuucaaauuuacuaacgcuuguuauaaucaagaacuaagcuaaggaacucugauuuuuauagaacguauucaaugggaaaaaaaaucaauaaauucagcaaaagcuucaaacuucacagguguuuuaagcagaauucuaauaacccacaaaauauuuauuuuccaaaacacccuaaguaaagauaguacaaauagcccaauauucccaaaguaacuaaaucuaauauguagguauguguuugaaagagaacaguaccaauaaaacuuagaaacuuauuuuuucacuaaauauaagaucagaaaaaaauuuaguuaccuuugaaaaucuuccucagauauaacaagguuauauaaaaaaaauggauccgugucaucagucagacgaauaacuaaguccuaaaagaaaguuuguuguuuuuaaauguuuuuacuagaucuggccuuuugaguaauuucuucucagaaguaaagaaauccaacaacaucaguguaucauaguuauauugcagacagcuuuguuuucuagugcugcugguuuuuuauuagucuuuagagaguuagaaucuuaaauagggguagacauuccgcucuuuaaaagccacauggaggucuguaaaaguuaagcaagugcuaggaguugaaaguuuaggaauauccuccuaucagaggcuuggggaaauuuagacccaguccuugcuacaccauaacaugaugaaaauuuucuuuaccacugaacauaccacauucaauuuuauuuuuaguuuccuuaaaguuaacugguauggcauuucaaaaguggcaaauauaucagcagaacugacaauaauccacacuagaaaaaagagcuucugucucucagaagaccaggguaucagguaacacguugccaggcuucuuccaaagagccuauucucuccuaggccagguggccacugauauggaagcccaacuguuuucagucucaaaugaaguaaguaccuuucauaaagaucacuuuccagguagcuacguguacauagugugggagaccaucauaacagcuagagcucacaaaaaguacaccaaaauuauguaccagagaacacuggugaaagaaaaacagcauuaguuacaagaugauguaaaacuaauaaagaacugggcauuaagguuaagaauucauuugaaauaaaaucucuacucaugucuacugaggaaaugcuaagauccuagaaaaaucuaaaccacuuaugcaccaagcuagaaaaugaagagguacagcaggcauaaggaauaacauguaagaaguauaauauaucaucucuacucuggaaaauuaguaauuuaggcaccugcucugccucagaaugccuuguucuuaagcagcuucuauuuaaguacuuccugaaauucacccaggaugcuacuuaaaaaaccaaagguacuauuaauacuacuagguccuugaauguguucagggaaagcuauggcacacagaaaacagaugcuauauuucaguguuuuuugacauggggucucgcucugucgcccagucuagguugcaguggcacccucacagcucacugcagccucaaccucccagucucaagugauccuuccaccucagccucucaaguagauggaacuacaggagugugccaccacauucagcuaauuuguguauuuuuuuguagagaugggauuucaccauguugccuacacugguuucaaacuccuggcucaagcaaucugccuacuucagccucccaaagugcugggauuacaggugugaggcacugcccuuggcacagaugccguauuucuuaguucucuguuccaguggcccccaaccuuuuuggcacuagaaaccaguuuuguagaagacauuuuuccaagaauuagggagugaaggaugguuucaggaugaaacuuccaccucagaucagccauuagauucucauaaggagcauacagcugagaucccuugcauguacaguucacaauaggguuugcacuccuaugagacucuaaugccaccacugaucugacaggagguggaucguaggagguuacacucgcuucccugccugccacucaccuccugcugugcagccuggcuccuaacaggccacagaccguaccaguaaguggccaggggguuggggaccccuccucuauucuauauccuuaguucuguuaaugacucacacuuuugaagguuauaugagacugauacucuaaaugccucucuucaaaacguaaaguaaaagauucacaaauaucucccugcaguacuucgguuuauuguuuuuacauuuauaccaugaaaugccaauucuacaaggcagcaguguguguguguguguguguguguguguguguaugaccaacagcaauaaaauauauuuuuauauauauguuauuauauauauauaauaugcaacuucuaagugcacugggcaaaucuaaggagaaugucaccccaccccacaauuuuucacguauguuuuagaaauauaugguauaggccgggcacagugguucaagccuguaaucucagcacuuugggaggccgaggugggcagaucacaaggucaagagaucgagaccauccuggccaacauggugaaaccccgucucuacuaaaaauacaaaaauuagcugggcgugguggugcaugccuguagucccagcuacuugggaggcugaggcaggagaauuguuugaacccgggaggugagugagccgagaucgugccacugcacuccagccuggugacagagcaagacuccaucucaaaaaaaaaaaaaaaaaaaagaaauauauaguauaauuauccuucaguuguugucucaguagauuccaccacccuugauuuccaacaguugcaaaauagccuaaaauguaaaagcaaaauaaaugcaauaaaagaugucacauucuuaaagaacaaaacuaauugucuacaauguaccgaaaugauauuucaaaaaaggacuaaauaccaaccuuucugugaacuggauuagaaacugauuguaguucaaugcucauucuuauacuuacucuccuguaggaaaagacauacccaaccaucagaaacauucacacgaaaugaguuaucacuaucauuuguauuaaguuuucagucuuaagugacaagacuuuccacagguguucucuaacuuaugaacagaaguuugaaaagcacaccggauuugaagcuuaauuucuucuuguuccacuagugaguaaucuagcaguguuuaaccuaaaacuaaauuuuucucaccuguaaaauggggauaucgugaggauuaaaugaaauaaacacuguggagugccuagcacuagccugauauaugacuuugcggcccugauuguaaaguaacaucuauugaaagacaaaccaucaauuuaguaacuuuucaacuguaaaauggggauguuuugaggauuaaaugagguaagaaccucauauacccuuacugcccugauucuaaaauaacaucuagaaagacaaaccaccaauuuaguaacaacuuuucacauuaaaaaauuaccaugucauguaaucaaacugauuaaugagagacugauugcauuuuaaaaacuuaguauguggcccgucgcaguggcucacaccuguaauccuggcacuuuggguggcugaagcaggcagaucacuugaggucaagaguuggagaccagccuguuaacacggcaaaaccucaucucuacaaaaaauacaaaaacaagccaggcgugguggcacccaccuguagucccagcuauuugggaggcugagguuggagaaaugcggaaccugguaggcagaggcugcagugagccaauacugcaccacugcacaccagccugggcaacagagacccugucucaaaaaauaaaauaaaauaaaauaaaaacuuaauaugugaagcgauauuagaaugcuuugaauguuuaaaaucaaggaaauaacauauucccuacauuuauucauacaaaaacguauuuucacauccacgaauuaaaucugcuuaauauauucuuuauguaauaaaaccacagaaguauuaucaacaaguuuauuacaccuauuuuauccuugaguaaaguaacuuuaagcccugagagggagagaccacaguguuccacauccuaugcuguaucuuagagaauccagaauuggacagagguauauaggugaaagugcucauaaacauuaaucaaauagagcacaaaugcuuauauaauucagaaaauaaagggagaaauuaguaaaaaauaccuaugcacaaguacuucucaaacuauucugccagaauuaaauaacaauggccuuucuuugaugugcagguagaaaaaaguaaacuaacaaauagaauuuguucaauuuuaaguuuuucuucuaaggacuucuuuuaaaccuuuuccacacuauugcuuaucuacuacacaaguaaaaaguauaaacagcaauugaguacugauaggaaaacuuggaaacaguugaucaaggcuagauucaauuguuuagauuuuuuaaugcugacuuguaauuuuauauggguuuaaaaugugucauuuuaguuaaguuucuuguugaacauaugauuggaugcuaaaucuccguuuguacaauaagguuaaauguuaccucauaacuuguaucuguuuucugaaaaggaacaagaagcacugguuuacaccagagagaggaagaauuauuuucaaaacaagagaauacacuguugcuauuuuucuaguaucuaaagcaacauaugugaaacagauuagaguguuacuccaauuccauuuaagcuuuccugagcugggcacagugccucccaccuguagugcuggcuacuucagaggcugaggcaggaggauagcuugagcccagggguucaaguccagucugggcaacacagcaagauuaagcuuucgugguggggugggggagggggggacucaguuuccgaacuuguaagauaaguggauucaacuagaagguuugugaaaaccuuuuuagcucuacaucauuauguuugguuuucaucuucugaaguuuucucuaguauaaaugccauagugguaugauacugcaguugguauuuaacuuuuuauggugcuuuacaguuuauuuuuauuuuaauuauuuauuuauuuauuuauuuuugagacagaguuucgcucugucacccagucuggagugcaauggugcgaucuuggcucacugcaaccuccgccucccagguucaaacgauucuccugccucagucuccugaguagcugaguuuacaggggcacaacaccacaccuggcuaauuuucguauuuuuaguagagaugggguuucaccauguuggccagacuggucucaaacuccugaccucaagugaucugcccaccucagccucccaaagugauagcaguacaggcgugggccacugcaccuagacgguguuuuacgguuuuaaaaguccugucauacuucauauauuugcaaaaaguacaagaagaauucacuuaucaaaguguucuuuacauaauccuggaagaguuauauuacuaugacaauuuaccaaucauauuaaugauauuguugcauauauuccaaaugccuauauacauuagauguugaaagaaaaaacggaaggccuguaaguuaaacgaauuccccaugcuuaguuaaaaaacaucccuagaaauaugcuguagaaaaauacaagcuuucagaggauacgcuaacuaaaaucacaaaucuuauuuuuucccuuauaaugguuaaugucauaagagcaauauaaaacaauaaaaacucaauaaaauguuauuucucaucucaauagaugucguacucaauagaugucuaauacuaaugacauuagauuuaguuaugaguucuucuaaauaaaaaguauucuaaacaucaggcuugcuuuagcacaacuggauucuaggccaucucugacacccaguagcugugcucuuaaacuaucaaucaaacaaauaaaagguacuuuaagccagguauugugccaggugcuagggauacaaacagaaauaaacaugguccaggggcuuggcacaguggcucacaucuguaaucccagcacuuugggaggcugagguggguggaucaccugaggccaagaguucaagaccagcaugggcaacauagcaaaauccuaucucuacaaaaaauuuauaaaaugagccaggcaugguggugcaugccuguaguuucauguacucuggaagcugaagcaggagagcuuaagaccaagaguuugagauuacaguaagccaugauuaugacacaacacucuagccugggcaacagagugacagccucucucuaaaaaaaaaaaaauaauaauuuuugaacauaggaugacacaaacaaaacaaaacaaaaaaaaccauggucucuguccucaaauugagaugagauuaaugacuuuuugcuagauuugcuucugauugcauuuuagggcuccaugagaggggagggaaggguuaccaacacuacugaguaccugccagguauucuacauauaucaucuuauuuaacaauaaucuugauaaguaaauauuauuuauuuuacaaaagaagaacuuaaggcccaaauaaugguuuaaggucacauuacagagcccaaaugaaaacucagaucuuucaccuacaccacacuaucuaauaacugaauaauggcaauucauuucaacuuaggcaacuuugaaggguccuuauagugaaaggauuuaagacauaccugaaaguuaugaaagaaaaaagcauuugaggcacaaggaacagcagggguaauaguauagaaugaguaucagguauauucagaagguaacaagaaugcuuguaugacuuucauauuggagagauaagcuuaggaaacaaaacugaaaaggcagauuagugucaaaucauggguuccaaaauuuugcauaauuuuccaccagaugaaguucccugaucauuaccacuguccucaacugaauuuccuucuucucugacuuuaguguacuuauauuacuuuaugcauuugucacacauuaauaccuaaaauuuagugaacauuuauuaugcucuagucacuguuguaagcaguucauauguauaauucauuccauucucauaauaccaugaaguagguacuguuauuaccaucaacuuaaagaugagacacagagaaggaaauuguacaagaucugucaguaaguggaagaacugggacuuaaacccaggcaaucuggcuccagagccugaacuccuaaucugugcuauggugccuguucaaggaaaaucuuauuuccccuauuaaaaugugaguuccuugagggacagaaugaaaagagguuuuuguuggcuuuuguuguuguuggggacggagaggggggugcguauuuacauccuccacacuuaggacaguuccugagacacagcagacauuugccaguauuuguugagcugaacuggccucaaauacucaaccaaggcgucugggcugggcgugguggcucacgccuauaauccccgaauuuugggaggcuggggugagaggaucacuugagcccagguguucaagaccagccugggcaauacagggagaccccgucucuuuuaaauuaaauuaacaacaaaaaaaagccaggcguggugguaugcgccuguaauugcagcuacucaggaggcuaaggugaggggaacccuugggcccaggaggucaaggcugcagugagcuguaaucgugcuacaauacuccagucugggcaacagagcgagacucugucuagaaaaaaaaaaaaaaagagagagagaaagagagagagucuggguuguucuuccuauaggucaaggaucaccaaauuauucuguaaagggccagauagcaaauauuuuaggcuuugcgggccauaaggucucugucacaauuacucaucucugcccuuccugugcaaaagcagcuacaauauguaaacaaaugagcauggcuguauuccaagaaaaguuuauuuacgaaaacagugagccaacuggcccaugugcuccaguuugcugaccccuauuauacagauaauaggaauauauuaaagguuucuaagcagagaaauugaguuuuuagauuaacugugauggcaauguaaccagaaagagaccaucuaggaguuuccauauugaaaccaaagucauggccuccuuuaucuuucuauaaucauucuaaaacaguguuguccaauggagauacaauguaagccacaaaugugagccagguauguaauuuuaauuuuuuucuuuuucuuuuuuuuuuuucagagacaggaucucgcucuaucacccaggcuggaguacaguggcacaaauaguagcucacuguaaccucaagcuuaggcucaagcaauccuccugucuuggccuccuaaagugcugggacuacgggugugagccaccauaccuagccuacuuuuaaauuuucuagaagucacauuuuaaaaagacuuuuaaaagcaggugaaauuaauuuuaauaauacauuguauuuaacccaauauacccaaaaauauugccauuuaacacauaauauaaaaauugacauauuuuacauucuuuuuucauaguaagucuuaaaaauccaacgugcauuuucauauguaaagcacaacaauucagauaagccccauuucaaaugucuaauaaccacauguggcuaguggcuaccauacuggacagcauuaaaagaaugaucaacuaaaccuacagaucuccauaugcagcugcugguuuugggaccaucuccuugaccggcuugccauugauuuuugaccgaauucugaacuauauauacuacaguuugacauuacuggcaacucaauaaggcaaugucuucauuuuuuauguuacauuuguacaccacuuaguuuucacauacgauuucacaccugauccucauuacaaacacgugaauacgcaaaagauuucacaccugauccucauuacaaacacgugaauacgcauguuauaucaguuuuacaaaugaggaaagaacguucagagaaaaaaagagacaaccauugaguguuagaacugagaaaaaaaaaguaagucuccugaccucuggucaaaucuauuuacgccccaauaauaccaccuccuuaaucaaaguugcacuucucugugcgacuggucuuuauuuccuccagugauuguaaacuccaugaagaaaaggacuguuuuuccugaccacuguauucccagugcccaguaagguguuuuacaaggaggcaauauuuauugaaugaauuaaugacguuucugcuuuucucauuuuuagucgguuaaauguaauuuacuuuuuuaaagcaacugaugugaagagccaaaguacgccaccaaauugguagguuuuuaaaaguugaacuuuacugccaacauacuucaaaagagaacgagggggaaaggcucggagccaaggccugaguucuaguccugacccugccaugaacuggcugugagcccucacguaaauuuuuuuaacuucucugggccagaguucuuaucugucaaaagggaagaguagggcuauaaucuucacgauuccgugcacagguaggguuuuugacauuaacuugaugugagccggcuuccuaacuccucacacccuuccuccaguccccucugcaacggccgacuuggugagagagguaaccaccgggcccucuggguucccuauccgcuuccuaggggggccgacucgacaccuaggugcaagguggaucccacgggccagaaccgccaucuuuccccauuggccugaccccaaccgccacccgcgggcacuggaugacgcggaccuuaccucuccucacagucuuugcauuucaccugcaacgggacuaguugguggaacagcacuuggcucauguuggcucgcugccucggcuggugugcagaaaagcccaacaggcccggcccucgggauuagccugagagguccggguccugauaaaguuugaguuuggcgcucggcuucugcggaggaggcggggagggagaaacgaggggaaggcguaagagacuuggcccucgccagccaccaucggauucuuccgguucugcggaggauaaagggaagacgguugugguaguuccggguauuaaccuguguggcgcgggggcugaggcagccauguuuguuaagggaaggagacccgaaggaagcuucuaacuuuucuucugguugccggaugcuggacaccggaagcgagcccuagaauuauggcgaccuccgcgacgucgccgcacgcgccugguuuuccagcugaggguagaugcgguuacuauguggaaaagaagaaacgguucugcaggauggugguggccgcagggaaaagauuuuguggugaacacgcuggagccgcggaggugugguaucgcccuacucucucaagagucggaaauaaguauccugguccugucggugcuggaacccggccccuccccucuuugacagcuuucugcuuguguccccuggauucuccagcuuucacuuuaauaaacccaguuuugcccuccuugcggagcgauuaugaguucuagugaugagaaauuuuuuauuuuucuaaguaaagcgccagcagugacccauuuauuuugaucuauuuaucucgaucuuaacucaugguaaugcuagguuuuaauuuuuaccccaagcuaccgcuccgucuuccugcuggaaagugguaguuuagaaaaaguagugauugaagucccaaagguuucacuaguuguguucuaauuguuauuucaugaaagagaagcacuucucgugaaugcgguuggaagaaacuuucuuuuaaaaauuuagacuugaggcccggcgcgguggcucacgccuguaaucccagcacuuugggaggccgaggcgggcggaucacuugaggucaggagcucgagaccagccuggccaacaugaugaaacccucucucuacuaaaaauaagaaaaucagccguggcgcgagcuacuaaaauuaagaaaaucgugguggugcgagccuguaaccccagcuacucgggaggcugaggcaggagaaucgcuugaacccaggagguggagguggcaauaauccaagaucacaccacugcauuccagccugggugacagccagacugaaucucaaaaaagaaaaaaaaauuuuuuucgacuuacaguuuuuaagaaugcaacuuugcuggaaugggaaggaaagauuuuuaaauauauacgaauugaccuuuuacaauugagaacaaagcauacaauuuuguuugauaauuaugcauauaaauguacuaucaaacacuuuauauuuguauauauguauauuacuuuaggauauauaugagaugggaaaauaaaaaccagaggagcaaaaugcucauaggaagagagcauguccuuauaguuccacagaacuauaaagaauaaaccaaagcgaucagcaucagauuucaugcuucugaauguucaguauuauuugcauuauuuuauuucuuaaggaauuuauucuucuagacaauauccagugcagaucaguccccugacccccuucaucugccacucuccaucauaguuguagucuacuuccuauuuuguuuugacuggcauuuaccaaaagugaagcauacugaaacaaggacauucuuguuuuggaauaugggagacgugauuuguugugggaacucugaauuaugcccauagucuauugacugguuuugaggggacuggcaaacaucccuuguugaagaaugagaguuaugauaggagaaggauuuagacuccaccuuauccagauauauggaaggugaaaacaaauagugaugauaguagaauaugaauaaauccuuacaagcugauuaguauuccuauagaggaacgacauauugucauuagacacuugaagagagaccgcaaaacaucaaguggaaacacuuuuauugacuacuaucucguuuuaaauuguggcuauccuccugaaucuguaauuuaugauguaacuggauguuguguuuccaucuuuuuuucuaagugucauauauagcugugaugacaccacucauuuuuacccagugguucucgacugggacugauuuugccuccagugaacacuuggcaaaaugaagacauuuugguugucaaacugaggaguaucacugacaucuaauggauagagaccagaaaugcugcuaaaccuccuacaaaucacaggacagcccccugcacucacccccucaaaagaauuaccugcccaaaacgucaauagugccaagauugagaauuccuguuucuaaauucaacuaauaaauuuuaaaugugcuuuuuuuuuccuaugcuacaguuaggcucuggggguuagaauagucuuuuacauggagguuaggauuuaaagucagcaauaaggaagaaauuauauacaguauuuucuuuuucuucuauugaauauauaguauuuucaaaaaaaaaauuucuuagcuuucccaugaaauucagugugaauagcuucauggacaugcugagaggcacauucgaacagaaauaaauuuuuaaaagaauaauaauagcagacacuuagucaccacuuacucuauguacagcacugggcuaggcaguuuuguuuuguuaacuauuagcucacuuaauguguucaaaccuuagaagguaagacauauuuuuguucucaucuuucagaugaggcaguaagccuaccuaacuaaggucauagggaucguagcugguagguagagcuggguaucauaccuaggcagucuggcuggccuguguucuuaacuguuauaugaccccuauuuauacagauucauguggaauauuggguagaauugccaacauuaucaauuuuccuuucuuuuuucccaguucauauagucaugugccacauaaugacauuucagucaacaacagaccgcauauaugaugguggucccauaagguuauaauacuguauuuuuacuguaccuuuucuauguuuagauauguuuagauacacaaauacuuacauuguguuacaauugccuacaguauuuaguaugguaacaugcuguacagguuuacagccuaguagcaauaggcuauacuauauaggcuagauguacaguaggcuauacuaucuagguuuguguuacuauacuguaugauguucucccaaugacaaaaucaccuaaagauauauuucucagaauguauucccagucauuaagugauguaacuuaggaaugaguaggauguaacugauaguaaaaaguugcaaagccaguaaaauauggcacauccaaaugguuaaaaugccauguuccauuguuucuaagaaacuuuauuuuuacauuuuaacauucuaaaaucaggauacaucuuaaaauccauaugucaaugggcagcauuuuccaaaaaaugauuaguaugugaggcaauacauguuaauuagcuugauuuagccauuccacaauguauacauauuugaaaacauuauguuguauuaaaaccauacauaaauaauaguguauauuauuuuuauugccauaaaaaucacaauuacuuuuguacaaaccuaauaugugauaaauauauacaacuauuugucaauuaacaugaaauaggcagcauuuuuuucuuucuugguugugcauaaaauagucauacauauaauaguugaugcuaucuuagauuucagacaccauauguaggccuucucuauacccuguuugaagcuauagacccuuguuuguccaaagcaguauuuguucauauguauuuaagccaguacacuggagaguuuuuguuaaacccuugggaccugauuuugccaacuuuucauuauguccuuguaagguuuccuuaccuuguuuugagauuacagagacacugaaguuauaucugguaucuguaagcaauaaacuugauauuuuauuuaaauaaauguaucucuuaauuuauuaggaagaagaugcucggaaaagaauccuguguccuuuagauccaaaacaguaaguguggaucagauacggguuuuuuuuugugcuggaaacaguaauuggcacaagucucauuugaaauaauuuucucuuuaaauuuagcacaguauaugaagaucaacuagcaaagcauuugaaaaaauguaacucaagagagaaaccaaaaccuguaaguguuugaucaguaaaauugaauggugaaaugugguauguaaugccuugguagaugcugcacauggaauguacuuguuucauagcugaggaacccaagcucaggaaauauaauuuuuuuuuaaagagauagggucucacucugucacucaggcuggagugcaguggcgugaucguagcucacugcagccuugaacuccuggacucaagcaauccucucaccucagccucaugacuagcugggacuguaggcaaacgacaccacaccuggcuuauuuuuuuauuuuuuuauagagacgggguucucgcuguguugcccaggcuggucucgaacugcuggugucaagcaguacuccugccucagccucccaaagugcuaggauuauaggcgugagccaccaaauccagccaggaaauacaaauauuuuuaaauuggguaguaggcaaaccugccugacuuuuguuccauaaguagacauuuauuuauuacacuguacaauaagggcugccaugcgauccaggaggugacaccauuucugucuuccaagggugcuugguauacaagcucccuugaaaagguagucugggaaaaaagauaaucagugccuuugcuucuaagacucauagaaaaucgagacuuaugggaggaugucuugcaauagcaccgcucaguuacuuugacaacaaaauacucccauucauuuccaaaugccucccaguugagaaccacugggccagauggcauaaguuuagaaaguauuuuuacauuaagaugguguagaagaaaaaugaugacccucaccaccaccaccuacuuaggacuuagccccuuuaauagaaagagagaacauuggcuuuguuugcaaauaucuuccuuaccuaaguuccagguuucaguuaaagcaagcaugugcaauauguguucagagaaaaguuugagaggauagauaaauuuauuaaaaauggaaacccuugggugaguuucacugcauaccaacacacaguggcaaggaaauggagaaaagcgguggaaugaugagacgaagaaagaaaugcaaagcaguauuuaucugguucacuauguagaguaggacacuuggaacccagguaaaggcauaucacuauucugcuuuacuuugggaaacuggugaacaauuuuuuuaaauuuuguauacuaaauaaaaguuaguugguuauaaauuucuccaguauaaauaguuuucacauuuaaaaaucuaaucuacaacguaaguuaccuggagcacucuuggcaaccauuuugaacuaagaguacaucaaauucuaauacuuaacagcuaguuuucuauuauaguuuuuuuccguuauccaguaaaacauuguaauuccugcaguaaaacauuguaauuccugcaguaaaacauuguaauuccugcagucuucacucauuccacucaaucaccaguuuccauugcaagcaacacacauucuguccauauagguaaagcuagcaacacacaaucaggauguuaccuuucugccuccauguaacaaaaguccauuuacuacacauaacauaauguccccaagaguuauuuucacuuuugaaacaggauuuguagaaacaguacuuuuucauucaucuagauccacaccguucaguauggcagccacuagccacauaugacuauuuaaauuugaauuaaaacuaaauaaaauuaaaaaucuaguuucucagucacacuagucauauuucaguggcugccauauuggccagagcagauguagaacauuuccaucauugcagaaaguucuguuggacaaugguaaugcagauccuuaccuagaaucuguauuucugaagccagacuagaaagauuucauuauguguguuuguuuguuucuuuguuuauuuuagagacagggucucccuauauugcccaggcuggucucaaauuccuggguucaagggauccuucugccuuggccucccaaagugcuaggauuacaggccugagccacugugccuggcuucauuacguuaauuuaaauagugugacaggacauuuauauuuucaaguuuuaauuaauauuuuaaaauagaagaaaucagacuuauuguuauaauaucuuugucuuaucuguuuuuggucaugcugcaugucugauaagcagcauuguguaguuaguacuuugcuguuuuuacuuuagcacuauaagacaaaauuauuacaguucucaguguaugcugucaacagucuaggcuguagaacuuuuaauaaguguuacaaaugaauuucuuuaaacuguaagugcuuauucagauaaucaccucacuagaauauaagauccacgaacacauauuuuugucacuuuuguuaucuacugugguggagugcccaauaccuaaagcaaacuagggccuagaguaaauauucaauagugauuucaugaagaaaugaauggaggaagggaggauggcagguacagagcaggggauaaagggaagaaucaguauuuuaguuuaauuuuugugagcuacacauuauuaacaguucuuuuaugguuuuguuuuuguuaaggauuucuauauucaagauauuaaugcaggcuuaagagaugaaacagaaauaccugaacaauuaguaaguacauugacuuaauauuuaauuuuaaaagauauuuauaagcucucuucaugaugugaauaaggcauguucuaauuuuugucucaagucuguuuuuaauuuagaaugcauuuuccuguagacuuaauauuguuagugaugguuaguuccuagacccagaccagcucaugccccauaacaaaagaagcuacaauauggcccugaauccccuuugauucuugaacccuucugagccuagacuuguucuugaccuugaggaaguuaggaaaauuaaaguagcacagcaaagacggaguagaaauuuagcaguuggacaauucugauggcagcuuagggaaaaggcuugauagagagaagagccuaagcugucaugggauuugcccaguugguaaaccucuacucagucucuguuaugcuacuuuaaagcaauuuuuggcuacauuauuuaguuuuauuuuuguauauagguuccaauuucuucucuaucugaagagcaguuggaaaaguuaauuaagaaauugagaaaagcaagugaagguaagacugccuaaaguugcaaguucaauuauuuuagaguaauuaggugguauaugaguugauaccauucugguuuaaaauauguuacuacuauuguucagaauccuacaauuacauguuuggcugcuuaagcuguugugcuuauauuuggcacaggcuugaauucuacacuuaaagaucauauuaugucccauccagcauuacacgaugcacuuaaugacccuaaaaauggcgauucugcaaccaagcaccugaaacagcagguauguuuaggcuauaguaacuacuaaacauggccuuuguucauuuguuaaaacuguuuuaaauguaauuauuaauaagauuuuauuuuguuuaccuuugaggguaccaaauauuuccauuucaaaaauauauagaaacauauacaaaaaauugagggcauggaugugauucugaguaccguauauuaaauauuuaaaggcaagagagaaaaauuuuaagucaaauacaaauuaucaauguaagcauacugccuuaugcagaaauuaccuugcuguuuucccauuugaaccaaauguguuuacucuaguuuauaaaauaaucuugugaaguuugcaggcuucuauuuuagguaacauugaaaauuuaaaguuacuugguccaagaagaugcuuuguugaguuuggagcgggaaagggaaaauuaucucauuggguugauauugccuuaaaagaugcugaaaaaguucacuucauccuaguggaaaaggugaccacaagauucaagguaagugaaaccauugcucuguguuaguaaccaaacuuguuuucauuuuuuguauucaggaaaaaagugauagaaacauuucuuaaaagaaaggaaaggaauuuucuuuaucuguuuguuguagcuuuuuauuaguucuaauuguauugauaacucaaacugaaggugaauuuuuuaaucuaaguuuugauaguccauugaucugaauucuuaaaauuauuugcagagacaggaaaauauauagaaagagccaagcucaagcuaggaguuaaaagucuugggcucuacuccuaucuuugccacuugcccuucauucauuaaacaauuuuugagcauacugccaggccccacccaggcugaaguacaguggcaggaucguggcucacugcagccuugaccuccugggcucauauaauccucccauuucagccucaugaguagcugggacuauagucccacgccaccaugcccagguaauuuuuuaaaauuuuuuguggagacagggucucacuuugucgcccaggcuggugucgaacuccugagcuuaagccauccucccaccuuacccuuccaaagugcuggaauuacaagugugagccacugugcccagccacuuuauuacuuauauuuagaaaagagacccaggcaaauacauaaaugauuguagugaaguguuaaaauacgagaaaggucugcacagaguacagcaugguuucaaagaagggagugacaaguucuauugcagggaagagauggagaaugacuauguagaaaaggugaugcuugaacuaaaucuugaaaggugaauugguguuuguuagagaguuugagaagcauucuaggaagcaagaacaguguaaccaaauaccugaaauaacaggaaaauauggaaacauuccuguauaaugggaguacauggugcaaaguagaguucagcaaugaugggacuggagaggauggcuagccuauagaaggucucauauuuuaugcuaaggaaggaguuugacuaugcugcugucugguggggauacaauagaaaaaagauuuaguucuuggcuuugaggaagcuuacgucuaguggaguagacauauaaauauuuguguucaguaugcuaaguguguuuugauagugguaaguacccaauccuaugggagcaugaagauagagcaccaaccucagucuagugugggucauagaaguuuuugcagaagugacaguugagaugagauugaaauaauauguaagaguugguaaaguagaaggaaauuuuucaaaguuuauccuagcagcaccauuaaaacuauauuagaagagucugauacuuagagagauuaauaauaaagauaauuuuuguccaacaauccaaguaagaaagaggccagagcuaaagcuauugcauugggauggagaggagggcaagaguaugagaaauauuaagauguuggaagccacaagaguuggugauuuguuaguaauugaauaugagagauaaggaguaauucucgguaggauuuuuauggcuuaggugacuaagugguguucuuuccugagauaaggaaugaaggaggcacaagaggaaggaugguuuuggagacagaaauaaugaguucaguucugaauguguccaguuugcuggugaaguagagcuuucuaguucacaauugaguaugugucugaugcccauuggagaggccugagccacaaauguagaucagccggucgugggcacauagguauagauuagaaugguugugaucuuucaggagagcaagaagaggagcgaaccaaaaauaguacaccaggagugacaaagauaaaggagcuaguagacaaucuuagauaaaucacuuaagaucugugaacuucaguuccuuugucagugaauugggaauuuuuaggguuaaaggaaauaaugucuauguaauaauugauaaacauuuucaaaucuuuuuuaaaaagugugauauuuugaaguucucaucaaagaauguacaaucuuaauuuuuaaauauguucuguugcucugaauuuugaaaaccaauaaaaaucuuuuuauuuucauaaagcuuuuuuaaauguaagaagugauuauuacaauaauguucuguuugugcagguggauggaaaacacagaaagaaaaauucaguguuugaaagacuucaaauugauauucaacacuuguguuugaguaaguuguguaacuuuccauuggucuacaaauaaaucauaacuguuuuaaacucugagguugcuuagaaauccaaucaugcagaacugugcuucagggaaaacagucaaaucaauucauuguuaauauagaauguuuuauauaauguuuuuaaauagauguaaauugaauuaagguugagaauuuuaaaaauuuucaguaucaaguggaaaugaaguguuauauuagggaagaguuuaaaaguuuuauaauauguacuucuguuguuucuuuguccuguuuaaauuaauuuugagucuguucaaacuauaaacuagccuucugccugcaguuaacgugacuuuaccuaaaccaugaaagaaaaugagauauuucucugccuagcuaauguguaaaagauacuuccuagaauuuuaaauuguacaaaagaagucaucacugugggauucauauuccauacacaaaacacacacagacacauacacacacaaacuccucaaucaaccucuguagugcccuuuuuauaccuuuucuauuuuucagauuauccaaagaaaauaaugcaaacauaucuuugcaaccucuuccauucaccaauuuuaauccagccaugaaaagcaacccagcauuuguauagaaaucaauguauuuaaaauuauuuagcugaauauauuaacuuucugauguuaugaacccuaaacaaguucuuauguuauauguuggguuccauaaagugauaauuuuuguuugagucucuuucaggcuaaaauucagagacucuaauuaguucuuucuuuuggaaggccacauuaauauguacuuuauuucacuagacaguuaauucucauuuccauuucagacaagauuccugugcuaagagaagaaaaacuaccugugguaggaauuggaaagcaucugugugguauggcaacagguacguaaacauacugauaauguuuacauuaaugcauuaaguuuuggccuaaccuggccccaaccauuucaguggucucuuuugaauagauaucuuauguuuacaacucaauaaucuuuauagagcacuggcccugugcuuuauuagaugcauagcuuuccuauuuaucugcucauauuggccauuuugcaggaugaauuaagaguuuuguauguaaauacugcaucacauuagaccuuaaaguucuuuggguuaaauuucaaccagaaaaggaaaauaagaccauuuauggaaacuguaugauuccaccuagaagcuacugauuuuuuagaguaguugcuuagaaagaacucagaaaccucuucuacuaaaagacuauuguguuucaggauucuggggaaaaagaaaaaaauaaauguuagacaaaaaaaaaaaaucuaagaugucuugucuuagcacuuugauccaucagaucuagcaugguaaaguggaaacagcaugugcuuuagaaucagauagucuagccuucagcuuuguuguguaaccuugucaaauuacuuaaccuuucugagcuuugguuaccucaucuauaaaacagagauacuaauauauuaauaauuuaccggguugcauguaaagugucuggcacauaauagugcucaauaaauguuaauuauuguuacaucaucuuccuaacuuuugcuaguuucaucaucuacccauauggauuacuuggagcauccauagauauuauucauauuggcuggaaauggcauugaguacuauauauuuguguuggccuucauaguuuuuaagacuauagucauguacaacauaacgaugauuuggucaacaauggacucauauaugacagugguccuauaaaauuauaccauauuuuuacuguaccuuuuuuguauuuagauacacaaauaccauuguguuacaguugccuacaguauucaguaacaugcuguacagguuuguagcuuaggagcaauaggcugugccauacacccuagguguguaguaggcuacacuacaccaucuagguuuguguaguacacucugauguuccuacaaugaugaaaucgccuaaugcauuucccaaaacauacaccaauaguuaagcaaugcaugacuguacuuuugcauaccuuaucucauuuaagccucauaaaagucuucuaaaguaaaccaguuccaucccggggguaggagggaguacacucuuuugaccuacaguggccauuucucauguuccacauaauuuuuucccuugauucacuguaucugaauccuccuuuugucucugcugcaguugcuuacccuuuuugaaauuccauuuucuucucuuuugcgauacucuuauuuccugguucuuccccuacaucuaugccauucuucuguuuauuucacagucuccuuccacuucuguccuuaaaauacuaauauucaggccaggcacaguggcuuaugccuggaaacccaacacuggaggcugaggugagaugauugcuugaggcuaggaguucaggauuagcuugggcacauaggaagaccccaucucuacagaaauuuguugggcacgauagcuugugcauguagucccagcuauucaggaggcugaggugggaggaucacuugagccuaagagucugagucugcagucaacugggauagcaccacugcacugcagccugggugacagagcaagacccuaucucaaucggucaaucaaucucagacccaucugcuacacaacuaaugugucuuucccuuuaaacucuucgguacuuccugauauaguccaaacucuuugacauaacguuuuagucucaaucuggcuucagccuuccucucuuuacauucccugucuccuacuuugcuguucagcaacaucaaacccugugugcuuuuccauagacuguacuauuucuacuauaucuggaauuucacccccauucaccuacucacccaaacaaaacaacuggucaauuuuuacucauccuucaccucaguugucaccacucucagggagcucccuuaaauaagauaugccuccuugguguuaucauaauacccucugcauauuuuuaccuugugguauuuuaauuaucuguuuauauaucuaauucuuccaccaugcucugaauuuuuugaguauaugguauauacuuaguacgaugcuugcuauauaacaggaacacagugaauauuugaaugaaugaauaaucuuggcuaccaauuugcuguguuuccuugucccuuucugcauauguggcuuugucuuuuaaguucuuuauaaaagaugaauugagauaaauugcuaaagcuccuucuaauucugaaauaacuuaauucuuuuuuuuuuuucuucgagacggagucucgcucugucgcccagacuggagugcaguggcgcaaucucggcucacugcaaccuccgccucccggcuucaagcgauucuccugccucagccucccgaauugcugggacuacagacucgugccaccacgcccggcuaauuuuuguauuuuuaguagagacgggauuucaccguguuagccaggaaggucuccaucuccugaccucgugaucugcccaccucagccggcgugagcuacugcgccuggccugaaauaacuuaauucuuuuaauaauuuaucugguuauucacauuucugaaaaucacuuacuuaagucaaauaugaauaaaacaaugacuaaauguauuuugucagaaaauaauaguuuaugaaauaauagauuagcuaucacuuucugcaaauaauggguuucuaauguuuguugacuuaaauucauauauugaauuaaauuuacuagugaaauaucagaucauuuaauagucauuugugauaucuuaggguaauaaaauuuuaaaauauguauauguuuuugauugaacagacacaacaugacaaucuaaugauuaagaagauauggguccuacauuuugggucuuuccaguauugucaacaguguaggaguuuucgaugggaaauagccauagucaucaaaaauccauuuauuuaguuuuaaaauauacuaaaauauuuucauuguaauguggaguacaucugccucuuaaguuuguguauauuaauaauuguauccucagugcuuugcacaugaaaggcauucaguaaauguuuguuaaauaaaugaauaaauacaguaaggcuacucagugaggccugcuuuccagauucuguucugacgcccucuuuucaacucuucaguucaucacuauuugcuaugagccucuucaagacaagcaucuugaccuagcaucaaccuaaacagauuugucugcccuuccucccucccuuccuuccuuccuucauuuuuccuuucuuaaacuagaauguaaguguaggugaauaaaguuuucccauacaagucauuuccucagcuaagguaggaaaagugagagacaauucagguaguuggguaaaaguucuucaaauuguagaucuuaagcuucagauagcuuuauugggaaguaggcuuuaugcagaauaaaucauuaaagaaauugagaagauagaagagcaaauuugaaugaaguugauaauucaugauaguauuauuacaaauauaaagcugaguagguuuuugcuguuuuuauuguugaguuuuuaaaaacaguacugcuuaauaaauguaaaaaguauuuauuuuuaaagaugaugugguuugggggggccacauaauuguguuugcagaucuugcauuacgauguuugguugaaaccuaugcugccaguuuugaggaaaggaaugaagaaccuuuagccaaacgcauaaagaaugauaaaacagaaaaagaaauuuacacuuuggccaaggaaggaaaugaaaaaaaugucccagagaaguggaacccuguggcuggcauuguuauugcacucuguugucaccacaggugugauuggagacauuaugugggcaaagaauauuucagggcucuaggccuuggagcaguggaauuccauuauuuccagcgaaugaguaguugggcaacuugugggaugcggaaaacaucuuuggaaaccucaaauaguaccacaaagaggcaagauaaucagaaugaugauagugaagagcaugaugauggaggauacagaaucacagaugauggcgcugauuguuugccuggguaagagacuacuuuuguaaugcaugauacuaaaggagaaauauuauauuguacuguacuuuagaugacuauuaucaacaauucaugaaaauguauuuuauaaucuaauuuuagaauaagcuaaaauauacacaucuuuuauuguggucauaaauauaaugugucuuggaagcaugggacaaaguacuuaguacauuauggguuaguuaacagucucucaauaaauagugacaaaaauaauuuuuuauaaacuuuugcaaaauuuuaacaauguuuuguguguguuuauucaauuuaggcuucuuaguguugaagaaaagaagaaaauagggcaucuuuguaaauugcugauugaccaaggucgaauccaguauuugcagcagaagggauucaguccugcuuugcaguacuauacagacccucuggugucuuuggaaaauguuuuguuaacugcuuuaccaaaucauucuucaucaccagaaacaacugcuuaauggaaaagaaauuugagcaucaucugucuuccaccaaaaaaaauuuuuuaauuauauuuuuauaucaaaaaaauauauacuuuaaauagcaaauaauaugaacuuuaaaaaaugcuguggccucauuaaacuuugguaauagcuuuucuuuuuacuucagaaauccaaacauuagagaauucaccaaaguaauccucuuuagaagggcaucuugaauuauauuauccauccguauuuauggagauugguaaaguaguugaaccguugacuuggugaucugaaacauacauaacaugucaacacauaauuagcguauuucuguuuguauuaauuuuggaaauuuaucuuccuuugauuuuauuuaauauuuuuuauuucuuaaguucaagagguagugauugauuguaacaagggccaaucugagaauuugacuuauauguggacauuuuucccuacagaucuggaaagcacaauugugauuuucucaaaugcagacaauucagagauauucacaauuaauaaacacaauuaauuaaugaagucaccuucaaauuuccagagccauacauguauauauugucagaaucuguccaugacaaacacaaaacugaagagcuguuuucaaagaaaaaagauuauuucacuuaauuauuuuguuggauaauugucuaguuagaacuuccaaaaagauacuuacaaacauaauucacaaauuugaaauaauuucugaaguugauuagcuaucucauaucuuuuaucaggucauuuuuuauauauguaggcacaaacaauaaguauguucucuucuguuugggaaaauaauuuggaauaaaauagaaauuagauaaugaaaccaaaaaccuucucaaauuuaggccuuauuuaacucaugacugguuucuaugcacaagaaaauacuaaaccaaauauaugguaggacuguuauucucuucugcaucuuaucccuauuuuguuucugccuuuauuuguaaaaauugucuuaauugaugguacauuugccaagacaaagguucagaauuacuaauuuuagauauuaugauauucugaaauaacuauuuuuauccuguaguucuaugauuauaugauuuguaaauaagaagccuaaccaauuuaaaauuccugacuuuagucucauauaucuugucagacugucucgguucaaauuccaaaccuaccaucuucaguugugcgaccuugggcaugcuaccuaaucucuuugugccucaauuuccuccuuuuaaaauggggaugaugaugauaacaauaauaccuaccucacaagguuguugugagcaucaaaugagauaacacaaguaaaaugcauagaacaguuccaagcacagaguaauucaauaaauauuaacuaguaauaguagugguaguaacucgugaaucuuuuuaauaacauaauaggcuuugauuuuauuaucucuuuaaguuguuaacuuuuuucccuuguuauaaguuuuaugucaaguaagguaguuuguuuaaguuaguuacccauguccccaaucaagggaaccuaaaugaagauauaucauuaaauaauuaaccuuuuuuuauugugucaagcaauacuaauuugugucauaaaauuuguuuugcaucauucaacaauuuaugcccagaaauaaacaauauucuacaacaggcauaaucucauuuauguuugauaaaauauacauacacacccaagaauuaucauacagaaacaguucuguggcccauuuagcuuaaugguauguuucugacaaugguaucaaguaccuuaaaggaagauaaguuuguccuucaacaugccagccuuaggucaggauuauuguuuuccuaacuguuaauuugucuucacauaucaugagaaagugacugugggauaugcauacagcuauuucuuguccugcagaauuuucagauucaacaaaccucuucuugaacuucagauucaccugcacaauuaccacaacuugcauguuccacaggugcaucaaauuuacugcuaagggccaggugugguggcuuacaccuguaaucccagcacuuugggaggccaaggcaggugaaucaccugaggucaggaguucgagaccagccugaccaauauggugaaacccugucucuacuaaaaauacgaaauuaguggggcguggcgugguggugcaugccuguaagcuacucaggaggcugaggcaggagaaucacuugaaccugggaggcgaaauuugccaagugagccgagauugcaccauugcacucuagccugggcaaccagagagaaacuccucaaaaaaaaaaaaaaaaaaaaaaaagacugccaaaauuagaaaucaucuucugccucuaccaccugauucuauucgccaacccaucuucuguacuucauucuccaucuuagcaccaccaucuauccaguugcccucuaaaccaaaaacauucauuguaaacucccuuuucucaucuucauucaauuaccaauucugucuccuaauugucuuuauauauucucugcuuuccaaaacuaggucacaauuaugacuuuuuugccugucuucccccaaucugucuccaugucauugcuucuaugaccuugcugcaauaaaucuaaucaccauuuccuaaacauccuccacugaauguuaguaaaaauuauuuccuuuagcugaaaaacucugucauugucuucucaguuauauucauuuuucaaacuaguuguugcauuaaguugaacuaaaaucuaccuuuuaaguuaaaaauucuuaacauuuuaaaauuauaagacuaugauuucuguuacuauuguuucauuguuuuuauuaacaaauaauugugcacuuuguccucuuccccugaucuugguuuagcuuaaaggcccucaauuaauuaucagagacuaagugauugaaaucucuauaucaaaaccucacacuuuguucauuaaaaucuguguucucagccagacgugguggcaugcacugauagccccaguuacuucagaggcugaggucggaugaucucuugagcccaggaguucaaggcuacagugagcuaugauugugccuuugaauagccacugcacuccagccugggcaacauaguaagaccucaucucuuuaaaacaaacaaacaaacaaacaaacaaaaaacuguguucucaauauuuuucaucccuag

SEQ ID NO: 13822 - RNA, 1016 nt, Homo sapiens
cucuaaauaccccaacuuaaaugcuaaauggcugauacuuucucacuucaaaaacaguagugaauaauguuuaaaaguacugcaaacaagcucaaaacaugauucagauuuaguacaguuuucuuaagaguuuuuuuuuuuaaaugcaaacaauucauuuaccauuucuuuguuuuagugcaucugcauuaaggcuuugaauuauuugacccaagauuuuacaauauuaaaaucugacucaaaauuuuacaauguuaaaacaaauagguccacaaccauacuaccuacugugucucacugagucagcauagaguuaaagcucaacaccuuaaggaaaugguagcagagacauuugcuaauaucuaagaaguuacauauauaguuuuuaauuaaaggauguauaauaaaacaaauagcuuaguggcaagaaauuggugcuaauaaacaaaagguuuuucaaaagaaauuguaacaucuuuggaaaacugucugguucuaaguucccacuuccuuuaguucccacggaguucaugcagauacauuucuuaagacaaucuuaaaguacacuguggauggaaauggaauguacauccagaacuagaggugaaaacuaagaccugggugcugauagaaaaaucuuccugauuucagucgucacacauuuguguccuggaguaaagguucuuuggccucuccuggcgcuuguguauuaugaggauggcugugacugccacagugcuuucuccaacugcuggaccuuaagcuuaaauugguauguuccggaauaaacaaggcaacaagcagagccagcaguacugaacaggcuccaaauaggaagggagggccagggaugauggaauucugaggaagaauaaaguaauuaggauuuuuacacaaauacuuuuacucauaaggagaaacuacauaccuuuuaguauuaacuuaugaauuacaagcuaauugcucuucucuuuauuaaagccauaauuauaaaaggcauucccuuuuuaggagaa

SEQ ID NO: 13823 - RNA, 3277 nt, Homo sapiens
ccaggcauuuggaaaaucuucacauacugacgugugguuucaguuuaaaaggugcugcuaaauagagacagaaacaagcucaaauauucccaaaugaugcuugcaucugaaagaagaggcagauaugucaagcuuuauucuaaucuaccacuaaaucugucugaucucaucaucaaguauuuauuaauaaucuaacauuuaugugcauacuauacuauguuaaaugacaagaagacagagcaucauuaaguauacuguacaacaaucuuaaguuguauagucuuauuacaaagccaggcauccacccauagagaguaaacucugguaucaucugcuuuguuccaaauauguguaaacaaaaacaaaaaugcuauauucagcuauuauauaaggugaaauaugauaauuguucaaaccaaauagcauugguaccuaaaguuggagaaauuaaaauuggggaagaagucagauuuuaacagucuaagauuugauguaauggauauaaugaaguaaaggcacuaauauuagaaagauggaguaagaugagggaguuuccacaacugagcauacaacaguauagugauguaguuucaaauauuggacuaaaggauacuaauuauauuaaauaauccuguaaaacuaucaaaagagauguugaauuuuaggaaggaaacucugauagagggcagugaaaagaauggagugaaggugugggagacaaguuggaaaguuuuaauaauccagaugauuguuauaagacugaaauaggacaagaacagaaugaauggaaagcaagaaguagaugauguugcagagauugaaauaaaaauauugcacauacaaauagauguuuggacagauaaaauugguaaagaucuuaguaacuaguauuuguuacagguuuuuacaucuauauucaugaguaauauugucugaaauuuuauuucuuuuagugucuugucugguauaggugcgggauaaugccagccuaauacugaguuuaaaugucuuucuaucucaucuguuuccugcaaggauuuguguagaauuguuacuauuucuuccuugaauauucaguagaauucacuaauagaauccaauucuuuaauagauacagagcuacuucuucuugagugagcuuuggagguuucugucuuucaaggaauuuguccauuucauugauuuaugaaaacuauuggcaacaguuuuucauaauauuuuuucuucuuccuuuauuuucaugucauuugcaguuauauucucucuauuucugacauuggugauuuguguguucauucuguuuuuacuugagcaguuuggcaagaaguuuauuaauuuuauggaucucaucaaauaauuagcuuucaguuucacugauuuuccucuauugguuuugugucuccuauuucaaugauuucugauuuuaucuguauuguuuccuuucuuuugcuuucuuugaauugaaauuguaccucuuuuuauguauuguuaagauggaaauuuauaacauuaauuugagaacuuucuuuuuuaauaaagacauuugaugcuuaauuuccuuuuuuuuuuuuuuuuuuuuuuuuugugacggagucucacucuguugcccaggcuggagugcaguggcgcgaucucggcuaacugcaaaccugccucccggguucacgccauucuccugccucagccucccgaguagcugggacuacaggcgccugccaccacaccuggcuaauuuuuucuauuuuuuaguagagacgggguuucacucuguuagccaggauggucucgaucuccugaccucgugauucgcccgccucggccucccaaagugcugggauuacaggcgugagcuacugcgcccgaccuaauuuccuuuuuacaacuguauuagcugcacccugaaaauuuugauauauuuguuuucuaaaguucguaauuucaaaauaguaucgguucccauuuaaucacuaugaaaauuauuuggccuugguagggaagauauaauuauuauauagauuacaacauucuagaaaugaagauucaggcaaaucauacucagaucuggguuuucaaaccagauaaucugcuucuaagcaucuugcucuucacacuauaccacauggcuucgugggcuacuuuacaaguucucaaguguggaagacuugaagaaaguugaauauauaagccaaaguuuugaauacagaaagagaaacagauuuuuuuuuuuuuuuggaggggaaguuaguuguuuuauccuauggugagcugaagcuauugaugugagaaauaaaagggcugucuggauaaaugcucauaccuugaaacaucaugaaaucugcucuuagagacuauuucauccagaagaaaggcacuucccauuuucuauuucugagauaccguuaauugaauuggacuaaauauuguuucguuuuccucccaacuacagcuuuccauauucagguacagacuucaguucuaaagaagcaaacaauuagaaauaggauacugaagauggcacagugguuuucagauauauaaaaucuaugaguauguccuaacagaaaguuguagaacccagaaaaccucugcucaguaugcauccuagucaauuacauguuauacaaagauauuuacauuauuauggaguaucagaguaucaaucaagagcauaaaaagauguccucucaaaggaggaagggaauaggcaaaaucugauagaaacugaaauguaugggaaauauacauguauuauccucccugucaaauuuacgucugaaaagguuuuccagaaucacuguuggaaaaugugcugggacaagacgguuugcucaccaucuuaacugacacacuguaaguguaauuaguuauugucuucuuuaagaaugaggaaaauaaauaaaauaaaggccaaacuugaauacgugaaaacaauaaaaaauaauagaaagaaaagagcuucuggauaacuuaguagaagaauuuuguuucugaaaggauuugcugcaggaaccagaaaaaaauacuaucagaauacaauuagcacucacggaaguacacaagaaagcauuauuuuuaauaaaagaaggauaaaacuauguuaagagacaauguucauaugaaaugguaagagaguaacuuaaaauauuaaaggauggugaugaaauuuaaaauuauauuaacaggaugaaaauccaaaaagccuaauaauaacguacaggcugaacuuggagaucaaccagaaacagaagaaaagaauauuaaaacaguagaagauuua

SEQ ID NO: 13824 - RNA, 3634 nt, Homo sapiens
ugacugaacuuuuucauuuauccagugcucaaccucaacuuuaucugcauucuauuuccaaguugauugcuuuucugauacuuuuuuuuuuuuagguggagucucucuuguugcccuggcuggagugcaguggauccaucuggacucacugcagccuccgccucccgaguagcugggaucacaggcgcgugccaccaugccuggcugaauuuuauuuauuuuauuuuauuuauuuuuuauuuuuuaagacggagucuugcuuugucgccuaggcuggagugcaguggcgcgaucucgggucacugcaaccuccgccucccggguucacgccauucuccugccucagccucccgaguagcugggacuacaggcgcccaccaccacgcccggcuaauuuuuuguauuuuuuuuuuuaguagagacaggguuucaccguguuagccaggauggucucgaucuccggaccucgugguccgcccgccucggccuccgaaagugcugggauuacaggcgugagccacugcgcccggccuuuuuuuuuuuuuuuuuuuuuuuuugagacagagucuuguucugucccccaggcuggagugcaguggcgcgaucucggcucacugcaagcuccaccuccuggguucacaccauucuccugccucagccucccgaguagcuggcacuacaggcgccugccaccaugacuggcuaauuuuuuguauuuuuaguagagacgggguuucaccauguuggccaggcuggucucaaucuccugaccucgugauccgcgcgucucggccucccaaggugcugggauuacaggcgugagccacaggugccuggccuucugauacuuuuuuuuaaacaagcucuugagggcuuuauuagucauuuagcccacauuuauugaaucccugcugccuacagacuuugucaggguuucagagacaccgcuacccauggccucuaggagcuuacaguguagagagguucuuuugacuauuuuuugaugauaggugaaacuuacugucccuguauguggcuucuauugaauaaaaaaaaaagaaaaaacacugccauguaugagaaagugacucaguuuucacuuagcuuucagauacauuauguacauguuuggggcaugagauuuaucguucuaauguuauauuguagcuaccauuaaaauuggcuuucugaccauaaauugguuaaccuuuaagaagguagucuaggccuggcgcguggcucaugccuguaaucccagcacuuugggaggccgaggcgggcagaucaccugaggucaggaguucaagaccagccuggccaacauggcgaaaccccaucucuacuaaaaauacaaaaauuagcugggcaugguggcacacgccugugauccuugcuacucgggaggcugaggcaggagaaucacuugaacccgggaggcggagguugcagugagccaagaucucaccauucauugcacugcagccuggguaacaagagugaaacucugucucagaaaaaaaaaaaaaaaguagucuaaaaaugggcuggauguugugagaaaaccauuuaagauuaagauccuucaugauauccauuggguguguuauucacugaaggacagggaguugacuuccauuuauuccuucuugcauucauccacucacauccacucauugggcacuguuauguuccaggcacuaugcaccuauuaguguaauggaguugcuuucuuuuuagugcccagccugacuuguaucuuuugaaacaauuguuuaaaauccauaugaagggguuuacucacuuuuaguguuuucuugucaucccucuucugauuggauaauucuucaccaucucccucucugucuccacuguucucuuuauugauaauuacuucugccugaggcagcuauuugaagagaucaucaguuuuccuaaauuccuuuauuauggcucaguugggaauauccuggaaaaaugaaccugcaauuucccaucacaccuuaaagaacugguaauggucugggucauuaguacacagcugagcauaaaacacugcugaagggucagagaaaacccaaaaauguaagcauagaaagaaaacaguuucuuaaucuugagaacacugugaacccuuuaucugcuguuaaauugagcaugacuuucaagccaugccuccuaauuaguuuaauuccauguucuggcaucaauaaguaauugaauuauaaaagaauucaguguaacaacuuaggacauuuuguugcugagagguagaauaauucagugauugaaauggggauguuugauguucacaagugggaauuaaggggguaagguaaaggccuuuuuuuuuuuucccaugauuuucguaacaucuuuuuacaaaguaaggacuucuuuaacagaccacaguaaacaugcagcagacugcuggcuaccacucaccaucacugucaguuuggguuggaggauacacacuugauaccagaacacucuaaacacuaguucuuuucuggccucccccaaauaagguucucccuuuugccacuggaaucaggagaauguugcagaggaauugcauuccugguaacaagauaacccagcaagacucagacugcuaacccaaggaucaacuauuaaggccguaagauugaagaagcuaaauaauuggauuccauuuagcuggacuaauuuuaugcugagaauuucaggggauuuuaucugccuuuugaucucuuuacaaugguuauaguaagcuucuaguaagaggcauaaccaucucuuaggggugcaaauuaaguaagucccuacacucccaucuacaagggagggcuguggauagaccacauuagggauauucuguuuuucuguaugcauuguagucaguccaggugccagauuugauggggugaccugccauguacgugauacuugaaaugcaucuuacuugaugagggguacuauuggucuuacuucacagagaagauaacugauacucagacugguuaaauaaccaccaggcuccagguguaugggccuuugcacugcaucaugcuccuuaauagagagauggggcuguugcaucaggaaaauaguucuuggaaagcaaggaaauacuugugcagaaagagcgauaaugagcacccagagaaaagauaugagugugagccaacuuauguucagaacaaucccaaaggggaguguuugugcauguauguguggaucuaugagaggcgugagauugguauuguaucaccauuuuccugaugaggaaauugagugacacagauuauguggccauagucaauguucguuauaugugggaguugugcuucuggaaagaaucuuacagauaaaaaaguuguaagaugggagaacccaauaucauguaauagguuuucacagaagcugcagagugaauuuuuguauuuuagcaacacuaauguucaaauuaguuugggccuucuuauaaaaugaaucaugacugucacacauugaccccucuaaaucugcucagcucgguuuuaugcugauugucaguauugagcugacuucuauaaaaccgaugagauugcuacuuuuagcuucauuuauuuuuaguuuuuuuuuuuuucuucugaagcuacauugaaacuua

SEQ ID NO: 13825 - RNA, 15666 nt, Homo sapiens
uaaugaggacaucaguguaauaauagcuuuggggaagcauaaaacaccacaauaaauauauaugucaaauauaagaugccucacuauuuggaaauguuaaacauuuugugaaaaauaaaacauaaagauggucggcugggugcaguggcucacaccuguaaucccagagcuuugggaggccaaggcaggaggacugcuugagcccaagaguucaagaacagccugggcaacauagcaagaccaccucucuacaaaaaaauauaauuaaaaaauuagcugaccaugguggugcacaccuguaguccuagauacucaggcgguugaggcaggaggauugcuugagccaggaguucaaagguacagugagcuaugaucacaccacugcacucuagccuagguaacagagcaagucccugucucaaaaaaaaauaauuaauuaaaauaaagaugagggaaaauacccuagaaucaaugaagaaaaccacacaguuugucuugacaacacagccacuggccugcagugccaucugcuguaaagaaguggcaacuacaguagcccucaaugccaggguuuuaccagggcaggagggcuaguaaccucuucguuacccaggugucucagagugccaguguccacgucacggauauggaauaaagggggaaauacaaauaaaaguaaaagauaagaggaagaaaaauaaagaagauggaagagaaaaauaaaaauaaaauagggagguggugucaucaucccugucauuaggagacuaccucuuacccgccagguauuuugcacauuuuaucuacaaccuauuuuguugaucugucuuaccaggggcuugccuuuuuuauuuuuccagucuuuucaaagaacaagcuuuuauuuuuauugaucaucgguauugcguuuuuguuuuguauuucacucauuucugcuagcguuucuucccucuacuuacuucggauaauuaguuuccauacauaugccaugugauuuuaaauccuagcauuucagagcuggaaggagaucaagaaaaaccuggcucuccucucucauuuuacaaagagacccagagaaagaggaaauuugccguauguccuacagcuggugccucguuuccacacagaugaguaauugcuccuccuccauucauaccauguuccccucuuccucuucuuucccuccucccuuuccuuuucugcuuucccucacucagaacagaaaaagauagcauuguugugagacagaguaggcgugggacugggccucccucccccgugccccaccaaggaccuuuacugcaagcugguggggaccccaaucagaccauucagaccuugcaccauaaaucuuguucaagacgccacacccacugauuggagggucuugaagaagcuaaaauaagcagcucucaccaucaauccuacucaagggaguuaacccuaucucccgcaugccucaaggccagaagaauggaguaaucuuuaaccuuagcuucauuaugguaggaaaaaucacacccaggggugaagauugaacaugcuaaugagacaugugacaugugaagaagcauguuaugaacugcacaggggcuaaaauuuccccgccucuacauaccuaaacaucacuuucccaccauagccccuuuaaaacugccucucuaacuccuccagggccagccagacucagucucucucucucucaagccuuguuuaggaaaacucuuuuggccucgggucaauuucuauuguauuaaaagcccaagaacccauggcugguaacaguuggacugauaaaauucaggauaaauaggcaaacuucccccuuaaaagaucuaaauuuaaaaucauagugcaucaaauuuuguacauuugugcuggaaguuagugguuuuccuguuuuuacaacacuacacauguacuccaaauagacaagguuaccaaaugcaaacaaauuuuagaaaacaaaauucaaccugccucuuuagaagcuuauacuuguaccuauuaaaaauggugauauucagcugggcaugguggcucacaccuguaaucccagcccuuuggaaggcugaggcgggcagaucacgaggucaggagauugagaccauccuggccaacauggugaaaccccagucuuuacuaaaauacaaaaaauuagccgggugugguggugcaugcagguagucccagcuacucgggaggcugaggcagggaauugcuugaacccaggagguggagauugcagugagucaagauugugccaaugcacuccaaccuggggacagagcgaggcuccgucucaaaaaaaaaaaauguugacauuuauuucagauauuuggcaaaaaacaaaaauagaugguaucuuggcagucaaaauguaaacauaggccaggugugguggcucacgccuguaaucccagcaccuugggaggccgagguggguagaucacgaggucaggaguucaagaucagccuggccaauguggugauacugcgucucuccuaaaaauacaaaauuagcuggacgugguagcaggcaccuguaaucccggcuacucaggaggcugaggcaggagaaucacuugaaccugggcgguggagguugccacugcacuacagccugggcgacagagugagacuccaucucaaaaaaagaaaaaaaaugaaaauguaguuuuacauuuccaguuaaacaaaugaacauugcaggucauaaaauucacugaauguugcaguaagcuggcucugggaaagauaaacagaggcugcgguuugaccugugggccccugcccugccuuucaugacacugcucucagccuucagaagcccugguggccuugugguguagcucucuuccucuaaaaaccugagauaagaaacguaucuggcauuagucauuuacaucuuauuauggauuuauuacucaaaugcccucucccagggccauuuguauuuuaauuuuuucuccaauguguguuaaaaaguuguccucucuaagacagcauuuuagguacauuaaucagguaggguaggcacgagagaggagggcuuuucaagugccuugacaaucauuccacccacuuaccuaagacccugcauauuucaaaacaaauuaaguuguccaugucgucaaaaaauguagucuuuaacagcacuacccagaacugcugcguuuuuuuuuuuuuuuggccaguguuaauacuuguuacacacaccacacacacacacacacggguacuuuggucaaaucucuaguauacugaugaacacugcaauaaaugggauacagaacaauauuucuaaaccauaucuaaccacaggauauuuuuuucaauagcgccuccaggucuaccguuccucagaacaugcaagagagaccaggucauaaucucccuucuguucagucuccagcaccauaaaagaauaauuugaaaugccuuccugcuagaacucucauuacucauuaaaagacacagaaagaagaaaauggucucucaagacugguacucagagugucucagagugccagcaagugcuucagcaagaggcaucccagacacagguagaaaugcuuggugaagguaaguaggaaauuucuugagguuguucauaggaaggcucugcccugcacaaaugcagaaauguaggagacaauagaugugauuaacauaaaaacaccacuaauauccaacuaaauggaaauggugagacaaaagaaagccaacaaauuagaccaaccaguccccagcaguucauacaucuuaucuucaguagaauucaaggacuuagcagucugacuguucuauccuucuauacuauggucagagagucuaugguuagauuguuugguuuagucuauaaagaaccaaccucaauuuuauuuuauuuuuauuuuuuuaaacuuaaaaaaagagagagcaagagacagggucuugcuaugcuccccaggcuggucuugcauuccuggccucaagcaauccucccucucagccucccacaaggcugguauuacaggcauuagccacugcaccuggccuuuuuuaacuuuuauuuuagauuuagaggguacaugugcagguuugucaccugggcauauugcaugaugcugagguuugagguacaaaugaucccauuacucagguaauaagcauaauaaccaguaguuaguuuucuaauccuugcucuccucguucacucccccaauagucccuaguuucuauuguugccaucuuuauguccauaaauuccaaauguuuagccaaccucaacuuuaaaaucacacauuaaaaaaaaguguagaguuaaaaaguuccagaugacucccuaccauacaccaucauuuuuuguaauauccccuaaaaagcaaacuaaauuauguuauuuaaggagugaaauaaucuaaaauaauaaguauguuuaaguaggcugggcgcgguggcucaugccuguaaucccagcacuuugggaggccgaggcgggcagaucaccugaggucaggaguuugaaaccagucuagccuacacagcaaaaccccgucucuacuaagaauacaaaaauuagccgggcgugguggugcgugccuguaaucccagcuacucaggaggcugaagcacaagaaucacuugaacccaggaggcagagguugcagugagccaagaucacaccacugcauuccagccugagugacagagugagacuccgucucaaaaaaaaaaaaaaaaagguauguuuaaguaaggggguaaacaaaacugagaacagugguuaccucugagauugaaagcuuagcaggaguuguguccaaggagaagcauuaugggaauauucuaguuauuuaauuggguagugaguuuagguguguucaugucauuaugccuuauaacuuaguauauaccccauguguacuacaguuuuuauuaugcaauguuugauauaugcaaaagaauauauuaacauaaauaauguaaugugacauauauaaucuuuuguaacuaaaaaauauuuuuuaaccaaacugaaagucccucagggcuaaaggagagacuguguuccaaggaacacauuuaagaagggagccugguggcuauacuguucccuugccucaccuccccauaagaauuuuccugcuggggcugggcaugguggcucacaccuguaaucccagcacuuugggaggccaaggcagguggauuaucugaggucaggaguucgagaccagccuggccaacaugacaaaaccccaucucuacuaaaaauacaaaaauuagccagaugugguggagcaugccuguaaucccagcuacuugggaggcugaggcaggagaaauaguugaaccugggaggcggaaguugcaguaagcugagaucgugccauugcacuccagccugggcaacggaacgaaacuucaucucaaaaaaaaaaaaaaaaaguauuuuccugcuggaaucuugcugcccccaccaagccuacccuugcucccugcucuucagagguacaaggggaacacaagccccucuccuuccaguccuuugagcacaaccaagacaggguagcauuuucuaaaagcuguucuacaaagugggagcaaaugagaaagauacaaucacagaaaggcaaacggcuucuugguguggcaugcugggcccuaacggcugaguuaguucugcccucagaaguauaccuucucucccucccuccuucucccccuuauuuucauccuccagugauacuacauggcuggggguccccugcugcuccaugccccuagcccuuuagccaugcucucucuucugccugggaagcccuccccaccuuucucuaucuugccauuucuuguucaucuugcaccauucaacucaggcccccucucccaggaaggcuucuuggaacccugggacugggcaaagaacccgcaucagccugccucaucauuaacccucaacugagcuugaccucgcuggagugggcaaauauuccuucuugguguucgugccccuugaguuggcccaaguccuggcacaaagcaagugcugagucaaucccuguugaauaaagauaggcuaaaauuaaucaagguucccccagagaccagauuucuaauccaaagauuucaaggagaaaagaaggucuucugaggcugaaacuuccucauccugaaaugaccaggauccagauuuaaagagcugggaguccuuugcacacacaccuugcuugguuuccuuccccccaccucccucccugucucagccaagugcuccccagugccuccuuaucuauccaguauaucuugggccauuucuggaccaaguacaaagacccaagaccucuugcauccuucaucucaucucuggcuuccagucugagguacaagcccccauggcugacaggaaaggcaagauggggaaggaucugguccuucugagucagugauccugcccgcacuggagccucugauaacugacucuuguaaggugagccccuucuuagucugggacgagaaauugcuccaucagagucuaacaucaugguauuuuauccagagggcaucaggcccaaagcauggugggaacucagccacaggagcugaugaggaggguaaggaagccugggaaaagugggaugaagggugggaaguucuggccuuucuuagugcuggccccaaaguacagugucaauaagauucacaggcugaagcuuaggucaagcuucagucugcaucugggagaccugccccaaagagguaauagucagacacuugaaagcaaagcaggcaaccugaguggcccuaacugcaucuuugugugaccagauugggacagaagcaagaucucaacaucuucagagagcaccuagaaguuuuagaaaaaggugccaaaggccuuuggaagagaugcagauuagaauauaagacaaacaugaaaaucaugagaaaguuaggaacagaugggcaggaggggaaugugagguauaggaugaagaaacacacagagaagaggaaaaacuguuaaggccaaagugcuacagaagcuccaggggccugcaugggguuggagugaagagauugagggugggaaacugugagagcuuggcaccuuagcugagccaauagaucuggagauacaaugauccuaaggcuaaguaaugauguugccucagugaggaauagagagggucaggcaugagugcccaagcugugggggguagaggggaguaaaaaaaaaaaaggcagaaacaaaagaaacaagguagguauguucaagagcaggugcauccauacagaaguguuaagcaugucuacuucccaaguggaagcucaggagguggcaugcauugucaucaucugugggaguacagucaggguggugggaaaaauuguagaggaaaaauuauaaagauaguuauagaaaauaaacacaaacccuccuggaaggcugggggguuugcauggcuucaguaccagauuuggcugaaggcagccuaauccucuuuaccuuuaguugauagcaaaaaagcaaacaacaagggaauguguggaguugaaauagcuuguuuacucuugugguccuaagaccaaacugaucaaccucaggugcauaauugcucucugcuggggggugggggggucggcaauguuaauuacccucuagugguguuuacucaagaccuuugucauuuaaucuguacuaaauaaaugcaaacuuugccagcuuauggggcaaugcuccagacucagaacagagccccuuagcuggacugacagcuguguuaguguaugucucucauucguugcugggucagggucugcaggucggacccuacagucaucgugugugucuguguguaaaguuagaaaaauaacaaaaguagagaaaauaguuuaaugaacccccagcaauuuaacgaaguuuaaugaacuucagcaauuaucaauggauagucaaucuuguuuccccauaccuccaaccauucuccuuugcccuggauuuuuuaaaaagcaaaucccagagagcauaucauuuuugguauguaaaucuaaaagauaaagacucccuuauuuuagacuuagccccagugccaucaucagacccccaaauucuuuaauauaaauuaguuaauaucaucaaacauccaaucacugcuuacauuuccuacaguguccucuaaaugaucuuucauuuuuucauuugguuuaaucuggaucuaaacaauguccacacauuguaauuaguuaaaauauugguuuccuuuaaucuguagguuuuccacauacucuuuucuuucuuguuaucuuuuugcuguugugguggagauuguugucaaaacacaaugucaaaaucgauuuucccauucuugauuuugccgguggcaucccugagaugucauuugacuuguuccucuauuuccuauauuuauagcaaaguugguagucagauuccacuggauuuuucuggcaugacaauuucacaggcagcgauacguucuucccugggaggagguugauggcugacugccccucuuuuaugauguuuggaaaacugugauauccuaauucuuuuauuccuucugcuucuauaagccacaauaugucuauuaagagaaacuucccucauugauuauuugauuacccuuaaguauuguucguauaagagagguagaauauguguuugauucuuucccuuuaaguuuuugaaaugaguuggucccuagaauuuucuagaggcaaucaauaaggauuuauuuucauuugguauuauugagaauuuaugaauauagacauauucaauguauuucaaggaugggauauuuacaaggguuuuagggucuggcauaagauggguuuuucaaggcagggaugcugauuuaauuggccaguuuguuauauaauaaguugagaacuggcgagaacaaugaaggguaggaaguugaagcgaguuuugaagggcacagucaugugguaacccaguugagugaucuacguauuauccugaugacagcuauuaaccauuagagccuauugcucuaauagguuuuuaggaaauuccuaaaacuggauuuuuuuaaaacaaauaauaaauuuaucugaaaugacaucuuaguucacaaguguaauaauaguucuuucuuccuuuucuuuuucuccaguacaaucuuuacuugguuuugguaucagguugaugcuggccucauaaaaugaccagagcaaauuuugcucuauuucuauuucuggagcaacuuguauguuauagaaauuaacuguuucuuaaaagucccuuaaaagccucuagaucugaguugggguggggggaguuuaggagagauauuuggcugccauuucaauuuaccaaacauuuagugguuuauucaaauucucuauuucuucuuauaucaauuauggcauuuuacauuuuuaggaacauaaccauuuuauuuagguuuacguauauuagggcucauaacacuuuuuaaauguuuuaauauauuuuguuauuuccuccauuauucugucuuauuuugagucuuuccucuuuuuuccugaucagucuugccaaaguuuggucuuuuaaucuuuuccaugggacugacuucuguuuuauucaucuucucuacuuuucucugugucacugauuucugcccauaucuuuauuauugccuuucuucuuguuucacuguguaugcuguugcuucuuguguugaaugcuuagcuacuuuauuuuuaaccuuuuguuuccugauagauauaacccauacaguuccaucuaacugguguuuuagcugugucccaauuugacauguagaauuuuuauuaacauucaauuuuaaauauuucuuaauuuccuuuaugacucaaggauguugucuaguaagauguuuuuugguuuccaaaugagguuuggguaguuuuugguuucuguuuguuuguggguuuuguuuguuuuuugcuauucugcugauaugguuugggucugugucuccacccaaauuucaugucaaauuguaauccccaaauuggugggaggugauuggaucauaggggcugaguucucaugaauggguuagcaccauccccucagugcuauuuucauaauagugaguuauugugggaucuggucauuuaaaaguauauugcaccuuccccaugucucucuccugcuccagccauguaagacaugccugcuuccccuucgccuuccaccaugaauguaaguuuccugaggccucccaagaagcagaagccacuaaacuuccuguauagcaugcagaacugugagccaauuaaaacucuuuucuuuauaaauuacccagucucggguauuucuuuauaguaaugcaagaaugaacuaauacaucugcuguauuauuuauuguaugugaaaaauuaccacauauguagugacuuaaaacaacaugcauuuauuaucuuauaguuucuguuggucaggagucugggcacaaucuaacuggguucucuuucuuuuguaaugucauguaaucaugggaaugacuuuccaucacauuuaccguguauuuuugguguauuaggggucuucagagaagcagaaccaauaggauggauggauggaugauugauagauaagauagacagacugauagauauuauaaagagauuuauuauaaugaauugacucucaugggauuauggaggcuggcaaauccaaaaucugcaaaaccaguguucuaauuuaaguccaaaggcuagaagcugcuguagaacaaggaaaugucaauguuccaguucaaguccaaagaccacuaggaugcuguagacggacagccaauaucccaguucuaaggccaucaggcaggaaaauccucuuacuagguggguggagucagccuuuuguucuauucaggccuucaacugauuggaugaggcccacauacauuagagagggaaagcugcuuuacucaguccaccaauuuaaaugcuaaucucauccagaaacacacucacagaaauacccagaauaauguuugaccaaauaucuggauacccuauggcugaccuauucaaaauaauacauaaaauuaaccaucauaauugguugaaagguacaggucccacccauaucugaagaagggaacuacauaaggguguaaacaccaggagguggaaaucauaggggccuuaaaaucuguccaccacacauacuguuauucauuacuucuaauuuuauugcacugugaaauuuauugagccucccuuuaagaucuaauacacaguuuauguuuuuacuuuaauguuucacauguaccugaaaagagaaaggacauguauucacuguuugauggaaacguauaugaguuauaaauaucuaauggcucaaguuuauuaauuaaauuguacagaccuuguauauuugcuuucuguguguauguguguugggagaggagaggaaguaucuacugucuacuugaucuauuggauacugagaggagccaguuaaaaaucuccaacuauaauucugauuuaucuguuucugccuaaauuucuguuagcugcugcuuaauaaauauuaaagcuguauuguugggcacauuuaugaccucccuuaugaacuuucuaucuuaaguuuuauuuugucagguuuuaaaauuacuacaugagcuuucuuugguucacauuugcacuauauccuuuucaagccuuuuaaccuuuuagugucuguuuuacacaaguuucuuguagaaaacauauugcugaaucccuugcuuucauucaauuugaaagacuguuuuucuuaauugguuaguuuaagccacuuacauuuauuguaauugcugcucuauuuaggaggcagcauagaauagcucuaaguaugguucuaaguauggguucuagauccagaccaccuggguucaggccuugguucugccacuuucuagcaaguuaguuaaucucaguuucaucaucuauaaaaugaggaugaugaaaguaauaguaccuuccucauaagguuauuaugaggaucaaauaagaaacacccagaaaaguaucuggaacauauuagguacacugaaaguaaaaauuauuauuaguaauuuuauuucugcuaucaaauuucauauauucuaauuauugcacuuucuuuuuauuccuuuuuccucugcucucuugccuuucauuugauaaaauuuucuuccacugcuuuaaaaguuacauguuuuauucuuuuuuaacgguaguuacccuuaagaccuacauucacaaauauuuaucccuauugauuuauuaaaguuaacaauuuuuuucgucuuccucccauaugauaguaauuuaacccaguacuacucuaaguacucuaaguaguacuggguuacuuaucucauccauuccagaaugagauuugagcccacauguaaaucaacacacagcuuccuucauugagaaagucuugcuacgaaagugucagcugaaucaaagaguuugcuuaugacauagcugauaugcauucugguacaagcuccuuaucucuuagagaacaauuaaguuuugugaaccacccuuugaauggcacuauuuuagaucacuguccuaucauuuuggccucucauuccugagucccacaccccucacaauauugauauugucuauaauuuuaggucugaaucauuauaaauacacuguucuuuguuuuuagacuuuugaaaagaguuuuuguaagucagguuuaaugaaauacaguuuacauacaauaaaauucaccuuuucuaguguacaguucuacaaauuuugacaaacagauaccacugggucaucaguaccauucucaagauaauggaauauuuccaucacuucagaaaguuucuccagauucccuucacccccagcaccugacaaccauugaucuauuuucugccuuuuccagaaugucacauaaauggaaucauagaguagcuuauuauaucugacuuuuuuucacuuaacaugcauuugagaucauccauguuuuugcauauguaagaagucuguuccuucuuaaugcuuaguuguauuucaucguauagaugcaucacaguuauguauagccacccaccaguuccuggacacuugggugguuccuggucuuuuuucuaacacaacaauaaauucagccuaaauauuuggccacucucaugcuauaucuauuguaucaucuccugaauuuguuucucuucuugcuugauuauguccuccaagaaugucauucaaaugaaucuuucauaagaauauuuuuauuauuaauacauucucacauucuaaugacaauauggcuuaauagaaaauaaguucaaaguuaugcuuuuaaauacuuacauauagaaacauuuugcuugagauaaaccuuuucaaucugaagguuuuuuucuaccuugaaauuuaucuccauuauaucuucaaauauuuccccuucucuguuuuuauauuucuuccuuucuguucuaguuuuacccuagauauaagcuagaaaauuuacaaauaagcuaacuuguuuuuuaaaacauuuucuacugccucuggagguuugcugaaagugcucuuccaauuacuaauucaucgucagcugcaucuuuuagacuauugcacauuacuaauacguagcaucaauauucauucuaauuauuauuuuuaugcuuaauauguuuuaguuucauauuuuuuccugauucauauugcuaauaucauaacucauuuuaaauaaauuuaucaugcuuauuuaaaaaucuugguccaucugcucuacugaucaguuucagauggcauauguuauucaguuguggucuuuuaacaguaguugcacuccuccagugucuaauucuuuguccuaugaauucauguuccccugggguuucaccuacucugucugauaaacaugcauccaggaaggcccagugaguuugcagugggaggguggugugagcccagaaggaaaucgcuggcaccagagaaccacugucuaucauucccaguuucucccacuuacccagaucuuuccuccagucagguuucuacccuuagggagaagcagcaccuaaaggaagcaauuaaccuagcaacccuaaggguggcagggggaaggguagaggcuugauugagaggagguggggggaggucggccugcaguuuuuuuuguuuuucguuuuuuaaauuccucaccccaacagugcuuuugcgcuggucugacacuaccuggaaaacuaugccaccagucgcuucaguggacacuaccauuucaauugcgaagucaggcaaugauuguccuaaggcaaggugggagagaagucagaguaaaccaccucgagagcgccggucucccggagugucuggguucgacuccugccuccacaacuuacugggucuccucgaacaaguugcaucaccaauggccgugccucaguuucccuccuccguagauuaggaauaacaauagcagugagaacagaauccagcacacaguaaaugcugcuuaccuguuugcuauguggaauacgccacuacacuguugcucggcccucaggaagggucugcugagacuuucuacuuccugcucagggcagaggccgaccacccgcccaaggucguggcggcgccggcucagcuuuagucgucaaagugcacauccugggagccgcugccucgaggugguugaggcgagagggcagggaagcgucugagccucuuccucccaccagagcaggaccccagcugacagcgggugagcugggcagaaacccaugccgggaagaggcggacccaguggaccgcagcgcccgcagucgccgggccaggcgcagaggcgaacgggaggcggcgcugcaccgugcccgccccuccccggcccggccccggcuccagccccagccccagccccagccccggccccggccccggcucgcgggcgcugcgucuccgcguacaggaggcggcggcggcucccagucaccggcccccgccggcgagcgcacgaugcacugccugggcgccgaguaccugguaagcgcucgcagccucggcccucgggggaggagccccggggaagggucgagucccccgccuucacgcaccuucccugccggacgcuuccgccuuucccgcgccucggggaucccgcccccgcuuaguaccuuggggccaccuggcggggaggaaccuggacccugcuccagugcuggggcggaggcgggggagacgcgggccgcggggcgcaaacuuggggucguccucaggugcaccuccagguaagcacuuggcggcagggggcuuaacauccgcuccgcgcagagcagguguuucaaaggcugugugaaagagcuucagguggccacguaaaaaaauaauauuaauuuuaaaaauuuagaaaaagauugguuacuuuggccccucuucgaguagauuuggguucgguuuccagguugaguccaccuguuuaucuucuuuuucucaacucucccuuuuucuggaagguuucugcagaaggagccccuaggcaaagggaguggcgaccccagauuuauaggaaaugcacagauacggcaugguuauuccuguucuuucucuuuuggacugguuugguaagugugggugcuugguaggaaagaggccagagugugugugcacgucuggaaauaacucugucccaaauguaaaucguaguuggugcug

SEQ ID NO: 13826 - RNA, 2715 nt, Homo sapiens
caggcuucaaggccuggcuuguuccugcccaaagggacaucggucaggggugaacaccaguaaucgugaucagaacagcucaaaacaucuuguggcaacuacuaagacccuuuauccuacucccucuccccuaaagaucaaugcuuucuggcuuuuugcuuccccuaaacccaggugaucuggcucuugcugaacaaagacagcuuuaaugagccagggcaugaggcugaugcaaccagcuccaucuuuccuggugcccugggaaguaggcaaugauuagccuggaccuugccccacucagcaccagccuggcgucacggugaggacagccucugcagacucggcucuguggagagcaguguggcaggugccugggaagcccuaggcagauaaaggggcaaguugauccgcagccuugcuucucaagacuuccccagcacccacccuaucucugccugauucugaacaaauaagccagcagcucacacaccuucccacaaagagccagagggccugagggaggagagcugggaaaccagggaggacaggaggaaaggacuuugugcaaaaggucagcuccucuuccagccaggcucaguagcuacagaagcugccaaagacaguucuacacauuucccuauaugcaaaucugauugauuucuugcuccgaaagggaaugcaaacaagacuuagugggaggagggcaggcaacaaugccugcgcccucuggcccccuuuguguauugcuguggacaagacguucgccugcccuggugaacacagacaguacauuuaggagugcgugcuguacauauccuggucuaacaguuuccccagauuccucaaggggaugaaagaguauggcuguuaaauggucucuauccggaagcaauauugaucugccuagcacauaaacaaagagacuaaaguacagucuucacagcagauuucucucugcugggccuucugucuucccuuaccaauuucuguuucucuaacuagcuauuaaaauuguauaacugaguaaugcgaagcaaaauuaggcacugugcccuguuuugcuuucuuacgcuaucacacacaauucugccccauucaccucucuaccacuaccaccuaguuccuggugucaccccagaaaucuuauauuacacaagcucaauuuucuguuuuuagcguucaggcaaaaagaaagaaaagaaaaagaaagaauacauacaggacauaaucccaagcucucaaauggcagacucacuaucugaugaucuuggccuucucugagauucuaugaaagucaugggcccuccuucuagagcaaaagacacauacuugcaaugcuuuacaauuagaacuuguccaauccgcuuuacuauguuguuccguuuugcucuguuuuaggcauuuaccagccugaagccguggguuuuuuuuuuuuuuguuuuuuuuuuuuuaaucugagacggaaucucgcucugucgccaggcuggagugcaguggcgcgaucuuggcucacugcaaccucugccucccagguucgagcaauucuccugccucagccucccgaguagcugggacuacaggcacaugccaccacgccaauuuuuuuuuuuuuuuuuuuuguauuuuaguagacacuugguuucaccauguuggccaggaugggcucgaucuccugaccucgugauccgcccaccucggccucccaaagugcugggauuacaggcgugagccacugugcccagccaaagccaugguuuuuaguuucugucucuagugauaaguggaaaagagggaugaggaaggggcuuuacuggcccaaccagaaacagaaacuaagaacccauucucccucuuggacaccucugcuucaggggauucuuguauccacuagaagcccauccauauaccccuuggagucuuauccauccaagaugauucaccaccuacuucccaagauuccuuuucuucuacacuuacuaugcaagcaauuacaccuggagcaaucacuuacuucuccugccaucucagcuccuggguuuucuuugcuguacacuuuucucuuucccuuuccauccacuuuugguaggcaugagcuauguaagcaacuaauaggcaacgaccacaaagcccuucagaggucccucccaugcagagugcugcagaaaugggcagacgggcaucugcgaggcccucuggaggccuuaccagccaggaacagcugccucucucccaccuccacugcgccaguucucugucucacaagcaccucugcaaaauggcaucuuccaaaacugagcugugagacagacaccugcuugucuucaaaauggcucuguaacacacccuggagguaggaggcuagagagcgagccaggauggguucuggucuucaccacuagcuagcugggugacuuuggggaauuaauuaacuucucugagccuuaguuuccuccccagacuuaccaaguuauuguaagcaucaagugagauaucacauggagggccuggcacccaacacauaguaggcacucuacaaacaugagcuuccuucccccuucgaaagaagggacaacaaaccccaucuuccccacuguacucgcagggcacacgcccacccacacgcugggcuacaggaaccacgccuguagccacgagaagagaguggacacccacccaugccaugagccacugaccacuggcuggcucccagcuggu

SEQ ID NO: 13827 - RNA, 25012 nt, Homo sapiens
gaguaaaaagaaguuugaaagagaauguagagaggcagaaaaggcacaacagaguuaugaaagauuggauaaugauacuaaugcaaccaaggcagauguugaaaagguaagaaauacuccaaaccaacuuuaaugucaaaauauuauuauuugcauaaggaaaguagucacgacauuuguaugacuacaguauuaggauuuacuugagauacacuguaucuaagucuaaaauauacaaauauuugccaacuuuaaauuauacguauuggucugagaaaguaauauauguuaauuuauuacaauaucuuagcugcauucaaauuuagaggaaagacguaguugcuacugggauugaguuuuuagccuauuccaaaauagguuagaaagcuaagauguguugaugggguaauaauuaguuagagaauaacuguuguaauuugacuuuguacaagagaucaagaggaacagaacuguauucuaaauaagcauuccuuaauuugacuuuguacaagagaucaagaggaacagaacuguauucuaaauaagcauuccuuaaaguaucugugguucuacacauugguggaaacacuguugaauguugcauuauucaacaaucauauuauuauuuaguuucacugugauuuaaguuccauauuuuaguuggauauaguuggaucauaaauguuuuacuguuaacuuuuuuaacaaucugaaaauauuccuaaagcuaccuguuuuucucuucugauuaaaagcacacuguuucaagcuauaauguuuucauuuguuuguuuuuuuaucuggauuugguaaggagagucuauauuagaaugucuuauugcuaucagggaauacuauuguaaugagagagggaagaauauuguaauaaggagaccacucugacaguaagaucugcaggugucuuuaaauauaaaauauauuuuaaaugauauuaauaguucaaaaaaguuaugccacgucauuauucuuuugaugucagguguuggcuucuucauugauaaaaucuaguuuuaguauaauuuucaaaaaagugaauugcugugauuuuguuguugauaauaauuucgaccauuuugccccuaggccaaacagcaguugaaucugcguacgcauauggccgaugaaaauaaaaaugaauaugcugcacaauuacaaaacuuuaauggagaacaacauaaacauuuuuauguagugauuccucagauuuacaagguaaaucuuagauaugaaguuaaucuaguuuuagauuaacugguguuuaaauauaaaacuuguaagucuuagacaucagaaucuuucuagauucacuagacaucaggguuggggugagagauuccuuuaugauuauagauuugaaaacaaguguuuucuaacuuuuaagucacacauuuuccuacguaucuacuauuaguguuauaaacaguuuacuaaaacaaugacauuuguaagauacauuuaaauacuuuaaguauuuugacaugacaaaggagaauuaauugaauuuguauauuguaaucugcucaccuagaauugagauguagcauuuuuauaccaaaccagagucauuggcaucaguccagauggcagaaauaaaucuuacaaaauauauuugcuagcaugguuuuugccugcuuaucaugcuggcucuguuagaugauaaauguaauucagacuuugagcuugcuuauaaauccugucugucaucacuugaugauaacaguugccaaacagccucagguaaaaaagaccucagaauuuucaugaggguuaaauuauuuaauugccuguucuagaaagaagagaaauuacagaaaagggauuuaguaaagcaguguugaugaguuauuaucucaacgagcagagcuucugugggaagagugucagcccggguacacuuuuucuucuuuauaaggcaaguuggaaauacaaagaaagcacagugagagauaaugaacuggaguggggaccagaauucuggucauugaauccagagggccaagccugccagucuucacugugaugcuuuucuaggcuuaguaguuaagucuucauauucuggggaaacuauaacuuguggagauaaacuaccuuuuguguuuugggccugauacuuggauuuggaccuuucuauggagcaauucugugaaaaugcaggucucaaagucccaggcugugggaguuuggggagacaaggaguguaacugcugucaaugaaacagcaaggucagugcuggcaaauaggauaugucaaaaaaaaaaugccuuuaaguuauuggacuuuauguguuccaacauauuuccuaguggcaugugccagugaauuuucaguugugaggauucuauaugugccacuuugagcuugugacuuccuguuuuuccucacguauccccagcucugagguguacacugcaguaggucuggguaccuguugauaaacaacuaguauggacuguugguccagccaagucuuaccaaaguauccugaauuaacuugagguuagaagucucagacuuggccgggggcaguggcucacgccuguaaucccagcacuuugggaggccgaggcagguggaucacgaggucaagagauugagaccauccuggccaacauggugaaaccccaucgcuacuaaaaauacaaaaauuagcugggcaugguggcacgugccuguagucccagcuacuugagagaccgaggcaggagaauugcuugaaccugggagguggagguugcagugagccgagaucgcgcaacugcacuccauccagccuggcgacagagcgagacuccgccucaaaaaaaaaaaaaaaaaaaagucucagucuuguauauguuaugggccaguugcuuuaaaaaaaaaaaaaagcaccagaauuuugucaucaaaugaaauguuuucuggaagcauaaacaagaacuacucugauugaauaguaaaaggugggagugcuauggggcagggagcugauagccaguaagggguccuuuuagaaggcuagaaucccagugucaucugguuuuaggaaaacaauacuaagugccuuacuauuuuuuuucuuucuuuuguuguuuagcaugucccagguuuuaaguauuauaagucaauagcacuuguuaaaagguauuaacaacaguguaacuaugaggguagaaauauuuaauuuuugaugggggaucacuaauugaacuccuuuagaaugauugaaaaauucaguuuucucuuuuuaaaaaaauucuugauuauuagcaacuacaagaaauggacgaacgaaggacuauuaaacucagugaguguuacagaggauuugcugacucagaacgcaaaguuauucccaucauuucaaaauguuuggaaggaaugauucuugcagcaaaaucaguugaugaaagaagaguaagugcuaaauaauuaucuuugaaugcaucuguuugguuuaggugugcaguuuaaguuagugaaaugaguugagaaagggauaaaguaaucugaugugugguucuaaauuauauucuguagaagaaugucuugcaauagauuccuuugaguucugagauucauucuacaugcaaaaguucuaauucuuucuuaaaaaaaaaaaaaagauuucuaacucucuucucccacuaaguuuucaguucuuaucaaagagucuaaccuaggaacuguguguuacaaauuguguuauacuauuauauuaguuuagugaaaauuuagagaaguaugugguuagaguugccuuuagcacuugagcuggaucaagaaauguggguagcauauggagugaugaccaaugaggaggaggaaggagggcauuaugugcagaugaaacagcauagcccuccuccccuugaggauagguaaucacauuguaucuugauuaaggacuagggucuuuuaucucaguaaauguugauugagugaucaaaaagcaugguuggcagaaacugaggaaaggcaguggcaagagaagagaacugguguuugcaggauaucagauaugugucacauauuuuagucuucaugaaccuaucaaguagauauuauauuagugaggauccuuucuguuacagcuaauagaauucucacuuaaauuuagaaaagaggauuuuuggcuuucagcauggcuggauacaaguuuauacaauaucauuacagcccucuucucucuaauuacccuuuagcaaauuauugcugaggguagcauuacugacaaaaguaagcuaugacuuaaggaugacuuuugacuaaaugaagggcaaaauguacuguuaacagaaauaggcaacaaaagagagguuguuguuagggguggggaggaauuuguagagauacucugaaaauaaugaguuuaagguaucacuaaagcauucagguagagguauguaugucuaaaaacaauauuuaugugaguuuaaaaauuuuaaauacaugguauuaaacuuucaaauguuguuugcacucaguaguguuuaugagaucuuuucccuguugcucuguuaacauuccacaguauauauuuaauuuauuuaucuuuucccauguuggaugaguuagaaagccuuuccuacucaucuuuuacucucuuuuacaauuagauguucuuuccucauuccaaagauuagcuucuuuguugacaucuaucuuuuaaagcaaaaagccuuuuuccuuugaaacuucucagaauuucuacuuguuaauaaccucuuucuguauucuuuuugucaguuaggucuuuuucagcuaaguagucuucagaugaauuucaggugguuaaagcuaccaaguaaaaacauuuuaugaauauuauaaauuaauuaaguuguaauuugcaaguauauuuuucuuuugggauuaaaauacuuugaguuuguuacacauucaugggaauaaauuauuuaccuuaaugauuauuguggaauuauuuauuuaaacuuauauuuguuguuuuuuuguacugaaaaaguuaugaaagcugauguagaauuaugagcaagugaaacaguuuuaaaaccuaguuucuuuuguauaggacucucaaauggugguagacuccuucaaaucugguuuugaaccuccaggagacuuuccauuugaagauuacagucaacauauauauagaaccauuucugaugggacuaucagugcauccaaacaggagagugggaagauggaugccaaaaccacaguaggaaaggccaagggcaaauuguggcucuuuggaaagaagccaaagguaaaagucauaaaauuccuauaugcuaaucaguuuaaguguaccaacuaaaacaauguggguauugaaugcaaaaugauuuaccauuaauggagaauaaauauuuucaauuugaaugauucaguuaaccuuucacuuauauuaggaauaccuuaacaguaacaguuauuuauggauuuaacauuugacuaccgcuuaauaauggguaagaguauuaacaaaguuguuaauaucuaguuaaguuauaugcuuuugaaguuucauuuguauguaguuuccaucagaauuuuuaaggaaacaugaucuaacuaaaauagcacuaaaauuggaauucucaaauggaaugaaugaccacagccauaauacaugucaaguuagguuuuauagauccuacuacuaaaauuauuuuuaucauccauaugaguuuuuaaugggaaagguucagucuugguuaauugaaguuuaaaacaauuucuaguuugguaagagaaucucacucuuaacuucuuguuagaacccaccuucugaugugcucuuuauuuuagauagaucuaggucagcaugugagcaaaugaaauagaugggugcuuugucuuucuuaucaauuaagugguuguacucgugucuuauuaguaaggagaauagagaaauacuuuuaaucugaugugcuguauuuauuaaaguauacuugauuauuuuaauucauuuuuugaucauggcauaugaguguagauaaaauuaaaauuuaacucauuauaauauaccuguaucuuuaaaagcacaauuauaauuaacucaugcuuuauuuaugcuuuuaaucauauuguccagucaagaaguugagaggugagaccuguuuuaagucagaucgagguagcuagaagagcuuagauguacaaggaauacuggaauuaaaaaaaaaaaggugaaauaaggaugaaauagaaacagccugagaggaaagccaugaauguaaugaaaauuuuuuugccuauuuuugguaauaaucaguuacaguuuuaauauuuuaugugcgacauuaccuguuuagauaacuuuagguguagcugccagcuuuauuucuugacaaguaccaugguaaugcuaauauucuagaaauuagaagagaauuuuaaaaucuaggccauauugcuuucuuugacaauauaauuugugaacucuguguuuuuaauuuguccgauguuaaaaguaaucaagugaaaugguacauuuuaaaaaguaaauuugauuuuuuuaaauaauaguuuugggcaaaacuauguuuacuuucucauaauauuuuuacagaaaacuuuauuugagauauauuuugugaaaaguauguugccaaaaauagaauuuucauuuaggagaaaacuaugcacauuuggcuuauugauuccuuucuuuauuuccauauuagccacaguccccacccuuaaccccuacuaguuuauucacauccaguacuccuaaugggucccaguuucucacauucuccauugagcccgugcauuauuguaugaaugaaauaaaaacagggaagcccagaauuccuucuuucagaagccucaaaagagggguaaguuuaauaauggguuaaaaugcaugauggccuauuguguguguaguguggcuuuuaauacucuccacccucauuauaaggcucucuccuauaaauacacaguuuaaaaacaccacagaauuaagaauagcugcccucaaguuaaaaacaacuccucuuuauaacauuugaaaugcucaaccauaaaagaaugguauuauaaagagggugcuggguacaaucauauuuuagcuauuuuuuuguuuaugugaaaucauauguucaccauugucuuguaauguauuuacauuuuuaagacuuucaguaauuugucacuggaguuacucuuguaauaauuugucaccaaugcugacuucaccugccaauuuuauaaaauauuauuuuauugacaauaaaaugucaagcucaauuuuaauugcccugcuuauuuucagauguauaaaacaguuuccaauaguuaaaaaaaauuaaagauaggcauuuuaaauaucaagauuguuguagaucaaauugagauaauauauuagaaaauagauuguaaauuguaaagccuacaaaaauacuagauaucacugaguaauguuuacuaaacuguuguuuagcaacaacuguuauacuacuaauaaauacauuaguguuacucuauuuaauguuagugaggcuaauuuuucuuguuuauguuugauuuuaagggugugcuuuuaauauucauaaccuguaauuuagacucauuuauaagauuugagcauuuguugggacauuugaaaaacauagguucauuaacccauagaugagaaaucagucuuucaaugucguaagaagccuaacaauaauaaucuaaaauuagguuguuucguucuuccuucuuagacccuucccucccuuccuuucuccucuuuucucucuucuuaccccuccuucccuucuauuuuucuuccuuucugucuucacauugcauuuuggccuccuauagaacaagauauauuaguuuagggacaagauuacaucuauauugcuuuaaaacauuaugacaaacuuaacugauguuacuaaugcagcagaaaugucccaguguauuaugucauuuucuggacuucuuuuuuccuccagugacaugaacuucuuugcaucugucuuaccuaauucuauauguggaugguagguaauugaugacauuuugaaaaguccccauggaugagucuguaugauaacuguaggcaugccuauaaucacuucuaaaagcucugaacacuuguuugaaagacuuugagaaaucauauuugggauuucuauugccugaguuacaaggcuagaacucauucccauguugcuucccuauggcaguuuauuuauuacuuauuuuuaauuuaaaauuguuuuaaagagauguggucuugcucuguugcccaggcugaucucaaacuccugggcucaagcaguccucccacuucagccucccaaaguucugggauuacaggcaugaaccacuacuccucuggcaauuuagacuacacuaaauauuauauuguuacauaaaucaugagaaauuacuauguaguagucacguuuuuguaaucauuuguauauccuauauaaugagucuaccaggcccaguuaaaauagucauauuuuacacuauauagucauagucauauuuuccacauguagucauagagaugcgagguaaguguaauucuaaggaaaaaaaaaacucaggcaauuagagcuaugaacccuggagagaagcuuaaauaugugucaucuuauuuuuuuuuuuuuugaauaaguuuguagguagaauuuuauaacuguaaaacuuaaaacuauuugcuuauuguuucucacaaauuauagauauucauaaguuauuuacguaagauagcauaaguuauuuuuguagggaucuaguuuuagaaggcugaaauccccucccagauuuauuauuagcuauaccacuccagagaagaaagcagugugaaagagaaaauaugacaaaccaacuagggguuuagaggacagagcagggaagaaaguggauuacaacuuggagguugagaaauuuuuuucuuuugauuaccguuugguauuuacuagauauuuaucucaaaaauuaaccuauagagauuuuuuuuccacauaagaauuuucucaauauagaaaaauucaaaaagaagaagguaagcuuuaguaagccugcuuauauguuuuuacauggaauuuucagucuauuaagauuacaaaauaagucuagagguuucuuaaaacugaugaguuguaccauucaguucagaaacuccuguuuugugcgauauuugcugcacauugcuuuuccuaaauaacuucuuaaaaauuaugauuuuuucuuuuucuuuuccuuuuuuaaagaaaaacucguguguacagaucccaguauaaauuaaggauaugaaaaauguuuuugaguuugacagugguaucagcagaucuuuucugagggaggaaguucuauaauuuccuucugugacauuaaguucuaaccguuaauggauauuugaggauauacucgaacuuaacuacuuaaaaacaaacuaauaauuuuuacucuauugcuacuuugaguuuuauuggauacuguuuuuuaaguuauuuauuuagcaaugaguccagguuuucucucugaauauuuaugacuuuauagacuuucagagacauuuuucuaagcuuuuaucucuccagaguaguucucaugaaauuuuguccuauuuaaaaugaaauacaccuaauaauuuuaauugucuaaaugauuuccuuuuuagcucucuuguguuuauuaaauguaguugaguauaugaaguuuucuaguuuaugaguauauaauuguauaugagaauaagauauuuuuguauggaacauguauuacuuuaaaaccuuacacagaacauaugucuaauauuuuuacaaagaacuugagcuuuguauauccccaaaucuaauuaucaaauuuccaauugauaauuuaguaagacuagauuaacaaauagcugaaacauuugauauuucagcuauaauuaucuuaauguuuucucuaaaauauuaauauagaaauuagauaauuugcaucacuuagaaauuucacuggugaaaauuauugaaagauaagucaaauucauauacuucaaauauuuuguugcuuguccuauguauaauuucauuuaauaacauuuuugaaagacugugaauaucuuucuucaaaccuuucuauuuccuuaccaggaguuuuuuaauagcaaaauaaauuuuuuuguuucucaaaaauacugacagucuaaagaauguuaagcuuaauuuggaacgauaaugcauaagcagugaccaacucaucagagauaagggguagauauuuuugucagauuauuuauuaaaauucauucauauuuuuaaugugaauuuuuuaucugacaucuccccaacaccuucucuuaaaacaugugauuuagaaaauagggaaaaguaaaaauuuuacaggcagcucacuaauugagaugaaugugaagauuaacuuuauaaagcuccguugcauuuucugggucaccguguguguguauguguguggguguguaguugggaugcuagauagaugccaugccaguugcagaauccuauugacccacagaaugugggagauauauccaaauccauauacauaucuauaucuguacacacacacauauauauacauauauaaaguauuguuguacaagagcacuaugguuggucucuucagaaucugugucauuucauauuuucagaaagaauacauuuuaaucaauuuucuaaaaauugaaguuauguuuuuaguguuguucaagcauauggauuuuaaaauaaaaccugaaaaauggaagcuauauuuuuaaagcaaaauucaaccuauauacuuguauauauuaggaaauguguacgggaaacuugaaucuggauaacucacuauuuugaaaauaauguguuuuaaauguacauuuuaaaagauuuuaaaaugaaaguaaaaauguuacccucaucuaaccaugguauauuuaaauucaaacaguacuuugaaguauaaaaauguagguaauaguguuuucuuuaacacacuggaaagaacauucuauuuuuuaauauuucacauaagauuucuuuuuaaauguuuaaucuuagaguucauauucaacuuuucaaauauuaguaauuugagaauaaagagcuauagaagugaaauccacuuacauaaaauucacuuuaaaagaaaaugcaugauuacagguagaauguuuauuuuuaaguuuuaguuaaacauagaaaauaucugcccauuaucaucaauguaugcuuuuuuuuuuuuuuuuugcaaguaauuuacuuucccaaaaugugcuuaaaaugguuuuucuggcauaauuguuuggauugugaaauguacgugauuuauuuuaguauugugaaaaagaauaggcuauugcaucuucuguauuaugguuuccugugaauaauuuaccauuucuuucuguuuuccauugaacuauucaguggucggugaagaugguaagccuuaugugcugaucuauauacugugccaacauuaaguaaucucaaaacauuguuuuguuuaauucaaaacaagugguaaauuacaucccacguuuucaccuuguguguuuuuucuuuuuauaguuucauaguccagcauaugccaguacucuugaugucauaagauuagaaaaugugguuaauugucaucaacccauuaaguucuuaaaugucauugaauggaguccuugucauguuacagaggagcguaaaauugugguuaaacauuuuuuaaagauuacaugguagagccacaguuuguuaugcagaaggaaaauuuagcaaauauuauuuugcuuaauagccuuuaaaaaaucguauaaauuugauuuguaguuuuauccccagagucauuagauuuuuccaaaaaaagaaagaaaaauuucaaacuaguaucauuauggaguuaguccuugguucuucugugcuauugaaggagaauagaaacacaaaugaucuaaauauccuguguguguuugugugggggguggggcggggcggggaagguguguguguguuugggauguuccuugguauguuuauuucaaacaaauuaauggaucuacauuaggaacuaaccccaaaauuauuguauaggaagcuacuggaaaauagaccacucuuuuuuacauuguuggaaucagccuuuuauaaauuccuuuguaguaagagagguuguuaaaugccccagaggucuucugaacauccauaggaaauaaaguuaaguuuaauucucauauucuauguaagaauagaguuccaaugucaaaugggauauuagaaauguaagugccucaguguuuacuguucauaaauuugagaacaggguuugauaagggauaaguggaauucuggcagauuuacuuguagguuauugugaguuuaucauaauuuugacaacaaaaaaaaacuccacaguauguugaaaugcauuucuucauuuuauucaauaauuuuucaagauuuuuagaaauauuuuuaaaaaucuaaauuaagaaguuuauuuuuggcauauauauauacuaguuuucaaaacuuguacuccuuuucuguaaucccagcuauuugggaggcuaaggcgggaggauugguugagcccaggaguucgaggcuauagugagccaugagagcuaugaucacucaacugcauuccauugugggcaacagaaugagacccuaucucuacaaaaaaccuucaacuccaaaguagauuaaauaugacaaauuuauguugcaaauuaaccaguaaaucuaaaggaacucaacaaaggaaauuucaccauugauuuauuuaggccagauuggguugauugauauccuuguuucuggugauugguaaaugaaaaaaaaaaaaaaaaaaaaaaagcaacacuuaggaugcccuacuuuuuucuagcaagcuuguugaauauccauaaucuacaggccacuggggaaagaggcuagggauucuguuauuaauuaaauguuacauuuaauuauagcucauccuaggagugaguuuucucuuuucugaaaguaagugacucauucuuacacauggugaaauaaagcuauuuagcauauguuacaggcauaaguggcccaaagagcaagaucguauuuguuuugagagcuccuuuuagcaucacuuuaacaaauuugaauauuuauauucuuuuuucuuuucuuuaccuuuuuuuuuuuuuuuuuuuuuuaaaagacggagucucgcucuugucgcccagccuggagugcaauggcgcgaucuuggcucacugcaaccucugccuuccggguucaagugauucuccugccucagccucucacgaguagcugggauuacaggcgccugccaccacgccuggcuaauuuauuguauuuuuaguagagacaggguuucaucaugucggccaggcuccagucuggccucaaacuccugaccuuaggugauccacccgccucagccucccaaaguguugggauuacaggcgugagccacugcgccuggccuuauucuuagaauaaccauuuugaaaagaaaaugaauagugacaggcaucaucaauuucuggaguauauauaaagauuuaaguaauauagguuuauauuaaauagauucaauagcggcuaauauugguucuguuguaaucuguaauauaaguaacagugauuaaaauaacauuuaagggaaaaggugucauuuggaucagauguuuacguuuaaauacuaguacuuuuucuuaaauugcauaguuuuuugaauaucaaaacuuuaaaaaauuuucagacaucaaggaucuuuccuaaagaaggauuuuauccuucuuucaguaacaacugagguauguuauuugguuuacaaaagguuaauugaaaauauacacuuguuugaauauaauuucugcucaguggauaguucuaucuuugguuuuuaaugaccagguauguuuugaaugguuuaaucaguuguucaaagacuauauguaguguuaaaguauauuucauuagauugucuuugugagguaaguuucuuaauuauauucauauuuucaguuugaacauuuguaacauucugaaugucauggcaauggguuuuauuuggaaauguugugauauguuauauauaaaacaauacccuguauagacaagaauguuacguguuuccauuuuguuguuguugcuguaagaagguuuacauguauucauuauaacucugccaagauuugaaaguaaugugauacuaccuaccaguuaucuguaucuggguaugauuuuacuuauucuguuucaugguuuuauaaaaugacugaaauuugagcucuuuucuucaguacauuguuuucauuaacauauacgcauaaacacacacaucuguguagauuucuuuuuuuuuuaagggguugcuugaggcaaauuugaaauuaaacuuaagauugguauguauucuuauuuuauagcagguauauuuuaaaaauaaaauuucccgaaaaugucuauuauaaugauuuagauucucuuuucagggcccagcacuagaagauuucagucaucugccaccagaacagagacguaaaaaacuacagcagcgcauugaugaacuuaacagagaacuacagaaagaaucagaccaaaaguauuauuccuuuaaguuuucucuaucauuauuauuuuaggaucuacuuugagugacgcccuuaaaugugauauacagaagguuuaaaaaucauauauccuaauugaaauaucuuuugagagagaauuauacuccuacccuggaaauuuuuaugguuacccugucauagguuagagaauuuccuugguugcagauuuuuauugaaugcuaauaugccuucauuaauuugcaaaaaauuucuugauauuuuauuaucaagaguaguuucaucagcacuaccucuuauacuuugauauauuuucauuuugcuuuuauauauaaauugauuucauuagcaaccugaggcuauuuuguagcaaaacauuuggcaaacggugcuugauuacugacggcuucauauuuguucacacauaaguuuacuuuuuuauuucauuuuuauaagacguuuccucuaguuuaauuuuuuaaaaauagacauagaagaauuauucacgaucauuaaaguguuauuacaaugaauuggugacuugcuaugucuucacuuacgauaaaauuggggcuuaaauuguagcaugagagauugaaguuuugaugcuaagaauuaguguaucaggugugauguggcgcuuaaucauaaugaaauauuugcacuaccuuugauucucauucacaguagcuguguucuguaaagucacugugaacacuaaauuauggaauacugaaacauugcucuuagggagauacaggguuagguucuagguagccacuggucacaauguuucagucagcugauuggcacauaaccuuuuuuuauuuguguuucuguguaaaaacaccuuauuucauauaugauguugauuuauuaacuuugauuuuuuucuaauagcacuguaacucaugcuugaacaaagcuuaucuaagauuagaauuuucucuguaagguacagccuucuugugcuucagaacacuagacagcacuugauugccaugcuuaggggcuauuuuaaacaccaauaucaacaaaaagcauaaaaauaugagaaacauugcacuaaaugaguagauugcaaaaaggauacauguccagaauaugagaauacgagcaagaaggccagagugucacugguuugaccacaguuuagaacuugaauguaccucuggugacucaaauuuucccagauaucuccauguccaaaacaagaguaaaggcacagaaaugugaauguucuugccauggacuggaauuagugcuaauccagagagacuugguuaaaaauuauguggaacauaauaauagaaguugaggaugaagaaguauaggacuugugaaaaauucugaaugcuuuucugugaaguucuguagguacuacaguccccaguuauugagagaagggguaacauuauuagcucugugugauaaaagauaauugaaaacuguaugaagaguaaauaguauaggaaagagauuggagguagaagccuuuaacaauccaggugagagauacugagggccuaaauuaaggcaugaccaugggaauagaaaggaggaauagauaaaagaaucauuucaaagccaaaguagguuguacuuucaccugauuggaugcuggagaagagaaaacauggaggaagcuuaaaaaaaaaaaaaagauuuguagcuauagauuuaauugcaacaauaagaaaaaaguuuagggcaaagauaaagauuuuguuuauguugauuuuugaaaugugaaaaauccauauuagaaguguccaguuggguuuaaagauaugaaucuagaauucaggagagagaggucuggagauaugcauuugaaaaucaucugaagauggaugauauuaaaacaauuaagagaucauccuccaacaagacuguaggaagagacgagaagaaaccuuugucauuuuauguaauacacauuuaaagguugaacaaagaaggagaaagaaggcagugagggagauugugagaaagcagaggugaggaggagggaaaagaaaauguaaccuauaggaagucaugaaggaaaagaguauuaaggaguguuagucaauagugucagauguuagagucaaggacagcuaauugaggcacaaccgauuguaauaugauuagagaauaggagguagguugagaggaauuggcaaaugacugacuuugggugggggcaaguuaaagcugccauuccuauuucuagcagaggugagugggaggacaaugaugauguaugagcuaaggaacacuguggaauaguguggcugaguuggaauauaaugaguuugauuugggacaugaugagcugaagaauauucuuccagcccuugauuuuguguguguguguauauguacauauaaauaaaauuccuuguuuagaaagcaggaaguaagaaaugaacucuguucucuuuugguauucugauugucuucauaaauuaguaacucuauauguuaucaccuuuaugcaaauugucuuuaaucaggucauguuagacaaacuuaaaaagaugugacucuacuuaagauuaagcugcguacgaguccccagaguccaauaaaacucuuuuaucuggaagcauaugaaguuaauauuuaauucugggguuccuucucuuuuuuagagaugcacucaacaaaaugaaagauguauaugagaagaauccacaaaugggggauccagggaguuugcagccuaaauuagcagagaccaugaauaacauugaccgccuacgaauggaaauccauaagaaugagguagauuuguuauucagcacuugucaagauaaauuauuuuuauaaacuucauuaugauagauugguuuuuguuagaauuaucuucaaauguuuauauuuaauguuaggguuuaugaucuaaaaguauuauugugauguguguuauuuaaucucauuaaaguuuuuuauuuagaccuuuauauaagauuaaacauuuauacuauuuuuuugaaucagcuauaaaguugauccuuugaccaguuuggaauaaagguuucacaucucuaagaauuacauaauuauaaaaacuuaaacacauuuuaaauguagauaucuuaugagcuuuuaaacauauuuauugagcucaguuguuugcuuauuuuuuuuccuaaggcuuggcucucugaagucgaaggcaaaacaggugggagaggagacagaagacauagcagugacauaaaucaucuuguaacacagggacgagaaaggugauuuuuuguauuuuauuuguauuucuucuccccagaguuuucucacccuuuuguccuaaacuuuauacaauucguuuuuuucuuccaaauuuaacaaguuaagcuuuuaguaaccucagucuuuugaaccuaaguaauuuucuuuagugauaauuacaggugaaguaggaaaguucaucuugcuauucaauccuaguuugucaugcauccaaacacagagcuaggaacauagaaaauucuuggagcuacagucugagggccuaggcuccucgggcaugggaagguuuccuaagguucaaguggaauuagggucgcuuaugccaaagaaaaauuuuacuaucaaauagcucagaguuuugugaagaaaaaaaaauguauuguuaguuuggaccagagcuuccaaaagacacuuugcuaaguuucuguaccacuugugacauuucuuucuugauguauuauaucuuuuuuuccagacuaaaaguccacaaauuaggauucaccuuagagaaaaaugugagaggccuaguaacaacucuuaguuuucuacuuaauuacaguguaaucugagcaaguucauuuuuaaugcucccuaagucucaauuuccugaaauauaaaauggagguuaaaauauccacccuuuagguuuguuaguaaaaaaguaaauaauacacauaaagcaccuaguaguaaauagugguaauaguaguaucacuucuugaaagaguacauaucuuuaaucuguuaagagauacccacaaauuacugguuuuuguuauuagguaaaacucagauuaaaaggaucuaauuucuuuggcauguguuauuucucuggcuuccaggcuuacugaaaguacuguuaaaaucuaauucuguaaaauuuuccauuauuaaaucuaauucagucauuugauucuucagcaaaauuauuaacauuuuucucugauuuaaaaaauuuuaagaaaaauaaauuguguuuguauuaccugcuuuuuuggauuuuuuuaaguuaccaacuucccuguuaccaugauuaguuggaaauuuacuuuacuuuuuauuuuaguugagaaucuuuuaauuuucagugacagaaugaauacuuuacccaugcuggcuuaaacuaaaaauggacuucauuggcugacuucagggagagcuugaucuaggagcucagauguuaucccuaggacucaauuucucuccaccucacagcugugcuuucuacuguguuggcuuccuuuuaaggcuccaaagcucuaggcgaguauuccugcagguuucgaguccaguagaaaagggacagagugaauucucuucgaagagucccaagcaaaaguuucugugcauuucuuaaaucugauuagguuacaggacuucuugugaacugguuauauagaugauugcucugaugggccacuccagauucagaauagaaacaauccaccugaagcgugugaacuaaacauggauaugcauggaucccuuaaggaauuuuaggaugauaaauuugggaugauggaagacaagggucuagaacguuuuucuguuuuaugucuagaccgagugauagugagguguauuuacugaauaauacuuugugccuagaauauuguaaucuuguaauuuuuuuuuaauucaggaaauucagcaaagcagcauuuuguauuagaaguaauuuguauacuugacauuugaaaaaaauagggcuuaaguggaaacugugucauuaauauuuaauuuuuggaauugauccugaggugaucaauuuauaaauaauauauagaauucucauguuuaugauacuugaucagagauaauuuuuuguuuuauaguccugagggaaguuacacugaugaugcaaaccaggaaguccgugggccaccccagcagcauggucaccacaaugaguuugaugaugaauuugaggaugaugaucccuugccugcuauuggacacugcaaagcuaucuacccuuuugaugguaugauuuucuuaauaauauuguauguaaaaaaauugguucuuuaaaaguauuuacaucaagucacucacuguaguauccuuauuuaaguaauauauguugucagaaaauuauuaucccauuucuuuaguaugcauacuuuuguuauaacuguauuacaaauguagauauuuuucuuccguacauggaauuaaaaggaaauugcccacguuacuagcauccuaauacagauuauuaauuaauuaucaauuuuggucagugcagaauuuucaccagaguccuuacugugcacauguccuaaacaaagucgaggcagcuugaacauguagcucaacccaggaagcgggaugcuggcggaugccacuucaugcucuuccuuguagcuuacuaacauuaagagacagguacaaggcauagcuagcugaaugccaucaucauauacugaguccguaggccaccuguuuagaugaaagugggagagaauguaguagcuacugacuauguuaucucuuacucuaugaaaguugaagaacaaacucuggaagggaaguaaggcacugaggccuucuccugcagauuuuuaguuccucuuuauccuggacugugaaaaauacuuucccucaacuaacaggagaacugagcgacacuuucauaaauaaacgguuguaaaauggugcuugauuuaaggucuuucuccccacuucguguugguuuaaaauugagcaaagucucuaguuacuucuuauuagaaaauauauuaaauuuaagaccuugcagccaagugcagugaugugugccuauagucccagacacuugggaggcugcggugagaggauugcuugagcccaggaguucgaauccaaccugggcaguaagacccuaucucuaaaacaaaacaaaagaaaacaaacuugcuauaauguaaucuagagaguagggaagcaauuuggcacguguuaaaugaagauucaguugugaaaauuguuacugcuaagcagguugggcgugguuggggauagagagugaaagaguuguguauggccauucuguuucuaccaucucuagagucaaacccguauuuuucucuguucucccuucagacucucuuuuuuccuucuuucuuccugcucuuuugcuaucugguuacuguuuuccuaauccauaccugcugaauuuuuuuagauagacuacuaaaauuugggaaaagaguuggaauagugacauaggaauuagaauacccugucaaaucauguaaugucacugugacucaguuaacuucauccguuacaugggggugauguuauccagcccugcgggcuuauuaugcagcucaaaugagagaauguauaugaaagugcuggguaagccacaaagcacaauagagauguugcuagugagagucaguaguuccagguacauugaaaucuaguaggguuucauuguauuuugugcauuguauuaguaacuuuaaaaaaaauuaucacaaugcuuaaauuaugcuugugaaaacucucaucuaggacauaaugaagguacucuagcaaugaaagaaggugaaguucucuacauuauagaggaggacaaaggugacggauggacaagagcucggagacagaacggugaagaaggcuacguucccacgucauacauagauguaacucuagagaaaaacaguaaaggugcaguaacuuauaucuaaacuaaccaggcaccuuugugccaugugugacauaggaagaguaacauaaaaugaaaacacauucaacagguugaaaaaaauaaggaaacuuaaagggcauccaagauuaauuguucacuaugugagcugaguguaggcuugaucuugugaauauuaccacaagaaacauuuuguggcacuuuacuguuugaguaacguuggugugaagcuuaauugaugccuuuugcuuuaugucccgcuuaagucugugugaaggauuuguguuuuucugccuuacaaauagaauuugauuuauugggcaggaauucauggauaguaaugcucucugcccccuuuacuucagaaaacacagugacuuuagugaauuugaauagugaaacugcucugaaaugcuauggaaagccgacuccccaaagagugguuucuucuagaaguuugaauuuguagcuacaguuuccaagaagaaaaauaguaguuggauaauuuaguaaaauaauaacaucauuuucauuuucuuaccuauucuuaacuuugguuuccuaaaggaagaaaaugagcagguagcacauaaucuauuuaaguagauuuaaagagaguuucaaaauaaaucuccuggucuagcucuuaggugaauaaaauagauuuuguuugagaccucaaaauauuuugagguuagcugguaauuuucaauaauuuacaagcuuccuuccaaacuaaucucauacuuuuguauguuucaucuugaaaauaucuuuugggaaauaccacuuuagugauuauuuagcauuuagcaguuacacauaggaaaauacacaguuacauagaaaaauacacauuugaagauagaggaaaccuugaauggaggggaaguguugacaaauuuuaauuuuuaaaggagaaacuuuuugacuaucuggguuagaggaagauauguguaccgccuuuagggcauuuuguuauuuccgcugaaucauuaguuauuaggauagauaaauuuuuccaauuaguuucagcaagcguuguuggaaacacugugcagucaaggauugugcagugcugguugugugaccacacccugagucagugguguggggaaguaaagugugaagaagcaguaagauugguuuuuaauuuugcccauguuuuaaauuuuccugguguuuucgguagcugacuauaaaaugauagagacauuugggacaggcacuuuaaacugaacaccccuuuugguuuuaccaaaggucuucaguaauuguucuuuucuuuuuccuccuggacugcagguuccugaagaggguuucugaggaaaugggcaagauguugaaggagguuacaugcagcugcuuuugggggaggguauuagaguugucaggcucaaagagagugagagaagcaaguugcaugagugcaugcagacaugauuuuuuuuuuacuaacuucauuagcauuuccauacauuguuuuuaaaaaucauaauaccaacccuuaaguuccuaguucacaguuauucccacaaaagaaaaagccaacaauaguguaccauuuuucuauuuauuuuauugcugucuaaucaauaaagaaugcagagcugucaaaaaaugugucuuacauuagcugucccaacaggauugucuucccucccagcucuguuuuaauuggcuuuuagacccacuaucugucagauccuugccaucugucagugucugccugcgccaccuccgugcuugcuuaacauccuguugcaugucuagcgugauugagcuagauuuuucaggcaugucuuuagauucccuuguucuugucaaagccuuguuuuguuuuacauuuguagugcaaaucacuuugucaaacaucuccagcacuaauguuuccaucuuaguauuugugcacacugcuauaacuuccccacugcaaacauuccaguuuuggcauuacgaagaaguagcugugaaccugaaguauuuaugauaagaaaaagaaaacaucucugcuguagccuacagcccaguugaaagaacucuuugaaacgugauacaucuucagcaccucagucugggaagaaucuagucagcacugaaauccuggcauaauaaacacagaagauauucaccaccucaagacaaaggacuauugucaaaagucagcugcuuccauucaaaugcugccuuaaacuugagugccuaaaucuguugauugccaacacuaccacuacaguaucccacaaagggcuuuaugugucagcucagugcgaccugcuuuaacucugcagcaccgcugcagcugccgauguagccucgguagguggcuauuagagcucuaccauauacaguggugcaucuucaaauuuaugcaucaaacuaaagacauguccaaguccauuuuaauuuccucagugguuuuaugagaaguuuuaugggccucccccaauugucuuuuuauuuuggguuaugacgaucauguuugauaauuacaaugauagucucuuuccacgugaugcuuuuguuugaaccugauaaaauuuagugaaacuuuguaaugaucuaugugcacuuuuacuuguaaaauggaauuucuguauguuuauacuuguaaauaugauuguuguuagugcuccuguugcucaugguguccugccucgcauuugugauucuguuaaugacauguaucuuaacuaauuucuuagugguguuguaauagggagauggggcaggugggggguuauuuguaccacugaaucuucauuaauuugguucuuuacuguuuugaggggagaaagaacgugaaaugguuuguguauuauugaauuuuaagcaauauuuuagaagcugugugacugcuuuaauaacuuuuucccaguguuauuugaaucauacuacccguuauacuaaagcugaaugacaauugugugaaaguuacugccuucauaagaucaagucaccacuguuacacagcugacauauaguguauuaccuuugcagcuaguaaacuauaaaguuuagauauugaaucucguuacaggguuauuuauauaaugugacauuauucaguacugacagacuacaugaaguaguuuuaaaaucuagugcuauuuuuauuuuaaagguuagcaaugaggaggaaaugugaucuggcuguguuugucuucuguacaaagccugaagugcuuaugguuuuuuggcuaacagccacagagggcaaaguuuaagacuuucuuguaaggacuaacuguucuuuucaagcuacuguuuguuuuucuaaaagcaggauuugcuuccguaggaggcaaguuccuugauguggaauagugcaaccuguauauggguuauuauaauaggaaagacauuuguacuugcacaguuuaaaucauucuuaaauuuugaacaugugaauugucccaaaaaaucuuuaauuuuuugguaauuuuuacucuuuuugugcacauguugauuucuuaaugguaaauccuucauuuaaagauaguguucucuguugagaauauuuacauggaauaaaacaaucuuuucauggccuguuaag

SEQ ID NO: 13828 - RNA, 10053 nt, Homo sapiens
aaggugggagaaaguguaggaugauugucaaauuuuuggcuuaaaugucuaaauucuagauggaugguagugccacuaauguaagaaaagagguauguaaaagaagauuaaaaaguagauaaauuucauuuuagacuuguugaauagagguaccuggggcagauggacugccuaugcaacugccacuccuccuccuauagaagcuuuauugagguauaauucauaugccauaagauucauuugcuaaagucuacacuugaguguucuuuuaguguauuuacagaguugugcaaccauaaccacaauugaauuuuagaauauuuucaucaucccaaaaagaaaacccuguacccauuagcagucauuuccuccuccuccaugugcuagcaacuguuaucuauuuucuguaucugaauuugccuauucuagugaauuauucuguugaucauguuuuccccuucuuccuuuuugaguucuuuuguagaaaggacuguaggucaugcccaauuacuaguuugcuaaccaugacucgucccauucuuucugucagucuaguaucugaaauaauuaauuuauagcagauaguagcuuugcugauauuugggugaauuaguaaaucauucauaacagugaguuuuguuaguguuuggguaaccaggauuaauaaccacuggucaagaguauuuauucagaguuccuucauaugacuuuagaagggucucugcuucguuccccucuuacuuuucacguuacuacuugcaauucucuagcucauauuugauguuccagcaacauugaacccacuuacaguucuuaaaugcucuguuuuuccccacuucuuugucuuugcucauuagaucuucucuaaugagcagaauccucccccagggguuuccaguugcccaauuccuguuuaucucuuuaggcuuagucagcaaaucagaaauuuuagcuuuuuaccccuggggaacccucuuuacagagcccucuauuguucuuaccauauuauguuauguaagagugucuauauauuugauuucucuagaccagagaucucugaacuuuuuauugcucaccuguaaaaaauguuugagcauaugacugcacaguuuguaaauuauguacauguauuaguguagugacauauuaaauaucagcaaaacuuugaaggccaaggaggaugacucacaccuguaaucccaguacuuugggaggccaaggcaggcggaucacuugaggccaggaguuugagaccagcuugggcaacauagugaaacccugucucuuuaaaaaguauauguaaauauuauuagucaggcaugauggugugugccuguagucccaacuacuugguaggcugaggcaggaggaucuugcccaggaguuugaggcuacagugagcuaugguugcacccuagagugagugaagugcuaaugcuuucaucuugucccuaacuuuauaaucaguggcaacuauggguuucuugaugguaggaacucaauacauguugaucugaacucuuuucucagugucuugccuguucuuuuuccaccccucacuggguguuaggucuuccuuuucuuuguguaucuuuaucauagcacuuaccaugcaguauauuacaauuauugguauauacuugucuccuuucaauagaguauaagucuccugcucauggguccucuuuuauuuaugaugcuccuaguaguuugcauggugcuuagcacauaauagacaauuuguagaaugaauaaauugauucaaguggcauuaauugauacuaaucugagaauaauuaagacagugauucuuuuauaguauugaaagauaguauggccacuuacuuuaaaacugcuuauaguuuuaagcagugcaucucaaauuguuugcgaugauggaccaguuuuaguuuccaauccauuguguacugaugcuuuuguaaacaauaaaaauuaaauacuagaaacaugacauaaaagagacauagaaaauauaggcccuaauuuuuaauuauuagauucaaaagaaauacaauuauucccaacuucuguacuuaucucauuguagauuauuaccaaagagucuauggacccuugcuggacccagguugaccauacuuugagacucaggguauaaagcacuuuauaucauuuauuucucguaacuguaugggguagguacuguuugcaccauuuauaggaaaugaggggacagagaaguuaggcaaauuguccaaggucacauagguacuacauaaaagccaggauucagguugggcaugguggcucaucccagcacuuugggaggcugaggcagguggaucaccugaggucaggggucgagaccagccuggccaauguggugaaacccuaucucuacuaaaaauacaaaaaucagcugggugugguggcaugcaccuguaaucccagcuauuuaggaggcugaggcuggagaaucgccugaaccccggaggcagagguuucagugggcugagaucgccccacugcacuccagccugggcgacacagugagacuccaucucaauaaaccaaccaaccaaccaaccaaccaaccaaccaaccaacaaaccagccaaccaggauucaaacaaagguaguccauucuggcuccaaaguccauaugcuagucucuuucugauuuugaaaagaugaaauaagguagcauucuacuauaagaauguuaagaacagacauggaugaaggcaaaaaacaguuacaagucagaauauaauucauuugucuagaaaagagaaggguaaggagucacauaaugauuugcauguaaaaguggaguuauggagauggugacaaacuguucuuuuauuccuugagucagcaucugcuuacauuuuaccuuaguauuaaaguccucaauuugugaaaaaaaagcgaugguauuucuuugaaauguuucuuuuugcccugacucaguuucacauacugaguguaauuguuccugagggggauugguucccagacccaugaauaccaaaauccaaagaugcucucagucccucauauaaaauagcauaacauuugccuauaaccuacccacauccuccccauacuuuaaaucaucucuagauuauuuagaaugccuaauacaguguaaaugcuauguaaauacuuguuaggcucuauugguuuuuuaauuuguauuacuuuuuauagcuccauuguuauuuacuuacuugaauauuuuugacccgucguugaaucugugguuguggaacccuggaauacagagggccaauuguacuuuguuucuucuauucuuccucuuaacuauuuucuuauuugauaguaacaucaaccaaauuguugugauuccauucauaugaaaauacagaaauaaccuuucuuucuccagguaucaguauuuuaagaacaaauuguaaguaaugauuacauauuaugaugcuaauggaguagagaucauauugcugucuuaauuguuuuauaucauaaaauucaugauugaaugaaauugaaaacuuagacuauuucaauuguaacaauaguugaaauuuuuaauaaacuuuaaaaaaucuucuuccuauagaaaucugguuaagaaguacugccccaaacguucauccaaagaugaagagccacgguaaauuacauaccuguucauuaaugcauauuaaaaaauuuaaaaauacuuauauuuuuauuauuuaguaagauauauucuuagcuuuuuauaaagauuuuauaaaguuuaauuuaaaaauuaauguuuaugaaagaaggaacuacuguuuaucuuuuaugaggauaaauacuguagugggcuugaucaacaguuuucuagaauagucagauacagauuuucaauuaaaauguagacuaggacuccacuugaaugauuuagucugcagaagaaaaggauauuuuucauacuugguuguguaguuguuggcuucguagauucuugcuuuuacucuuauagauaguaaaacaauuugacugauugguauaaagggauguugaaaagcacugagaguuuuugcauuagaaauaaauuaaaagguuagaaaucacuuaugaguuuuuuuguggucuuaaagaggaauauguggaugacuguuuagauggagaaacaagaggagacucgacuuaaacaaacaacucuguauauaauugucaguuguuaggauucucagguuuaguguuaauggaguccuaucugagcuguuaaucuucaucuguaagagaguguuccgcaguauguucaaaguagauauauacauuaauacagugauucucuuuguuucucuccuucccucacacacguuuuuacccuuauuuuugacccuuuacccgcuuuggugucaacuauaauggcacuucacuuccauucaggauaugggcaggcauacaggcagcuguguccagagcugauagcaaaauuguucuguagaucagccaucgagaugcauuuggcaagcacaucaucucugcaacagguucagcuaccaagccuaggaauccaaccaaguucauucccaagcucaggccagucaguuggcaacuuaagagauuccaguaugccaaaagagccugcagguaguauucuuauuauuuuuugaccccaaauaucccuuuacuaauaaaugaaagacuacuugaagauauacaaacauguaugacuugagcuuaaugcaggauuuuuuuccauaugaaguuaauuuagaacuaguagcugagauuuagguugaauaugcuaaaauuugcgaaauguuagauucaguccauaccucaccaacauuuguaaugaaaauaaaaguaagucucaccauuuugaaauguuuuugccagguuuaccucguguguagccuuuuuuaauauccuuaaugaguuaaaugacuaugcaggacagcgagaaguuguagcagaagaaauggcgcacagaguguauggugaauuaaugagauaugcucaugaucugaaaacugaaagaaaaaugguaauucuuacaauuuucauccaauugcaauaguauaugaaauagucacacagaaacacuuuguuuucuuuaaaauguguguucagcauaaacugguuuuucuauuucacuacauuucuucuagcuaaaaauuaucacaaaauacucuugcuaauuuaugauccuuuuggauuuaaguuuggcaaacuacagccuaugggccagacccaaccaacugcuugguuuuguuugcuaguugccacaggcuaagaaugauuuuuauauuuuuagaugguugaaaaaagaauaauauuucaugacauugacaauuauaugaaauuuuauuuuuaauguccauacauaaaauuuuauuggaacagacccacauucauugacuuuuauauugccuguggcugcuuuugcaucacacuagcagaguugagugucacagagacuguguggcuuaaaaagccugcaauauuuaucugaccuuguauaaaaaauguuugucaucuacuauucaagacaaucauuauuuuucuggaaauuguaucuguuuucaagguuauauguaaaguguuaagacaauauccuauaaaaugcauuuuuaggaaguuuugcauuacuuucuuccuaagucuugguaaaguuauauaauuaguaccuugaaaaaaauaaagugaaaagccuuuuggggacuuuagacuuuaguguuuaaauguaauuauuuuuauuuguuuuuguuuuauuuuuuauuuuuauuuuuuuuggccgugguuauaaucuucagcaucugcaagaaggacgaaaagcucaacaauaucuugacaugugcuggaaacagauggauaaugugaguuaugacauuuucaugguuaacauaaaaucuuguagacuagauuagcccuaaauacuuuuaugcuucauaucuauuugaguuuaauguuucucaguguauuauuaauaauuugacauugguauuauuguauaauagucaauaaaguguaaauggaggaugugaggucauuuugucauuuuucuuguuguccuuuauaacucuauacuuaagaacucuguaaucuucaaucauugugaacauuuaaggagauucuuuuuuuuuuuuuuuuuuuuacuuuaaaguaguuacuauaaaguauuaauagaggauagaaguaagagggaaaaggagauauaucuuagaagacuauuuccugaggacugagaauaaucaagguucuuuuucuaccuuuaacuuaacacuugaugucucuugacuucauuuuuagcaugugaaaaaugaagagagugaacgagaugauaugaaauguuucuuccaguucagucauuguauaauuuuguaaaugcuccugauauuggccugcuaauagaaaccuucccauuguaggaaauaaaguacuuuguagggcaaaauuauaaaggcauaauaauuauuuacuuaaaaauuuccccaaggcacuugcucaugugguuuuucuuaaaugcucucguauauaauuuguaaaacaagauguucacguagaacacugcaguugccuuuacauaaaaugcucuauaaucugugucaugggauuagagucaaaaaaaaaaaaaagcucuauuaaaugauauucuguaguauaagauacucuuuuuggacccucaaguuaucgaacaguuuacucuuuacuagcauauuucucugguggacacugcguauuccuugaaaauuaugccgaagggaguuuuuccauguuaaauuaaucaguuuagccugugcuuguuagaaaaaguacuuugagauuaaaaaucucauguauauacuuccauugcuuucagccuguuuucuuucccuuuuaaaaaugcauuuucaaaacuuugauuacauuucuacuauguaacuaccauugaugugauauucuaaucaccagugcugauugagaguucuuagguauauuaauaauguuuucauuuucauuuugauuuucuaauugguuucagcaagacuucaccaaguauuuauguugauuaaguuuuaaauugccuuaacuaucauccuuaguaucugccaccuaaugaguguguguguguuuucauuugcacaaaauaacauacuccuacauucaugagucauugguuccuuuaaaaauugguguuggcacaaauuauucuuaauaggugccaacuugccuuuagaacaauugaccguuguuaagcaaaaguuuuagaggucauaagaaagaaagaagcaucaaaaauguaggagagauuucuuuaaggcauuaacaaugcuauaaaaaaaggugaguucagcucuacuuguguuuauugaaaaguauccuugacauguacucuggagguacaaaaguaaguaugacaugguucuuguuuuuguagcacuugcagucuagugagggaaacuaaccaauauaauuucuguuuaauauguagaaacaaguguaggauucuauuuccuaguuccaugucuuccucuuuagucaagaaaaugaaauuguagaauuccuaacacguuugaaauaauugcgaggugauguaaagaacugguggacagguugaauuagugacaggguauuaaaaauugaggaaaaaaauuaaaagacaguuauuaaccuugggaugaauaaaguaggcaguacuggcauuuaagaucaggacagaagagccuguaaaggagguauuaaaggaauggucagagauuaagaagauagaagcaucagagaugcgagguccaucaguuacaaggcuccaaguaacagagcauacaguuuuauaagagcagagcucagaaauggagcaguuccauaguuagucaguagcccacgguugucaccaggcuccaucuccuuuucaucugucuacuuugccaucuugaccaggugcucuuuuccucagccaugucuccuuaaggucagcaguaggcuuaaagagcuaaacacgauauccucauucaguuucauccagaggugggaaaaaggcagcauuucacuuccaacuaucccauuuuaucagggaaggaaaacuuucccagaaaguccccaacaaauuuccucuggaugccuuugacagaauuagauuacuuaccucugcccuggcuguggggagucuaggagagcaaguauuagcuguuuucugccucuguacugggcggggcaggcucugcuaagcaagaguaggggaguagaaguggcuguacuucgucugccacaccaaggaugaagggaaaaacaaucuuuucuggaguauauuucugucuuguauaauguuauauuaucuuucagggaaggagcauuuuuaauauuauuguacuacuaguucuuuugcuuuugcaaggaauuauuagguagguguuuucccacaaauaagauaccaaauauaaaaauacuuuuguacauaaguagccucaguuuguaccagaauuaguagccuauaguuacuugauuggaaaacacagcucugaacucaguuucagagaaugaaauguggaagcuuaauuuucauagcaaagugauuuuauguaugaguauuuaaauauuuuaggggcuuugaguaaauuacaagugccucauuuggugucucauacuaaucaaaauaccuguacaaaauaaagccuacauuuaaauaaauuugaaaaaauccuggagcgcauuuauuugauguaaguuauaggccuaucugguuguaacuguauuacaaacugaacuacgaaaccucuuggcuacaaauggcuugauauaacagcuauuguaguuuuaaauuguauuuuaaacucuuaguuacuugaaagaaagggaaauugcuaacugcuagggaacuauggguaaacaaauccagagcaguaggugucugagcugauaaguggcauuuggaaaaauggggacaggguguuugagguauaaugguuuccuggaccugguacuugcuaagggcuuggauuuccaggguaagaaauuaacauuguaacugguucgauaaaggagguuagguaaauacaaaauauugagauccccuguuugcuucuucugaggaauucucagagcacagguugcaaggugcguauuuuccaggcaagaaauuggaagucuuucgggguaaucuaaucauuuagggagaaaaagcuuauaaaaacugcugccagguuuuuccaaggaaacgaacucccuggccaugucacccuagaggaaaauaucauaauccguaaagcccgaucgguggagcuuucaauggcuuuuuaaauaagagcagauauccaaggaucccaggauauuuaaagaagacaucuaaugugcacaugagggaccagaacuaauaugcaggaaagaaggcaaugugacuaugaaaggaaaugaaaauuaaaaugcaaaaacaaacaaggaaaauacuuacagcuguuagcuaauauucucaaagggaauagagaaaauuuuacauccaugaaauaagguauuauuuuaaaagaaacauauaaagaacaaaaaauaacucuaugauaguagaaaaaaaagcccacuagaaaaaaaaugaaagauaaaguucaauaaauaccccaguagagcaaaaugacagacauugaaaauauggaaaauuaggagacucauccaguagguucauuuccaaaauaguaaacauacuagaaaagagaaaacauagaaaaggaacaaaacauagaaaaggacaaaaauaacucaagaaaguuuucccagaacugaaagacaugaauuuccagauggaaaggauaucccaugugcucagcacaguggguccacaucucuugaaauuucgaacacuuuggagagagagaagauucuaccacccuccagggagaaaaaaccccaaacaaacaaacaugguuuauacaaugggucaggaaucagaauggaauagacaggauaguuacacaggaagccagaagaauaguggagcaauacuuuuaaguuuuugaaggaaaaugauuuccaacuuagaguucuauauccagccaaauuuugucaauuaaaaaugaugguaaaugcauuuuuagccauggagauucaguuaucuccugcagaccuuuuaggaggcugcug

SEQ ID NO: 13829 - RNA, 814 nt, Homo sapiens
ggguguggaaguuggggggaaaucacuccuuugucuuuauuaaagaaacuuagaaagagaccagaccuggcaaccaaggggugagguacuggccaggaagguggagugggcucaggcucuguggauuucaagugcagacugacggccugggagaggccaaggagaccagauccuggcagcagcugaggaggugcccaagggcacuuucaggcacuggggccuucaguuuguucugugggcaaggguuggggguugggaugcaggguagguugggcuggccuggaaucucccugagggcacccugccuuaucuaccuagaucauucacugguccacauccuguucguuuccuucauguccaccucauugaccucuccgucaucaggugacccauuguagucauucaucuuguccauguccugcauguccucaucauccucuaaguccucuucacuauccucauugucuucaucauccuccucuuccucaucaucauagugcucugaggcuggcuugccaauaggaaccagauuguugucuuucucugugaugcuuucgagccaggucugaugcugcuguuccugcugcugcagcucugucucucccauacaaggucgauccagauuaaaccacagugucucagucccacaaaggaagagugagggaaacaaaguggacaugguuccuagacuggguuugaguccuggcuccacuacuuacuagcuguuugaccuuggccgagucacuuaaccucucugggccucaguguccuccucgcaccagggucugcagccaguggagacccggaagcgcuu

SEQ ID NO: 13830 - RNA, 83855 nt, Homo sapiens
uauuaaagcuaucuaauuaaaggcaagaaacaacugcuuggggaauacacauucacgccacaggaagccauuuaacugcaaauagaucgucuaacgacucacggaaaucuaaaggaaacugcguguccgcaugggguucugaugccaaacuacggauuguucucucagguaacaccuaaccuaagugaaguccuugguggauccgcguucuugagcuuagaaaauaccgaaugaacuaccaagagcaccagaauaaucgccuccuccugaagaacuagccucuuucucaccacaccagacagcacguccuacaaccaccuuucccccaacaaccaaacuccagcgccaagcugccgcuuuugcagaaauguucuaucucuuggucucgcgcgaucucgcgccuccgaggaagccaacuguaucgcgcacgccaucaaauccccgcgggaauagaauuccgcagguccagaaagccgggaaaucgcgagcggaggcggaguuaccucggugagcgugaaggcggagcccgcuccgaggggcgggcucgaggcggggagaggggcggggcuccagggaccuguugaucgcaggugucacuggccugacuggucccuggguauuggggcguaugcgcaugcuccgcucacagggucgggcucugggcggcggagaccagccgccugugcuccaguucccggugagccucgguacuguggcagcagucagugugucuggcgggugucggcgugaagcggggcugggccagcgggagguagcucugugggaguggaaggccuguauuucucuaccuggaccgcacgcuccucgcgcaaggaggguagagcucaagguaagucuccgaaacuagcccucugguuggagauccagagaccugcgacccccgcgggccugaccgggacacucucauucuagccccagagcucgucucuccccucgcagcccggcgaccuccuauggccccggcccucugggcacacacacacucucuuugcugggcgguucagacgccagaggucacgcagcccuuucgccccuucucgccgcgucuggcggagaugccucuggccaggcuggaggcgcucgcgaggcgggaggaggugcuguacuuguuggguccuggauguuauugcugccguguuugagggcggcgacaagcuggaguccugcugggauugugaguaauacccuuacuuggcuccugccccuggcuguccaagccacauugccucgccugagcacacaguuuuuuacuuaaagggguccaggaugguuaugcucccuccuuggagaagagagaugacuggacucgugagauucuugggguggugguuucucagugguaguggugauguauauaaaguuaauguuuagcuucuaaagggcggcuuacggggcauuuaccaaacuauuuuuaaacaguguuggagaacaggaaguacuugcacagguguaauagggaggguuucuaaaaccugcaaucugaggauguuuugagguuuguaacccugcuacaagguuuucuuuaucaaugcaaaguaugcagggaauuaccaguuggacagcaaaguuuuccgaaaguuuccuuaucuggaaauagauauauauauauauauauauguguguguguguauguauguauguauaaauauauauauuugcaaagaauaucuaaggcuauuuuugagguagguuuaauaguaaacuuaaccuguagucccagcuacucgggaggcugaggcaggagaauugcuugaaccggagguugcagugagccgagaucgcgccacugcauuccagcaggggcgacagagccagacuccgucuccaaaaaacaaacaaacaaacaaaaaaacgcaguacacuuaggaagguuuuugugauuaagaucugauucacuuuuaguuauuaaaagaaaaggcuugcugauuuucacuauuuaaaaugaguagcaagugcuaacacaaaaugucuguuggaaaugaacuuuuaguuacauugauaauuguuauuuucuguucuuuucaguuccgugaugauggucuaagcaaagacccuucguccuguuaaagauaaauuaaaaaaaaaaaaaaaaaaccaaagggaacaaaacuuacucugcaaaaguaauauaugauuuaccugcuguugucauaagaauuccaaauagacaaacucgguguaaguaggaguuaauuauagucugagaaauaagguuuuuguuuuguaucucaaaggcuuuuaaaauaagcuccuugauacaauuugugcagguucguguuuacuggugauaaaccaugaaagugauuuauuaagauuuuuucauuaaugaaacugggagguuuguguauuucuuccuaacguguaaaaaagagacuaagaacuggccuuuccuuuuuccuaagaauuuuaacaaauauuuuuaaaaauguauguagauuguguaaguucauggaauuugauacuaauaaucaauucguuaauauuuucacuaaacaaugcauaagauaguuuuaaaaaagauauuuuaaugggaagguagacuuuuccaacuaguguauucuuuuccuuaaaaaaaaaaaaaagaaaaaucacaauacucuuaagaccugccauaugugcugugauucaaguucuuuuauauuguuuaauguuagauguuuauuuuaaacugugcaguaucaagaaauacaacuuugguaccauaugguuuacaaguuuguuuuagcaagacaaaguuuaaaaaugaaaauuuuaucucauuuaagguuauauguagcuuuaaaagccaaaaucagaauuauuuucccuccuggaauuguuuggaacucucuuacuuacugggguaggaggggguacauugcuuuacccuacaacuuuccgaaaacacaguugaucuuuauaaagugauggaauaaacuauccuacaaagauguuugguuacuaaaauacuuagaagauccuuuuugacagcuuuaacuguaagguauuucuuguagaacucaaaaacaaccuguagaaaguuggguaguuuauauauugcaucuggaagcauuuuuaacacagugugcuaggugugcuagggccaaaaugauugccaguuucgcuuacucugcucaugagcucuuguuuuaaggagggaaguaugcugauuuauguuaucuuugcagagcuagguagaaauuaaugauguuacaaauauaguauuauuauauuguuaauuuuauacugaugauuuuagaaaauuuugcauuaugguauuugcacaugauaggaacaagaaacggaugcaaccugcucuacuacaaguaaaaauccucaaagguuaaauuuuaaauagcuuuauguaauauuguaaucuuugcagguuauacauuuuuuaaaauuaauaauaagaauaccauagauaccauguacaguauauagaauauuuaggcaaauaauauucugugcucuuccagguuaacucauauccucuaucaggaauuguugaaccaaaagcccaugauuagaacuguggucugugguuagaauugaguuuuaauauaauugguuuucuuugugaucuuaguauuuuuuuuucuuuuucuuuuuuuuaugcuaugaauuuuauuuuguucauuuacaaacauuauucauagggggcuucauuaggccaccaaagauguccaugauacaagaaaaggcuacaaaccauugcaucuggcuaaagaauuaugauuuuacaugagacuucagaagaguugcuucauauacucugcaguucaucagaauuuuuucugcaaaauaaaccuuauuccaauaucuuagcuauuuuuaugaacaaaaucaguuauuugaggugucaugguauuuuugaauuaauuugaagauaacauuaguuuucaauuuuacacauauuacaaaaaagaaguuuuaagaaauacccuuccuuuggaaguuuuuuacugcugcgcuuuucugaguuagaaguauugaauaaacauuauugaccuccuauuguaugcuaggcauagugcuaaacacuagaaagucaaaaguuaauuagacaauguuggcugggugcuguggcucacgccuguaauccuagcacuuugggaggcugaggcaggcggaucacuugaggccaggagauugagaccacccuggccaacauggugaaacccuaucuguacuaaaaaauacaaaaauuagccaggcgugguggugcacaccuguggucccagcuacuaaggaggcugaggcaggagaaucacuugaacccaagaggcggagguugcaguuagcugagauugugccguugcucuacauccugggcgaccgagugagacucugucuaaaaaaaaaaaaaaaucauuaaguaguuauuuuucugaaaacuuauacuuugguugaaaauuucuaaaucaagucucuguugcugacacuuacuucagucacuuuaucuuucuuucugauccauuggcuguuaacauuuuaacucauuuucuccuucucuccuuucuaguccagaaagguuuuguaaaugaauauuuacaacaauucuguggugaaaauccacuuauaaugugaaguauucccaaacauucauuuuauaaauuagguuuuucauaugcuagauauucuuaaacuaggauagcuccguaacaaaauugcuuaugauuuacuaagaacagcuacuaaaauuuuaaaauuaagaaauugauauuucauugaacaauuuaucugaucucauuaaucugaauuaaagcaaugguuaaguuuaauauaucaguuuaagguauuuccuuaaagauagcaaaauggaguauaaaauauauaauacagcgucugcuuuuuucuaaauccuuguugacauuguuaaaaaucauuuuacguggaagauaauguuauuauaauuagccugcauucguugaaugccuauguuuuggccauuuauuagguauuuuauacaugguuuaugauucucacaguagcccuaugauuuugauuauagaugaugaaacugauagauuuuuaaugauugaguaguugagcaauguguuguaaacuuuauaucagaggaggaauaaaauaucuaugggaauuauaaggucacuaucaggguauggauuccauccuugucaagaagccaucaggguauucuuugcccaucagauaccucauucuuuggcuuuuucuuaacuccucagccugcauaauaaacuguugccccucucauggugccccuccccauacuuaggugagcagauugagcccuaaauuuuuccuccuauaugaugcuaccauauaggcaugagauaaugcuccuccuuugucaguguaguacugacacugaccuaccugccagaugguaggaaauuguccuauacuuuagugccuagguugucuuuguuaggaacacuguuuuuuccaaaggguuuguuguuugagauuuuacuuuguuuccugagcuuccuuuaauaaauauuugaugaaaacuuaaccaugcacuguguucuguucuagaugcuugggauuugcuuuacauucuaaguggauuuggagaagagacaauaaagaauaagcagucaauucuauaauauauuuagaaggagaaaagugccaaggaggaaugaaaaaguagaacaagguaagaggaauuuggaaagcgugguagagauugugaugguuugcaauuuuaaauaaguguaggccucauuuaagugacuuuuuuggcaaagcaauuaugaagggagggagggcaaagccaugugggcguuauggggggaauguauuccaggcaggggaauggccagugcaaacaauauagagaacagaaguuuguauagugugcaggaaugagaaggaggcugauguggcuggaaugggaaagccaaaggucaaguaguuagaugaggggcugggcagauagugacauuaugauuuaauuuuagaaagaucucugucugcucuccagaauagacuuauauguuacuguguaaaggguagaagccaggagacaagcugcuauuuuuuuaauccacacaagaugugaugauggccaagacuagaauuguugaaguggagguggugaaaaguggucagauccugaaauaugacagaaaaaggagucaaagaugacaucaagauauuuguucucagcaacuggaaagauaaaguugccauuggcugagauggggaggaagguauagauaaaguaagaguucagucuggggcuuugucaaggcaaauaaauguuagguuauugcuggcuugacauaauuuucuucuggagaucaugucuuaaaaguagacugcuguaagccauuuucuuuaaugaccauguccuauauucuggauacauguguaugcuugucuuuugcuaguuaguuacuaguggaaacuagugaauagguaaaagcaacaugaaauauagcacgguuuuuuguuagacacaaagaaauagagcaaaaaaguggaaacauugaaaauuacuuaaaacuuacuguuuuuuuguuggcaguauuauagucuuuuuucuuauuaauuuuauuuucuguguuuuauaaauuuucuacuguagucuucucuaauuccuccauuucuagagugacaaugguuuuacacaucaaagaauauuuauucuucaauuauaccuuccuuacuauaauccuuuagcuuuauaaacacaguuacuucuguaaugaaagauauauuuuuucuuuuuucugacacuaucuacuugaagaugaagaguuuuuuuguauuacuucaacuugguauaacucuucuguuugcuaucuaguuaucuaaaauaaaaucuuaaauacuucuaguaagaugagcaguuguagcauaucaucagaaaguccucaguguaucuuugaggugcuauauuguuagugaaaagauguuaauaugaaguuuuacuuuacaguuugauggcuaggacuguguacuauuaagaacauauuugcagugauucugugcuaauauggaauuauggauauuucuaauuuucuuuauguaguauuucugugguauuucagaaaucuaaugaacaaguacuguuugauaaucaaaaaaauccauacacauaaaagaacaaagagucucauggcuuuaucaacuauuauauuaguuuccuagggcuguuguaacaaagaaccacaaacuggguggcuuaaaugacagaaauuuauucucucacaguucuggaacuagaaguccaaaauccaggugucagcaggauugguuccaacugagggcucugaauagaaucuuuccuugccccuuccuaacuucuggcaguggcuguucaucuuugguguuccuugacuugcagcuucauccuuccagccucugccucugucaucauucucucucuuucucuucuuauaaugacugcuaccagucacauuggauuaggguccaccccagugaccucaucuuaaucugauaacauuuucaaauacccuguugccaaauacauugacauucauaggucugggacuuggacauauguuuuugggagacacaauucaacccauaauagguauaaugaaucagguuuaagaugccauuaucauuuacccagaccauucuaguagccugauaaaguuauuggauguuagaauuugaacaaauuccauauagugucauccccuuuugggggaaaacaccuguuaaauaauuuauauagcauggugaagauuaccuaacuaauuauguauugggcuuaaguuuuggaaggagaaaagauaguuugauagucuugucuaggguaaugaaggagaguggcccuggaaucuugccuuuuaggauaaaauuauugcugguaaagcacugacucauaagaaaacagcagugacuuauuuccuuucuuuucuuuucuuucugucucucucucuuucucaaaacuucugguucauuuuaaaguucaaauuuaaguuuuuuauuuuaaaauauuuuauuggaaaguauuaauaacugauauuaagcacuuaauaaaguuaaacauuuuguuuuuucuuauuuaagccuuacagaaauuuuaauaacaguaaauguuguaauuauccuuauuuuacaggcaaauguggauauauguuuauaacugcacaaaugaauucugaagggacgcauaagacauugguauugguugccuauggggaauauaauugauaugggggagacuugguuuuccuuguaugcucuucuauaugguuuaaaaaauuauuuaugaaaauuaaauauauacuaaaaaagagggaaauugcugaguuuuuccuuuuagcugcacuauuaacucuuuuaggaaaaagcagugaucuaucaaauuguauugagauauucaguagaucugcuacugaaguacuuauuuacauuggaguuaaaaacacaaaugcaguuugacaaauauaaauucuuagaaaaaguaaguucuacucuuuuauuuggggauauaauauuuuacuuauuucauauuugcaguguuguaggguaaugcaguugcuuuuaacaagccauaagugaacuucugagaauuucauucaaaguaaacaguuaggagaauauaagauccuuugaagugauucugccaguuuucuaauuuuuuucuuuaagaauuucuuaagcauugugaaauauauuuauguauuuaaacuuuuagaaauuuaugcuguuaaggaaaaaauuauucaugacaauuguuaaagaugguaaggaagacacuuguuacagauagguacagggagcacugcaauggagucuugcaguuggggagagagauugggcucuacucuauauacuacaaguaaaagcgggaauuuauagacaaggaugugggugugguugguggauggaaaauuacuagggggcaacauuaggaauaagagaggauucuggccaaacugaccuaacaggauucuuguugaaggcaggccagggugaucagacaucaccuggaggauggugaaggaugaggaaccuaaucagauaugaggaugaucagauaaggagaauggcugacuugacuuaguaggacucuugcuaaaauuggacaacguagagacaaacaaggaaguccaaaaguugaggaauaguugaaaaagaacauggaauagcucgaguggaguuugaucaaugagagaaucuuugucaauauuuucugacaccuguaucugaaaauaucaaauaguuacuuauauuaggcccauuuagaaaaucaaaacuguuguauuacauuagaauuaguauuaguggcaggggcacaguggcucauaccuguaauaucagcacuuugagaggcugaggcaggaggaucgcuugagcccaggaggucaagguugcagugagucaugaucaggccacuacacuccagccugggugacagagugagaccccagcucaaaaaaaaaaauuaguacuaguauugaauuagaaaauuuaauauaagaaaaaaauuuaaaaagcuguuagaagaccuuaaggagccaccaggggaagauaaauuaucugguguuguaaguugccacugucccuaggcuuaaguuccaaagacaggagcccaagagcuggaaccaccaagccugaccuagaacuuuagaggccuugcuguaaacggggaacuugagccuucgaggagaauaugccagagauagcaacagggcagagagagaaggggagaaauaccuuggcuucucuccuuugucuucgauuuucuggcagugccucugauuggccgaaaugggccagaaauggauucacaagggauccugggaaaugcuguuugcagagaucagcucuguaugguugucccauacacagcagagcaaaggagagagggggaugauuuugaaaucaaacauggacauaaacugcauugcacugaaaacuuaccacaauauacaauagcaccuugugcuucucuuuccuucuagugccacccugaagaagcaaacacuuucaagucuuucagcugauuauucuauaguuuuauuuauauuucuaaauaugaauucuguauugcuauuuggugauuuuucaagcuuaaauuaacauuaauuuucuaugaugguggauauagguuuaguuuuuuuauuuucuuccuuauucuugcaauagaauuguaucuuuuuuuaauuuuaaauuuuauggauauguaauaguugcacaucuuuaugggguacaugugauauugugauauaagcauacaguguauaaugaucaaaucaggguuguugggauguccaucgccuuaagcguuuguuucuuugaguuaguaacauucuaauacuacccuuguaguuauuuugaaauauacaauacauuacuguuuagucacuguguugugcuacugaacaccagaacuuauuccuucuaauuguauuuuuguacauugaccaaccucucuuuaucccuucucuccacuuccuuucccagccucuaguaauuguuauuuuacucucuauauccaugagauuauuuauuuauuuuuuagcucccacauaugagugaguacaugggauauuugucuuuccgugccugucuuauaucacuuaauauccuucacuuccauccaugucguugcaacugacuggauuucauucuuuuuuauggcugaauaauauuccauuauguauacauaccacauuuucuuuauccauucauccauuggcggacuuaagacacuuagggugauuccauaucuuggcuauugugaauaaugccacaauaaacaugggaguauagacaucucuuugauuuucuuucuuuuggguauauaccacuagggauugcuggauuuugcauugcucuuuuuucuccuggaacacauguaauacaaaaaauaauaaauauauucccacuauuuuuauaauuauuuuuaugauuuaaaucauuucaaucacuuuauuacacuucuuuguaauaaaauaacagauguauauuuuucccuuguggauuauguuauacauacaguuacuuugggaaccaguaaaucugaauuuucacugucucuauuuucaguaucuauaugcacauaauaaauuuugagaaauaacuaaaaccuaagaaguuaaaaguuuauuacaaauguaucuuuuagugagauaagcugagcaugaguuaaggugcccaauuaaaggaagcuuaaauuacaccaauauuuugaguuguuccuuuauuuggcaccuggagauuuuuguaguaaaccuagaaaauagaauacuguaagauguaggaugggugagggguauaugucauuauuuuguaaaguaggaggaaagcaauugugaaagcagaacugggaaagaacuacagacgaaucguuagccagaucaauucuaggaaaguguacauuuggaaguggcagaucuguaaauuaauuccuuuaaaucuaaccauaccuuuaaucucugggaaaaucauuauguuuucuuggaugugcauaucccaauuugaagaucgcugccuuuaaauauaagagaaccaagauuguaggauuggugaaaagucaaaaaaggagaaggugacuugauagaggacaaguuagaaaucccgacuaagaguuuccucccugguacuucuguguuugugaucuuccugaugugcuucuagaaucuuuaccauccacauuauuuuucuuauugcuaccaggguaaucuuaaaacaggucugaucaucauaggugguuugguuagaaguaaaaguguuaaauuggccuuuaagguauauaauuccuaauuuuagcucuacuacuuacagucucuaaaaacgaguccauuacuaaacuucuccugaccugauauuucuuacacugucaaaagaaggaaaaaaguuaguuuaguuuagugguuuucauacuuuuuugaccaugacucaagguaaggaagaugauuugcaucacagucuaaguaccuauaucuacauauuauuuuauuggagaccugaauuucuuuuuaaauauuuuuuauguauuuuauuuuauuuuuugagauggagucuugcuguguugcacaggcuggagugcaauggugcuaucuuggcucacugcaaccaucauuuucugaguucaagcaauuguccugccucagccuccugaguagcugggauuacaggcgugugccaccacacccggcugauuuuuguauuuuuaguagagacgggguuucaccauuuuggccaggcuggucuugaacuccugaccucgugaucugcccaccuuggccucccaaaguguugggauuacaggcgugagccaccacaucuggcuugaauuucuuuaaacagaaccgauguauaaaugcuacauuaagcccaaagcagccauguuuuauuauauuacacaguguuaauaaugaauugucagaaugcaaauuacuguauacuagccaaaagaauaucacaacuaucacauuuuaaacuuguguuucuuagcauguaugagguuuagaauuauuuaacaauguaacucagugcauuuaaauguuguggaguuagggagggagguuaguucuaaauaucuuuauagaucugauuuaaagcuaugaucagggaggcugaagugacuagaauuuguggagcagaaugcuagaagggaaauaauuucacagagaggaaacucuggcaaucugcauaagagugcccuugaaucucuggcugggaacuggguacagggagaaacuccaggaggcuggggaaaggaguacuugaaaguugaacaagggaaauuugaaacuauguugaacagaauaaaauugaaaacaguauagcagacugugugggauuuaaacuaaggcaguguggagggaaauuuauaacaaaaugcuuauauuagaaaagaagaaagcucuaagcuuuuaucagaaaacuggaaaaagaagagcaaauuaagcccaaaguaagcagagaaagaaaauaauagaguucuggaaaccaaugaaagugaaaacaggaaagcaauagaaaaaaaaucagugaaaugaaaagcugauucuuugaaauuaucaauaaaguugauaaaaucccuagccaagacugaucaauaaaagagaagauacaaauuaacaguaucaggagugaaagaauggacaucauugcaaaccuuaccaacauuaaggggauaauacagaguauugugaauuuuuuugccaauaaauuugacaacuaggugaaaugggaaaaguccuuuaaagacacaaacuaugaaagcucacucaagaagaaaagaaaaccuaaguagcccuuucuaucaaagagauuuaauuugugauuuaaaauauucccauaaagaaaauucuaggcccagauagugcuacugaugaauuccaccagccuuuuaagaagaaauaauagcaggucuacauaaacucuuccagaaaauuaaagaggagaaaacacuuccaaguucacuuuaugagaugauuauaacucuaauaacagccaggcgugguggcucacgccuguaaucccagcacuuugggaggccgaggcgggcagaucacgagguccagagaucaagaccauccuggcuaacacggugaaaccccaucucuacuaaaaauacaaaaaauuagccgggcgugguggcgggcgccuguagucccagcugcucaggaggcugaggcaggagaauggcgugaacccgggagguggagugagcugagauugcgccacugcacuccagccugggcgacacagcgagacacugucucaaaaacaaaaacaaaacaaacaaagaaaaaaaaauucaguaacaaaaucagacaaagauaucacaagaaaacuacagacugaaaaucccucaugaauacagauguaaaaguuauuuaaaauuuauuagcaaauuaaguccaaaaugcauaaaaagaauagguuuugauaaauuggcaucaucgacaggaauacaagguugauuuaacacuugaaaaucauuguaauauacugcauuaagacucagaaucauauaaucaucuuaguauuuacaaaauuuaaaaguuuugacaaaauucaacaaccauuuaaacugucaacaaauagaaucauauaaucaucucaguauuuacaaaauuuaaaaaauuuugacaaaauucaacaacuguuuaauauaaaaguuucaacaaaguaggaauaaaggggaacuuacccaaccugauacagauaccuguaaaaaucuacagcuaacccuacacauaagguuaaagacugaaugauuucaucucagauuggaagcaagauuaguauuucuguucuuacuucuuccuuuuggcauuguacaggacguccuaccuacccaguuaaguagggcaagaacaagaugaaagaggcuuacagauuagaaagcaagaaguaaaaguaucuaagaaaucuauacaauagcuccuagaacuaagguugcaguuuuuauugucaguacaaaaaaucaauuauauuucugcauguuaguaaugaaaaauuggaaaccaaaauugaaaacaucauuuacuauaaugucaaaaaaagaugaaaaacuuagagauaaauuuaaaaauauauauguauaaccuguacaccuaaauuagcaaaacauuucuaagagaaagaagaccuaaaaaaauguagaaagacauaauauuccuagauuggaggucucaauauuguuaagacguuauuuauuuuuuuugaaagagugugguuuugguauaauucuagacauaccugaaauauuuauaauucauuuaaaguaauggcaaaaagcacaauuacuuuuggaccaaccuaguagaauagagagaccagaaauauaucuacuauguaaguaaucaguuaauuuuuuguuuuuguuuugaaacaaggucucacacucugucacccaagcugaaguguaguggcacaaucacagcucacugcaaccucuaccuuccaggcucacucgauccucccaccucagccuccugaggagcugggacuauauaggcaugugccaccaugcccagcuaauuuuuguacuuuuguagaugguucuuacuguguugcccaaggugcucucaaacuccugggcucaagugauccucccaccucagccucucaaaguacuaggauugcaggcaugagccacugugccuggcuauaaucaauuaauuuuugacaaaguauuccaaagcaauuuagggaaagcauacucauuuuaaaaaauggugcuggaaaauuagauuuuguuuggacaaaauuaauccaaagccuugucuaacacuacacacacacacacacacacacacacacacacacacacacacaaacuugaaaugaaucauagagcuaaccauaagagccaaaacuuuaaaaccucuacagggccgggcgcuguggcucacgccuguaaucccagcacuuugggaggccgaagcgggcagaucacgagauugcgaccauccuggcuaacugggugaaaccccgacucuacuacaaguacaaaaaauuagccgggcgugguggcgggcgccuguagucccagcuacucgggaagcugagccaggagaaguggcguaaacccgggaggcggagcuugcagugagccgagaucgcgccacugcacuccagcuugggagacagagcgagacuccgucucaaaaaagaaagaaaaaaaauugcauaguauucaaaaacuuaggaaggcacuuuggcaauuuucuauaaaguuaaacaugcauuuacaauacaaccuagcagucccacugcuagguauuuacaagagaaauguauccacagaaagacuuguacuugaauguguauaguuacuuuauucauaauaaccccaaaauggaaacaacugcaauuaaucucccuuuaccaguaguaaagagauaagcaaaagaauauuacucaguaauaaggaauguacaacuucugauuugugcagcaauacagaugaaacucaaaaguaugaguccauuuaugagaaauucuagagaaguugaaacuaggacagaaaguguaucaguguuuucuugcagguugaauguauuaauuuucuauuacuauguaacaaauuaccacaacagcuuaaaacaaugcacauuuauuauuucacaguguuaguaggucagaagucuaggucguuuuuaacuggauucugugcucuggaucuuacaagaguggucaaagcaucaaaugggcuggccuuuuaucuggaggcccuaaggaagaagaaucugcuucuggguucauucagguuguuggcagaaguauuuccuuguaggagcgagguuccuguuucuuuguuagcugucaaccaggaucuguucucucauguugaggcccccuccaccuuuaaagcagcaauggcacaucaagucuuucucaugcuucaaaucucucuuuuucugucaccagccagagaaagcacucugcuuuuaaggauucaugugauuacauuaggcccaaccagauaaucgccauauuuuuaggucaacugcgccauauaacauaaugagauaauggaauacauaucuugucauauuuacagguuucuauaggguaugaaaucuggggaugggggugugggugcacugugguagaauucugccuaccacagugaggaagguuauugacugugaaggggcacaggagagcuucucagggugauggaaauguucuauagcuugauugugguaaugguuacaugacuguagguuugucaaaacuuacugaacuguacacuaaugggaugaauuuuauugauuacaacuuacaccuccaaagcugguuaacuuaaacauccuauguacaaaaauauuguacguaagaaaauuagcugucacugagauacuagugaccucugaauuguuuaauuuggaucuuacugaacagaaaauagacuaaaauauaaauagaaaaaguaauauaaaauagaaggaagaguaaggaaaacuacaguugcguguguaaguagauuuagaugaauaaaagggaggaaggaguuaauuacuggcuguuccuauagaccuucuguuagaguuagauucccucuacucugccuuccuuuuugcuacccagguauucagccuggggauuauaaaucugaauggucuuagcaacaucagcucuagaccucugucagauacaauagcaauugcgugcaacauagacuguaguggcuaucuguugucauccauccagccaucuauauauggugcuauuaugugaaauaaagacuaaaauauuguccuuuuggcuccaguauaauaauuacuaccauaaaccugguguuucugauauucuuucaggcugccacuuuucucacucgcauguccuuucuuuaccauuucaucuauucuuaugguuucuuauguuuauauguucaugacuugaaaauccauuauguccaacccuaaacucuuccccaggauuaccuuuugaaucuaaauauuuacugggucucuccccuugaauguucuguagaaacucauucauuuuaucccaaauggaacucaauauuuucucucaaacaagcucauuuuccuauaaauacuauuugaguugguauaacaguccuacuaccauucacucuagaaaccugggaacuuucuuuacuuuccucucugcuucauagguuuuguggacuuuacuucugaaagagugucauauucauccccuguuuaugcuaccacugcccuugugcaggccuaugucaucucuccugugcauuccuucaccagccucccaauuuaccccuucuacuugcagauuaauuuaccucaaauucaucuuauucauugccauggucuauuuauaccacaagucugauuguaauuucucugcuuaaaaccaacaaaagcuuuuugccaccuauuagauaaaguccaaauuucuuaugugaccuucaagaccagccaugaucugaccccugguucugucuacuucguacuuuauuguguauauuacuugauuacuugguucauagcauuucuuugaaaugcaucucauccucccaacauacgcaugaaacuugugcucguuuuucaauauauaauaaaauguaaccucuccaagaagccuauucugcuuccacauggaucuuaugcuauaauaugcauaucucugguuuugcauauuuacauguuuuguucuuuuuuucuuugggcuucaacugcacauaacugaguuaaucuuuuuuguuuucuaaguuggcugucuagcccuguuucaauuauacauauauacaccuccuugcucaagugaucauauaaaacauauauguuuucacacauacauuguuuuaccaaagugagaucauauuaaauuccuguauuuugccuuugucacucaaaaacacuuguguuuuccucuaauguggucuuguggucugucuuuggagaguggcuauaaacacuaccccuucccugccagggcuucgggagaucuggucaugaguguuuacaaugugccuuucacaggauacuucuuuguccuggcauaugaccuaaugccuuaguguccaugacccuugauaggugucccucucacaggaaacuuguuuauacuggcagaugcccuuguagcucuugucuuaccuguguugaguuuauuccuaucaagauagccauucucuaggagaguccugaccagaaaagaaguuggauucagguguaacugggcaaaacacacaggauacaacucaccaaaacacaugaaauaacagaagcaguauuacuuacaaaucgagagagaagagggcagcacaccuccuauggccaacuggaaguggggagccaacgagauaugcauauucaaccacuggguggggagcaagagacagagagugaggggaaccuguaggccaaagccuuuauugggguccaggguauuaccuagguggguuuccugcagguaggucuaauugguggguuuagaguaaguggguacauguuccaugaagucacugugacugaaagguggucacuguggcauaucugcacagcccaugcaggcugugugagucaguaggucaagucaaguggguuguauuucacugaccaccuauaaagaggugguaacuaggaagcaguuauauaaaguagauaucuggauugaccauauugaggaacuaggaagagguagaaaacuggaaacugucagggguaacugaguacugcuucuggaaucagaaaguccaacuuauguucaaaguggaugcagagguaacauaaaauuauaggaauucacagcgaacacccuguagcaauuauguuccuacugauggauauuuacuuuauuuccuucauuauuuacugguagaaccuaauauaucucaauaaaaauguacuuuuauuucuggaguauagauucucaguauuggguuucggagguugaaguguguuuuaauuuuuaauaguuguugccauguugaucuaauauugccagaggguauaauaguaugauuacauuauuagcagugaaagaagguaccucuucccuuuuauccucaccaacaguauuuuaauauuuuugccagucugauagaaacgaagcagcuuucaaguacuguacuauaaugccucuggguuggagguccccaagaucccucccaccugacagauuuguugauucucuagcaggacucacagggcucagcauauaguuguaugcauugcugugauuuauuacagugaaaggauauaaagcaggaucagcaaacagagaaggagccggaggugaagucaggaggaaaccaggcacaaacuuccaauuguccucugccaguggagucacacagggcacacugauuucuccagcaauagauuuugugaugacguguaaaauguuguguaccaggaagcucauuagagacucagugcuuaacauuuuauugugggguggucacuaugcauccucugccugggacguaccaaaauuccagauuuccagaaggaaaacagguguucaggauaaacauuuuguuugugcaguuuaggugcagugacccacucuuaucagugugguagaaagccuccccaaaucuugaacucccaaaggucagcccugcaagcagaccacuguaaggauggcagucucaggaaugcuauguaaagucuuuucuuuugcucuuuuuaaaaaacagcuuuauugaaauauaaucacaugccaugcaauucacccuuuaaaaguguaaaauucagugauuuuuaguauauucacagaaauauauguacauuaccacagucaauuuuggaauauucuuacuaccucagaaagaaacucuaucuuuaacgaucaccccucauucuccuauagcccccacuucuccaguccuaaacaaacauuaaucuacuaucuaucuuaguagauuuccuaguuguggacauuucauaugaauggaaucauguaauauguggucuuuugugacugacuucuuacacuuugcuuaguuuuuuaaauguucauucaugucauaguaugugucacuacuuccuuuuuauggcugaauaguauuccacuguaugaauauacauaacacauuuuguuuauccauugauugguugauggacauuuguuuggguuguuuccacuuuuugacuguuaugaauaaugcucuguuagcuauuuucuucacagccucccaaauauuuauugagagaauaaauacagacucacauuugcauucucguaauaaacugcaguauucuuuucaauaguauguuauuccuuugacauauugguagauucuguuugcuagcauuuuauuuauaauuuuuguaccuauaaucaugucacauuuguaugagguuuaucauguuuugauauuaaggguauguuagcuuuaugaaaugauuugggguuacuuucuauuucauuuucccuuuggccugcagugaucuaacacuagaauuaacuguuauuugaaguuuagauaaaaauuuaacuuugaauuugucuaauccagaugccauuuaaaaugggagaacuuuucucucuuuuccauuuucuucuaaacuagccuuuuuaagcuuuucauuuuuucuuguauuaauuuugguaauuuguauuuugcuaggaaauuaccuguuccuuuuuaguuauugccauaagaaauaaaguaauauucuuaccauugcuuauguguuugguuauuucuccuuuaacaauuucguuaguguuuauguuucucucucucuuuuuuuuuuuuaaucuuaaucaggcuuuuuguaaagauuuugucaguuuuuguaaaauuuuaguuugggauuuauuuuuucuauuguuugacuauaaauugacuuggaaaucuccuuucuucuuuuuaguauaagguuucacaguuuucaucuuacuucucuuuuuuccuacaucauguuuggauucuuugaguuacacauccuguuuuuaucugaguuucucagucucuaauucuggcaaauucuuaaucauuucuagagauauuuauuuauuucccuuucugagaaucuuauuagauauugacauuuaaauauuuuaaccaugucucauagcuuuugagaaguguuuauauuuucuacuuccuuauuccuuuuuuaaugcuuuguagaauugcuugaccugaacuuguugcucacuaguauauucuugcccuauauucaauuugcuaguuaacccaucggauuuuuuauuucagcaguuuaaaaaaucuauacauaucuucaauuggugaauauuauguuuguuuuaaauuuguggucucuuuagucuuuuuucuuaugguauugauuguucauuuguugccuuucuuucauugugcucauacucuccaagugucugguuauauuuuucuuagaaguuccaaguuaugagcuaguaauauuugccuggggagcagggugaaagacuaggcuuuaacaugugucuuuguguaauuucauggaguagaggugggagugugugggcugauucggggugaugcaguucgacaguuggugccaaaaaggaacuuccuguugaccugcuuagaggcaugaucuucuccaggaccugcuauccuuauuguauuuaugcagugccggugagaacagaacacacaggggccuugcaggucaccuaaacuuguuaccauuucccaaacuguuugugcucuggugcuuuccugauauaauaaucuccuguacucuucagauggcacuggagugguagcagagcuuuucugucucauugcauccuguaggguagaaauucucugcccagagcaauguaaggacuggaaaaggucacaacuaggucuuuuccauuugguagcauuuggccugcuccaucucuugguugccauuuccuuaacacucuagaagccauugcuuuuaguguccccaagguuuuucauuuauuagacugcuuuuugcuuuuguguaaucuauaggguugagauggagggagggaagcaggaauuugaaaucuugugcuggaauggaagccauaauauuuuuaaauuaucuguuugugucugugccccucagcaaacuaagccccuuaaggguagugauuuuuacauauacgcuaaaguguauauaaaaauaguucauggggcagacuuggugucuaauaaaguuuauugaaaauauuauuucaaaaagauucuuucauuaaaaauaaaaauguacuaccaauauagaacuuccuuaacauucuacaaacaugauuaaauuuauuaaaaccuuaauuuguaugcaagguuucaggaucauuuagaucacuuuagaagagguuauaaacuguagaguaaaauaaaaagaagaaaacaacuaacauaauacauuuaucccucaguggauugguuccaggaccuacaacagauaccacaauccauggauacuuagaucauucaguggaccuaaaaguugguccuccacagcugagguuccgcaucccacaaacacuguauuuuugaucccugguucuugaauccacagaugcagaacucguggauauggacggcugacuguauaguguuuuauaauucucaaaacauuuaaccuauguuaaagcagggcuguuauuguuauccccaucuuaaaagugaagaaaccaugaaucagagaugacaagaauguaucuaagacuaagcagccaauaaauaggcauggaaacaaagucuccugacuuggauucuuuuagagacugaugcuucuuuguuuuucagcgcuucuguaauggcuauuugauuaaugacauugaacuaaucugugucauucugucucccaucuuuuuguacuguggaacucagugacuguuacccagaguuuuuguuguuguuguuuguuuuuagagacagcaucuugcugccacccaggcuggagugcaguggugcagucuuagcuuacugcagccucaaacuucugggcucaaguaauccucccgccucagcuuccugaguagcugagauuacagguguguacaacugugcuuggcuaauuuuuuauuuuuuuugauuuuuuguagagacaaggucuugcuauguugcccaggcuaggcuugaaccccugguuucaagugaucuuccgcacuugaccuccagaagugcugggauuacacacguggaccacccugcccagccaucacccagaguuuaaagccagaguucuuaaaaagggcuugugagaucccacaugaucugucuuuuucccauuuacuuuucucuuuguucacauuucuccugccacacuagacuuuauauuacuauuucuccgcuauaccagauaugcuccaacccucaguaucuuugagguuucuguucacugugcuuggaauuccuucucuuagguggcuucuucaucccuuuccaaucuuugugcaaauguaaccucaaugagaccaucguucauuauccuaucuaaaagcacaaaccaucccacauuauauauacuuccuauccccuuuucuuagauugcuuuuguuacuacuuaucauguaacccuucugguacacucuacaauuuauuauuccuuaagguauugucugccuuucgucauuauaauguuaguuucagugacugguucaauacauggcucaaaaaauguugaaugaaauaauucaucaacgaaauucaguugauuagacaaaacuguuaguaauacagguauaccacugagguauugcagguuugauuccagaccacugcaauaaagcaaguugcaggaauuuuuuuguuucccagugcauauaaaaguuauguauacacuauaccacagucuauuaagugugcaaaauagcauuauuucuaaaaagacaauguauauaucuuauuuaaaaacuauuguuagaaaaugcuaaugaucauuugagcuuucaguaaguuguaaucuuuuuggugguagagggucucgccuugauguugauggcugcugacugaaucagggugaugguugcugaagguugagguggcuguggcuauuaaaauaaggcaacaaugaaguuugccacauugacucuuccuuucaccaaagauuccucuguagcaugugacacuguuugauagcauauuccccaccacagaucuucuuucagaacugggguggaacccuggcacugcaguaaugguucuaaacccuuuguugucauuucaacaaugugcacagcaucuucaccagaaguugauuucaucucaagaaaccacuuucuuugcucagccguaagaagcaauuccccuguucaaguuuuaucaugagauugcagcaauucagucacaucuucacacuccacuuauaauuuuaguucucuugcuguuuacauccaguuacuuucuccacugaagucuugagccccucagagucauucauaaguguuggaaucauuaaccaaauauccugguaauguugauauuuugcccuccucuugugaauccugauuguucuuuauggcaucuagaauggugaauccuuuucagaagguuuucaguuuacuuugcccaguuccaucagaggaaucucuuucuguggcagcuguggccuuaugaaauguguuucuuaaauaaugggacuuuaaagucaaaauuacuccuugauucaugagcugcagaaugguuauugcagggaugaaagcaacauuaaucucuuuguacaucaccaucagaaaucuuggguaaccaggggcauugucaauaaacaguaauauuuugaaaggaauauuuucugagcaguaggucuucaacugugagcuuaaaauauucaguaaaccaugcuguaaacagaugugcugucauccaggcuuuguuguuccauuuguagaauacagucagucuagauuuaucaugauuuuuaaggcccuagaauuuucagaaugguaagugagcauuggcuucaacuugaagucaacaacugcauuauguccuaauaagagagucagccuguggccagaaagguggccgcccccucgcccgucacgcaaugcauguucguggggaaccuggugcuaaacuauucauagaugaccugcuucugggucgggguuuuguauguagcagagcggcucccucgcugcuaucuauugaaagucagcccucgacacaaguguuugaaaaaauuaaaaaauaauuaaaaaaaaaaaagacagaaucagccuguccuuugaagcuuugaagccaggcauugacuucuuucugacugugaauguccuagauggcaucuucuuccaucugucaauaucacugucagucuucaacuguuucuuccacagaugacagucuucaucugucaaacaguugaugacuguuucuucaacacugaaaaucuguuaauuaguguagccacuuucauuaguuaucuuagcuagauuucuggauaauuugcuguagcuucuccaucagcauuugcugacucaccuuguauuuuuauguuauggagauggcaucuuuccuuaaaccuccugaaucaaccucugcuagcuuccuacuuuucuuuagcuuccucacccucuuuuucucagcuuucguagaauuaaagagcguuagggccuugcucuggauugggcuuuggcuuaaaggaauguuguaacugguuggaucuucuauccagaccacucaaauuuucucacuaucagcaauaagggaguuucacuuucuuaucauucagguguuuauuugaguaacacuuuuaauuuccuucaagagcuuucccuuugcauucacaacuuggguuacuuacugcuugauguaggaagccuaccuuucugccugucucaacuuucaacaugccuuccucaccaagcuuagucauuuccagcuuuugacugaaaaugagagacaugcgacuccuuuuacuugaacaccuaggggccauuguaggguuaugaacugacgucauuucaguacugcugcaucucagggaguagggaggccugaggaaaagagagaguuggggaaacagauggucaguggagcagucagaauacacacauucauggauuaugcuugcuaucguauaugggagugguucauauugccugaaaacaauuacaauggaaacaucaaagauaacuuaucacagaucagcauaacagauacaguaauaaugaaaaagaauuacugaagugugacauagacaugaagugggcauaugcuguugggaaaauggugcugguagauuggcuugcuacaggguugacacacaccuucaguuuguuaaaaaggcaguauaucugcaaagagcgauaaaguaaaaugcuauaaaacaaaguauucuugcauuuguuuguuuuuaauucauagguuuaacauuuaaaguccuuuuaaucaggagugugcguuuguugauaccauggaaauuuaauucaccaagauuuauuuaugacuuaaagguuucuuuugaauaauuauacauauccauuuacauaaaaucugucuuuuuuuggaaaaauaugauucuauguaagaaggauaacaauauauucuagagcaauuuaguguugacagauacagcauaccagcugaaauauaauuuauucuagauuuuuggauaauauuuuccuuaggaaaccaucuuuugaacauugagcuuaagguagguagggauugaugucacauugauauuuuaaaaauguaaaugaugaaauuuuuaaaaauuuauauuagaaugcuaucaguucuaauccuuuuuaugacgaguuuuaauucuauauucaauauuuguguucaaaugguaaaguuaagaauuuucuuauuugcauuugcuuuuauuuaaacuuuuuuuucuuuuuuguagauuugcuuugaggucacauugauaugaaauauggagucaccuuuuauaacuucaccugggaaagagagagaaaacuuucuuguuaaaaaaacauaaggaaaacaaacaaccaaaggaaucaugccaaaugccaacucuacaucuuuuuguauuauuaacauauuuuaugcaucaagacaaauggcuuaugcauuaaaggggaugauucguucaucaguauuuuuagccauuaaaaaaaaucguuuucauauuaaccuuauacagcucccauaaaauuuaacacauauaaacaucuuuaacgccuuguuuaaaauagcuuucuuuuuuagugcuuagaacuucaauguuuaugcacccuauuguuacuugucagagucuuuaagaguuuauaacaucaggaaagauauggacuuggaaacuuacauuauuaaaauagacugcaguggauuuaauuggacaauucaagacauccauuuuauuguccaaaauauuacauaaaaguguacaguuuuuagccuaaaugcaaacaaaguugcuugaaaauggcauggguaaaauucuuacggaaaccugguggcaaucuuggaaaaguuuaucagccuggaaguaugcuaucacuagccccuaccaaaggcuuguuaaaugaaccaggacaaaacagcugcuuucuuaauagcgcuguacaggugagaccauaauuacuuauuacauuaaaaaaaauacuuuucagaaaauccuuuguuuaaugcuucuuuagcucauaaauuaaaaauaaaguuacuauagacuagaaugacuuuuuaauauaacuuuaaaugggagcaaaaguguuuuggcuggucauuuugguuuuuauaauaaaugaaaaugguuuuuuucaacagacugauguaucacuaugauauaaauaaucuuauuuaaaagguuuauuuaguaaauuaaggacauuuuucuaacauacacaaauguuuugguuuuaaucagcuaacaccccucccuuugaaaaaacauccaguauauggaucccuguagauagaauaaaaagacauaagcugcuuguauugagauaagaaugcagaguuuuugauuucaguacucaaacucccuucaccucccacugugguguuuaaauuaccucugcggaaucaucauuugggcuccacuguuuugguuaaauugaaggauaauccauuuugccucaauccuuguugaaaaucuuaauuaaccugcuuuucugccuuagauaacuauacuuucuuaugcuuaauaaaguuuuuauucagcaguuauagauuuuauagauccuguguccuucugaccauuguagaguacuaaagaugaggaagauuuagaauacugauaacuuuuucuauugaccuuagaauauaccuuaaaagaauucauauauaaugauucacuuuucauaugcauuguuuuuucuuuugaaaacuaauagagaaaaauauuguguugauuagcucaucugacaaauaaacacauguagaaugugucaagugcacagauaucugacucagagcuguauucucaguugccuucuaccugagacagaugccaaacuugaacguucucuaacucacccagcgaaagagaagcaguugguauuaagaaagcauuuauucuaauuuacuuuaggacacuuaaaugcuaguguucugcccuggcucaaagaucccacugacauuacugugacaaaugcagaaaaauauuuauucaguggcacuggauauagugaaauauuagauaccaaaagaccuggaauuaaaugcuuuugauagaaucaggcugugagaaagcguuucuggcauuucagauauuuuucuguuuacccuuuuuccuauucuuuuuaccuuuuauguuuuccccucuguuucuguccuuuucauuagcacccaaaauacuauguauaguucagagaaacaaaacgcauauuagaacgggugaaaauuuugaguaaggaaacuuacauggaucaaaacauugagaaguauuccuauggugauguauuuuuuuuaagaaugaacauucugcugacauuuaccaugaagacuguuuacuuauacauaucugcauauuugccauuucuggugcucaucacuuuuuugcauagauccacauuccaucugauauccuuuucuauugcuugaaggaucuuucuuguaauacagguuuauuggugaugaauucuuucagcuuuuguaugucugaaaaagaucuguauuucaccuuuauuuuugaaagauauuuucacucauuaaagaugguccaaguugacauuuuuucuuucaguacuuuaaagauuuugcuucucuguuuuagcuugcauuauucuaaugaaaaaucuaauauucugaucuuuguuucucuguauguaauuuguucuuuuucucugggugcuuuuaagauuuucuccuuaucauuggcuugaagcaauuuaaugauguuucuugauauagguuucuucauguuucuuguguuuggguuuguugagugucuugggucugugcguuuuggauuuaaaucaaauuuggaaacacuuuguuauuucuucaaauaauuuuucugucucuucccuccuuugggguuuuccaguuacauauguagugaguugccugaaguuuuccaguuguuccacagcuuacugaugcucucuuuauuuucuuucucagucuuuuuuucucuuuguguuuuacuuugugugguuucuguuacuccauuuucaaguucauuaaucuuuuccuuugcauugccuaucugcuauuaaucccauccaguguauuuuuugucuuagacauuguaguuuucacuuugagaaguuuuaucuuggucuucuuaaaaucucuuucaugucuuuacuuagcauuugcuagucuguugaacaugugaaguauaguuguaauaauuguuuuuauguacuugucugcuaauucuguuauuuguauaaauacuggguacauuucaguuacuuuuuuuguuguuguuguuggaugucagacaagguuuaccuugucagguuauggauauuuuuauauucccuaaaaauaaucuagaaguuuguucugggacagaguuuauuuauuuggaagcaguuugaucauuuuacuuuuaaacuuuguuaggcgggacagagcuaugcuuauucuuugguuaauuucucugcuauugagacuccuuuuucaaccauugcucugugaauuaugaaguuuucuacuuuggcugcaggaauaggcaccaucuugggccugugagcucugggcacuauucccucuaauccuuuuggguguuucuuucccaggccucagacaguuuccucauaguacacccccaaauacuggaggaggauccucuacugaucccugauguuaacucucugugcagcucucugcaguacucugcccugccaacucuagcagcuuugggggaucuguuggucucuguugucugccauauaaacucauuuacauggcuaauucucccugacaaaacaacuauucaaauagauuuucuaugagauaagaccuuucuuuuugaaaauucagaauacaaauguugauuugcaauucgaugaauacauuuucaaaaaugcugagaaauaaauuguagaauaugucuuguaagaauuuacuaaacacagacauuaaaauguuuagaucugauauaagacacaaaaaugaauuuacaugccauuucuuauuaauauuuaagcuauuucuuacauuauuuucaaguaaagaauguaugaugaaagguuuguauuuaauguguguauagauauguauugaucuuuugggaauaauauaagaaauauguauaaauauucaaaaauaacuacauuaauuuuguuaggcaccauuuaaauugcuacaugcaaauaacgaaaaaguguauauugcuagaaacuaauuaguucaauaacuaucuuaaaccuuaauuuuuuaaaauaagugauagaauauaaucaacauuuuaaaaugaaaugggaccaggaacaguggcuuacaccuguaauccuagcacuuugggaggccaagguggguggaucacuugaggccaggaguuugagaccagcuuagcgaacauggugaaaccccgucucuaccaaaaauaaaaaaauuagcugggcgugguggcaggcaccuguaguuccagcuacucaggaggcugagacacaagaauugcuugaacccaggagguggagguugcagugagccaagauagcaccaucacacuccagcuugggcaacaaagcaagacuccaucuaaaaaauaaauaaauaaaaauaaaauaaaauggaugaagauuaacuauaauuaggauaauuauuuugugauagcgauuuguuaaaguagccuuuacaguauuguguuaaagacaauaauguacagggaacuugaaauaaaucacauaaaacauuuuaucuguaguuugauccaguguaacucagaguuuucguaaucauagaaaacauucugguuacauuuggaagacuucacuaaacuuuauaaacagauuauagaggguauuuuagcugaauauuuuaaacuuuuaccuaaugcaaaaacaguacaauuagguauaacauuagugugauuuuaaugucugagaaggaaaguuauuuaauacuauacuauuuaauagcucacauuuauuguguucuuacugcuuguuucaacauugcauaugucaccuaauuuaauccuuacaacagcccuaagagguaaguacuacauuugucuuuauuuuacuguugagaaaacugagucccagaaaauauuuugccugagucaguccaggauuugguaaauaguaaacccagaauuagaaaccagacaccugccuucagauguuuuuuauuaaccucagugguacauugcuucuaaaguugugcugucauuaaucaucuucuuucuugguaaaauggauuuccguguauuuuuuaaaauaugcuaggauaugauacucaagaaaguuauuaaacaucaucaagugcuuugcaaaaacacugaguuaucugugacagaaaaauggauccuauucauuaugcuuuaauaaaaggcaacguuuaaagagaaauuuugaaaugaccuuuaguuguggaguaguugaaaauauaggaaauauuaaagccaguuuguuuuuauuaacuuuuuguuuuuauuugggagaaaggagagaucaugaauagauuuucuuaguuacguuaucugaggacacgacuaaaagagaaauuugaagaucuuauuuguuuguuguaauaguaguaacagccacaaauagcagcugguacucauugcaugccaguugaguaccauacccugcucuagaaacauuacauauuauuuaauccuuacaagaacucuaugagacacaaguacuauucuuauccucauugucuagaauucagguuuuucagaaugauuuuaaguauuggacugauuuguuuugacaguugccgucuuuggguuugguuugucuuugucuuugcuuugucuuugucuuuuaguagcagaagauaaguggauaauugcaucaaguauauacuuagguaauuuauuaauggcugcugcuuacuaugcuguacccccauuaccacacaggcccccuuucuuguuccauguacagugaccacauacaccucugcucaccccuuuuucuugccauaaugugcagaccccaauuuaguacacucuggcuuuaaagucuaauuauauuuccuuucaaaauuucaguuuguuccaaguauuauaaucacuuccucuuucaugucucugccaacuucucuauuuaguauuccuuguuuccuguucagaccaaauccuuaaugaggaguugguuuuucccugcuccaugcuugucauaguuuuucaugugcaccauuaagaguaucuucugaauccaacuuuuauauaugcacaacaugcauguagcaauuuuauacuugcuguuauuuccagugguuaugugugucugauuauguacaggcaauuaaaagaaguuacuuguucgccuuuugcaauuuguaaaauaucuaaaucugucuuuuguuacaguaagaaaaauuuguuuauuucuuuuuccuuaacaucucccuguuuuuuagguuuuauggcaauuggauauauuccgacgaagcuugcggguuuugacuggacauguuugucagggagaugccuguauauuuugugcauugaagguaaccuuuuaauagcucugaaaaacuacuaucaauuguuccuucaaaaauuuaaguuugauauauugggucaguuuguuguaacuaaaguucacugucaggugauuaacaguuuugaagaugaauucuuaacaguaugacuuauucagguuuguguuuucauuuuccucuuuuauauaaggacaguuaaaaauuaauauucuaaguaguauaaaauuguuaggaacauuaucuuuuucauuauuuugcaauuauucuuauucauuuuaacaaauguuuuuggagcuacuacugaguucuggguaccaguguaguuacugaggauacagcagugaacaaaacugauaaaaaucccucuucucauagagcuuguauucuuauagaggaggagacaauaauaagaaagcaaaauauuauagaguauguuagaugguaauaguuguaacauuggaaaaauacaucagggaaagaaaauagggaguguuguauaggcaggaaagccucacugagaaacugauauuugaaaugacaccuugaagagccuuccagguagacaaagaaacagcaacugcaaaggccuugagguaugaguauaccugauauauuuaaggaacaccaaggaaauauggguggcgauggcaggagcuuuaugagcaaggaagagagugguagaaggugagcucugaggugaggguagccgagguggcuuuaaaacaugucuguggaugcuuuugcaugcuuccuuauccaaaaucuaauuccuugaauauaggcuggccuuaaugacugauuucugucaaauagacuauggcagaacugaggcugcaagcaagauaucugagguuagguuaguuuagaaaaggugauauaacucucacccaccucugucucuugaguugcucauucuuggaagugagccaccaugaugaggaagccagguggccaugcggcaagaccacguggagacauucuggacacagcuagagcugaguucccagcccacagccagcaucaacugccagacaugaaagagcgacccucagauauuccaggucccagcauucaaacuguccaaaaugacuucgaguggagcagagacaugcuguccccacccaaauugcagauuuauguaacuaaauuuugggggugguuuauuuacagagcaauaaauaacuauaacagggguuuagauuguguagggccuuauaggccucuguaaggaucguggcuuuuucucugagugauuuagggagauggggcauuguuuugaguggaagagugauacagucuguuuuaaccagauauaauauuugaacuagaucccuguggcugcucugcugaggaaaauagaaggaagacaaagaaacagagcauccaguauauauuagcaacucauucgugucacugaaauguuuugccagagaacuuaagauuuuguuauacauuuuagagauaaauguuucauuuuuuuacauucuugaauauucauaaugaacacauacacauagacacacagaauuuuuuuuuuuuaauguaugugccuuaauuucauuauguuccugaaaaggcuguuugaguaaaucaccaaaggaagaaauuuuauauucucuuuuuuuaagaacauggccaaauaggguuauuguuaggacaugaagaaugaaccuagaucacauuacaguaucacauuuuauuuauuccacaguaaauuuugaauguuuugucuaauuguaaaaccuaggauuauuaauuuccuagaccaacucucuuguagcccugcacagucaccugccucuuuccugugcuugccuuccucuccuccccugucaaaaacacacauaaacacauugcauuuuagccaaacugggcucuauuucucagagcugauccccaccucaaagucuucucauuguuauuccuuuugucuggaaugcuuuucuuccagauguccucauggcuaacacccuuauuuccuuuaugccucuccucaaauguuacuuuuccauuagugaggccuuccccgacuacccuagguaaaagguaagcugcuuccaucuguaauaucccuggcauuccuauccccguuacacugcuuuauuuuucucucuuguaucuauuuuucucuacuguacuuaucacauucugauguuauauaauuacuucuuugccuucucauuacuauaacuagaauauaggcuccaugugggcaggguugucauccauuuuucuaggguagaacaaugccuaacauauacgagggaggcaaaaaauauauguugaaucaaugagugacagucucgcauaggauuaaaaaucuuaaacauuaccuggaaguuaauugccuaaauaagagauaaaaucugaaaguuauuuuucaucuuuuacuauucauaauuuuagcuacuauaauggcuaaaauaauuauaguucuggguaucuaauaucagaugacaucuguuuuuuuauuucuuauuuuauuuauaaauuguauuuuuuugcuguagugaaacagauuugugaaauguuuucuuuguauguugaucuuaaaaaaauauuuuuuuuuugagaugacaugacccuuugagcuaacaugggacugaaugugaccaauacuacuuuggugggcugucauugaaaacuuuucuuucuuccauguaagaugauugucauaaaauuggaauuuauuaaaauguuuuuucuugcuuaaguuuaauaaggaaaauugaaaaucauauuaacaacuauaaucucauauuuccaguuucuuagguuuagauuagaaacugaaugauguuuccaguuucuuaauuuagauuagaaauacagguuggguaucucuugucugaaaugcucaggaccagcaguguccucugagggugggaccugggaacccuauauguuuaauucuugugucugcuaacauuugauuuagaggcuggugcaaacauuucuacacuugaugauacaaauaauuaauuuuuguaugaaauuuuagagcaaaagacuucuguauuauuuuccgaaauacagguuggguaucucuugucugaaaugcucaggaccagcaguguccucugagggugggaccugggaacccuacauguuuaauucuugugucugcuaacauuugauuuagaggcuggugcaaacauuucuacacuugaugauacaaauaauuaauuuuuguaugaaauuuuagagcaaaagacuucuguauuauuuuccaaguauaguguuuugaguuucucuguguuguaaugaaauuacugaaaugucguuaaagcuggcauuaaacuuacugauuuucuugucgauucccagacgauauuugcacaguuccaacacagucgagaaaaagcacuucccucagauaacauaaggcaugcucuugcagaaaguuucaaagaugagcagcgauuucaacuuggccuuauggaugaugcugcggagugcuuuguaaguguuucugauauuccuuaagaagucaggauaguaguuuucauuccuuagaugguacaaguguugagacaaaugaaacaaaaauuuagaacaauagaaaaaugucaaaacuguccaguagauccauaucuuacccauccuucaagccucaacuucaauccaucuguguuuuguguuguacuuuugguuuugauuauuuuuguugcucuaauuuuuacucuuaggcuacuaaaauguuuuaaaacuuaguuggagcaauaagcuuugcugaauauaaaugauaucacuuaaaucaguguucugccacuauagggaccacauaugcagcacauucccagcaguaauaguuaucauugcaugcaaugauucucacugggagagaaggggauuuuggugggauuuugguggguaacaggggcaacagccuguuacacacauuccagguugaaaaucacugagguugauguucucaggcucuguguuaccaccauauuaguaaguagagcauuccuuugaucagguacauacuuuauacauguaaaauagguauguuaauuauuaaaugucucauuaauauugaugucaccuauaauuaaguuguaaccauuucuucucucuucuuucuguuucuagucagcaaaguuuguaaauucuuucaucagaaacccuuucagaaguuuuuucuuuccguauuaauucccuaccacaacuucuuccaguucaguauauuuaagccuccuauugguguccauucaaccuguuuauuuauguccuauuuuuuuuuuuuuuuuuuuuuugagacagagucucggucugucacccaggcuggggugcaguggugugaucucggcucacugcaagcuccaccuccuggguucacaccauucuccugccuuagccuccugaguagcugggacuacaggugcccgccaccaugcccggcuaauuuuuuguauuuuuaguggagacaggguuucacuguguuagccaggauggucucgaucuccugaccucgugaucugccugccucagccucccaaagugcugggauuacaggcgugagccacugcgacuggccuuauguccuauuuuuuaaauaaccaccauaucaauaugauuuuauucagguuaacgcuuacucuucaaauauuucugugauuuaaaucuagacuuuuuauucugauauuuaaggcccuuuagauuaaacuccaccuucccucagugcuucaucccuagauuuuucuuccuagugagauuauuccauucuguuccucacauauauuuuuauauucuuguuuauaguccuuauuuauaaggcuguucuacuagcagccuuugcucaaguuccugaaauacucaaaacuuuaaaaaucuaucauuuugucaagguucagacuaagucuaugccuaccagauaacacaugaccaaaccacccaauccauucucuguagaauuuacucuguagaauucauuuggcauuuuuauauuauuaaucaccuuuuuaaaaaugagcaucuucaugguuuccuuagauggaaagcucauugacuagcaucuugccuagcacacuugcauguugauuaaaaugucaauaauggcacacacaguaaugaaauauacuuuccauauuucuucuguuuauaauugauuuuuugcuuaaaacaaauauauuuugaacaaugcuaaacuuuauaguuuuacuuucacuuaaaugaauuauucuaauacaugauaugauaauucacaaaaugucuagaagucuaggcuuaaauuauuaaauggucuuaaauauccuggggcagaggagagagaaguuagcuaaugaauagaauccauugguuaagcuuugguaaaaagaauuauguuaaagaaauaaaugccccuuauugaucuauauuguaaaucaauauuuauaugaaauucacugcagauugcauugccugcauuaugguguuaguguagauauagagccuuuguuuugcuguuauuuauacagacuaccuagaugauucaaguaggauuuuuuuuuuuaauuauacuuuaaguucuggguuacaugugcagaacuugcaguuuuguuacauagguauacacguggcaugaugguuugcugcacccaucaaccugucaccuacauuagguauuucuccuaauguuaucccuccccuagccccccaccccccacaggccucagugugugauauuccccucccuguguccauguguucucauuguucaacucccacuuaugagugagaacaugugguguuugguuuucugaucuugugacaguuugcugagaaugaugguuuccagcuucauccaugucacugcaaaggacaugaacucauccuuuuuuguggcugcauaguauuccaagguguauaugugccacauuuucuuaauccagucuaucaucgaugaacauuuggguugguuccacgucuuugcuauugugaauagugccacaauaaacauaccuguguaugugucuuuauccuagaaugauuuauaauccuuuggguauauacccaguaaugggauuggugggucaaaugguauuuccaguucuagguccuugaggaaucuccacacugucuuccacaaugguugaacuaauuuacacucccaucgacaguguaaaagcauuccuauuuuucugcaaccucuccagcaucuguuguuucuugacuuuuuaaugauagaguuuucuaaauauacaaucaugucaucugcaaacagagacaauuugacuucgucucuuccauuuugaauacccuucaucacuuucucuugccugauuugacuucaucucuuccuauuugaauacccuuuauugcuuucucuugccugauugcccuggccagaacuuccaauacuauguugaguaggaguggugagagagggcauccuugucuugugccgguuuucaaagggaaugcuuccaguuuuuguccauucaguauaauauuggcugugaguuugucauaaaucucucuuauuauguugagauacauucuauugauaccuaguuuauugagaguuuuuagcaugaaaggcuguugaauuuuguugaaggccuuuucuguaucuauugaaauaaucaugugguuuuugucauugguucuguuuaugugauggauuacauuuauugauuuguguauguugaaccagccuugcaucagagggaugaagcccacuugaucauggcggauaagcuuuuugaugugcugcuggauucgguuugccagaauuuuauugaggauuuucacuuuaauguucaucagggauauuggccuaaaauucucuuuuuuuguugugucucugcgaggcuuugguaucaggaugaugcuggccucauaaaaugaguuagggaggauucccucuuuuucuauugauuggaauaguuucagaaggaaugguaccagcuccucuuuguaccucugguagaauuuggcugugaauccaucugguccuggacuuuuuuugguugguaggcuauugauuauugccucaauuucagaaccuguuauuggucuacucagagauucaacuucuuucugguuuagucuugggaggguguauguguccagaaauuuauccauuucuucuacguuuucuaguuuauuuguguagagguauuuauaguauucugugaugguaguuuauauuccugugggaucgguggugauaucccuuuaugauuuuuuauugcauuuauuugauucugcucucuuuucuucuuuauuaguuuugcuaguggucugucuauuuucuugaucuuuucaaaaaccagcuccuggaaccagugauuguuuugaaggguuuuuuugugucucuaucuccuucaguuuugcucugaaccuaguuauuucuugucuucugcuaguuuuugaauuuauuugcucuugcuucucuuguuccuuuaauuaugauguuagggugucaauuuuagguaucuccugcuuucucucgugggcauuucaugcuauaaauuuccuuccacacacugccuuaaaugugucccagagauuuggguacauugugucuuuguucucauugguuuuaaagaacaucuuuauuucugccuucauuuuguuaguuacccaguagucauucuugagcagguuguucauuuuccaucuaguugugcguauuugaaugagauucuuaauccugauuucuaauuugguugcacuguggucugagaggcaguuauuucuguucuuuuacauuugcucgggagcguuuuacuuccaauuauguggucgguuuuagauuaggugcugcgaagaauauauauucuguugauuugggguguagaguucuguagaugucuauuaggucugcuugguccagaacuggguucaaguccuggauauccuuguuaauuuucugucuuguugaucugccuaauauugacagugggguguuaaagucucccauuauuauugcgugggagucuaagucccuuuguagaaaucuaaggacuugcuucaugaaucugggugcuccuguauugggugcauguauauuuaggauaguuagcucuucuuauugaauugaucccuuuaccauuauguaauggucuucuuugucucuuuugaucuuuguugguuuaaagccuguuuuaucagagaccaggauugcaaccccugcuuuuuuuuugcuuuccauuugcuugguagaucuuccuccaucccuuuauuuugagucuaugugugucucugcacaugagaugggucuccugaauacagcacacugaugggucuugacucuuuauccaauuugccagucuaugucuuuuaauuggggccuuuagcccauuuacauuuaagguuaauauuguuaugugugaauuugauccugucauuaugauguuagcugguuaauuugccuguuaguugaugcaguuucuucauagcgucaauggucuuuaaauuuggcauguuuuuacaguggcagguaccgguuguuccuauccauguuuagugcuuccuucaggagcucuugaaaggcaggccugguggugacaaaguaucucagcauuugcuugucuguaaaggauuuuauuucuccuucacuuaggaagcuuaguuuggcuggauauaaaauucuggguugaaaauucuuuucuuuaagaauguugaauauuggcccccacucucuucuggcuuguagaguuucugcagagaaauccaccguuagucugaugggcuucucuuuguggguaaccugaccuuccucucuggcugcccuuaacauuuuuuccugcauuucaaucuuggugaaucugacaauuaugugucuuuugguugcucuucucaaggaguaucuuugugguguucucuguauuuccugaauuugaauguuggccugccuuguuagagguuggggaaguucuccuggauaauauccugcagaguguuuucuaacuugguuccauucuccccaucacuuucagguacaccaaucaaacauagauuuggucuuuucacauagucccauauuucuuggaggcuucguuaguuucuuuucagucuuuuuugucuaaucuugucuucuugcuuuauuucauuaauuagaucuccaaucacugauauacuuucuucugcaugauugaaucggcuacugaagcuuguguaugcuucacgaaguucucguacuauguuuuucagcuccaucagguuauuuaaggucuucucuacacuguuuauucuaguuagccauuugucuaaccuuuuuucaagguuuuuagcucccuugcgauggguuagaacaugcuccuuuagcucggagaaguuuguuauuacugaccuucugaagccuacuucugucaacucuucaaacucguucuccgaccaguuuuguuaccuugcaggugagggguuguauuccuugaaggagaagagacauucugguuuuuguaauuuucagccuuucugcucugcuuucuccccaucuuugugguuuuaucuaccuuugguauuugauguuggugaccuacagaugguguuuugguguggauguccuuuuuguugauguugaugcuauuccuuucuguuuguuaguuuuccuucuaacagacaggccccucagcugcaggucuguugggguuugcuggagguccacuccagacccuguuugccugguuuucaccaguggaggcugcacaacagcaaauauugcugccugauccuuccucuggaagcuuugucccagaggggcacccgccuguaugaggugucuguuggccccuaaugggaggugucucccagucaggcuacacaggggucaggaauccacuugaggaggcagucuguucguuaucggagcucaaacgccaugcuaggagaaccacugcucucuucagagcugucaggcagggacauuuaagucugcagaagcugucugcugccuuuuguucagauacgcccugccccuagagguggaaucuagggaggcaguaggccuugcugagcuguggugggcucugcccaguucaagcuucccugcugcuuuguuuacaccgugagcagagaaccagcuacucacuccucagcaagggcagacaccccuccccucaaccaaccucccgcaucccagguugaucucagacugcugugcuagcagugagcaaggcuccgugggugucggacccgcugagccaggcacgggaggggaacuccuggucugcugguugguaagaccgugggagaagcucaguauuucggcaggaguguauggcuccuccagguacauucacucacagcuucccuuggcuaggaaagggaaauccccugaccccuugugcuuccugggugaggugauguccugcccugcuuuggcucgcccuccgugggcugcacucacuguccaaccagucccaaugagaugaaccagguaccucaauuggaaaugcagaaauuaccuguguucugugucagucucacugggagcuguagaccggagcuguuccuauucagccauccaggauuuuuuuuaaagcuaucuguuuuuucuucauuugagaauguugggaacacaggaaacuguuuucuaauauuaaauuguagaugucagucaccauggguuuuuagaaggauuaaaaauaacuuuauuaaagaucauguuauaauguuuguuuaauuaaacaacauuuucuuucaagcuagugcuauaaaaggugaauaauugaacauucgaucaaaguguugauuagagaggaaagcugaaaagcuaacaauauguaugacacucuuaaauuuauacuuuggauaaucugcagguaaagaguuauauuuugcuguguucccugcaagaucaacaacucauuuaucuauuuuauuuuuaaauuaggaaaauauguuggagaggauucauuuucacauagugccaagcagagaugcagacauguguaccucuaaaucuuguaucacucaccagaaguuugcuaugacucuguaugaacaggugagauggcuugauuauuauuuagauauuguaguucuguuuuaugauugauagauuaaacauauguuuuuaccuauauagugugugugucguagcuguggagcaucgucagauccucuaccuuuuacagaauuugugcgguacauuucuacaacagccuuaugguaagaaccuauuaaagcuuaauuaucaacgauauuaauaacauauuuaagcacauugagcacuuauuuuauaaaaucauagcauacaugaauuuccccucucugucugaggcuaccaaguaugcugcugugagauguauuaagugaugucuaucaaaguuggauguuuguaauuuggccuaauauauguguuacuuagugaaguguacauaauacuaguuaaauuuuauaucuauuuaauuuauaacaaauuuuagaacugugaaggggagcaugaaaugauaaacugaauguuaaauggaacuauacaugguugcuucauuuaugagauguucuguuuguaauggccauauuuucagucagcuccacuaugucccuuucuggugauaaaagcuaggguaagcggagaagaaagaaaaaugugagcguaauucucagguuauugcauuugaggacucaucauucacuuuaaauaaaaaauuugccaugcuugccugcucagcugcccacucacucucucccuuucuguccaugaaagauuagcucguuaaggaucuaaaaguuaucccuagaccuuacauaauguucuuugaauauuuuccaacagguauuugaaaguauaaauauuuggcauguggcugggcacaguggcucaugccuguaauccuaguacauugggaggccaaggcagguggaucaccugaggucaggaguucaagaccagccuggccaagaugguguaaccccgucucuacuaaaaauaaaaaauuagcugggugugguggcgggcaccuguaaucccagcucuuccggaggcugaggcagagaauugcuugauccugggagguggagguugcagugagcugagauugcgccacugcacuccagccugggugauagagcaagauuacgucucacaaaacagcaacaacaaaaaaguuggcaugugguaaacauugaguaagaucauaaacauuugcauacauuuuaauacaaaauacauaauauggaucaauaauuaucagucagaauauguuagugcaacaguugauaaaugcugccaauauuugugucagugugcaaaguaaauaucauguuuauucauuucauauuauuuaucuuccuggcuuuauugaguauaaaauguuauuucauaaagauuauugaauaauaacaauuucguuauuuggguguguuuacuaucuuucuuacauuuacagacaagugaaaaacacugauuuagagaaacauuccuaaacuucagucaaauuguagucagucgucagucauuuuuuuaaauuucuaugaaaaguaggaugguguucaaagauagacaauaaguuaaaaacuaaaauuuuaauucuacuuuaaaacucuugaaugaaaugacaguguucugaggcagaauguuagauaauaagaauuacagccccaucauucucugcuugguaaacacugcaaguugcaggagugcacgcuuugaauucuaauuauaauauccuuauuuguauugguaaucaguguugaauaccaguuacugaaugcuuaccauguuccaggcuuuauguuaaguuguugcuuuuaaucuuaaccaaaauucuauuuuguugaugaagaaauagguuuaaugagguuaaucuaguaaguggaugaauuaagauugaaacccagaucggucugacuucaaaauuuuucuggcuaaccacuacucuaaugcugucaguuuuguaaaagcaguauaugcaauuugaaugagcuuaucagauuuagggcuuucuaguguacucuugaaguguuuggauggguacauuuaguuguuaccaaauacuuggagauuauuuaaacuauugaacuguaaaauauauccagcucuagaauaguuauauuacuguuaaguacaaucagaacaucuagaauggaaacuaguuaguguuucagcuuacauuacauuccuuuuuggaaauauuuaaauaguuguuuaaguauuagucuguucucaugcugcuaauaaagacauacucaagacuggguaauuuauaaaacagagagguuuaauugacucacaguucuauguggcuaaguaggccucacagucauggcagaaggcaaggaggagcaaagucacaucuuacaugguggcaggcaagagaagagaaugagagucaagcaaaagguguuuauccuuaugaaaccaucagaucuugugagacuuauucacuaccaccagaacaguaucggggaaacugcucccaugauucaguugucuccagcugggucccucccacaacacgaaggaauuuugggagcuacaauucaagaugagauuugaguggggacacagccaaaccauauuaguuacuuaauacccugauacauaaaaauaugucuuuuaaggagguugaauaaaaaguaucacaguuacccuguaguguauuaaaaggccugccugggcucuaauaaaaugauuaguauccuggcugagcucaguggcucacgccuguaaucccagcacuuugagaguccgaggugguuggaucacuugaggucaggaguucaagaccagccugaggaacauggugaaacuccaucucuacuagaaauacaaaaauuagccagaugugguggcacgugccuguaaucccagcuccucaagaggcugaggcaugagaaucacuuuaaccugggagguggagguugcggugagccaagauugcaccauugcacuccagccugggcgauagagugagaccccaucucaaaaaaaaaaaaaaaggggggggaguaauauucaaaauaagaacaaaaggaguaagucuggcuuuaaaaucuuugguugugacuucugcauuuaaucagcaaaggaccuucuccuagcugaaauugauaacauugcuccuaggaacuuugggcuagagagggagccuuuccuacaguuuguuguucuuguuaggguaggguuuaaacuuaaguuucuacucauuaaguaauaauacaaauaaaacauuugccuuagaauuaccuccagacagagcauguuagccucauuuaucuaguuccaaacauauaauuuuguguuacuuuguuuucuuuauuugagcuaauuuuuuucauuauauacuugccaaauuuaauaauuuuucacuuuauggaaauguacuuuaugguuaauuuuucagucauggucauguuuuagauagaaaaagugaugcacaucuaaacugacaauauuuuucauguguaauuuauuaaaguuuuaaguucauaggccagauuugggauugcuucuuuuuuuguagcaaugagguugaaagaauguuggaaaggcaugaacgcuuuaaaccugaaauguuugcagaauugcuacaagcagcaaauacaacagaugacuauaggaaauguccuguaaguauaguuuggagaauauuaguaugcuucuuguuuuguagauuugaaaauaggcauucagauauuaucauguaaauauugauucuauaucuagaauuagcuuuaagaauuuuuaaaaaauauuauuuuagauuauaccauguguaucauuuaucuuagcauaaauuguuuaaaaacuccuaaguuugugaagcauauauugauuaaauuuuuucaaaguucugaaauuuaucauuugauuacagagaaaguuucuuuucaguaaacuugaugaaugaugaaugauacucuuuucucaucuaauauauuuguuacugacuucaagaguuuuauuucugcuuuuuuuuagguugaauucuuacuuuaacagauuuacaaaauuaucaaagaauacuuuuauuuaaaauaaacuucuuuuuuaaucaauaauuaagacaaacagcuuguuagaagucaauuuuuaguauacugaauaaauugcagauauguguuaaaauugucauuauauaaugcaaacuguguaaggcugccugguuuaucuguuuucauaauuuuaaaacuuuuauguuuuucuguagaguaacuguggccaaaaaauaaaaauucgccguguuuuaaugaauugcccagagauuguuacaauugguuuagucugggacuccgagcauucugacuugaccgaagcuguuguucggaaucuagcaacacaucuuuaucuuccugggguaucuuaucuauuuucauucccuucccuuuuauuuucaaauucuucuaaaacaucauccugauguuuuaucugauaacgacaaguuuaaucaaaucaggcuaacuggaaugccuuuacuacauagacuaggaauggcuuucaauuacaaacuaaacugucucauggcuuuugcuucuuucacucuaaaaucaugaugauugaugauuuuuuauguauggccaugauuguaaauauaaauauuguuaacuuagaaagguuuaauauuuaaaauucaucuaaagcacugaucucucucuuuuuuuuuuuuuuuuuuuuuuuuuuugcggcagagucuugcucugucacucaggcugcagugcaguggugcaaucuuggcucacuacaaccucugccucccaggcucaagcaauuuucaugcuucagccucccuaguagcugggauuacaggcaugcaccaccauacccagcuaauuuuuuguauuuuuaguagagauggguuucaccauguuagccaggcugcucucgaacuccuggccucaaguagauccaccugccuuggcuucccaaagugcugggauuacaggcgugagccaccacaccccgccaugaucucuuguuaugcuuguuacuuucuugguauauuuugauuugguucauguuacaauuaaaguuuuggauaauuaucuuuuagauaauauguuuaaugaacauucaaauaugugauucagucaagaauuaccagaaauguggaauuuaucucauauuuugaauuucuuuaugaaaagugucagucaugugucauuagagauacucuauuauugcuaaacuaauuuguagugaauucguuuuauuggacuuaaaguuuuaugaaugaauuaaaagugguaauucuguuaacaaugugaugucaguggugccuucaaguaauaauauaauauuagauuggggcaguaugcaugagaaauauuucauuaugugucaaagacaugauucaucuaauuauuccucauuuuacaaaagauguaguguuaaguguacauuaccaauuuuuuuaaacagcuuuuuuauagaguuacugaugaaaaugccaaaaauagugaacuuaaccuuguugguaugaucugcuacaccagccaacauuauugugccuuugcauuucacaccaaaaguuccaaauggguauuuuuugaugaugcaaaugugaaagagguaagugacacuuucuuuaauugaaauaauuacugugauuuuuacuuuuuguuaauaaaugauauauugauauuaauauucaaaaggaugauauaauuaauauguaaaauaguaauaaaugaacaugaugauagcaucaguaaguucaaacuuucuuuuguuauucuugaaauuggcuuauuuugaagccagcuuuuaaaccaguccauuuccagaauaauaauaaguaaacuaaugaauauuaguauacaaauauguaacuaucagugaucugugugucagugaugauccuuuuugccugacgcauacuugcuauauuuacuuuuuuguggaugauucacaguaguuuuguauaacuagugaugaaaauaugcuugccuuuauuuuuauuaugacaauuuuuuucaaauuuuguguguagaauacagaaauagauauaucaguuauaucuuuugguaauuacaguugacccuugaacaacauaggagugccaagcccucugugcaguugaaaacccacauaccacuuucgacucccucaaaacuuaacugccaacagccuacuauugacaggcagccuuaccaaaaacauaaacagucaauuaacacauauucuguauguucuauauauuauauacuguacucuuacaguaaaguaagcaagaaaaaaaguuacuuagaaaauuauaagcaaaagaaaauauauuuaccacucacuaaguggaaauggaucaucauaaaggucuucauccuugcugucuucacgcugaguagacugaagaggaggaaaaggaagauugcuuuugcugucuugggugacagaggcagaagaaaauucacauauaagugaaccugugcaguucaaaccuguguuguucaagggccaacuguaauuuguuuacucaaauaguaauaauauugucuagaaaaguagugaauaguaguucuuaauaaggaguauuggaaucacgaggagcuuuuaaaaaaacauauauuccuggauuccuaaaguuuugauucagugguguaaagccagguaucugaaauuuuaaguucuacaggaaauucagacauaacacaguugaaaauuauuggucuugucaaggcuuacuggcuuuggcaaucuuuauuaaguaguaaacucauuuaaaaauacaaguucuuugguuguuauaagcaaaugauguagaauucuauuuaguuccauuuuauuaauauauaacaaaaggccauuuaucagcacugugauuaagacaauacaaauucaaauguuugguauuuaguggacuucugauucuacccaugaaggauuaacugcuauagaaauagccauuucacuguuuaaaacuaggacauaggugaaacaacucaagacauugaacaacaugcaguugaacagagaaaagggaaacaaaugaguucagcucuauaauuacccccugcuuacugccuagagguaguuucuggguugcagugcaggcagugggagcccaaacaaagccuaguagugucacugaguucuggagacugaaacuggaguucagggaggccuagauggcuaaaauuugcaggacagaauacuagaaagaaaacuguacagggaaaaaguucuggaaauugacagaaggguuccuuggaauuuuuggcuaaauugugauuugugcaugugaggggugaacccacacaaguuugggguuaguugggaaagaugggaagcaucacuggaaaacaaaagguaaaacaauucucaaaaaucauacaagguuaguaauaguuuguauccccaccauaaagaguggagagaugauauaacauguaggcauuagcuggaaccuucagaaaaguauuaccuugauaauggggcuaaguuauuccuaggcugaagguugcucuggaccugauauuaaaaagcuuaaaacaaggccgggcuggucacgggggcucaugccuauaaucccagcacuuugggaggccaaagugggcagaucacgaggucaagagaucaagagcauccugcccaacauggugaaaccccgucucuucuaaaaauacaaaauuuagcauaguggcacccaccuguagucccagcuacucaggaggcugaggcaggagaauugcuugaaccuaggaggcagagguugcagugagccgagaucgcgccacugcacuucagccuggugacagagugagacuccgucucaaaacaaacaaacaaaaaaagcuuaaagucuugaaaguucaaagcuaaucccacuuuuaaaauaacagaacaaaauucaauacccaagacuacaaaguucaaugaaauucaauaugccacuucaaaauagcauucaauaaaaaauuaccaaauauucaaagaaccugaagaaaaauuaauaaaaacagaccagaaaugacugagaugggacuaucaggggaggauaguaaaacuacuauuuauauauagggauuucuuagauaacauuuaauaagcaugaaccauaaaaauagcugguaaauuagacuucauugaaaguuaaaauuuuuguucuucaguaagauacuauuaggagaauaaaaugacaaaccguauacugagagaaaauauuugugaagcauuuaucuaauaaagacuguauccagaauauugaaagaacucuuaaaauccaauuaaaaaaucagcaaaaaauguugacaguucaccaaugaauauacaugaauggcccuugaaaugauauucaguacaucauuagccacaauggaaauacaaauuuaauucauaaugagauucuaguacucaucuguuguaauggccaaaauuaaaaagaccaguaguuggugaggauaggaacagcuggaucucucacacaagguugauggaaccacaaaauugaacauucacuuucaaaacugucaguuucuuauaaauuuaaacauauauuuuccauauaacccagcaaauccacuccugugaaaauguaaguccauguaaaacguguacuugaauguucaugguaguuuucauaaugcccaaacuagaaaugacucaaaugucagcaauuggugaauggaugaacaaauugugguauagcuauacaguggaauauaauacucagcaagaaggacugaacuauugaacugacacaugcaauaaugugaaaaaaucucagaagcauuaugcuaagaagugagauauaaaugacuacaugcuaugauuccauuuauaugaaauucuagaaggaaaaacaaagguguggaggguagaucacucauuuccagggacugcaaaaugggguacaagguaagauuuuggggugaggauuacacaauuguauugucaaaacucaaugacuuguacacuguaacuagauaauuuuacuucauauaguacaacucaauaaagcuauuaaaauuuuuugguauuuauauuuaaaaucagcacuuugcuugaauuacuuaguacuuugauguaggaguuuauuaaguuucaucuugaguugauguguaacaacauuugcagcuucuacuuugcuuuuacauaguuuaaauuguucaaaauuuggaggaagaacuggcuguauuaaucacccugugaaguuuuuuauuuuauauucacauugacuccucaaagccuggccaacauggugaaacucugucucuacuaaaaauaccaaaauuagccaggugugguggcacaugccuguaaucccagcuacucaggagauggagucaugagaauccccugaaccugggagguggagguugcagugagccgagaccgugccacugaacuccagccugggcgacugugagaccuuuucucaaaacaacaacaacaacaacaacaacaacaaaacaaauggacuccucaagucucuuggaauccccagugaggaggguaaacagcugaauauguguaguucaaaaaagcucaucagaauuguucuuaaaaguccccuugccugcaaaaauauucuagaaugcuuugugguguuuuuguuugguugguuuuguuuugcuuuuaaaucaauuuuauagagguauagugcacaaacauuaaaauacacccauuuuaaguguacaguuggaguuuugauaaauguauuuaccuauguaacuaccauaaucaguacacagaacauguucaucugcuagaaaaauucugucaggcuucuuuguugucauacuccccacaccaccccaggaugaggaaaucacuggucucauuauagauuaguuucacucauucuacaauuuuauauaaauggucucuuacaguauguacuacuguguaucugccucccuuccuuuagcauaaugucuuuaagauucauucauguuguuuggauucacacuuuauuuuuauuguguguuuuauggcuguacaacaauuuauccguuuaccuguugaaguaugaguaaucugugaacauauuuuuuuccguugcuguuagauaauaccuugaagugggauuucuggguugugugguaagugucuguuuaacuuuacaagaaacugucaaauugauuuccaaagugguuauaccaauuugcauuuuaugagagcaauguaugagaguuccuguuguuccacauucucagcagcacuucguguugguauucuuuuuaauguuagcccuucucguguauguauaauauuaucucacugugguuuucauuugcauuucccuugucauugguaauauuuugagcaucuuuucaugugcuuguuugaccauucuuacaucuuucuuuuggugaaauguccaauuuuuugccaguauuucgcauuggauuaucuucuuauuaauguguuguaggaauucuuuauucugcauaccaguccuuuauuagcuguauguugcuuauuuuuuuucaauuucuuaauggugucuuuccaagagcaaaaguuauuaauuaauuuagauuaaguccauuuuaaaaauauuuuucuucuaugguuugguaugcuaagaaaucugcccuuccccaagguugcaaagauuuucucuuuuguuuucuucuguaaguuuuaguuuuugugugagccauucugaguucauuuuuuuguuguuguuuuauaugaagucagguuaaaguuauuuuucucaugguaaaaguucuuuuucuccaguuguagcaccauuuguugagcugacucuuauauuucuccauugaauugucuugaagucuuugucaaaugucagucaaccacauauuuggaaagcuuuuuaaaauuuaaucaccuugaaguuuauaaucuuugcccgucaaauuuuuaaaagauaauguuuaaaauauuuuuauuuagacuaguuacuaaauacaguuaauuauaugauacauacuugaacuacuagcagcugcauaucuaaauuuuuuaaaaauauaaaguaacucagagucugucuuuucauguaacacauugauuacaagguuuuguuuugucuuuauucauuguguuuuuuuaaaagauuggaacuagauggaaagauguugucuccaaaugcauucgaugccacuuucagccacuacuuuuguuuuaugcaaacccagauggcacagcaguuucuacugaggaugcacucaggcaggucaucagcuggucacauuacaaaucuguugcagaaaauauggguaauucuuucuuuuaaaaauucucaauguuuuucuauuaucacagucaacuaggaauacuaguacucugaauauaaaaugaauauagaggauaauuucaaauuugacuuucaguagagcugaggaaauuuuaguaauuuuuguuaguauuuuggaaugaaccuuuucucaucgguggccucagaagcaccuucaggaguuacccacuauuauggucacacaaucacagaagaggcuucauuaguagcucuuucuagaaguacauuuuaagugauuuaguaaacuggaaaaguccgaaacagcuaggucauuuuuggaugcauuauaaagcaauucaaaauucuuaaaugaugucaauccgcuuaaguuuuaaguaacuuuuuuuacaguuaaaaauaaucugggccgggcgcgguggcucacgccuguaaucccaaugcuuugggaggccgaggcggguggaucaugaggucaggagaucgagaccauccuggcuaacaaggugaaaccccgucucuacuaaaaauacaaaaaauuggccgggcgcgguggcgggcgccuguagucccagcuacucgggaggcugaggcagcagaauggcgugaacccgggaggcggagcuugcagugagccgagauugcgccacugcaguccgcaguccggccugggcgacagagcgagacuccgucucaaaaaaaaaaaaaaaaaaaaucugaaaaaaaugauucaaacaucucuucucaugggaaggaaaggaaugauacauuuuugcuucucuuuuuaaggaugugaaaagccuguaauucauaagucagauaauuuaaaagaaaauggauuuggugaucaggcaaagcagagagaaaaucagaaauuuccaacugauaauauuucaucaucuaaucggagccacagucacacagguguagggaaaggaccagguauguguuuaaauugucauuuuuacauaguuccaagugaguguccuccuuucuucacuuaucggaggaugcuuaccuagcuuuccuuggcugugaaaagauaauaacaaauagauaacaaaauucgucuuuugauuuaugcauuucucugagagcuguaguuuuaccugaccaguuugauuccaugaguuguuugaguuucuucaugcacucagacugugguaggccugaggcaaucuggacaguuaccaaauaaagcaauaauguggcauuucauucaaggaguuaauuaucagcuuggagcagaaaaacaugaguuaguaauuuggcauaaaugccaaaauuaaauuuacugguagugaaugcaacagcaguucaaaguuacuauugcuguaguuuguucuuaaccucguuuuuauucaacucugucuuguuacuguuaucccauaacuaauuuuuacaagccagguucuguaacuuggguccagaaugaaaccucacaauacuguguaccauuacaguuuagaaauacaucuaacucuuguguggauguucaggaugauuuuguuagcaaccuuuaaacauauuaaugaaauaauguguaaucauaaaaguaacucauuuaaucaaggguaguaagauugagaauuaacaguuauccacaaaaaacuaaaauaaaggcuuuuuaaaaauucuuaaugaagcuguaucucuuuuccuuucacagauuauugauacucuuagauucagacauuuuauguuuuucaaaagacaccuaguuuuaagcccagaaauaguauauauguguguaagaauagaagcauuggaacaagacaacuuggguucauauuccugguucuagacuuacaaacuuugugaacuugggcaaauuucuaauuucucucugccucaguuuccuuacccaaaauagagacaguaauuguaccucaaagaaguaaaugaguaagacaacuggcaaauagugaccauucaguuaccuuuagcucuuauuauuuuaauggcagaucucuuucuuuuuuuauacuuguuuuaggggcuauacaaggaguuuuaaaauacaacaugcaucuccagugucaagaaaaaucacaucuaguuuuuaaucauaaaaauaccauuguauacuauauaucuacauaucuaugcucuuuuuaaauauaucuuaacauuuuuauauagaucaauuuuuauuuuuauugggcaauuugaaaaaugaucuguaucauaguaagaaugauuucuuuuacagcuaaguuaagucacauugaucaaagggaaaagauaaaagacauuuccagagaaugugcucugaaagcuauugaacagaaaaacuuacuuucuucacaaaggaaagauuuagagaagggacaaagaaaagauuuaggacgacauagagguaaguuaagaucuuguacuauugauuuuaaaaggaacuucuaaaaaucuuauuuuaaaacugaauuuuauaacuuuaauuucuguauauguuaaauaauauauauuaaaaauacauaaauauauaaguuaaauauauauaccuauaucuaauauagaaauauauaaauuacauauauuucuguauauguauaaauauauaaauuauauauaauuuauauaguuuauauauagaaauuaaauuauauuaaaguuauuuuuaauaacuuuauuuugaagaggugagaguucacucuuguccagccuagagugcagugacacaaucauagcucucugcagucuugaacuccuggguucaagcucuccucacgucuuagccuccugaguagcuaggacuacaggcacaugccaccacaccuggcuaaauuuuaaaaaguuauuuguagagauagggucuugccauguugcucagaguggucuugaacugcuggccucaaacgauccucuuaccucagccucccaaagugcugggauuacagggguacccagaccuauuauauuuuauauauuuauuaauaugaguucuuuaauacaccuauacuaaaucuaaauaugcaaaauauccugguuuguucuuaauucuaaccugggauacuuguauauauguguuucgauguuuuaacuuacuuacagauauaauucacucauggcacauucaaguaauaaggaaguuuauaaaauuaagugaagggacuccuuuucuggcaaucccugaccuucccccucuuuacuuaguauuuccauuuccacauuauaagcaugucucuuuaugguucuaugcuuuuuucuuuauggacagagcauaauuuaacugauagugauagacuuuacaggcugauuuaagauuuuugcuucagcaacaucuuuuuucacacauaccuuuauacguuuuugccuagagccauagcauaaaauuccuucagaggaauuucugggucaggauauguuuacuuuuaauuuugacagauguggcucaguugcccucuugaaagacugaacuagucugcacucccaccaacaaugauuggaugucuguuuguucacacucucagcaacaauugguuuaacaaacuuuuaaaucuuuaccaauauaagaaguggaaaauauuuuuaugauuuuuguuaugagugagauagagugcuuauuuuuuuaaaaacugccucaauuaugaucuaccuuagagaucauuuuuugaaguuucuuuuacaaauaccccucauuaagcauacacaaggacuggaaaaucacuuuuuaaucucaaagcaguaugugauauguacuuguaauuacuauuuaccuaaaacucuuuaacauuuuaucucuaacagguauuugccuugugacuacaagguggcucugaggaguaauucauguguaucuuuaauuuuuuuuuuuaagauuugguugaugaagaccuuucacauuuccaaucuggaucaccuccugccccaaaugguuuuaaacaacaugggaauccacaucuauaucauagucaaggaaaaggaucauauaaacaugaccgaguuguaccucagagucgagcuucugcacaaauaauaaguucaaguaaaucccagauucuugcuccaggagagaaaauaacuggcaaaguuaagagugacaauggcacuggauaugacacagacagcagccaagauucuagggauagaggaaacagcugugauagcagcaguaaaagccggaaccgagguuggaaaccuaugagagaaacauuaaauguugauaguauuuuuagugaaagugaaaaaagacagcauaguccaagacauaaaccaaauaucaguaauaagccuaaaucuagcaaggauccgaguuuuaguaauuggccaaaagagaauccaaagcaaaaagguuuaaugaccauauaugaagaugaaaugaagcaggaaauaggaagcagaaguucccuugaaucuaauggaaaaggagcagagaaaaauaaaggccuuguagaggguaaagugcauggugauaauuggcagaugcaaaggacugagucuggauaugaaagcagugaucacaucaguaaugguucuacuaauuuggacucaccuguuaucgauggaaaugguacaguaauggauaucagugguguuaaagaaacaguaugcuucagguaauguaaaaguugagugaaucauuuuuccaucacucuucuuuuuuguuaauugcaugaaguaauuuuugaaguuuggggucaauuaaauagaacagaaacagcaugagcuguuuuaaagagcuuuaaaaaguuuguuucuuuuaaacacaaguauguuucuguaaagaaaccuaggauauuguaguuuauuugauauuuuagauuuccauuuugaauaguuauuuccugauuccaaaaauagcagcuuuuuauuuuuagaaaauuuggaaaguacagaaguuuauuaucauuguugugucacugucaacaauugauugguuuuaaagcacagacuucaauugguaucaucuaagucauuaaggugguuguuuaauucuucuuuuuuuggugggaggggaaggagucucacucuguugcccaggcuggagugcaguggcgcaauuacgggucacugcaaccuccgccucccagguucaagcgauucuccugccuuaacuucccaaguagcugggacuacagacacgcaccaccacgccuggcuaauuuuuguauuuuuagagacgggguuuccccaggcuacucuugaacucccaaccucaggugauccaccugccuuggccucccaaagugcugggauuacaggccugagccacuaugcccaggcuguuguuuaauucuucaaucuauauaauguuuauaaucccaucucuaacauuuguaacucagaacugaagcuaguuuuuacugucacacucauucucauggaagagauauuuucccuuuagcaaauauaaaaaaaaucagccaaauaacuuuguguucgauuaauucuaaauacauuuauuauauuacuguuuaauccuucuaacaauguguuuguuugauauuagcugauauuugaccacauuuguuauuaaaagguagauuugcaaaaaucaacugcucauguuuuaugaaaaugcuuguuucaauaaagacuuaaggaaagggccagguguaguguuuacacaccuguaaucacagcaccuugggaggcugaggcaggaggauugcuugagcccaggaguucaauacuagccugagcaacauggaaagaucucaucaucucuaggaaacaguuuuaaaauauuagccagguauuguggcauaugccuguggucccagcuacuugggaggcugaggugggaggauuuuugagcccaggaggucgaggcugcagugaaccauguuuguaccacugcacuccauccugggcaaaagagcaaaagguccuggcucaaaaaaaaaaaaaaagacuugacaagguaauuuuauaauucuucuuggaauggaguagccuaggguaguagaaagaucaggacuuuauaaccagauagacuuagauuuuaauuauugggcaaauuaauuugacuuuuacagucuuuaucuucuguaaaaugaagauaacaacuacuuuuaaguauuaaauaauguacauuaagcccuagaacagcacauggcauauaauaaauguuuaacaaauguuguuuuuuuuuagacuaaacaaaggcaguccauaauaccugauguguuuaguguguauuuuauuuucuagugaccagauuacgacaagcaaccuaaauaaagaacguggggacuguaccucccuucagagccaacaucacuuagaagguaaaaaacuuauuugaauauaauaguugcuguaaaaaaugaauuauaguaauuuauuguuugcuauuauguaucugagagaaaauccuauaugacuauaaaaauuauuuuuaaauaacccuaaaauaucaauaaacaaguuuuauuaaguuaauauauguuuuaaugaaguacauguggaaagaaggaaaucagcauucuuuuuuguauuguauugucauacaaaagaaagcaugcuauacuuuccacauugacuucacaaaguguuaauaaugguuuuguaucuuacuuuuuauuugauuggauaacuauugcuuuugaaguuugcagccuuuuuuuuuuuucuugguccucuuguuuuauuuuuuuauuauuauuuuuuauuuauuuauuuauuuuuuuauuauacuuuaaguuuuaggguacaugugcacauugugcagguuaguuacauauguauacaugugccaugcuggugcgcugcaccacuaacucgucaucuagcauuagguauaucucccagugcuaucccuccccccuccccccaccccaccgcaguccccagagugugauauucccuuuccuguguccaugugaucucauuguucaauucccaccuaugagugagaauaugccguguuugguuuucuguucuugagauaguuuacugagaaugaugauuuccaauuucauccaugucccuacaaaggacacgaacucaucauuuuuuauggcugcauaguauuccaugguguauaugugccacauuuucuuaauccagucuaucauuguuggacauuggguugguuccaagucuuugcuauugugaauaaugccgcaauaaacauacguguacaugugucuuuauagcagcaugauuuauagucauuuggguauauacccaguaaugggauggcugggucaaaugguauuucuaguucuagaucccugaggaaucgccacacugacuuccacaaggguugaacuaguuuacagucccaccaacaguguaaaaguguuccuauuucuccacauccucuccagcaccuguuguuuccugacuuuuuaaugaucaccauucuaacuggugugagaugguaucucauugugguuuugauuugcauuucucugauggccagugaugaugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuggacaugaaguccuugcccaugccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuccauauggcuagccaguuuucccagcaccauuuguuaaauagggaauccuuuccccauugcuuguuuuucucagguuugucaaagaucagauaguucuagauauguggcguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuucaaguaguuuuuuccaauucugugaagaaagucauugguagcuugauggggauagcauugaaucuguaaauuaccuugggcaguauggccauuuucacgauauugauucuuccuacccaugagcauggaauguucuuucauuuguuuguauccucuuuuauuuccuugagcagcgguuuguaguucuucuugaagagguccuucacaucccuuguaaguuggauuccuagguauuuuauucucuuugaagcaguugugaaugggaguucacucacgauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauacaaucaugucgucugcaaacagggacaauuugacuuccucguuuccuaauugaauacccuuuauuuccuucuccugccuaauuguccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaagcauuguugaauuuugucaaaggcuuuuucugcaucuauugagauaaucaugugguuuuugucuuuggcucuguuuauaugcuggauuacauuuauugauuugcguguauugaaccagccuugcaucccagggaugaagcccacuugaucaugguggauaagcuuuuugaugugcugcuggauuuguuuugccaguauuuuauugaggauuuuagcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucagcugugaauccaucugguccuggacucuuuuugguugguaaacuaucgauuauugccacaauuucagcuccuguuauuggucuauucagagauucaacuucuuccugguuuagucuugggagaguguauguguugaggaauuuauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuaguggucuaucaauuuuguugauccuuucaaaaaaccagcuccuggauucauugauuuuuugaagguuuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcugaaaaaaauguauauucuguugauuugggguggagaguucuguagaugucuauuaggucugcuuggugcagagcugaguucaauuccuggguauccugguugacuuucugucucguugaucugucuaauguugacagugggggguuaaagucucccauuauuaaugugugggagucuaagucucuuuguaggucacucaggacuugcuuuaugaaucugggugcuccuguauugggugcauauauauuuaggauaguuagcucuucuuguugaauuuaucccuuuaccauuauguaauggccuucuuugucucuuuugaucuuuguugguuuaaagucuguuuuaucagagacuaggauugcaaccccugccuuuuuuuguuuuccauuggcuugguagaucuuccuccauccuuuuauuuugagccuaugugugucucugcacgugagauggguuuccugaauacagcacacugaugggucuugacucuuuauccaauuugccagucugugucuuuuaauuggagaauuuaguccauuuacauuuaaaguuacuauuguuaugugugaauuugauccugucauuaugauguuagcuggugauuuugcucguuaguugaugcaguuucuuccuagucucgauggucuuuacauuuuggcaugauuuugcagcggcugguaccgguuguuccuuuccauguuuagcgcuuccuucaggagcucuuuuagggcaggccuaguggugacaaaaucggucagcauuugcuugucugugaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccacuguuagucugaugggcuucccuuugagaguaacccgaccuuucucucuggcugcccuuaacauuuuuuccuucauuucaacuuuggugaaucugacaauuaugugucuuggaguugcucuucuugaggaguaucuuuguggcguucucuguauuuccugaaucugaacguuggccugccuugcuagauuggggaaguucuccuggauaauauccugcagaguguuuuccaacuugguuccauucuccccaucacuuucagguacaccaauuagacguagauuuggucuuuucacauagucccauauuucuuggaggcuuugcucauuucuuuuuauucuuuuuucucuaaccuucccuucucgcuucauuucauucauuucaucuuccauugcugauacccuuucuuccaguugaucacaucggcuccugaggcuucugcauucuucacguaguucucgagccuugguuuucagcuccaucagcuccuuuaagcacuucucuguauugguuauucuaguuauacauucuucuaaacuuuuuucaaaguuuucaacuucuuugccuuugguuugaauguccucccguagcucagaguaauuugaucgucugaagccuucuucucucagcucgucaaagucauucuccauccagcuuuguucuguugcuggugaggaacugcguuccuuugaaggaggagaggcgcucugcguuuuagaguuuccaguuuuucuguucuguuuuuuccccaucuuugugguuuuaucuacuuuuggucuuugaugauggugauguacagauggguuuuugguguggauguccuuucuguuuguuaguuuuccuucuaacagacaggacccucagcugcaugucuguuggaguacccugccgugugaggugucagugugccccugcuggggggugccucccaguuaggcugcucgggggucaggggucagggacccacuugaggaggcagucugccgguucucagaucuccagcugcgugcugggagaaccacugcucucuucaaagcugucagacagggacacuuaagucugcagagguuacugcugucuuuuuguuugucugugcccugcccccagagguggagccuacagaggcaggcaggccuccuugagcuguggugggcuccacccaguucgagcuuccuggcugcuuuguuuaccuaagcaagccugggcaauggcgggcgccccucccccagccucgcugucgccuugcaguuugaucucagacugcugugcuagcagucagcgagauuccaugggcguaggacccucugagccaggugugggauauaaucucgugguucgccgcuuuuuaagccgguccgaaaagcgcaauauucgggugggagugacccgauuuuccaggugcguccgucaccccuuucuuugacucggaaaggggacucccugaccccucgugcuucccaggugaggcaaugccucgcccugcuuuggcucgcacacggugcgcacacccacuggccugcgcccacugucugguacucccuagugagaugaacccgguaccucagauggaaaugcagaaaucacccgucuucugcgucgcucacgcugggagcuguagacuggagcuguuccuauucggccaucuuggcuccucccccguuugcagccuuuuuucaugugcuguuuggauaugucucuuauuaaagauagcauuagauugcuuccuuuuuugauuuagaugaugaagucuuucaauguuuuuuuuuuuuugguagcaguuugcauuuuaaguguccacauuagggacccuugaacacauugcuuuugauacuagcccuuaaaacugugauuugagacccagauaggcaggaguaucugucuaugguggcuuguuaacacuuuacuuuuacuuaacagaagguauauuucuauauuugcaaagaaaaaugucauauucugauagcuuagaaacuggcuguagacuguuggucuuucugacuuuauuuaccuccuaccuuuuaugucuaugggaaauaggcauaaaaagagaaugguccauugagguaagcguaaagaaaauaagaaugguccuguuacugauaaguuuaugaguaaugaugagggaaguugagagcauucauacuugaaggcuuuuaaaagaugggaaagcuaugagaaaaggggaaacucuaucaggauagguagguuuuagauuaugcaaugguaguaucuucaaaaucucaagguguuaacucaaguuuguuucuugcugacaauacaaguccagagguggucaguguagucucuucuuaggagucacucaggaucccaggcuaaggggauaugggugaggaggacauaaaggaagauauauuguggagaaucacgugccaacucuuaaaacuucaaacccgaagugacacaugcacuuccacuucuguaucauugaccagagcuagucuucuaaccaggccugauuucagagaagguagaaaagugcaauuuuacaggugcuuggaauugaauggaaguaugugugaacaacucuaaugacugccauaguaguuaagaacacauagaaagauugauaaagagccuucuggaaaaguucaauuuggcaccaauaacuaugcaauggugugggauuauuauaggcgauuuguuagcaacacauaacagcccagaagcaaagaaaguuagauauuugaacguauacaggauucaggguuccuauugggaguacauaccugaagaauuugggcgagagaagucaaggaagaugauuagcaaagggauuauuauguugcaaucaaagacaauguuuucaaauuuuauaauucagaggaguagaagggauauaauuuuucacaauauaaaagagcaaugaacagcaaauuuuaaaguuuuuuagucuuuguuaugcuuaaggcuuuuguggggauuauuuuucaguuugcagacaaagaaugugauuaaauguuaaauuauuuuguuuucaucaaaugguauacuaucagaaggaaacacuuauauuaaggaaauaaccuuccuuucccauauuagaaugucucgccugauaaaaucugauaaguuugguaaccaaguauuacaggaaacaguaaaggguuggccagaaaucauagcaaaagucagugagauugaacaauaacugcaaguucaguacuuguuacaaaaugaugcuugcuuccugauaguuauaaaaacacaagaucguagagauuuugauggucagaagugcauugcuguaagaacuuugcaggagguuuccucauuuaauaugaaagugugugugugaugcacuuaaaaaugcuuuuuugugguaaaauauguauagccaaauuugccauucuaacuauuuuuaaguguacaguucaguggcauuaaguauauucacacuguugugcaacgauuacuaccauccaucuccagaacuuuucuaucuucucaaacugaaguucucuacccauuaaacagcuccccauucuccccuccucccagcccuuggcaaucaccauucuacuuuuugucucugugaauuggacuauuuuagguaccucauauagguggaaccauaugauauuuguccucuugugugugaguuauuucacuuagcaugaugacuucaggguuccuccauguuguagauguaucagaaucucauuccuuuuuaagacugaguaacauucuauuguauuauauaccacaucuuguuuaugcuuucaucuguaaguggacauguggguuguuauuauccuuuggcuauugugaauaaugcugcaaugaauauuagugugcaaaugucuguuugaguuccuacuuugaaaucuuuugaauauauacccaaaagugcaguugcuggguccuguggugguuauauguuuaauguuuucaagaacugcuguacuauuuuuacagcagcugcaccauuuuacauucccaccagcagugcauaaggacuccagucucuccauauccucacuagcacuuguuauuuucuguuuuaauagguaucauauugugguuuuguguaacccacucuuuauuuaacuaaauaaauuauacuauuuuaaaguuauuucugauuucauaaacuuucuacuucaaagccuacuacgguucucuaagccagucuuugacuucagaacaucuguuuguguugugccuugugguauuauguauucccuucccccagucugggacugagaauauguggaaaagugauauaggaauuuuuucccaaauuaaaaacuugcugugcaugguuuuuucccccaauaagggacaauuuauuauaauuuugugacuauauaugauuuucuuggucauuccuauuucuuauuuauaaaaugagggcacacuuacauuacugaccuauagaaucauuuuauaucaauagcuaaaagacuuaaaauuuaaagagccuuagaaauuucuuacuuucauauuuucuugacauuuugucaauuuuuaauauuagucuaugcaaguauauuuaaugguagaggaccaaaaucuauaauaaugccaccguuauuucuuuuuuuauuccauuaauagagauauuauauaggcuugucugccuaugucaugaugaauucugcugcaaaaauucaucccuacacugccuaaaguuguuauauuugggaacauuguuuaaauugccacaaugccauuuguaauguuuuagccccuguuuuaaaauggaauuguaguggagggauuucacacgccuuaaauuauauucaagacagaagaaaugauauguuuaaaacauugucaggagaaagcaucacauauuugaagaacacaaguaguuugguauaugcagggcagaagugcaugcauggaauuaugggauaauggcaacagggauagaagcgaaauuaugcugaaaauuugugcuauuuuuuaaucauagaggaaauggagaggcaccaaaggauaagaaaaaugguauacuguaauuugcauuuuggaaaagacugugguggugguaguauagaggauaaauuugggacagugggagaaaaauuaguuagaugaugauuguaauagccuaggagagaaaaguugggggcaguaccaaugucaagaaauauuugagagaugauaagcguaugugggcaggauaauuaguuagcuuuugugacacguaccaaaugagagaaagggaagcagggauagauguauuugggauguauacaacuagauuuacuauuuagcaaaauggggaauauaggaagaaggaacagauuuuggggguggaaggaugccaaguuuauauuuuaauuuguugaguuuaucaucuagguaaacagcauuauuaggcaguuaggaauauaagucuaaaacucaggaaauauuauauauuuaauaaccauccaccuauauaggaauugaaugccacagacacagacaggauccuucaggaaaauuggagaucgaagggcaagaaauagacaaaguaaggaacauuggcuuugcugaggaagagaagugagcuaaagcuagagagaaggagcaacuguagaaaggaaugagaagggggagcuggaaagauaugagaaaauauuggagaugggguuaucaaaggaaaaacagagaaguguagaucuuucaggggaagaguguccauagauuaagcagaauaaggauuaaaaagugccaguuugauuuagcauuuauuagugguauaguaaaagcaguguuugaggaacauuagacauagacgcaagauugaaguagaauugagguauuuagaaguaaagggccauguuuguaacuuaaucucaaaugguccagaaaaaaaaaaacccuauuauuaaaauguuaauaauagcugaaucuggagaaaggauauaauauacugcuuuuuuuccauuaauagagauauuauauaggcuugucugccuaugucaugaugaauucugcugcaaauauccaucccuaaacugccuaaagccauuauauuugggaacauuguuuaaauugccacaaugccauuuggaauguuuuagcccccuuuuuaaaauggaauuguagcggagggauuucacaugccuuaaauuacauucgagacagaagaaaugauuucuucuuauaaaaaguauguuuuauacuuuuuaaaucuuucaacuuuucugaauuuugaaaauuuauuuccaaguaaaaaguuaaaagauuacaguagacuaaugguugcacagcagugugaauguacuuaaugccacugaacuguacacuuaaaaauaguuagaauaauaaauuuuguuauguauauuuuaccacaauaaaaaacccuugaaguacauuauguacuuuuucauauuaacugaggacaccuauugcaaaguucuuagagcaaugugcuuuugaccaugaaaaucucuaagacuuuauguuuuuacagcaggaagcaagagaaguaaagaaaugaauuuuugucugucuuuccaaacguuugcugugaauagcauaccuagaggagaaaaugaaacuaaaugcuuaguuugcguuuuguuuuguuuguuuucaaguggacaugcuugguauuuauauugcagaagauaaggaacuaauguuguacagagggagagaaaggcaugaagaauagaacagaacaguaauugauggaguaagacccuuuaggcagagugagaaggaaacaagguaaagacagaauuugaaugaaaaggauggcagcuuuucugugaugaaggagagaaagaugagagcagauacugauuaguguguauuuguguuagguagaacagcugaaguguuuauaccuaauggacuuucuuuuuuuuaugagguacgguuaucuacugagguaaguacauaguagguuaggauauuuauagaucauauguaacagaucacaaaagaauuauuaggucuuucaagaacuuuugccauuugcuuccagagucugcaauacuuggcuuaaucucaguugauccuagaagucaggauuaguuaaugcugagagucaugaucugggacauaacaaauaagagugaaagaaguuaaucagugguuuaaaaaucuguuaagucccuuauuucuucuuguacaaauagucuguaccuccacuuucuuaagugaaauauacuguccuuaauguuguuacauccuagaauuaagucaauaaaaaauuuugucagaaguguuuauacauauacauaaguuuucucuaagauguuuuuggcaaacuaccaaguuuguucauuuaagauaaauacauuagaaaguauauuuagagaaguacuuuugucagccgauuuuuuuucuaugcauuuuaaacauuuuuucucuaagaauuucacaaacugguaacacauaaucucuucucuugcuguggccuacccaggaccaccaaauggcuaccuauguacuuuuuuaaaacuaaacuucugggauugaaauuugcuuuguagcaaaauagcaauauuugcuuuuccuuuaaauuauaauccaagugcaaaaagcauuuauugacuccugcuuuauuauuuuguaaaauccccaaauuuagguuucagauaguauagauuauuacuacauauuaaaguaucucucuacuccuuuuaguauguaguaaauuuauccauaaauauuuaucuaguuaaaguuuucugauuuuucuaaaauauucaaauuuauuucaaauguauuuuuauuguaaauucagucauugauuugauuauugcuguuuaauguuuaggguuuguaaauauauauauaugucuauuuuaaacauaggucuuuuuuuuagaugaaauauauauuuugauuucuugaauacucugcuuuggguuuuuuuguauacagaaucaaaaugggcauuauuaaaguuucuugccuugauacugaguuuuuuuuuucugugucaaagcguuaaaauuggacuuagauuugcgaauaaccuggagccaaaauuccucacaaagacacauggaugucuaugucagcagaagagaaaaauaacauaucuauuuuuaaguuaguuggaauucugaagucaaaccacuugguugaaugccugccacagugauauuaaaauuucaaacaugcucauaaaaccuaugcugccuccugcugcccauugugugaauaauuuauaaaaguaaagaauuacuuaagaacuaaauauuuacuuguuucuuguuugugaauauuaaacuugaaauuaugaauuggugaauaaauuaugaauuggcuaauaauaugaaguuaaaaaucacacuggguagcaaauuacauuucaacuuaaaaauuaagcugugaacauugacaaauuauugaaguucuuuuugacaucuuauuucuugucacaucuuuuuuuaaucauaaaauagcuguugaaaagauuggcaaaguuuucgagccucaggcagugugucaggcuuacccacagugauuuucuuaaacaugaaaaauaauauauuccuucuagagagacucugggauaaauuuuacugcuuuuuaaaaguguuaugaguauagcacuuauagacuuaagugggagggaaagauaagauuugucucaauucauacuuaacuugucuugcaccacugaguugggaacaugaugggcaggguggaggugacuuaaaagaaguaaaacuguguuuuugaggcaauuguuuauucugcagaccuucauuugaaugucuuuuguaugcuagauacuguguuaacuucugggcaaauuuuuuuuuuuaaaggcacguauauaaucagagcgcuuacagcaauuuaguggaaguaaacguguuaaaucuuaaaugaaugccagauuuauaguuccucucauucuaccaucuuaaguuuuuauuauuuacuauauggagcgauguuggcauagaggguauuaaauucucauguauauuacaugacucuuucuuggaaauugcuuccaagauuuaacuugcagagccugaucauaaucaaauauagauuauuuuuccccuauagggcaauaccuaaaaaauaucuaagauaaagaacacuuauuguuuaaaaaauaaaaucacugcuuuaauaacuuuguuuucuuugcagucuucauagauuugguguacaguaaaguagaaacaggagaaugagaggaaaaugagauaaaugaacaugaugaaaaugucaacuaaaaauacgggagaaugcagaaaaacuuacuagaaauguuacagaaguguagacgauuaauugacaguucaugcuaaugccauauauuuugcuaucuucuaugggcaucagcauguuauuugauguucacacuaguggccuaguuucaucagaaggagauuuaguauaaugucuuuguauguuaauggcauagugcaguggcaugagcacuagcuuuggagugaacccuggauugguuuaaaugcuccuacuuaccagauauauagaauauagauuaggucacuuaacuucacugagccuaaguuuccucaaguguaaaaaggggaauuguuucacagaacaguugugacugauguuuuaaaagacaacuauuaccaacuagaacaguaguugucaaacuuuugggccucagauaucuuuauaaucuuagaaaaggauuuaugaccuaaaagagcuuuuguuaugguuaugucuuauauagguuaugucuuauauagguuaugucuaucaacauuugcuagauuaggcacuaaaacugaaacuuucaaaauauuuauucauuuaaagaaauaaacccaguacaugcuaacacaaauaacauuuuuaaaugaaaauuaacuauugaaaacaaaaauuuagugagaugaauggcauuguuuuaugcuuucaaaucucaguuaaugcuuggcuucauguaagauggcuggauucuuguuuuugcaucagacuguugugauguuuucauguaugaagaaagcccauuuacacacagauaauacaguuggaaauaggaauauuuuaauagcuuuuccuaaaaauuguggauauuauucuuugacacuacaccaaguaguaguuucuuuaaugcagugugaaaucugaaaccauaguauuuaacuuuucguccuccauuacauuaaaauacaucagucugucuugcacuuugaauggauacuuuacucaugcaugauuuuguaacauccauguagggucauuuaaaaaauacugguuugcagccgggcacgguggcugacaccuguaaucccagcacuuugggaggccgacgcuggcggaucaccugagguuuggaguucgagaccagccugaccaauaugaagaaaccccgucucuacuaaaaauauaaaaaauuagccaggcgugguggcgcaugccugaaaucccagcuacucaggaggcugaggcaggacaauugcuugagccugggaggcggagguugcagugagccgagaucgugccauugcacuacagccugggcaacaagagcgaaacucugucucaaaaaaaaaaaaaaaaaaaaaauacugguuugcugaguuaugcagggcuuccaaguguugauacauuucacuaauaucuuucuaaaaacuauuuuuguuacuaucaccauagauacuagcagaaagucuuuauaaguauugggaaguugcaaaacuugugguggauacaaguuuucuucaaacaggugucaugcuuaguauuaccacagcaaaagugcuuuaugcauauuucccauuuccucauauagaauaacaaaaagaugugcaaaugaaguaaauuaauaaaauaauuguuacuguuucaucaagcauucuuuaaguaaaacuggcuuaaaaaacacaaguauauggcaaugaagaauacaauuaguacaguuuaguguuacugccuugaauuaugcuaacauuuuuacccauuauuguuuuugcgucaucaguguaaauggcaacacagucaaaaaguaaaguaacaucuuaauauuaucaugaaaauaguuugacuucauagacccucugaaagggucucggagaccucccgggguccaaggccacacuucgagaauugcugaacaagcauaaucuuaagacuugguacauauuggguauuccauaaacuguagcuaucauuauuguggugguacaugacuaaaauaauuuuauacaguuuucugcuucucauuucuacgauaagugggugaugauguucacaaaguaauuaaagauacuuuugugcuuuguugauacauuggugguugugacuuuucuaucaguauauuggugccccaggacccuugugccuuaguaaaggaaaaagcucccuguagaccuucagguucucagauauaaagcacuuguucucccauaagggggaaucaaaaacugagaugguguuagguaaacuccuguacaaauccaaaugucuuaguucccuuuucuucaucucuaccuuuuaaaauaauuuuuaguuuucaggguuuuguuuguucaguugggccuacuuuaucuguagucuggacauuaauuuaauuuaauuguauuaaagauuagagggcaauagucauuuuuauuagagcuguuuuaguuaaggucauguuuuguagagagaaauccaaauguagauaauguuuuacucugaacauuaauauuguuaaaggcucuccagugaauucuccuagaaucguuguucagagggaaauagaccugcuguauuuuauguggugccauauugaccuuuagguucuaaucaauagcuagcuauaauuagagagagagaaaaaaugauuaauuugguaucugaaaucucauguagcaggcuuggaagacacuuggaaguaacaaaagucacacuguaaauuaguauaacuuuuuucauaagacuucauuaaaauuaaauuaaaaaacuauuuggugccuauuaaaugucagaaccaggagagaaguuaaguaucaauuauuaggaagcauuauggcaucaugguuaagagcacggacuuuugagucauaaagaucuaauucuguaguauaucgauauauauacuuaaccuuucuaagccacuguuuucucaucuguaacaucaaguugcuagucauuucuuuauaagguuauuguaaagauuaaaugaaauauccacuucucacaacuugaguaagcagucaauaaaugguagcuaauuaguagugguauauuuuauaugcuaucauaauaaccuccuaccaauuuuaauucaguuuaaauuccuaauauucccaugagguagguaaaauggauuaucauuaucccauuauauaagugagggaacugagauuuuaagagguuaaaaggcuuguuuaccuacccauaauuagugaguccaaacuucaacucaagccagcgaucuucaaaugcaggguuuuuuucacuguuaacacuuggucaguaaagaucuugucuuaaguaacagggaaaacacauacacagaucugcaugacccagcaggaacagcacuauuccaucauggaugacacccucaagugauaauaaacugaagaaauuuugcauaaagcauuccaaaaagaacuguuauuuugaguugggucuuaaagaauucauuuuuuuaaauuggaagagauuaccuuuuauagaaagcuuuauguaaauauagaaaaguauaaaugaaauaaauucuguaacauaauuuaaauaauuuuguuuuccucaucucuucuccccaccccacccaacccuaggcuuuagaaaagaacucaggaauuuggaagcaggcuauaaaucucaugaauuccacccagaaucacauuuacaaauaaaaaaucauuugauaaaaagguaaccauauuuuuuuucccuaaauacauguauuauaggcacguuguuuaucagaagggcauaaauacauauuauuacuuugaaagcaaugggucuauaguauugagaugccuuucuuauugggaaucauuaauacaauguggaucuaaggauagagagcuuacaaaguaccagguacaguaucugauugucuguuucaauccucacagcauucuuaugagguaggugauauuuuacaagagaaaauuugaagcuuagguuaaguaaugugaccaaaacuaucgagcugagauuugauuauagcuccaucuaccuagcaaauccucaacucucuuuaaccauugcauucuaauucaauuccacauaauucauauaagaaaaauaauuugcaauauggcaucauuuacccucaccuuagaaaauaacuauuaccuaaagauaaucuugauuacauuauuuuaaacuauuauacagccaggugugauguggugguacaugucuguaauccuagcuacugaggaggcugaggcagcaggaucacuugaggccaguuuaaagccagccuaggcaacauagcaagacccucaaauauaauauaaauauauuugcaaaauauaauaaaguaauuaauauacuauacugcuauauaucaaaauuuaaguacuucuaccucuauugccuuuaaaguuuggaauguugguggggagauguuuuagaguacuguuugacuguuaacacuuuccucaaguucuauauauuguuacaaauaaauguaauuuuaguguuuugaguugaagugaguuuuuaaaauuauauuucuaauuauuagaaaugggauucugguaaugauggguguuucugguaaacacucacauauucugacauaaagaguuuggauuuggagagaguugaaaauguuaaugguugcaaauaucuuuccauuuuugugguuuuguuguaaaaauaauauaaacuguauuuugggaaaaucaaacuacaaaacaaauguuuauuuuccccuaguuucauauauuugcauaggguguucuagcuuuguuuuuauuuucauauuucagaucacauguacaugaagacaauggaaaguuauuuccuucauccagucuacaaauacccaaggaccauaaugcaagagaacauauccaccagucagaugaacagaaacuugaaaaaccgaaugaaugcaaauuuucugaguggcuuaauauagaaaauucugagagaacagguuugccuuuucacguugauaacucugcuucugggaagagagugaacaguaaugaaccaucuucauuauggucuucacaccuaagaacuguuggguuaaagccagaaacugcuccucucauccagcaacaaaauaucauggaucaauguuacuuugagaacucucuauccacagaauguauaauucggucagccagcagaucugaugggugucagaugccaaaacuuuuuugccagaaucuaccacccccuuugccaccaaagaaauaugcuauaaccagugugccacagucagagaaaagcgaaucuacaccugaugucaaacuuacagagguguuuaaagcuaccucucaucuuccgaagcacaguuuaaguacagcuucagaaccaaguuuagaagugaguacacauaugaaugaugaaagacauaaagaaacauuucaagugagagaauguuuuggcaacacaccaaacuguccauccagcuccucaacuaacgauuuucaggcaaacucaggugccauugaugcauuuugccaaccagaacuagacucuauuucuaccuguccaaaugagacaguuucauuaacuaccuauuuuucaguugauagcugcaugacggauacauauagauugaaauaccaucagaggcccaagcucucuuuuccagagagcaguggcuuuuguaauaauucacuaucuuagagugaaaaaggacuagaccuguguuacauaauaaucuugguucaagcugcccuucugaacaaagauauaaaccuagcauacauuguaauagauaacugguaaaacugaccaacuuuuacuucucagaggccauuuaaauauaauaggaaccuacugaccaaaccuagugauacauaaaauuaaagccuguggcauuuuuaaaguuguuaaucacuauacauauguauguguauauguguauacacauauauaauuuuaugaucaauaucuuagauauuuuagaaauucccuuugaauagucuuggcgugccgugaaaaauagaaaaucagggagauauaauaauucauuugucauaugcuacaguugaauaaaaauuaaauuugucccccuauuuuguggccaguagacugggaaguauuaaacuaaccaguacucauguauggagauuauaaacuaugcuaauugaaaaguaccaggugauacauagccugguacuuuuuugucaaagaauugcuuuaugaagaagcacuuucuaauggguaaccagaaaagggcuucacccauuuguuuuugacuucuaugauagucacugcauaugaucccuuuaagugucuuuaaaaaaaaugacuuaugaauuugauagcauuuggggaaaaaaagccuuauaugauuaacaauuuguaaguuuucaagaucggauggaauuuaauuuugcuccuagaauuuuugucuucagaauaucuaguuaagauaaauuaggccuuugacuauuauagguauucauaaaugcuacuuuagccauguaaguuaaaaaguuaaaauacuuaaacuuuaguguauuuauuuaucucguuacuuuuuuucuaauuuuauaugaaaugugaaaggucuuuauuuugguuugguuuacuuugggcugcuaaccaccaguguuaggaauuaauguagggcacccucuuauugggaaugucacuguaauugccuacauuuucuuugcuguaauauuaccugcuuauagguugucaacccauuuuaucugaauuugaaaaucuaucuagguuuccagauuaaauuucuaccuuucauauagagaguuuaauuuuaauaaaauguuuaauuagagcauccuucccuuuuauucuacuuugaacaaauaguaauuuuaccccaacuacuuuucaugaagagugcuuugaaaauuaaaggaauuuuuauuauuaugguaaccuuaugaguaaaaauaaguuacuuuaauugcuuuauuucguuaguugucauuuuauuuuguacuaugcugguaaacuaauugugguuuagaauaguuuuauguucacuccugauaacugagaaacagaacuaaaguuuuccuuacauugcuaaauggauaaaccucauauucaauaaacuaguaaauguagccacuugacugauugcguaaaucguguuaaaacauucuaaaauguuguaacuaauuuaaugugaauacuguuaaacagaaaauaauugcuuauaaaagucuaacuucacccaguuaccaagucuuggccaaauuuuaucuucugccuauaguuuuuacuagccuuuuuaaacuauaauagugagugaucauuacuuuauauucucguaaguuagaaauacuugaaugccaaauuaauuuuguuuuaagaaagcuuauuuuuaacauaauuuuuuaguguggaggguuuguaaauaauguaaaguuuguaaaccuguauuuaaaauaccaaaguuuuucuucuuuuauaacauuguaagauacuagaaaaaugggcuucaaguuuuuuaauagcuuucacaguuuguguaguuuuuuuuuucuauuugguuaagaugugaguuggaaauguauuauuugaaacauuuaaacuaauuuuuguauuuaacagcagucucagacauuugucuuuucaacucaguugaguuguagauaucaaauagaaauguccaguuuugccucuuuuaaguacuguccaguugaaaccuccugacucauguacuacuacacaaacuagaaaaugcccauuuauuuuuguugauucaacacuccagauacagauugauacauauauacuaaucauuuuauuucauguaaaaguuuuacaucuagggugccuauuuauuuuuauagaugcuuucauccaguuauaagcuuauuauaacuuuguaaauauuucagccaacaguuguaauguuuaaaauacuuaccuucagaauguuauauuuucaugugaaaucaauuucuucuaauucaaaaaaauuuuaagauaaacugauuuuuaaguuuauaugauuggacuucucuuugcauucaugaacugugugucacccucccaccaacguggauuauuuugggacauguuaagucgcggguacuuggaauuucacugaucauaaacgguuaucacaggagauccuaggaguuaaacuccagcaaggucuaaagcacagcuccuuagaaaaggaguuggcaaacuuucuauaaagauagaaaauaauuuaggcuuuguggaccauaauauuucuguaauaacuacucaacucugccuuuguaaugugaaagcagccauaaacaauauguaaaugaaugagcauggcuguuuuccaguaaaacuuugucaacauagaaauccagauugcauauaacu

SEQ ID NO: 13831 - RNA, 51686 nt, Homo sapiens
accaccccaaccugcgagggcccuggagaccccuguggcgcaacagaucccuuacugggucccuuccaaguggcgucacauagcaagcguccagaaggaggcgggacuuccgggccaagcgagccaauuccggccgcgccggaagucucuacugaggaaagcuaugaggauacucuguucguaagcucccggugaauuuuguuccacagacucggaagaaagguuggauaagaguucacuggagauugacaaguacucgggauagugaaaagccggaguuggaacauggauagccgcuugcaggagauccgggagcggcagaaguuacggcgacagcuccucgcgcagcagguccgcggcccugguguccccugugggagggaucgagaaugcgagugcgcggccgccuccucccuccacaccccgccuuuuucugucccuucucuaccugccgcuguuaaggccuuucugguccugcgaucuugaucccugguucugccuuuguaguucucaauuuucgcggugucccgaauguuuuuccaguuccuuccgcggucuuuguggugcuaaaccgaaugccaggauuagccuuuaagcuuuguggaacucccaccgagugucuggcauguucacgccaggaugagugucauguuauccccuacauuucucuucacuauuaaauggucaucuauuucuuucuuuucuucgucgucagccccaaauucuugagauugugguuucauuaugaaauacguuuacaguauuuucuuugacaucuuucugaagacaacacuggaaguagccugaguguaaauuuuagauucugcaucuuauauagaguauccuugucacauccacaguuaauauuugaaaucuuacucuguguuagucacaauaaucuccugaaacagguauuauuaccuucacuuaucaaguaaugaaaaaggcuccauacguuaaggaauuuuacuccuggucgcucacuucucugcugggaaauagaaccuagguuugucuccccaaagcuugucuucuaaaccauuguccuucacuucuuucuuguguaugaguaaguuaacauuugcugauuaguagagugcacaugcagaaaauacagauugugcacaguucuacuuaaaaucgaggcuguauuuuccauucuacuauucagaucaguaaaagugauaggagcaaugcucauagaguguaauuagucaucuugcaguuauuuuucaguaaugaaacuugguuuuaguaaauggacuucugaaaccuauccucuuuauggucugaugaacagauuuguggaauauggcuaaaaccguggaaacuuggagucagauuuguuccuuuguuccuuaucccgcuggcauuacgaucuugggcaaaucaaguauccuuucuaagucuucuuuucgccaacuucuuuuaucguauuaucuucaaaaauguuaaguagcucuuuguugcuaccacagaagacguuuuacuccuuaauauugaauucaaacuucuauuugacucaauauacauucauaggacaauuauuuguuuaguguuuuacacucagcagaugccaggggcucuaccuuuuaaagucuuuuaugaauugguugcacucuacuuagccagccuuauaaccauuauuuguuuacauuuguuuguauuuugcaaaauuuuccaaacugccaaacaaaauuuauguuaccauuuuaagguaguaaaguucagccuugugucuauaaauaguaagacuuagcuugaguaaaacuggaucgauuuuuauuagagcauagaauaaauaaguuauauaagcugaugccuacaaaauguuuaacaugguacccacaacccugugcaaacacugucuuaucugccuuuuuuaguuauugcuauugcagguugaauaucucuuaucugaaaugcuugggccagaaguguuuuggauuucagauuuuuuucaggauuuggaauauuugcauauuacuuacugguugagcaugccaaauaccaaaacucaaaaucggaaugcuucagugaccauuuccuuugaaugucaugucaguacucaaaaaguuccagauuuuggagcguuuuggauuuuggauuuucagauuuggaaugcucauuuuauauuaaaucguguguauugcuucacaggaaauuggcuaaagugucuuauuuucaaauacagaugguuccagacuuacuaucauuugacuuaacaauugacuuuaugaugguuugagagugauaggcauccaggcugcucauugacuuacgguggaguuguguucugauaaacccaucauaaguggaaaauauuguaacuugaaaacacacuuacaacguuuauuuugaaacagauuuacuuucaacuuacaauggguuuaucaggacauaaccucaucauaaaucaaggagccgcuguauaacugaaagcauaaaauguuuugccagcugucaaacucaucuuaauuaaugcgguuuuuuuccagaguuuuuccaguuugucuugcaagcugauuaauucauuguuuugugugugugugugugugugugaauuaagguguuuuuguuuuuuaaguauuuaauguauuaaaugcugcuacaaaugcccagaaaggcuauccagugcauugcaaucuaauuucugauuuugucuuuucucaguugggagcugaaagugccgacagcauuggugccguguuaaauagcaaagaugagcagagagaaauugcugaaacaagagaaacuugcaggucagucagauaauucuuuuuuuuuuuuuuuuugagacaggguuucacucuguugcuuaggcuggauaggcuggaguacaguagcaugauuauggcucacugcagccuugacuccugggcucaagugguacaccugccuuggccucccaaagugcugagauuacagauaugagccacugugccgaggcagguggaucacuugagcccaggaagucgggaguucgaggccagucuggccaacauggugaaaucccaucucuacuaaaaauacaaaaauuagccagacaugguggcgggcuccuguaauccccgcuacucgggagccuuaggcaguagaauugcuugaaaccgggaggcggagauuguagugagcugagccaagauugugccacugcacugcagccugggagacagagugagacuccgucucaaaaaaaaaaaaaaaaugugaaaggauuacuguuuuaauaaauaacccuagguagguaugcaguguauuaagaaaagcaucaaaauaaugauuuuagacacaaugguuuuuauugucaguucauuaauuauaaaauauuuauuuucugaggauaguaaguucccauuuguaaaguacuuagaaaauggaauguuagacuaagaauuagcauauauacuauaaauaaacaaguauauuuaaacauuuuuuuggaaauagagucucgcucugucaccaggcuugagugcaguggcgcaaucucggcucacugcaaccuccgccuccaggguugaagcaauucuccugccucagccuccccaguagcugggacuacaggugcgcgccaccacccccagcuaauuuuuguauuuuuaguaaacaugggguuucaucauguuggccaggcuggucucgaucucuugacuuuuugauccgccugccuuggccucccaaagugcugggauuacaggcaugacccaccaugcccagccuaaaaauuuuuauaaaagaaaauauacuuuauccuaaaagugguauuuauuugguaguucagaaagcauuucaaaauuuuuucgcuauucuaguuuucaauuuguacgucuguuuugcucaaaacagauuaaaauaauacauacuauauaaauuuauuuucaauauaucccuuauagcagcuuauuuucucauuugguugcuuucugauaaaaaugaaacacagaauuaucaaucagguuauuugacuuuuuggaugacuuauaaacugcguagauagauauucuuuaaucaggaaaaauuugucuuguucuguuuuuauaaccuguuuauuauuauuaauagaugcauuuauacaucuuguauauauuuauggguaauauuucuguuuauuuuucagggcuuccuaugauaccucugcuccaaaugcaaaacguaaguaucuggaugaaggagagacagaugaagacaaaauggaagaauauaaggcaaguagagagugaaauaaguuuauggucaaagaaaacauaaauccaaaugauagauucauauccaggaaaacaaauuugauggaaagccuaauuuuaagaugugcuaaaauaauugucaguggcauauguuaucaccaguuacauuaagaccauuauaucaguuuucuuaucuuuuucuuuucuuuuccuuuuuuuuuuuuugugacggagucucgcucugucgccaggcuggaguguaauggcacaaucucggcucacugcaaccuccgccuccuggauucuaagggauucuucugccucagccucccaaguagcugggacuuggugcaccaccaugcccagcuaauuuuuguauuuuuaguagagacaggguuucaccauguuggccaggauggucuugaucucuuuaccuggugauccaccugccuuggccucccaaagugcugggauuauaggugugagccaccgugcccugccaguuuucuuaucuuaaugcaagaguuauguggauuaaaugagguuauauauaugaggcacuuagcauaaugucugguaagaacuagguaauaauauucuuuuuuuuuuuuuuuuuuuuugugagacagagucucacucugucgcccaggcuggagugcaguggugugaucucagcucagugcaacuuccgccuccugguuucaagcuauucuucugucucggccucccaaguagcugggacuacaagcacgcaccacgacgcccggcuauuuuuguauuuucaguagagacaggguuucaccauauuggccaggcucgucucgaacuccugaccucaugauccacccgccucggccucccaaagugcugggauuauaggcgugagccaccaugccuggccagcaguagacaauaauauucuuaaagaugacugaggauauaaguguaucauaaaccuugggcccaguguggugccucacgcuuguaaucccagcacuuugggaggucaagaugugcagaucacuugaggucaggaguuuaagacccuccuggcuaacauggugaaacccugucucuacuaaaaauacaaaaaauuagcugggcaugguggcacacgccuguaaucccagcuacuuagguggcugaggcaggagaaucgcuugaaccugggaggcagagguugcagugagcugagaccaugccacugcacuccagccugggcaacagagugacucugucucaaaaaaaaaaaaaaaaaacacaaaacuuuggguaauugauuggaucagauuuugagaagcugcaguagcuuuggaucagauuuugagaagcuuuuuugaggaguuguuauuccauguuaacaauauuggauaguauaaucaagauauuuuuaggauuuauggccuggacuacauuguagaaauauuucugaaagaggcucaagaaaaacccaacuucuaacuuguaauugcaauauuuaguugaaauaguugaaaguauuaugguccaaaaaacuuacuuuuguuuuuucaaguuaauuguauauaauagagauaagaauguauaguuucaauaaaaucucuagaaaguucagugaaauaauaccuaaucucgugaauauugucuuauauguugcaguucugauaauauguaacuuaaauguuugugacuuuuuuuuuuauuaauuaaaauguuagugauuauuuuagguggaacuauaugcaguugcugauauucuaaccuuuuugaccuuuaagcauagcaguuucauauugcaacauugguggucguaucuuucaugacucaaacuagacucuaacacuuauaguauuguauaugagauaaauaguuuuagacaaaucaaucagcaaaauaguaguuacaguaauuauuuaugauaggaaauuuuuuuaugaaaauaaucagcuagcuagaucuaauaaugggaaagcaaagacuucaauguuugauuuuaaugcuaauuuaaaacauuuauuaaaucuuaaggaaauaaaauauguugaguuuuaaucaggaugugauagagaaauaaccccuauuuguaaaauauuuacuuaaucuuauguuuuucaaggaugaacuagaaaugcaacaggaugaagaaaauuugccauaugaagaagagauuuacaaagauucuaguacuuuucuuaagguaaaauaaauaauuuucaaauuuuguaacucuucauauuuaaguucuauaccugaaaagauuuuaaauaccuguuugucuucaagauguuuuuuaauuauugagggaucauuguuauaaaauaaagauuauuuaaaauuacucaugaaauagucuucugauauuuggcuauuuagugugagguaacaguauauuaauaucaguagcuacugaaaaguaauaauuuuaguuguauuuucaaauauuacuaauuuuuaaaucuaucaauugauugcauuuuauaucaccuuguaauagaaaacaguacagagauaauuuaucugccauuacaaugcauguuacaaauuuaauuuuguuuuuuaauuuagggaacacagagcuuaaauccccauaaugauuacugccaacauuuuguagacacuggacauagaccucagaauuucaucagggauguagguaugucagguuuguuuggacuacgcuauugcugacucucaauuacaugcauguaauuuauccaauuuguggauauuucuaacaaaauuauuucuccagcuugacaucuuuuuuucguucucagugcuucugguauaccuucuuuuucuuuucuuuucuuuuuuuuuuuuuuuugagacagagccuugcuguguugcucaggcuggagugcaguggggugaucucucuuggcucacuacaaccucugccucccagauucgagcgauucuccugccucagccucccaaguagcugggauuacaggcaccccccaccgugccuagauaauuuuuguguuuuuaguagagacgagguuucaccauguuggccaggcuggucuggaacucccgagguuucaccauguuggccaggcuggucuggaacuccugaccucaggugaucugccugccucagccucccaaagugcugagauuacaggcgugagccaccgcuccaggcccuguauaccuucuuuuucuauaaucgauauuacuauuuuuuuguuuguuucuuuuuggcuccaguuugguauuaugccuauucuugcauuuuagacagauuuauugagauaauacuuacauacuguacaauucacucaaaagaguuuuuuuuuaauguauccacagaauugugcaacuauuuucacaaucuauacuagaacauuugcaucuccccuaaggaagcccuguacccauuagcagucaguccccauuuccucucucucaucuaccccuucucagccuuaaguaucugcugaucuacuuucuauuucuauacguuugccuauuuuggacauuucuuguaaaugaaauuauacaauguguggugguuugucacuggcuucuuucacuuagcauauuuuuaagggucaucgauguugaagcaugugccuguacuucauguuuuuaaauugccaaguaauaugcuauuguauauguuuaccuuucugacaacuacucucuuguguuuccaagcagcugcacgauuuuacauuuuuacuaacaacguaugaugguuccaauuucuucacaucuuuggcacuuacuauuaucuguuuuuuauuguagccauccuagaaagugugaaguaguauuuuacugugguuuugauuugcauuugccuagugacuaaugauauugagcaucuuuuuuuaugcuuauuggccauuuaaauaucuuuuuuagagaaauauccuaauacuuuguguauuuuuaaauuauuucacugucuuuuuacuauugaauaacaagagucuuuuauauauucucuuuguguguggguguggguguguauuuuuuacauauucugaguacaagucucuuaaccugaugaauaauuugcgaauauuuucucgcauucugugggugacuuucuugauaguauauuuuguagcacaaacauucuauuuuugauauaaucaaauuuaguuuuuccuuuguuacuuguaagcaacauuucucuugaaguagagaaacuaauuuuaauguuuuuauaagcaaaauguagauguagcauaaaaauuuaugguuaaauuguauaaccagauuuagauauaaacugcucugcucuuaggauaccugccuccccaaggcaaagaaaacauacuuagaaaacuauuacagauugaggaaaaguuguaccuucuguuuuauaggugauuagaagcugacucugcugucuugaaauuugacuauaauaaaaucuucaaauucauuaauugaaaugugaucugcaaccacugacugaggaagcuuuacaaaaucauuuucuuuuuuucuuugauauuaaaguuacuaauauuuguacuuuugguuuuuaaauuaggaaguucauauaauuuauguuguuauaaaugugcuuccuguuugggaagaaaagaaacacucauuuucuuugcuuugaauaacuauccaagaaauuaaguaaaaaucuuaacaaucagguucuuuaggauaaggauuuuuuuuuuuuuuuuagcuaagaggaagggggaaaagaaucacacaagaaagguaguuguuuuuuuuuuuuuuuccugaauguuaaacuggaugcuagggguaaugguuuaacuuaauaaauaugugauauuaaguggcuuauugacuuggacuggguuuuagaacaucuggguuuuuacuugcaugucauuaguuaugaaaucugcauacauauuauuuaaaauuauuagaaguuaagcuuccuuaaaagauaugagucaaguggcauguguauuauuuuguuuucuugggagggcucauaacuuuugaauuacugauauuaacuucaguugagaugaauucagaauuuacuauuuuuucugcucagguuuagcugacagauuugaagaauauccuaaacugagggagcucaucaggcuaaaggaugaguuaauagcuaaaucuaacacuccucccauguaaguguuuuuauucaauuacuguuuauucccaacucaggcuuaaaguaucaguuuguuuauccuauaaccuuuuuucuucuuccuaaauucagcacuuauguuaacaugcuuuauuacucuguuucuucucucugccuuuuuguuuuuuaaaggcuggugcucauuauguugcccaggcuuguguccaucuccugggcucaagcaauccucccaccucaccuggacuacaggcauuucagccaucacuccuggcucuauuuuucuuucuuucuuuuuuuguuuugagauggagucuugcucuguuguccaggcuagaguguggaguguaguggcgcaaucuuggcucacugcagccuccgcccccuggguucaagugauucucaugccucagccuucugaagagcuaggauuacaggcacgcaccaccaugccuggcuaauuuuuggcacacaccaccaugccuggcuaauuuuuguauuuuuaguagagacgggguuucaccauguugcucaggcuggucucaaacuccugaccuugggugauuugccccccucaaccucaaaaugcugggauuacaggcaugagccagcguacugagcccuauuucuucguuauagcaaaaauguuaauuugaagcucuggugcugaguucagagggggcucucaguuuuuuuucagcuuuucagauaauuugcuuaaagugccucuaaauauuuuuucuucuuaaaagucauccaagucgggcaugguggcucaccccucuaaucccagcacauugggaggcugaggcagguggaucaccugaggucaggaguuugagaccagccugcccaacaugcugaaacccugucucuacuaaaaauacaaaaauuagcugggcaugguggugcacgccuguaaucccagcuacucgagaggcugaggcaguagaaucguuugaaucuaggaggcagagguugcagugagccgagaucgcaccauugcacuuuagccugggugacggagugagacuccguauucuugauagcuuacuuaaaaugccuuuaaaugacuucuugucaaguaauuuguuuguuaaaggaagcuuagaaaacuuagagucaggaaaggaagaaaacaaauauuaauuacagcuuagcauucugagauacuauucuuaacaauuuggaauaugauaauucauuucaaccguugcuaagcagaauaauguuuuccucagaaauguauaugagaucuuugaaauuggagaauuuagcuuugaagguuuuguacauuuaaugauaugauaaaauguauuuugggccgggugcgguggcucacaccuauaaucccagcacuuugggaggcugaggugggcggaucauuagaucaagagaucaagaccgucuuggccaacauggugaaaccuugucucuauuaaaaauacaaaaauuagcugggugugguggcgcacaccuguagucccagcuauucgggaggcagaggcugaggcagaagagguggaguuugaacccaggagguggaguuugcagugagccgagauugugccacugcacuccagccuggcaacagagugagacucugucucaaaaaaaaaaaaaaaaaaaaaaaaaaaauuguauucuguaagucauuagaagcaccacagaauguuuuaguauguggagaggaagucuaaguauacucuaauauucaucguauuuuaaaauacaccuuuacuuucuugcuuauuuacuuauuuauuuauuuaaauagagacagggucucacugucucuauuuugagaccaggcuggucucaaacuccuggggucaauugauccucccacgcuggccucccaaaguguugguauuauaggcaugagccaccaugccuggccuaaaauacaccuuuaaugagauguuaaggugggaagaucacuugagcccaggaguuugagauuguaguacuguauaaucaggccugugaauagccacugcauucagccugagcaauauagugagaccuugucucaaacaaacaaacaaacaaacaaacgaaaacccauuuacauuuaaaguauuuuaaauuuaaaauauuuucaugcuaugugacaauaacuuuucaguaaaggccaguaauaacuuauauuagguagcaugaaaagacucuuaauagaaacauuuuuacuaaugaaaaaacuaauaaaagaaaacuauaugaaaacuauguuuugggggaagaauuuaaagcuuacagagaaauggguuuucuaacugaacaauugagaauaaaacaaugugauauuccuuagaaaauucagaugagaagggaaagggguucagagacacaucugaguauggauuuuuaauauugagagaagaauauauucuggguguacauggggaaaauaggacuuuuacuauguaguuuaauuacguucaugucuuaagaaagaucacugguagaucguuuaagucuauacugaagaaaaaaagacucaauaaaaaggccuuuaguaauuagguuacugauuacuuuguaaauaguguuuaguaauaauguuuagugauaucuaagacauuucuuucauuaccaucuguuaagguacuugaaaaucuuauuuaaaaagcauuuuuuuaaaaaccucauuuuuaaugcuuuaaucaaauagguacuuacaagccgauauagaagccuuugacaucagagaacuaacacccaaauuugaugugauucuucuggaacccccuuuagaagaauauuacagagaaacuggcaucacugcuaaugaaaaaugcuggacuugggaugauguaugaucaaacuuucuacauuguaaugaauuauuuauuuucaaaugaauauguuuauuuggucagaaagugagauaauaaauaucaucccuacuuuuguagggauuauaaauguagauuuauaguguaaauuauagcugaagguccaagguacauugacuaauauuacauuaucuuuaauuugagccuucuuuucaaggcaaaaauugagcagauagcaagugaauaggcuguagaagacuuaaaauuuuggucuuagaguccuuggcuauauaguuagagaaguuuaaaaacagauggaaugauucauaauucauucugcauuugauuaguuucaguaaacaucagagcuuguuuauguauauaaaaacaugauuucuacucuuuaaacagcuuacaguguaguaaaguauggauaaacacccuguauggacacauaauuacaauuuuguugauuaaacgauggaguccugcauaagaugacaugagagcaacugaccaguccuggguagaugggacauaggaacauagaggaggugacaccugaacaauauaaauagauuaguuggaauuagccaagaaagaugugggacggcgguuacaagcagaaggaacaacaagaacagaggggauggaggcaaacgacuaucugguugugggguggagguccuguauguagguugguauuguuggaacacagauugggacuaucuugaggugauguguuaggaguugggacuuuuauucugaagacguuaauaagucugaagaguuuuaaccaguuuaguaaaaaggucagauugguguuuggaagcugggcuagagucugggaaagaauucuggaaaaauggccagguguggugucucaugccuguaaucccagcacuuugggaggccgaggaggguggaucacgaggucaggaguuagagaccagccugaccaacauggugaaacccuaucucuacuaaaaauacaaaaauuagccgggugugguggcacguaccuguaaucccagcuacucgggaggcugaggcaagacaauagcuugaacccgggaagcggagguugcagugagccaagauugcgccauugcacuccagccugggcgacacagcaagacucugucucaaaaaaaaaaaaaaaaaaaaaaaaauuuuggaaaaaggagagcaauuagaagacucuuucuuagaguaaccuaaugcugagaugaagggacgcugaauuaggguaauaguaggaauggaaagaaggugauacauucagcaauguuuaggagguagauuuaguaagauugagugauugggaugaggggaagaguuaaggauaacucaggguuucuaucuugggauagguggauugaauuaucaccaacugagagugaguuucagaagaugagcaggauuagagagguuaaauaauacugaacaaguugauuucuagguauaugugagacauucaaauggaagaggucauaggaauaaaauaugaaacucuaaggacaggcagaucugguuucaaaauacauauuuuagaggauuaucacauaaaauccauguaaauagaugaguuuauccugggaucgugucucaggauaaaaauguggacugacaguaaagccgggaaaacauuuacauuuaaagacuacauauaaaagaaauuuaaaaacgaguuguucagugaugaaugaagagaaccaggagaguaugaauguaauggaaaccaagggaacagugaguuucaaggagaguguaaucaggaccguucugcauuucuagaaaagauguggggcaaggaaaggacugaaacuggaagacguguuucuuaggaaacggauuagaaucuuugcaugucccuuucugaguuaaugguaguuacuacucuuaauaauaucuauuuuuccaagauuuaccucuaauucuuccucuuccuugaaacuuuuccuauuagcuuuaauacuccuagcacuuuuauuuauauuuguauggcuccuauaauguaaaaguuuuuccccuucccuguuuaaaguguuaucuguguuuauuguugaaaaaucagaaaagugcacagaaugugguauuucuaagacuuaagauuagagacuuaaugcucuugauauuucuugcagagaaguuuuccagauagguauaaauuuacauuccuuucaguaguguuuaagaaugucuaguuagccauauccucauuaaaguugaauauuaauauuaaaaaccauuuuuuaucaguuugcucaaaagaaaaaauuuaaacaaugaaucugauuauguucuuuauuaauaauuaggcagaauuuuguuuucucuagccaauccgugagguuucagcagugaagguacaagaacuucaauuauaugugauaaacuaauacaguuuuuaaaauaaagaaauucuauuuuauaugcaaauucuugauuucaguuuaauuucacuguacuucaacucuggcuggcauacugaaaaauuuugucuggccccagagcccuaaguucuuuaacuuuuaugagauaccguccugaaggaagugccaguaguuaauguaauaaacaaaauguaaauaagaaaaauguuuggguuucacagguauucuuuuucauguuagagagucgguaguggucauuguguuuuacuuaagaacacaagcauuaaaguaccaacacuuaacuuuuagaauuagugucaaaagagaauaauuuuuuuuuuuuuggcauuugagacucaaaguaguaaucguagcaaaauauguauauugauuuauugagaaguucuucuguagacacuggauaucacaguccucccgaaacauuuauuguuauauuuuaauuuuaauuuugucccuaacauugggcuuaguuaagugcuucauucuuuuucaguaaaugauaaaagauugcuggagaaucugucucaagcuccaucuuaaaagauugcauaagucuauagcuauuguuuccuauaagcucuuuccauauaacagcaaguguauauauguauauaugugcacagguguguauguuguuuguauauaaaguaacaaaacaauagaacgaguaauuuuaaggauaacauuuauuuucuguuaguuccuaauggaaacuaauacacuuaaagaacacaucuauccuaauaaaucuuaauuguuguucuuuuggauuuaggaugaaugggaaacaaaauacuuuuaugcaauaucguuuugauuucuuacagauuaugaaguuagaaauugaugagauugcagcaccucgaucauuuauuuuucucuggugugguucuggggagggguuggaccuuggaagagugguaagauggugcuuuuauaaaguggauuuuuaaauuaauaagaaaaaaauguaacaguauguugcauaggauguuugaaaguggauguuauuuuguccuuuguuucuuaaauaauucuaaaauagugagaaaaaaaaaauguccagaaaagaacguaagaaaggcaauacuuguaaguuaguuuaccagcacuagggaggaauguguagcucuuucaaaagacacuucauuacaaguacaggaagagaacagcuuaaagauuugaaacuccaaauuauaccucaaaaaugagcugcuugguaucauuuacaauucuuuaugaguagcuaaaaaguguucuaugaguagcuaaaaguauucaggagcauuggcuccugaaauccaaauggaagucaaauaaaauuggaaaaguaacacagcauauggaagacaugaaugaaugagaaagaaguuauaauaccugaacuuauuuuaaguaucugauauuuaauuguauuucacagcuuuuuuauuuuuauuuuuuuauuggaguuuuuuuuuguuuuuuuuuguuuuuuugagacaagguaccaacucuguugcccaggcuggcgugcaguggcacaauuguggcuuacuguagccucgaccuccuggacucaacucaagcaguuuucccacaucagccuccuaauagcugggaccacaggcacaccaccaccccuggcuaauuuuuuuaguauuuguagagaugaggucuuguuauguugcccaggcuggccccaaacuccugggcucaagggauccucccaccucagccucccaaaguguuaggauuacaggcaugagccaccaccccuggcccugauuggccuucaccaaaaggaacaaaauaauauauaugcuguuuuaaacaagaauaacaacaguauuaugacuagguaucaggagucuuaauuuugcucucaauucagcugcuaugcuguaacaguaagacuuugggcaaaaagauacucacucuugagggucucaauuuugucacauuuuauugguugacacuucguuuuuaugacauauuauuuauuauacaccaaacuaucucauuuaaugauuccaauuuggggagguauccauuugacaauugaaaaauuuaaguaggauuauaugagauaauaaguaugauuauauggaaauaagauugugcccaaauucugaaauucuacaauuacuguauauucuuuauauaaauaguaaggcuguuggguaacaucauugcuuccaucauuuauuaacuccaagguaaacuauaacuguguuucaguuggauaucuccauuuuuuugguguuggcucuucaagaugcuauagaaaaguaagagcgaaacauacauguuuuuauagguauauugguguuuacuuuguuuuaacuuuaauaucugacuuugaucuuuccuuucauuccccaaauuagauugaaaaugauuagaagguuuuuaucuuuuuuuuuuuuuuuuuuugaggcagagccuugcucugucgcccacgcuggagugcaguggugcgaucuuggcucccugcaaaacucugcuucccaguugaagcaguucuccugcuucagccuccugaguagccauccaggagguuuuuaucuuauuuacuuaauguagcaguuuaucauacuggugagaguucggcgaaaaaugauuuaaaaaauaauucagcaugagaaauacucaugagauuuugauaaauuaguggauuagggcauguagaauuuaggucauagugauguuaaugacaccuggugcaaaauaaauauuuaguaacaggaacagauauugaucuugauuuuggagauuuuaaaauaaaauucugcugggcgcaguggcucaugucugucaucccagcacuuugagagacagaggcgggcagaucacuugaggccaggaguucaagaccagccuggccaacauggugaaaccccaucucuacuaaaaauacaaaaauuagcacagcaugguggcacgugcuuguggucccagccacuugggaagcugaggcaugagaaucacuugaaccugagaggcggagguugcagugagccaagauuaccacacugaacuccagccuaggugagacuccaucucaaaaaauaaaauaaaauaaaauucugaguuucauuuugagguguuaucuuacauuacccaauaagcauuccugaaaaguguauguuuuauacucuaucuuuuuuuuuuuuugguucagggggaacucccaacaggauuuccugugguggaaaggaagcuuguuggaagguuuuauuauuauuauuauuauuauuauuauuauuauuauuauacuuuaaguucugggauacaugugcagaacgugcagguuuguuacauagguauacaugugccauggugguuugcugcacccaucaacccguaaucuacauuagguauuucuccuaaugcugucccuccccuagcccccaaccugccucuacuauaucuugauauguacuugaucaucauaccagcaauacuguacuuauuuguuuauuuuucccuccuuuacucuuaaaguugauggggauagggacugugucuuauucauguuuuuauuuccagcagcuaaccagcacuggcauaugguagacuuucaguugucacugugagcagucauuuagcugguauuuguuuuauguuaauguauaacagcuucuaggacauuaagguucacaucucuguuuucuagauuauauagagaugaaaguaccauuuuacccaacaaagagauacacguaacaauuuuaaguuugaacauuuuuacaguuguauuaaaaauagaaauaagauuuuauaagacucucauuugaaguuagcguuuagaaaauuuucaauaguauguagcuuugucagagaauagaauauugaguuggcaggaaucaaauuguguuuuggauuguuuugugauuacagaaggucugagugcuuacaauuuaaaaccccauguccauugaugacaauagaauguagaauugggagaugauguaauccuuucuauguuuugauauuuaacuauauauaugacauugauauccaaaagauauauaugcauuccguauuauggcuauguauuuaaagacuggcauuucuuuuuauauucuacacugaaacaaaauuaccuugaaaccuuggaauauagugucugaaaccucuagaaaguuuuuuuuaaugcugguuguuauuguuaaguauuguuuauuucuuuaaguuaaggauuuguguuuaaaauucuuuuguuucuaguguuuacgaaaaugggguuacagaagaugugaagauauuuguuggauuaaaaccaauaaaaacaauccugggaagacuaagacuuuagauccaaaggcugucuuucagagaacaaagguauugccuuuacugauuuguuuuuuuuaauuuuugugauuuucucucaagcuuuuccaaauaacuguauacuguuuaauuaacuucagugaaaagguccuuuucuuagacuuguaaagacagcauugagcauuacaggaauacauccaaauuaguuuuaaaauguuuuauucauuaucuuagaucaaccccaccaugcuagaaaggggaguauauauuccuccauguccuaaaugccauauuucuaaguuagauaaaggcuuuugaucacacucacccgcagaauuuuucuaggcucagaaagaagagauagcaagaucgcaagacucgaguuggccagcuuagagacguauuucucucuucuuuccuucuuuuuccuuuacaagaaccccugagaacuucuguuuguugugacucugcccugcuaguaucaggcuuuaacaguuuuuguucuuacuuuuuagggagccucuggugggagggucuuucuuauuaagucuuuuuuguacuggaaucaugccuagguaaugaagccuccguaaaaucccaagauggguuggagagcuucuggguuggugaaccuguggaguuucugggacgguggucugcuuggagagggcacagcagcuccaugccccaugccccaugccgcauacuuuucauuaugugucucuuccaucuggcuguuuuugaguuguauccuuuuauaauaaauaggucauaguaaguaaagagcuuuccugaauuccucgagcuguucuagcaaaugaucuaaccugaggaagaggucaugggaaccucugauuuauagcugguuggucagaagcacaggugacaaucuggacuugugauugguaucugaagguggggcauucaugugguucucagcccuugaccuguggggucugcacuaacuagguagauagugucagaauugaauugaauuauaguguugauggagaaguggagaauugcuugguaugggaaaaacccacacaucugggaucagaagugaaguauucugaaaauacugaguguugugagugcguagaagaguuuguuuuucuuauuuacauggcagucuuuccucauccagagauccagguuuuccuguuguuuuguugcccauagaacuguaucucaccagaaaugguggcucacuucuguaaucccagcacuuugggaggccgagguagguagaccacuugagcccaggaauuugagaccagccugagcaacauggcgagacccugucuuuacaaaaaauuuaaaaaucagccagguguggugguguguuccuguggucccagcuacuugggaggcugaggcgggggauugcuugagcccaggaggucaaggcugcagugagcugagaucgugcuacuguacuccagccugggugacagagcgagacccagucucaaaaagaagagaaauaacuguaucccaaagauuccgagaaaugaggauuguuuuagaauugaggacaucagaaaugugaaagguuuuggaaugacuguugaugaaaacagauuaauuggucugcucuuguuauuuaggaacacugccucauggggaucaaaggaacugugaagcguagcacagacggggacuucauucaugcuaauguugacauugacuuaauuaucacagaagaaccugaaauuggcaauauagaaaaaccuguagaaauuuuucauauaauugagcauuuuugucuugguagaagacgccuucaucuauuuggaagagauaguacaauucgaccagguaggaccucaguuaacaacaacuuuuaugauucuuuggguuaugcaugucaagaaauaggacauggugcuguguaaaauaaaguucuuaugcauuugauuccuuuucuugcuguacuucaaauaugaacaguuucagguccacagcaaaauugagaggaaggcacagagacuuuuccauauaccugcugcccccacacaugcauaaccuuuccaguuaucaguaucucccaacagagugguacauuuguuacaaaugaugaaccuacauugacacaucauaaucacucaaaguccacaguuuacauuaggauucacucuugguuguaguaauucugugaguuuggacaaauguauaaugacaucuauccaccauuauaggaucauacucaauaguuucacggcccuaaaaauccucugugcuccacuuauucaucccuacccacaacucuugacaaccacuuaucuuuuuacugucuccguaauuugccuuugucagaauguuacauaguuggaaucguauaguauguagccuuuuuagauuggcuucuuucauuugguaauuggcauuuaagauuucuccauuccuuuucaugguuugauaggucauuucuuuuuagugccgaauaauauuccauuggauguaccgcaguuuuuauauccauuuaccuacugaaggacaucuuccaaguuuuggcaauuaugaauaagcuacaauggaaaucuguguacagguuuuuguguggucguaaguuuucagcuccuuuggguaaauaccaaggagcacaaaugcuggauuguaugguaagaauguuuaauuuuguaggaaacugccaagacugucuucugaagugccuguaccauuuuacauuuccaccggcagugagaguuccuguugcucugcauccucaccagcauuugguguugucaguguucaggauuuuggcaauuuuaguguguguguagugguaucauaauguuguuuuaauuugcauuuuucugaugacauaugauguagaaccucuuuucauaugcuuauuuacuaucuguaugccuuuuuuggugagaugucuuuuaaggucuuuggcccauuuuuuauuuggcuguuuguuuucuuauuguugagguuuaagaguuacuuguauauuuuggagaauaguacuuuaucagauuuguuuuuugcaaauauuuucucuuauucggugacugucuucucacugccuuguugcauguuuauuuuuauuuaauuacuuucugcuuuuuuauuuucuuucuaguuucuuuggauuuacuugcugucuuucuaucugaaguauuuuuagauugauauucagguuagggguacagguuuaauuuuguacuuguaaacuacuaguacaaaaagaaagaaagaaauugaauaggcaagaguuucaagaaagaaacucuugcaaaaauuuaguauuagcuacaugcaaauaaggaagaaaaauuugauggaucaaaguguagauguuugggaguuagccauauaaauaauaguaugugcaauugagagucuguucaagagaccuuaauuuauggccaggcacugugacucaagccuguaaucccagcacuuugggaggccagggugggcagaucacuugaggucaggaguuugagaccagccugggcaacauggugaaacccugucucuacuaaaaauacaaaaauuagcugggugugguggugugugccuguaaucccagcuacuugggaggcugaggcagaagaaucacuugaaccugggaggcagagguugcagugagccgagauugugccacuguacuccagccagggugacagaauaagacccugucucaaaaaaaaaaaaaaaaaaaagaccuuaguuuauuaaguugcuccucaaacacacuucuuccucaaggacauagccuaagguauuucacauauaccuuaggaauacaauuuaccauugcuuuaaaauaaaauuuacagauaacuaugugagucaaauacacucugaagccagacaauuuuuuuuuuuuuuugagacagguucucacucuuguucaggcuggagugcaguggcacgaucuuggcucacugcaacccccgccucccagguucaagugauucagccuccugaguagcugggacugcaggcgugugccaccacaccuggcuaauuuuuuguauuuuuaguagagaugauguuucaccauguuggccaagcuggucucgaacuccugaccccaagugaucgcccgccuuggccuccaaauugcugggauuacaagugugagccaccacacacccaagccagacuauuuuaaacuuacucuguucuuaguaauaccuuuagaauuucugauaaaacacaauguugcugugcagaauuuggaagagaggggaaucccuuggacuucuauagccaguuuacucugcaaggauuuccauguuuuacguaagagacaguauagcaagggagacagaguauuaguuauuuuuauuauaucuuuaaauuuucuguuucuuauuccuuguuugugguguuguguuccacauauauugaauauuaucuuccauaauaccacaaacaugccaaaaaacaaacuagaaggcagcaaauaaaaaucucauagguuuaauagucagugagagcccauagguguggaaugugcucuugaucaugguaucugccagguaauacauaaaagacacaguauaauuaaccuuuuuuucuucaacuauuacaaaucuuacuguauucaugcacuuuuagaaacuaaaaauguuuuaaaaaacaaugaacuaaguauuguacagaaauggcuacuguauuuuagaaugugauccuagugaaauauuuuucauuuuauagcuuuuuaugaugcaucuacuuuucuaagaaauaaccuaaggaugauggggcagauauauuauaaaccuaacuuugcagauaaauaaccuaauucuuacagauaauuggaccugucccaaauaaugcugugucucuuauaaugcuccagaggcauauuuucaggguccccuacaaagggcaugucuguaagagucaccacacccaaagaaccccagagcaccgugucuguauuggguauuuguaguuccuuccauucuaaagacaguuuaaucaaucagaaaauauccuuauuacaagaaaaguugucuagcaauauaauuggcaaaauagcuguuuaccuacagaaguauaaugugcaguggaaauucugagaaagaagaaauaauuuucauuucauguaagaaauauauuugaauuggauguugaagggugggauuuuuaacagguugacaggauagaaaagaaaauaauaugggcacaaaaaucgggguuaguauagaagcaguuacuauaguaguucauuguuuuccuuagagguucaugaaaagcauuaaugagaaauguuauuggaaaguucauucagccaucauuguaaaagaucuuagauuuuauauuuaugaauuugggcuuuguggaaacaguuggaagguuuuugagcagagaagugacauguuuuaagcuuugcuuuaggcuuuccacuuuuagagggaggagaagcuauagguugggagaucauuacaguauauaugugugucuguuacacauguguuauaugguaggguauugaccuuguaaaaaaaaauaaaggcuuaaauuugaggguggcagcagaaauggaaagauaggaaugagugggaguaacaugguagugguugaauuucucagaccuaucaacugagaauauuuucuaguuagcaaguguagagcaaaaguugguuccaagauuuuaaucagaaaauggcaccauuuacauaaauaggaagauuauauauaauuuauuacaguuucacuaaacccaaacucaguguaauguaugggauuuuuuuucucuaaguucuauucucacaaaagauaguacguggaugaggaggauauauuacaaaaguuacaaucuaggaggagaaacaagauauauaccugugaaaucuuuaaaacaugaccacaauuaagugccauucuguaaaagagaucaguauuggaugaaugauggggacaucuuuaagaaugcauuggggauuugaacuagcuucuaaagaauuaauaagagagaauugcaaauaaaaaguauaaucuuuuuuuccuccauuucaggcuggcucacaguuggaccaacgcuuacaaauagcaacuacaaugcagaaacauaugcauccuauuucagugcuccuaauuccuacuugacugguuguacagaagaaauugagagacuucgaccaaaaucgccuccucccaaaucuaaaucugaccgaggagguggagcucccagagguggaggaagagguggaacuucugcuggccguggacgagaaagaaauagaucuaacuuccgaggagaaagagguggcuuuagagggggccguggaggagcacacagagguggcuuuccaccucgauaauuguugaagacauugaaccuauucauccuccucuaaccuucuuuauuguaauuaaauuucaagugggagacuuaacuuuagaacucacuuccagcuugcacuuugcuuuaauuucucugagcugcaagaaugucuuagcgagccuugcuugcaguugucacacacacugucugguuuuuuucaggauaaaugaaugauucugccuuuuguuaugugcgugaacagaauggaacaacucaaguagcuucaucuucagagacugaauuuauucugauagacuucagcuaauuacaaaggauuuugcuaauuuuugggaauaaauaauggaaaaagauccagucugugguaucaugcuagugcugacagggccuugauagaauagaguuggaaaagaugguaagcuuuugucaggguuuuaacauuuucuugaugaaacaauaaaaagagguaagcuuuuuucuucuuuuuuuuuaaguuuuaaauaaacucagauauaauuugaauacugaagaaauuaagagacuuugaacaaaaacucuucccaaaucuaaauuugauaggggagguggagauuccaggggugggugaaagaagagauagaacuuagcaggcagacuuaaaaaaaaaaaaaaaguuuaucaucauaaucucaauuuuguggcuaugacuccuaaucacgcuuccuaagaagcaaaggaggacaaauauucaugugcuagauagcacugugguguggacuugaacuuggauugaccuuaaauuuuauauuccucaaauaaaagagaggcagcgacaagauaccucauuaucagaugcuugguuuauacauuuugggacuaaaauacuuggugaugaaaugacauacaccuuuaaacuuguuauggagauaguuuaauguaaaaccaacuacggaaaacccucaacuuaaggauacagcuuggaaauuggaacugcaauugccuuuuauuaaaaccauauggugugauguuuguuuuuaaaauuauauaagacuuuaugcugucacuucucuugcuguacuguaauucauguuuuaaaugaauuugauaaugaaauuauacuauuaucauucuugaugaauacuuuucuuauuuuuaugauuuuucuaaugaaacuuuaaacuuuugagauuugagagucuguuuucuauaaguagaauuacuguuguuacaaaaugaaaaaggacugaccuaaaaucagucucuucuuuuggucugugauggauuuuaauggccguucugugcucauauauaccuaagaugagauuauauuacauccaccaaagacucaguuugaagauaaggaaugagugauagaagaaauaaggcugagauccuuaaaagccuaauuaauuuaacucgcuuaacccauuaguacuaucuaguacaagaccccuuuuuuuuugcugaaauuaugguauauuuucaacuucacuaauuacaaauuaucuagauuuagaacucuauaugucagcauugaccugggaaugaagucaggauagagaaauuccacuugccugugauggguccuuagaaguaucagcuaaggagugacccuguccuauacacagggcucucuauuacguuccauacccugggccuacccaaggugacauuccugcuguuuacauggcauaggcaccugugagaucagugucacaauuucaucuuagaaagagguagguauggcugcuuugucgguugaaaguuaaggggagccaugaucuaccauauuuaggaaaaaguuauuuaaaaaagagcagaugguggaaaaagaauguaagacccagaauuuaucccuuugacaaugaaucuggccuuuuuaauagcaggauggaauugauucacuaguuuuugcuaacuuucacuuucaguaaagguugagguguuguuuuugcaaugacuguguauucauugaggaaagguuuccaaugaaauuucauuacucugaccucuucuaauuuuuggucuucuuuauauuuacaugucuuacauuccacaaaauuauuuagaaaugcugggcaugguggcucaugccuguaaucccagcacuuugugaggccgauguggguggaucacuugaggucaggaguuugagaccagccugaccaauauggagaaaucccaucucuacuaaaaauacaaaauuagcugggcgugguggcaugugcacgccuguaauccccgcuacucgggaggcuguggcaggagaauugccugaacccaggaggcggagguugcagugagccgagauugugccacugcacuccagccugggcgacagagugagacucugucucaaaaaaaaaaaaaaaaauuguauagaaauaaauuuuuaguugcuuuaugcacuaauuccuuacuggggauagaagcuaauuauugugaaauaaccuaguuuagaaguuagaagaucagcaugucugaguuuuuacagaauuauaauucaugguauuccaaaccaacuguuguuauuuauuuccagugagaaccauuuucccacugaccuuccuccuuucagaggauggggauuaggaggcccaaaguacugauugaguaggaauacuuuuuuacucuucuucacuguggagaaagaagagggcagguaguugaugaugucaggagaacagauuuuaugguguggaauaccauaccuaaacacaaaugaaucagauuagaccacagaauugugaugauggcagucagaauguaauacggucaucaugaaacagcacagugugagaggucaaggugucaaccugggaagugagaaucaagcaggaguguggcauggcaaccaacucacagauccagaguugagagggaucacuacugcagcaguucugcucuguuacucugguaaguaguagagccacuuuaugagcccuuauuuccuaucucccuuauucugaggccaggucagugauaugcuauaguuucauuuaaguuaauggaguauaaagaugggauacuugggagcuauauugugcaucagggugucacagcugcuacuaggaguuacuccuuuucaugucuuuuaaaauacuuucuacccaucuuaauugcuaaauuaucuuucaguuaguuacagcgcuuaauuuaaaaccuguacuguuuucauccugaauuuagaacauaagauuuagccuuugaaguauaguuucagacuuuacuaauuuguuuaauauaauccuuauuaacaugacaaaaugaaagcccuguugggacuuagucuaaacaguagucuuugaucugaaagugucucauauuuugugaucuauuagaaacauaaaccuuugcuuaugcagaaggucuuucuuagaacaauccuguaaucuuaggguucaugugugacuagcauuauccucucuuugauguuggguaauagaggcugaacuuuucuuguguauauauaguuaguuuugaggccauaaaucuaggacuucucaaaagauuagaacauuuauccaguaaacugacuccauugaagacuucauuucuggaaauaccacauugcuucugcucucaauaacucuaucauuuacucguauaaauauugcuagcuguaaugcacagagaaaaacuaccucauucaaucuagauaauugggacauccuuuuccaguaaacccuuuuuccacuacuggauaaaauauuaaaaugaucaguuugaguguauguuagaguucauguuucuguaacuaaaggugcuaauaaacugaaaucagauaagguagguuuuuccaaaaauacuucuaaauaauugacaaccuagaagucaacaauguaaaaugcauaugggacucuauauuaauagagaagcaggccaagaacuuuuuaaugggauaauugucuucuuuaggcacauuguuugcauauuaacgacauggaaauauuuucacucauuuacuuucauccaucuaucugugcuuuuucucacuuugaugaguucucucaacuccuuucuaagaaaagcagagcagagcagcauagagugcguuaguaaauggccacugacucuuggucucaggccauagcaacuauagagagaagaguggggcuggagaccucauacccuggguaaaguggacaucacuugucagcuccagcuaauugucaccacagagagaagaggguaagucugagauguucaugugcauuucccuacauuuuagagguugacaaaauaguuugugacuuuugcuuacauuugcauucauagaacuaaaaaaaauuuaacuuggcuaacaaaauaccacaugcauauuuucuuuuuuauuuuuauuuuuugagacagagucucuguuacccaggcuggggggcagugauaagaucuuggcucacugcaaccuccgccuccaggguugaagcgauucuucugccucagccuccugaguagcuggaauuacaggugcccaccaccacacccagcuaauuuuaguauucuuaguagagacaggauuucaccauguuggccaggcuggucucaaacucccgaccucaacugauccacccacccuggccucccaaagugucaggauuacaggcgugagccucugcaacuggccaacaugcauauuuaaauuaugcaugcauuguagcuguauacugugugaccacauuuacuuaaaaaagaggaaaaaagguuacuugcuugagacaggaaacuaucaccuuugaaagcauauuaaguaguuggcuuacuuuggaacacacaguagacugaaaaugugaacuaauacuuuaaaauugccguauaaugaugucauugcaagccauucaucuauccaaugggggaaaauguggaggucuaggcuuguguugucacaaaauacaccuuuuagauaauccuuaccuguacagauuuuuauaacuguuguuaucauaagagaauggcuacaucauuauccugccuuuucuggguguuuauuuuguuguuuuugaaaguggacaaaaccucaaagcacaauuuuguucugauauauccaguuuaguaguuuaugcugguuaaaugaucaaaguaauugcuuaaaugucuuguggaauuagcugucacuuuauaguuuauguauugugguggguaccuuaauaauaaaaagauuuuuaauguaauaauauugcucauaauucaugaaagcuacauggguaguuggguuauuguuuugucuaagaagcuagguuuauagcaugguaaauaaaaacucaagauuauagcuuucuuuucuacuauugagcucaauuaaaggauaaugcaugauuaaaaauauauuuauaaaaauaauuccaaagcaaaauuuagaaaaauguaaacacaaauguaagcccaucagccaacuaccuccuugaaucuuaacuccauauccuuccucagauggugcugacaagauaguggaucaggauggcaccagcaccucuuuggggaccuuucccaguucugauugcuuuccuuuacccugauucaaacagaaagcuugccuuuucaucugauaccugcauuugucuacucaccuaguccugagcuuuuacaccacugcuugggcucuuaugacuuaguuuuuguuguuagcuuuauaagggcagugguaugcuuucucagcuucuaauguauggcauauaauaagugcucaauaaauagucccuuucccuugcugcuugcuuaauaauuggaaauaacucccaggagauuuuucauaaccuucccuugucagcucuuuucccuucugcugaugcuuucuugcuguguaagaggacuguuuuucuaacaaagacuuuuucucugucucaaauaaaagaacauuaucuuuggggauaaagaaaacaaagcaguuuccacugaauuaccauuuaucagaggucuugaacagaacuaacuuccccuggucugacuuuaaaggaaccugacuccuuccuuagaauguaacuuuucaauuacuucucugccaagggcaacauguuaaaauaaggagagcgauuuaacuacaccugugucaccuuguuuaauuauagccuaaguggaaaaaguagauuauauuucuccggugaauaauagagacaguagauugccugaguaagggggguggacaggaugguggaggaugggugugggguggcacccaggagucuuaggaaacugcugcuggucagcaacagcaacgccuauaaucccuaggggagagaaccucauggggaaagagcucaguggcacggagcuccacugggaaaguagcucagcccagaccacucacucauuuuccccaagcauggugugaaagcagagagcccuggacuucacaaagccauggggcacuuugacacuagucaucaguguggaugaaagagaguaaagauucccuuucaguccugugggauagagauucagauugucagguugauuuuaaaaacaugacauuuuugcacaccagaguuuacaguugcaauucauaucugcuugaaacuucccuaauucaugaagguaauaaccuuuuugacacauaggcauaugagguggggucccuaaaacauugauuggguaacauuaaaccccauuggguauccuaaaaugguauucuucaaacaugaauaauguguguuuaaacaguuuuucaugaacccaaggaauaccucauauugaaaaauaccaacaaaaaaacuagagucucguucuucagaaggucuuaaaauugcaaaucucauugcaaaagaguuguuuuuauaacugguaagagaauuuuuucaacuuuuauuuuaaauucaggggauacacaugcagauuuuuuaccuggguauauugugugaugcugagguuuggggucugaaugaucgucacucagguacugagcacagaacccaaguuuuucuuuuucuuuucuuuuuuuuuuuuuuuuuuuuugguggagcaaucagaacacauacaacauuuauugauuaggguuugccaucuuauaugggugugguuugucgcacccccaaaacaauuaugauaguaacauccaagaucacugaucacacaucaccaugacagacauaauaauaaacagguuugaaauauugugauaauuaccaaaaggugacacagaaacacaaagugagcacacacuguuggaucaacaguuuuugaauucuugccccacucccucccucccaccucaaauagucccgugucuauuguugucauauuuauguguagcaaauguuuagcucccacuuaugagaacaugugguauuugguuuucuguuccuuuguuaauuugcuuaggauaauggccuccagcugcaucuauguugcugcaaagaacaugcuuucauucuuuuacauggcugugaaguauuccaugguguauguguaccacauuuucuuuauccaguccaccauugauggguaccuagguugauuccaugucuuugcuauugugaauagugcugcuaugaacaugugucuuuuugguagaaugauuuauuuuccuuugggcauauacucaguaauagguugaaugguaauucuguaauauaauuuuuuaaaaaauuaucaaagccaggcaugauacccuguaauccuagcuaugugggaggcugagauggaaggauuacuugagccugaaagcuggagaccagccugggugacauagugagacuucaucucaaauaauaaaaaaguggaaaaauaaaauaaaaaagcauucccuaaaaauucuuacacaacucggccgagcgcgguggcucacgccuauaauccuagcacuuugggaggcugaggcgggcagauugccugagcuuaggaguucgagaccagccugggcaacaauggugaaaccccgucucuacuaaaauacaaaaaauuagccggguguggcagcaggcaccuguagucccagcuacuugggaggcugaggcaggagaaucgcuugaacccgggaggcggagguugcagugagccgagaucgcgccacugcacuccagccugggcaacagagcaagacuccaucuccaaaaaaaggaaauucuuacacaacucauguauucuugagacugcaucuguaauccacuuauaguuuccuuaaugaaacacuaguaauuugucuccccaaauugacuuuguucuuuacgugauucaaaacuagauucucauguauuaaguuuggauaacaauggcucuggaaauguuuaugaggguacauuuuggaaaucgagggaguuuagccugcacaagaaacaugauagggauaugucucugaacuaucugaaaacugcuauucauuggaggaggaauucaccuugggaggcugaggcgggaggacugcuugagcccaggaguuugugaccagcgugggaaacauggugaaaccacaucucuacaaaaaauuagccaggcacaugccuguagucccagauacucaggaggccaaggcaggaggaucacuugaacucaggagguugaggcugcagugagucaugaucuugccacugcacuccagccugggcaacaaacugacccccugucucaaaaaacaacaacaaaaaaagugaugagaauauuacuuucccaaacaaccauuuaugaacaguucuguuagaaaauuauauuugguggacuuucccuaaaacuucucuuuuugguacaaguacucgcuugucuuuugaggccaaagguagauugagaucauaccugcuuucauuccacacuagugauucauaauggcaaacucccuaaguucuuuuucuaacauguauuguuuccaagaacgauauccugcauaugcauuuguuuuuuggacacaagucuagaugauucuuaauuauucucagucuacuaccauuauguuagacuuuuagaagugaaccuucuaggaaaguugccauuugguaaccucaaaagaugugccuucaaaaagugagugaacucauuucuuuuuuuuaaauaaugguuccuuaacauuugaaauacaaguucuugucuuugguuuauauauuauugagguguugguuuuuagcauuuaaaguaguuuaagcugcaaauuucucauauggcaaauuuauucuaaucucugaaaccaucuguuaauuggaauuucuauagcauuuaaagagcuugauuuggaggaugucaauuacgauacugguggcauaguagcaaauccuauuaggagucagauuaguccuaguuuuuaugauccuuagcaaguuuaguaaaaaaccuaauaaaacaauaacagcaaugaauacuuaaauagcagcacuaugugucagacacuguucgaggcccuuuauaaacuuuaauucuugaaaaaacuggaggaaacagacacagaaaauuuucuaacuuccccuggaucacacagcuagugguggaacuaguauagaaacccaugucgcuggguccagagcgacaugggucugagccguugugcuccaccagcucuuccagucuggggauggggagcaccguuucagagcagcacuuacaccauuuuuggcaaguggucauucaggacucacuggagcauuuccauuacauauuggguuucuucuaccaugaaagcuaaccucaccauuuauauuauauucccucuguuuuccaagggucuugcucuuuugaauauuuuuucucugucuucaaucuucaacauucuuuguaguacaguauugucacuaucuauauuuuuuccacauaauacuggcuucuuuccaccagcauuugaauggcaaaucccuuaaaauuuaaaauuuaaaacaaauuuaaaauuuaaaaaauccuccccuuucugugauccacccgcucgucgccucuugaguugccuccauucugccuccccuucuucaaccuguucuaaucuagccuuuagccuuacugauuuagagaaacugcucuucaccaaagucacccaugaccuuuuacuaaucccaacaaacauuuuugucuuugucuuuuggaagccuguaacuuggcugcccacucucuucaugcacccccucuuuuaccuugagguuugugacaucuucuagccaaguucccuucuuaccucucuggcccuucccaguuucaagguuucuagugacucucugcccuagggauuugcuuccuucccacucuacagagucagccuaaguuuuuucagccacuuguguggcuuccuuuucuugauauauauguagauggcuugcagaucuuuagcuuacagcucucugcugagcuucacacccauauuuuuaggucuuauaguuuaucucacuuggauagcuugcaagcuaccuuagauauguacaaucugaacuauacccuuuacauacacacugacauacacaagcuguuuuuauuucuguuuccucucagagaaucaucugucuacccaguugcucaaaacaaaucguuuucugacacuuucucuucccuuacaucaccucucccccaauucccccacccccaacaacuaaauaccauuauuuuaauucaggccaucgugaacucaaauguacuauucugauagccuccuaaauggucugucugcugcaaguuacaucaccuuacaaccccaaagugaucuuucuagagugauccugcugcuccugcuuaaauuacuuugaaggucuucacuuugucauuaggauaaaguccaaacucuuccuuggcuaagccucacucuacuugcuucuccaacuuuaucuuuuacgacuuugucucuccuugauaguuccagucaaguuuaaguucuuuaguuuacugaaagggugaugugugcccucuccacucugagccuucaugcuuauuuucucuucugcuggcauauuuaccaauacugccaaguaccuggcaaauguuuacaauuuuucaggucucaucuucaauguaacuuccucuggaaaaucuuuacugacuacaccuugcccccccagcuagaccaggucagauaucccugcugugugcuuacuguagcauuucauggcauuucugaaacuuuccuguaauuguagagauggcagggacuuugcuuguacuguucacuguugucucuccaguauagcgccuaguguuuggcaccuagaaaaugugcagucaguauuuguuaaaugagaagauacuacuuccaauggcauauucuuugagcaccuaauuauuuagaaguuucuuguguuaaguggaacuuuguaacuucuuuuuuuuuggagucuagcucugucuuccaggcuggagugcaauggugcgaucucagcucacugcaaccucugccucccggguucaagcaauucuccugccucagccucccaaguagcugggauuacaggugccugccaucacgcccagcuaauuuuuuguauuuucaguagagacgggguuucaccauguuggccaggcuggucucaaacuccugaccucaagugauccacccgccucggccacccaaagugcugguauuacaggcgugagccaccgcacccagccugucacuucuauuuaaugauucugguucuauacccuaaggaacacaaagaacaaaucauuagacagccuucaaaugaauaaaggaaugugcucugugcuucuauuucacauagggcauggugccuagaauugaacaagcgccuagguguggccugaccucagaguagaguggaaccaucacuaugcucauuugacagccuauccuaguaauaagguagauugacaucauaucugcuuucauuccacuagugauucauaauggcaaacucccuaaguucuuuuucuaacauguguuguuuccaagaaugaucuccugcauaugcauuuguuuuuuggacacaagucuaggagcuuacauuucuucuuguuaaacucauccaaguugaugauguuaaacucauccaaguugaugauguuaaacucauccaaguugauguugaagcaacaugccaguuggcuaacaugggggggauuuuaguucugucacuguauuuguuuuucuaccuacuucaugacaucuaauuuauaaauaaaucuuacuagccauauaaucagagacaaggaacuuaagccuguuucuucauguguaaauggggcugauaacaggaucaggguugcugugaagaauacaugugcauauguucccagaaaacauagugcaguucuugggacacgauauguacucaauauauguuagcuauuauuauucauauaauugauaacaaaguugaauagggcagguagaggcagaugccuuugugacaucacucaaaaucauucuucuagguuuagacauauucauuaauaaugguuucaugucgcccauuucuauuuauuuugcccacaaaaacauuuuagagaacuuugaaaugccuuucucaaguauaauaugauguuucuuagauuuauugccuaguacuccucaacccucaaaaaaaaagagaaaauuuuguuuuccugauuuguucuuagugagcuacccaaacaacuuuuugccaagacuuuuugaauacuacccuuauuucuuuuuaagaccuaaaaauacauaauaaauaaauaaaucuaccuacuaagauuauacgaagugauuuauugauacugguuaacauccauuauauacagguagaaacuuucaaaauuguacaaagaaccauuaagcauauugauaaagacaguuuuacagacaaaacaacuggaaaauaguuuuaacauacacaauauauaauuaugaaaaaaauguagaacacauauuguucuaccagauaaaucccaagguuauuaaaagucugcuaugcagaccuuaaguugaaaaauguguucaauggaguuacaugguuuuagaaaauuaaguauaauguaaaaauuaagcuuuuuuuucucauugcaauugggagaggaacugagacaacuuuuuaccccaaaucuauacaguuugaaaaauaauuuauaugucuagcauaaagaaaauugagaauguuuaugguucuguaaacuuugccuuuuaugaaaugcaaaccacaucaguuuuaaaaauuagaaacugugcaaucagaaacagauuguucccuuuaugguacaauuguaccuuaauuggcuuuauaccugagcaccaaagcugaaguucuaaaugccaucucuuccuggaaaguuauucugaaaaugagcaagaaaucaaaacuagccuauuaucaucuagaaaauuaggcaccaagaaggagauuaucuccuuggaaaugcaacaucaaugacagagaaguuucaauuaauuaagcagcugacagaucuccuugugaacacaacaaaggaaauccacauaagaagagccuccguaaaguccuuugucuucuaccaggaacugucggaaaaccauuucugguuguucucgcugcuuuacaauugugagcuaggaaaaaaaaaacaaaacaguaacagccccugguuauaaacauuauuugaaaaugggucaauuuugucuauuucaauuuuggcaaacauuauugaaugcccauuaugugugaggcuauggaggaugaugggaaagugccugauaucuagaguggaaagaggcauggaccccgaaaccccaaaaccuaagacauacaauuuuaaguggcaaaaaugaaaccuaagcagaguguuacgggaaaggcuucacagugauaguaacuguccccugagccuuaaaggauagggguagggcuagaaaguguuccauacuggaauacaugugccauguaccagagauacaauuauggcuggcauguaaauuaucacaggcuucuucuaaaagggacaaauuaucaucauaaugaguuuggguuucuguaggaaaugugauccagugaaggugcagaagaaugaaaugagagaguuaaguggcagcaguauguacaauacauucgugagaugagggacacuagauaggaagugguuugaagugucugggugggagaugaucagguucugaauuagagcaguggagguggaaaggggguagauuggagagaugcuagagagguuaacacacagggaaaacagggagaacuccuguccuuugcucaucaugauucucuagaccugugcuguccaguacaacagccagacacacauacuauugagcauuuaaaauguggcucauccaaauugagaugugcuguaaauauaagauuucuauauuuucuauauaagauucuagaaaaaaauagauuucuagacuuaguaugaaaaauaaaauauaaaaauaucucaauaauugauacagauuacauauagaaauuauauuuuagauauacuggguuaaauuaauuauuuaaaugaauuuuuucuuuuuaaaugcagucaucagaaaacacagaauugcauauucauuugcauuacuggagagugcugcucuaagaagaaacccacagggaagaagcccagaagagaggcaguuuugucaugaacacuuugaacccuucuuucuacaccuguauuccuacuugaggaagucaagguagaugaucugaauugucauaauuucauauuuauugcgccacaagugggguuaacugagccacacaugcacaacaaugccucuccaccugccuccuguguaauuaagaggagcgaggguauuucucacuucuuccucucaggagguaaacccaccagaaaggccugcaauagggaaacacaugcaguuagcugcuucaccagcugcagcagggaagguaugugcaauuuuggcuaggagggcagggcccucccuacuuuugcauucuaugcuuuuuaguuaucaagcagagaguaacucugucaacaccacuugcuuuuuuccuuuauaacguuucggccuggauccaagucuguuagguuuuaaguugccccgaccuaguaaaaauaauaauauauaagaacaacugcuguugccacaacucagcuaauuccauguggauacagauaugugugaugccuuggcuuuugggugucagcucuagguacugggaguuggcacuggaauagcugugugcauaggcagauuccacuccuacauggggaagcaaaacuaacccuuaaugagauuucuccaaagaaguuuaagauuugccuccugaugaaccugaagucaggauucuuuucauuuuauguuuuauccacccucucccacaugccacuacaacuuuacuauuguccaugauugguaggggcagugugggucuagccucugacacaauucagacugaggcugggcaggauaagacauugaaggaggaaagacuugaaguuccaauuucuuuagaauuuacuuucuuuauggaaauuaauggaaagaaggucagauugcucaucugagguauuuucuauugcugccauucacuuggguuuuuuuuuuuguuuuuguguggugcucauuguacaaccuccucugacaaaagugucucgcuaugagcugaggugguaaguagaacagggaaugaaugucagccuugggagaaacuuagcuuuaagcuacagugauuaauauccuauccuaccauuugauuaucuacaggugucaggaugacacagaaaguauaguggaaggucucaggggaguggagucauggaagugguauuggccugucuugacacagugauggucgucucuucaaggggcacacccacaccaauaaaaggaaagcauacugguauggauugguagauccaucuuuauuuccccgcuuuacauuucuaaagggagggggauggcccuauagaguaggaagagaacauuaaaauaaucacugcuugucaccuccuugcuucuugugugccuucuccaagggaagacuggcuaacucugaaugugacauucucugggucaccuuaccagaggucuuaaagaauuaaugugcuucaaaagccaaucucaucuuucauuggcugacucacagggaaucgcuaaagcaugggagugauuaggaaggcccagguagaacauguugagcgagaagagagccaugauacaacccucggggaauaccaacucuuaaguggcagaugaaugaagagaagccuaugaaaaagagucacugagaaagaagaaucaggagcaggggauguuuugaaagcugacaggagagaauuugaggaaguagucaaccuuguaaaugcauaaaaggauugagaaucaauugucuuuagcaauuuggcaguuuacagagaaguggagagaugagaagaaggaaagagcaguuaauauagacuuuuucaaggagcuugguuguagaauguuugguauauugccgguguucaauaaauauuuguagaaugaaugaggaaagggaagcagaaucuuggagaaguggcagcuucuaugaagguagauuugaacagcuuguaaacuggaaaagggccaaugggaaaggaauaaucuagaaaauacaaguggaaggagagagaauaaaaaacauuuggagcacagagaacugugcagggcaggacuagaauuucucaggaaggcacuugguuucggucaucuguagauauacugugguagaaaucuuuuuuuguuguuguuccccacagagaauaaucugacaauaaggucuaagaggacuguuuuugaaaaaguaauuagcauaaccuggaagguagcaguuccuucuagauuugauuuuguuacucuugauccuuccauaccaacucuuuucuccuaccuaaucuuaacccuuuaaaaguauguuuucauuuccuuuguuuagucaguuuucaagugucagagaaaggguggaaugcuaagugcacugggacuaagcagcuaguacaagcccuguaucugcuaugauccaguugugagacccggaccaagcuagugagcuccuuugagccucacuuucaugucugugaugugcagcuacaggaagccagguaucucccagauuccuuucaacucugacaucuguagauuuuagauauuucuaauucuuuauagagauagcacucuaugaacagauggauacauuugcagauaguacauaagaaaaucugauucuuuaaguauucaagcuaaaauuguuuuaucacacaggugcuuaauauuuuauucacauauaauauuugaagcucacccccagaugguuuuauaaccaaagcugacauaacuuugauaagugguuggaacaggugggagaaagcagaggaaaguuuaauguuuuucccugaaggaggaacuacugagcacaaggaugaucuccaugcuuagucuugccucuuuucugcaaaugcccaguuggagggaugcaguugcugcagcugggaugaaggugaaucauuauugcugugcauucuaaauaccaguggcuuucaguuugcauuuccugagacucaagauuugguuacauguuucuagggcauucagagagaaugcccuagaaaaacguguaaccaaaucuuaagagaauguguuuaguuugagccuugucugucaucucuagguccugcccuuaaacugaaccauaggugcuguguggugugaaaacuguucuagaaaaguuguguauucauccagaugucauuaguucaauuuaccuaagcucuaccuaaaguugauguuugcaugcaugaguuacuuucacaguuacgaauguugguucagauugacaucacauuuacauuucaggagacaacuggccccauaaauacccuggcacuuguagacacgugccuccagcugagugucuuauagcucuucaguaagcaguguuacacagcacaucaucaucaucuauacauucuagaucccaggagacucuaauauugagcuugggaaggaaaacaaguaaguaucuggaacguggcaacaacauauaauuuucuuggguucuagacauauuaaaauuuuuuacucaaacucagaaaaggcuagaagggcuuggaaggacaagaauaacaaaacuuuucagagauuauaaauuaaacauuguaauaaaucaaauuuuacaaauguucuaaaugauacuuuuauaauuaaguaauuuuaggcaccagaagaaaagucacuucaaagucuguuaaugguaccaauugcuauuaaaucaugaaguuaauacugacuuaagauaccccauaguuaacccaugguaauagccauuuauguuugugacugguaaguagguagauauacuuagagguuaaugugagguuuuuuuaacuuuuauuuuagauuugugauggugugaguuuuuaaaaucaaagaucacgucauaaaaauauagggugugcauguuaagucuuuaaugaaauuuuuaacauuugaauaaagggaaaaauaaaauugcuuucuuaccuucauugaauauggccucuuuuguuggauaauacccauuaucauucugaguuguugagaguauggguuucccacuucaggcagcaaugucuuagauuuaagaaaaucaaaguuuuaguacaguuuauaacauuuagauagaaguagcaauaugagauuaucauaauguuaaaaacauaaaaccauguacuugaacauugguguaguucauuaccugaaaaccaaaacuguggggaaaaugcacuaaaaauuauuggcacccauucccauaauugacagaagacaauuauuucugucuuuuggaaaaaacucuuccucuggaauuugacacauguacaucacugaaaugauacagcacagacguagucagcccucuguauccauggguucugcauccauggauucagccaaccacagacaaaaauauuauuuguaaaaaaugcaucuguacugaaaaggcauggauuuuggguuuuuuuugucauuauucuguaaacaauauaguuuaacaacuauuuacauagcauuuuauauuguauuagguguuauaaguaaucuuuuuuuuuuuuugauagagagagggucucacuauguugcccaggcuggucuugaacgccugcacucaagcaauccucccgcuucagccucccaaagugcugggauuauaggugugagccaccgugcccagcugguguuauaaguaaucuagagaugauuuaaaauauauggggguauauguacaaguuauaugcaaauaccaugccauuuuauaugagggacuucagcaucuguuaauuuauagaguauucuggaaccaauuccccauggauaccaagagacaauaguauauguuuuaugcaaacaacuuccugugaaaguuugaucccuuuucaagauucaaggcuauguugcgagagaaaagaauguacuuuguuccuucaguggauggaaaauuccauccaaguacuacuguuccggcauuaaaacaaacuaccaaauguugauuucucaaagggaaugcagcgucuuagauagcccagaaaucugguuaguggucuacaggccaauccagcugcacguggcauccaggugauaugaaggauuuugacuuacauuucuuccguuaagacagaguaaaaugcuaauguuugcuucucagcaagaagaugccaacagccaaugcaucacugugaguuggccagagaacaugugaguuagaauguuucaccauaaaccucaagugucaggaaaaguuuauggucaauguuuuucacaggaguaaggaaagcaaaaaauucauuauuuacauucacacucccauccccuauaugcauuauguggcauauuaugguagaucuauuuauucaacaaacaacguaaguauucuucauguauguguuuuaaagugccagcugccucuaaaaagaaaguagcuuacauuugguuuuuaacuuuguuucauuuuguugaugaaagucaaggaaauaccaguaugcugauauaagcacagaccuaccaaucugcugccuugugguagagacacuggcuauuuccuguggauguucaguucagcaacuaugcauucagcauuuacuaugucaauauauuacaagaggaagcuuccuuaacuuuuauauaaacauucuucagacucauaguucuuugccuacugaauuuuauuuuuuuaaauugcauuuauaaucauuucuuaauuucaaacauaugcagauaucaauuucuaaaucuucaucuuaaaaccaaucucuaacuggaauauugaugccccugaauucucuuaaaaauacacuuuugacauuccucaugaauaugcagcucucuaaacugaucaccugucauggccuugaauuuuaaucuugccucuuucugcaagaugcuauauauauugauaaacuguacuucauacaauuggguucaacaacuagacuuaagccaucuugccacaauguaagugagccuucaggaaacuaacuaucugcugagcucuacuggaauccacuaucagagucaaacaauagccaucggcagugaugcucacacaacaauggucuacaaauaacguuugcaauaaauguugacucuuguacaaauuauaagcuggguuuuccuaagauacuuuaaaauagucauuuguauuaauuuaacaucaaacucacaauuucuuuuguuguuauugcaacagagggguguauagucucuuuuuauggaauuauuauuuguuaacucaguaaucugauuuagucuguagccaaacacuuaugaaagauuucuacauucuucugaguaugcaguucagcaccagggaugaguccagagcauaagaacugaauucaguucccaucucugccacuuuacuaccugaaggaacuugucuccaagccucaacugauuccucuguaaaauguugagaccauauccaucucacugauuuguuaugacaauuaacugaaaugguauauuuaaguauuuagaguacagagacuggcacauaguuaaugaucuggaaguguuagcauuuucuauuaaagucacauauuuuaguuguuugaaaguacucuauacaaauaacuuuauaccagcuaauugauauugaucaaaacaugaaauuauuucuuucauauacagaaauauaugccuuauuauuuuucuuucuguaauauuugacugcacauaaauaaaaacauuuacgaauuuauauuuuucauauuaccacaaaagcaaugaaaauaauacuuaccauaucuguguugauaugugcaaaagauggcacauuaaauauuccuuggaucaguucuggugggcugcuuacucccaaccacaggaacauguguagaccauuagccaguaagaauauuccuucuucugaaagacgggacucagagcaacgaacggcagcagguaacauuguacucuugacaucuaacgugugcugggcaggcacagacaaaagaguuagaaacuccuuucuuccccuucccuucccuccuuccucuuuuccuuuccuuuuuccucccuccccucccucaaugcauagugaguaccuauuaugugccagacuuuauuccagucauuagaaaauaaucccuaccuugcacagcaaaugguuuugugcagggaggaagagacaacacauaaaauaaguaaaauauacagaauauagauggugugaagaguuaugaagaaaagaugcacaaaagugggauggggugugucgcugauaaaggugcggacaaauuuuaacuaggguaguccagggagcccacaaacuuuuaagaagguaaccugaggagguaagagaaggugccaucgggacaacuggagaagaccauuucagauggaaggaaaagcuagugcacugguccuaaagcaagggcccaaauggaguguuugaggaucagcaugaagcccaguguggcugaagugggauggggaaagggagaguaacagaagauuucuagaagggaggggagggcggggcacacagcacugggccagggugguaggaacugagaugggaaauccuggaguguuuugagcaaagaaguaauacgagcugacaauuuuauuuuauuuuauuuuuugagacggagucuugcucugucacccaggcuggaggcacuaucucggcucacugcaaccuccaccucccugguucaagcaauuccccugccucagccccccacgaguagcugggauuacaggcacauaccaccacgcccggcuaauuuuuuuguauuuuuuaguagagaugggguuucaccauguuggccagacuggucucaaacuccugaccucaggcaaucugcccgccuuggccucccaaagugcugggauuacagacgugagccacggcaccuggccagagcugacaauuauuuuaacaggaugcccuaacuucugugcugaaaacagacugaaagagacgcagaacuccucagauucccuccccucaccauagugaacacauacugaugcacauaagcaacuugcagaaagagccccugcucgaaaucccacaccauauauuuugaaggcauuugugacuuuaacuuuccucuuaagaacaacauauuucagauauaacauacgggaaagcacaaaauaugauucccuuccagccuccucugggaaaugcaccaccccagcaugcuuacuaugggcagaaguuguggguagaagaaaagcugagagucagccacacccauggucaugaccagcugucucugguaugcucguucaucaguugagaucucuggucugcugaguaguacacaguuuuucaacaagcaauucauguacacuggcaauacuuucauggaaucugguagaauaagcugaaaaagacaauuuuuuguuucauacgcuugaucuuuacugagaacaauucccugagcuucaucuguaagacugaaacauuauuugcuucugaacuuguaaggauguaaggauuaacugguaacccauguaaaacaccuagagcacacaguaacuggcacagaguaggcauucaaagagcagcaguuguuuuuauuuuaucuagugcuacagcagucugguguagcuguuaucagcacuacccacucacugcuuaggaugcaaucccagcucugucuuuuagcaggugugugacccugggcaaauuacuuacccugucuuuuucucaguguuuuuuuuuuuuagcugaauauggaauaauaguauaucuacuucauaauuggguuaugauaauuaaaugauuuguaaagcacaauagugccuagcacauaggauauaccauauauauauguuuagauauauacauaguuuaauaaaauuuuuuaaaaaugauuucauaaccuauauuuccacuucaagaauagcauuucuaacugccaacaggauaucucuuccguuaugcuuuucaugcaucuuaaacucaucaaaaaaauauuaaaugccauugugucauagguucugugcaaagugucaaggauauaaaaaggaauaaggcauaguccauguuguaagaugcuugaaguucgcuggggauagacauauaaauacauaaaacauaauaaagagauugcaguacuauagauuaaaaaaggaaaugcuucaugcauuuagaugugucauuaaugaaugauaacaugcaaaaucaaacuccuacaauuccacaaacacguucuuccucccauguuuccuauucaguguagaacuuccagaugaacccuaauucauuuauuucuuuacccucaauuaauaaacaaauccuuuuaauucuaccuucauaaucuaccuguaccuucucuccacccucacuuuggcucacaugaccucauucuaacugccccaaaguacaugcccuugugagauacuacaaccuaacacaaugcagcaauucuaggaacacaaccugaugauuuaagaaauuauaguguccuauauuguuuaacuuucuccuaaaucaauauuguuagaauagcuaauaaucaaguuugacugaucugaaugucacuuccuuccacuuaauagcacaagucagugaacaaggacauauccaaaagaaaaauuauacauacgagauaauaacuugcaaacagauaaaugaaauaucugaucuauaaauuaaugguuucuuuuuagcuuucucucuuuuuuauuuuuauuuuuugagauggagucucacucuguugcccaggcuggagugcagcggcgcaaucucgggucacugcaaccuugccuccuggguucaagugauucuccugccucagccuccugaguaccugggauuacaggcauguaccaccacacccggcuaacuuuuguuuuuuuaguagagaugggguuucgccauguuggccaggcuggucucaaacuccugaccucaagcaauccgcccaccucagccucccaaacugcugggaucacaggcgugagccaccaugccuggcuuaguuuucugucuugaugaugaaaauggauauagaguuaucagaauccacacugaaaagaaaaugucccugagggucuguuagaauuuauucugcaucuuaaauucauaucguaagucucuucucaugauguacuaaguaaggaauguggggaacagaacuuucuaaccgucucaggcaaacguauuucagaaugauucuacuuugcaguuuguuucccccgucaacuucuaaucuccuuucaaagaaccaaggacaguuaaauauauguuuauucauaagaguagaacacucucuucuaauuuuuucucuagcauaauauaucuucauuuaacaacauuugguacuggauuacuuucucagccaaggaaaacuaugauaaaaagaugcaggaaccagauagaucgccccgaugcuauuucuggucuaguuacuaguuagccauuuuacauguuaucaagaucaaggaucaagaauguucuuagauuccuguauaaagcauguccauuugguuugaaaauaucagauugaaauuucacugguugcuucuaauuaaugaggucauauuaagaguucagaaaucugugauccuaaauaccacaaaggggugagguuggcccacaaugacacuauugggacuaaaaagucuaaucagaggagauuggauuauagaaggcagagggaagaaaaacaggugguaaaugagaaggaaaaucuaaucaugaaaacaaaaccaaaaaaauggaguuaaagaaugaaagaaaacaagaagacaaucuuauucaauguuuuugaggugaggaagaaaauguggccauggauuaccacuguaaaaucuccccacccgacugacccccuccauaaauaacuaaauuauucuuugggaguaaagaaugagagugaggugggagcaguaauucauauaagucgagcuugcuugaauuuggaaaauucuuuccuucuuuagguuuuaaagugacagaagugguaaugagguuuuuuuuguuuuucuuuuuuaaaaagaaagcuuauuuugcaguuaaggucauuugacuugccuuuugaaaugaaugcacucccauaugauauugauauauuuaagcucagaacagugagauauuagauuuaauuaaaagaaucuacauugcuuauguaagccuuauaagccuuaaaguuugcuuuuuuuuuuuuuuuuuuaaagauacagggucucacuuugucauccaggcuagaguaugguggcacaaucauagcucgcugcauccucaagcuccuggguuccagggauccucuugccucagccuccugaguggcugggacuauaggcauguaccacuacaccuggcuaaguuuuuauuuuuaguagagguggagguuucgauauguugcccaggcuggccuucaacugcuggccucaagcaauccuccugucuuggccucccaaagugcuaggauuacaagugugagccacugcacccagccuaauuuaucuuguuucuaguuauaugucuuuuuuuuuuuuuuuuuuuuuuugcccacgcuggagucgaguggcaugaucucggcucacugcaacguccaccuccuggguucaagcuauucuccugccucagccuccuaaguaacugggauuagagguccaugccaccacgcccagcuguuuuuguauuuuuaguagaugugggguuucaccauguugcccaggcuggucuugaacuccugaccucaagugauccaccugccuuggccucucaaagggcugggauuacaggcaugagccaccaugcccagccauaugucuuaacccagcaucuaucauaugauccucagaaugacagcuuccuuagauuuuguacccuaauugccuucucuugcugcagccuaguuuuggcuccagcaauucaguaaaaguaguucuacugagguccaguaucauacaauccagauagcuccuugauggucuugcuugggucaaggaaacuuugggcucuaugguaaaauaguggaauuccuuuaggaaucucuccaucuucauagauauuauuuuucacaagugaacuguaggaaaguaccaaguuuacaguuagauuuucugaagagaacauuaaguccaacuauucuauguuuucagacaauacuguuuuagaaucuccacauuuucuagacuccaugaugguuaaucauaagguacuuaaguuacauuauuuuuuaaaaacauaucauugguugaaaggcacacuugaaaagugcuaauggaaaaaccucauuauaagaacaggaauaaucuccuaucaacuuauucagagaaaauuuauaaucauaauguuuuaacuccggaaaucauuuaauugugcaaacagguuauccagugguagaggcaaugcuuuuaacuuuuaaaccagaauaaaauaacagguuuuucuu

SEQ ID NO: 13832 - RNA, 850 nt, Homo sapiens
gguuguuaacucaaacuacaaaagccagcaaaacgggccaacuuuagcuuuccaacguccugccgcuaaggcguuucagauuaacucagaaauaucaaaaaagaaauguaccuuauguuuccaucauccaucguaauguguucagcucagcuuccuagaaacauugaacaacgguuuagaaauuuugcccaauaacccggcacccucuagguuuuuaacagugaauguuacuugugcaagucagaaucugauaccaauuaaauggugacagcuuugccaauaaacaaggauaugcucuuccauggcuaggaagggagacugccacggcugacaggucccaaagauacauggagauucacaauccagaauuaaccagcaaccaaacugcuacagguuauuacucaccaucuggcucaaacugacgguucucggggugcuagggcacaagagcgacagaguagacucaagauggccacaugacacagacggcugaacaggcuucaccggaguccccgagugcacggaaccuuuccccgagggcccacggcccacgcacgccgggguucaggguccagggcugcacguggacgcccggcgaccuaaugagcacucaaguccgcgcaugcuuguaaacuuaaggguuuccaaagccgcccccgaccuaccaauauccugacugcgcugccuuuuagguaaggcaguaaguuucggcccaauuaucauuuuaacuuacgaaagacaacuacguacuuucaccuaaucccgacgcuucccgaaugugaaaggccgaggccuucggcacacgcucucuuauagaacugaugacgcuauuccgggggaagcgccgcga

SEQ ID NO: 13833 - RNA, 3864 nt, Homo sapiens
gcgacgaucaacguugaagaucaccgcucgcaaccccgggccuggcgccggguaggggcgcggcgcucgauuuccuucccugccuccgccgucccccuggugcgcaugcucagcucagcucggcccucgccuuugauuuauuuuuuuucugggcggccgcugcgacccgggacugacuucgggaugggaaguggagcccccggagcugcuaccguggcggcggcgcugugaggagcagccagggggaggcagcugcggcucgccggugaguauccgggaagcgccaccauggggcuccguaagaagagcaccaagaacccccccguucucagccaggaauucauccugcagaaucaugcggacaucgucuccugcguggggauguucuuccugcuggggcuuguguucgagggaacagcagaagcauccaucguguuucucacucuucagcacaguguugcugucccugcagcagaggaacaagccacgggcucaaagucccucuauuauuauggugucaaagauuuggccacgguuuucuucuacaugcugguggcaaucauuauucaugccacaauucaggaauauguguuggauaaaauuaacaagagaaugcaguucaccaaagcgaaacaaaacaaguuuaacgagucuggucaguuuaguguguucuacuuuuuuucuuguauuuggggcacauucauuuuaaucucugaaaacugccugucagacccaacucuuauauggaaggcucguccccauagcaugaugacauuucaaaugaaguuuuucuacauaucccaguuggcuuacugguuucaugcuuuuccugaacucuacuuccagaaaaccaaaaaacaagacaucccucgucaacuugucuacauuggucuucaccucuuccacauuacuggagcuuaucucuuguacuugaaucauuugggacuucuucuuuugguacugcauuauuuuguugaauuacuuucccacaugugcggccuguuuuacuuuagugaugaaaaguaccagaaaggcauaucucugugggccauuguguuuaucuuggguagacuugugacuuuaauuguuuccguacucacuguuggguuucaccuggcuggaucgcagaaucggaauccugaugcccuuacuggaaauguaaauguguuggcagcuaaaauugcuguucugucguccaguugcacgauccaagccuacguaacauggaacuuaauuacucucuggcuucagagguggguagaagauucuaauauucaggccucauguaugaaaaagaaacggucgagaucuucuaaaaaaagaacagaaaacggagugggaguggaaacuucaaauagaguagacuguccgccaaagaggaaagagaaaucuucauaaucuuugcaagcgcauugauuaaugucugcaaaggaaucugcucuuugagguuucuuucugcacuagagauuuuucuguuuuugaaaauaguucgugcucuucgguuuuuguuauugaacuguuucauguauuuuuuaaagacauuugaggggaggaggauuauuaugaaugggaaaaaaagauuuugguugagacuaaauuacucaucgucaaaauaaugucaaaauaguuuuggggaucaccacuauauuuuguuuugauuuuuaaccuuucaacauuuuccuaaugauuugcagagauaacugcacaauuuugcauaucaaugauacugguucuuacucccaccaguguuucauaauacuaacaagauggucucuccuagcaagauuauguguuuaaugcuugcuuugggguaaaauaaaaguacgaaaaagguggaagucaaaucaguauucuguaauuguuagaauuuauuuuuuaagaacuuacaacucagaaaagauugcuagacucaccaaaauaauaaauguucuuuauuuuacagguagugauuauuagugcuucauccccauuuaaaaaaacacaguacuaauggguaacacauauggagguuugcugccauauauauugcaucaaaauaucauuaauuaauauaaaaauauuaaaaucauuccuguccauuccacuuguaaaugggaauucaugaaauuaaauauuacuuuaaaaaggacauugaacuuagucuuuuuuaaaaauguuuauuaaaaaugauuccuaaugaggccuuguaagaucaguaaccacagcaucuuagaaaaauauuguuuguauaccagguugaaaaauaauacuuggcauguguauaaaaaaagucagcuaauuacauuuggaaagcauguuaugcaucaaccuucaauaaguugaaaaucagauagucacaugaaaggcuuuugaaaaauaauguugugauuauuugucuucaucuuuaauuggggaacauuuaucuguauaagacauauuuugaagauuauuuacauacacauguauguauaaucuguaucuuugcagaagccaauggaaacaaugggaauuagugggugaguauuuauacguauugccucucaauccuuauuucaguuuuauuuccauaauguguuuauauaauuuuucaguaagacaguacuuuacaaauaugcuaggggaaggccauauauuuccuauuccguuauauuuucuccuacuaugucucucaucucuaaauauuuuauagccagcccucucuuugguuuaaguaauucaacucucccaagcauggagggcccucaaaaucaaguuuaaugcuuuuauuacagaucacagacagaagagccacucuugguaaaacauuccuuucugucugcuuucagaaguaaauaucaaagcaagauuucauuuuuuaaauauagaauccaucaucuuaccuauuuuuguuuucaguuacugaauacuguaauauugguagcacauguuguaagguccaaaguaaaccaacuuuaugcaacugaaaaacaaagauuuuuaccuucucguaugacagagaguucuuuuuuuaaaaccauucuagcccauuaccuguaaccccacuccugguaagaaaugcccuauauauuguauacuucuuuacaaauaagugcagaucugacucaaacuggaaaaauaaauuacagaaaaauuauuauguuacaugauuaacaaugccaagaguuaaauuuggcuuagcaauagaugugauuaggauuuagaucaguuucccuaggauuuuucuuggcucuaaccccuuagcuuuauguucuucauggcagcaaauaaugaaagcuauucuaggcuuuguuucuuuaacccugugauggagagaaagagaaaaaaacuaauuucuaaaauucccaagacaaugggaguuaccuuuaguaaagucauuugauaaaggaguauacugggcugauggauguaagucagguuucaugcuucacccauguaaaaaggcaaagccuguuuuguguguguguguguguaagauauuaguucacaagaggaagcaagguuauugagaagaauaaagggaaagaugcuggcuacaucucaacuacucacaaugguauuccuacucaauaaauaucgucagaaaauaaaugccaaauaaauuaugaaagcaacauuacaaaugaaauuuagcucaauacaaauuagguauuuuuaaaaauuuauucucaaaacauucaugccaugauauaucucagugugaugauuuggucugugucaaaauggaccacauggaaacauaaauuuucauuaugauuugaguuauuaaagcaggcauuaaguaacccugugaaggcucaaauagcugauuaucugccccucccaacaccaaaacugcagaaaucauaaagguguaucuaauauuuauauuuaaagauuuucugauuu

SEQ ID NO: 13834 - RNA, 383 nt, Homo sapiens
cgccagaccgccgccgcgccgccaucauggacaccagccgugugcagccuaucaagcuggccagggucaccaagguccugggcaggaccgguucucagggacagugcacgcaggugcgcguggaauucauggacgacacgagccgauccaucauccgcaauguaaaaggccccgugcgcgagggcgacgugcucacccuuuuggagucagagcgagaagcccggagguugcgcugagcuuggcugcucgcugggucuuggaugucggguucgaccacuuggccgaugggaauggucugucacaaucugcuccuuuuuuuuguccgccacacguaacugagaugcuccuuuaaauaaagcguuuguguuucaaaaaaaaaaaaa

SEQ ID NO: 13835 - RNA, 383 nt, Homo sapiens
uuuuuuuuuuuuugaaacacaaacgcuuuauuuaaaggagcaucucaguuacguguggcggacaaaaaaaaggagcagauugugacagaccauucccaucggccaaguggucgaacccgacauccaagacccagcgagcagccaagcucagcgcaaccuccgggcuucucgcucugacuccaaaagggugagcacgucgcccucgcgcacggggccuuuuacauugcggaugauggaucggcucgugucguccaugaauuccacgcgcaccugcgugcacugucccugagaaccgguccugcccaggaccuuggugacccuggccagcuugauaggcugcacacggcugguguccaugauggcggcgcggcggcggucuggcg

SEQ ID NO: 13836 - RNA, 2677 nt, Homo sapiens
ugccagacacgcagccacugaaccacaagcagcuucgcguuaacuggagugccugggagucgcgugccaggagccgcacggccagggacugacugacagacagacacgcaccaccaccacaacacacgagacccgggcgggccgccgccgccgccgccggggcucuuggcaaacucgccggucgcagaggucccccgcggagcugcgccacaguagcgccgggcuugcagcuuucacgccgggcgaaggacccggcgcugcgcucgcagcugcgcggagauucccggcacaggccaaagucacagcaacgcugaggcacaguuagagccaacuaaguaaguauucgagccaccgcuuccaacuacgcaggugguuuccccgcacucaguccaaccacacccgcacgcccucugcuccgcgcagaaucuuugucgcggaggccgcagucccuucucggggagggaacgcaggaccgcccgcggagggcaggacccggcugacuggcagcagggucacagcgagcgcuagcggcgcuccugaccuugguuagcacugccuggguuucuuccuucgccuuccugcuccgcgccauucggagcuggucuucucgggugcgcgccggagcacgccccugugacacgaagaucgcgccucuguuucuuuccuuacaccucacugccuuuuuccccuuucucucuucgguaggauguucgucaaauccgagaccuuggaguugaaggaggaagaggacguguuagugcugcucggaucggccucccccgccuuggcggcccugaccccgcugucauccagcgccgacgaagaagaggaggaggagccgggcgcgucaggcggggcgcgucggcagcgcggggcugaggccgggcagggggcgcggggcggcguggcugcgggugcggagggcugccggcccgcacggcugcugggucugguacacgauugcaaacggcgcccuucccgggcgcgggccgucucccgaggcgccaagacggccgagacggugcagcgcaucaagaagacccguagacugaaggccaacaaccgcgagcgaaaccgcaugcacaaccucaacgcggcacuggacgcgcugcgcgaggugcuccccacguuccccgaggacgccaagcucaccaagaucgagacccugcgcuucgcccacaacuacaucugggcacucaccgagacccugcgccuggcggaucacugcgggggcggcggcgggggccugccgggggcgcucuucuccgaggcaguguugcugagcccgggaggagccagcgccgcccugagcagcagcggagacagccccucgcccgccuccacguggaguugcaccaacagccccgcgccguccuccuccguguccuccaauuccaccucccccuacagcugcacuuuaucgcccgccagcccggccgggucagacauggacuauuggcagcccccaccucccgacaagcaccgcuaugcaccucaccuccccauagccagggauuguaucuagagcugccauuucugcuacccacgccaggccuuaguggguucccuuuccuguccccagucgagcccuccucccuuccccugccccuccuuuccacgcccuggaaaccaucucacuucacagggcagguguagccuuucugauuccucgguuguuucuugcauuucuuggcuuuggguauccuucauucagacgggcucugauuuacugaaggugugauggagcuuauugucaaagccaaggguggcguuuugggggcgcuucuugagacgaaaaagacccugggaagagaugaugguggcauaucuaaagaguuugcagagcggacugacgcuccuccccuuucucuuuaacgccgaaggacuuggugcaguucgugugaaucucacagggggaaugcaacugguuccugugaucucuucaccuuugcuucuacauagagauguuaaugucgaguagaaagaaauguaucuuagcaucugaaugauuuugcugguaauaauauuauccacagauuugcaauggcuggcaucugcuuuauucccauugcugucugcaggcugugggaauuucaccugucaaaccaaacuucccucucugaugugcacuuuguucuguuucccagauucgucacaaugccuauuguccuguccuucucuuuccuuuuucuuccccauuuugccaucugucucuuaugauuuauaaggggaaaaaaacuuguuuuguuagaggggcagguuagaagucauuguauaauuuguaggcuuuguaaugauugaaugcaagcguggaaauuuaggcugaacucucuaucaaaaggaaaaauguggaggaaaagggaaaaaucaggagggaggauugccucauguauuauuuauuucgaccuuuuaggggagaaggaacucccccauucuuucaagagauuaaaaauaaaucaacagucugaaaaccuaagcagacacggagcauuauccggaucagccacacacguguucccuucuauuuauuauaaagaaauuuuucaugggaaaauauguauuuuuuguauauucuacagaguuuauucuaguauguauuuacaucuugaagaacaagaaaguuguucuugugauuaaacuauaaauaaacuaucuaauuuucauaaguuuguguguu

SEQ ID NO: 13837 - RNA, 2677 nt, Homo sapiens
aacacacaaacuuaugaaaauuagauaguuuauuuauaguuuaaucacaagaacaacuuucuuguucuucaagauguaaauacauacuagaauaaacucuguagaauauacaaaaaauacauauuuucccaugaaaaauuucuuuauaauaaauagaagggaacacguguguggcugauccggauaaugcuccgugucugcuuagguuuucagacuguugauuuauuuuuaaucucuugaaagaaugggggaguuccuucuccccuaaaaggucgaaauaaauaauacaugaggcaauccucccuccugauuuuucccuuuuccuccacauuuuuccuuuugauagagaguucagccuaaauuuccacgcuugcauucaaucauuacaaagccuacaaauuauacaaugacuucuaaccugccccucuaacaaaacaaguuuuuuuccccuuauaaaucauaagagacagauggcaaaauggggaagaaaaaggaaagagaaggacaggacaauaggcauugugacgaaucugggaaacagaacaaagugcacaucagagagggaaguuugguuugacaggugaaauucccacagccugcagacagcaaugggaauaaagcagaugccagccauugcaaaucuguggauaauauuauuaccagcaaaaucauucagaugcuaagauacauuucuuucuacucgacauuaacaucucuauguagaagcaaaggugaagagaucacaggaaccaguugcauucccccugugagauucacacgaacugcaccaaguccuucggcguuaaagagaaaggggaggagcgucaguccgcucugcaaacucuuuagauaugccaccaucaucucuucccagggucuuuuucgucucaagaagcgcccccaaaacgccacccuuggcuuugacaauaagcuccaucacaccuucaguaaaucagagcccgucugaaugaaggauacccaaagccaagaaaugcaagaaacaaccgaggaaucagaaaggcuacaccugcccugugaagugagaugguuuccagggcguggaaaggaggggcaggggaagggaggagggcucgacuggggacaggaaagggaacccacuaaggccuggcguggguagcagaaauggcagcucuagauacaaucccuggcuauggggaggugaggugcauagcggugcuugucgggaggugggggcugccaauaguccaugucugacccggccgggcuggcgggcgauaaagugcagcuguagggggagguggaauuggaggacacggaggaggacggcgcggggcuguuggugcaacuccacguggaggcgggcgaggggcugucuccgcugcugcucagggcggcgcuggcuccucccgggcucagcaacacugccucggagaagagcgcccccggcaggcccccgccgccgcccccgcagugauccgccaggcgcagggucucggugagugcccagauguaguugugggcgaagcgcagggucucgaucuuggugagcuuggcguccucggggaacguggggagcaccucgcgcagcgcguccagugccgcguugagguugugcaugcgguuucgcucgcgguuguuggccuucagucuacgggucuucuugaugcgcugcaccgucucggccgucuuggcgccucgggagacggcccgcgcccgggaagggcgccguuugcaaucguguaccagacccagcagccgugcgggccggcagcccuccgcacccgcagccacgccgccccgcgcccccugcccggccucagccccgcgcugccgacgcgccccgccugacgcgcccggcuccuccuccucuucuucgucggcgcuggaugacagcggggucagggccgccaaggcgggggaggccgauccgagcagcacuaacacguccucuuccuccuucaacuccaaggucucggauuugacgaacauccuaccgaagagagaaaggggaaaaaggcagugagguguaaggaaagaaacagaggcgcgaucuucgugucacaggggcgugcuccggcgcgcacccgagaagaccagcuccgaauggcgcggagcaggaaggcgaaggaagaaacccaggcagugcuaaccaaggucaggagcgccgcuagcgcucgcugugacccugcugccagucagccggguccugcccuccgcgggcgguccugcguucccuccccgagaagggacugcggccuccgcgacaaagauucugcgcggagcagagggcgugcgggugugguuggacugagugcggggaaaccaccugcguaguuggaagcgguggcucgaauacuuacuuaguuggcucuaacugugccucagcguugcugugacuuuggccugugccgggaaucuccgcgcagcugcgagcgcagcgccggguccuucgcccggcgugaaagcugcaagcccggcgcuacuguggcgcagcuccgcgggggaccucugcgaccggcgaguuugccaagagccccggcggcggcggcggcggcccgcccgggucucguguguuguggugguggugcgugucugucugucagucagucccuggccgugcggcuccuggcacgcgacucccaggcacuccaguuaacgcgaagcugcuugugguucaguggcugcgugucuggca

SEQ ID NO: 13838 - RNA, 906 nt, Homo sapiens
cagaucccaccugcucugccagggcuaaagagagggucagauacagggauacuagcuuuggcguuaaaccuaagcucagcgcaggguguguccagguugccguggagccgguccuacagcccauuagcgcgaagcuaccccuuguuuccuggagaugaugucucccgugacuccuuccccgcgugacagggcgcccuggcaggagggacaccccgcccccucuucuaccucuuuccgaggaggccccaagaccggaccccagacugggccuccaagacgaccaccagucugacgucugcuaagcagugaguguagcagggcucucgaccgccaccuccagccgccgggggacggugaaagggauuccccgccgggggccgaagaggaggagccacgggggccgggccccucccccagcgggcuuacccuccgccgccgccuacucgcugcagccgccccgcuuccuugcgaagcaguccgaagcacugcguccagcagcaguuccccaucgcaugccgcccaggcgccgccgcuccuccuccuccucccgcucaaugcccaaacccaggcccggcagcugcauccgcacggcacgagccgaaaugggguucaaggaccgagggcgggccggccagagcccggcggcgugagggcacggggcgacgaaagacgaggcgcuagggaacaaaggcaguguuuacuccagcggccgcagagccaccgcugcgcgagggaggagcaccgggcucaaggcucuggacucccucgccguccgcauggcccuucucgccucagcuccuagcccagcgugagugaccgccuccagcugccgaaggaggccaguccccgcgagccgagcacccuggccccgcccccagcgcgcccaggccccugcucgccgccaac

SEQ ID NO: 13839 - RNA, 19653 nt, Homo sapiens
cacggaguaggagcagagggaagagagagggaugagagggagggagaggagagagagugcgagaccgagcgagaaagcuggagaggagcagaaagaaacugccaguggcggcuagauuucggaggccccagugcacccguggacuccuucggaacuuggcacccucaggagcccugcaguccucucaggcccggcuuucgggcgcuugccgugcagccggaggcucggcucgcuggaaaucgccccgggaagcagugggacgcggagacagcagcucucucccgguagccgguaaguggaggccaucuaucccgcagggaugugagauaaugcgagucuggaaauuuguuccacuucggagaaucuucaccguaggugauuuguggcuuuuggggcuaaguuucgcccaagguaacgcagucggcaaacagaccuugcaaagcccuguuccuuucgucccccgccacagacacuaacaaucuacagggugcugaagucgagagggaagccagaccguggcuggcauuuaaaacgagguaucuucccuuaaaucucggugccaacacugcaggaacaaauccucgggccaaggauuagcauucucaagauaaagggcuggguacaaaguuucagcuacuggaagauuagcccccuucccauuguuauccauugggaaaaaaaagaaaagaaaaagauuccaucuuaacuggcaguuagugaccucucaggcccaagcgaauuaccugggagccaggccuggaugccaagcucucaccauuucuuuggauuguaacuccuuuaaauugaucaccagucaacuccaaucuggcacuucaggagauacacuuuaaauggaugcagagaauuauuuuccagcuggagauuaagaaaaaaauuuucgauucuaaaccuccgaaauauguuccucuuuuccaguuuaaccacuuuacuuucuuaagcaauuuagaaaucaaacuaucauaagguggugugauuuuuuuuuacucuuuugugugaguauugucuuacuaaacuaaacggaaaaaacuuuuaccauuauaaauguaaauaucagaauucauacauucuaaaauauuuuuaugaaaaauuaaucugauuuaaagaaauuuccuugcauuuguuuuagucuaucaaucaaaacuaaagaugcuuuuaucacacaaaauaucauuuuggcagaaauccaucuaaaauucaaauaccaauaauaucaagaaaacaaagcacauaagcaaaauaaauugaagauuuuuguugauguaacaugagcauacaacauuucaauaaccaaacuuucccuaaaaaauuaaauagccacuucauuuguggaauguuuuacuuuaacucagcaaaauuacacuuaaauuauuuaggugcuuuguuccuuaaguuaagcguguuugucuucaaauguuccuaaagcacuuauauuaauugguuguaaagaacgcauacacaugguaaaauacagaacugaacugagcaguauuuuaauuuccuuaaauaauuacuuacuacaaauuaauuuacuggcuaauuucacaauuuaguucauuuaaaacacauguuccugugcuguuuauuuuuaaacuuuccauuaaagauuuuguuaugggguaacaaaguguaugaaaaggggggaaaugugaaaggaucugggauuauucgaacuguauuuuuccugcacuuucagucuugcgguagucaucagaaauuauuuuuuagcaaauuguuuuauuucuuagggcuugccugccugcuuugccaugguuccucguccuccguuagccguguagugcuuuuugugugcucacaauauaaaacccaaguuggccaaaacaagaguccuuggcauauacauuccaacuagaacaugaacuuugggggugagaacuaccucccaucaggaaaagucucccaucucaauuugugagauuagccauugaagccaguuccgaagucuggcagccaaauuucucacagaagacuugucuugauagggcaaguuuaaggaucagcaggcgggaauuggaggucucuuuuuaaaaaauuaucuuccccaguuauuuagacucaguucuucuaguaggccuggucauuaaaugaagcauaaaaaugcaagucucaaggcucauuuugacugcaaaauaaaucuccaagucacaaggacauguaggagugagcuaaggaacacgccuugaccuucuuuucaguccuuagaguggagcucuaugaguucuugaagauuuguuuuguauugcuuuguuuggucuucagcacugaagcacggggaaguggggggaagaauguguaauaauugacugacuuuacaccaagcaacgcaaucuuuuucuuuuguauauuucauucuuuaaaaaaaauaaauaaauaaaaacuauuugcaguuaccaucugcagugcuccggcuaccagcuaauaaugcagccaguucagacauauaaaaaaaaaagauuaucgaaaugaugaugacaugcaaauuuccuccgaaauuaucauaaguaaacauuugaagucuggacuaauaaaaucccaucuguguuacuucauaucgaguuaguagaaagcugugauaaugaauuuuguaauaucucacgaacagacaucucaaucagggacuaauccugugauuuuacugcagaaucacuaaaucuggagccgccaaacugcuacuucugggcccacgggcccacaaggaucgaaucggcagaguccccgcccgcguucucgcuagcgggugggggaaccgccuggccguccccacccuggauccccacgccacagcgccgggcagccccuccuguaggcagcgaccuuggccagaggcuccccagggcccagcucccuucaggagaggccgagacgcagggaaacgguacucaggccagaggcaggcccgcagcucccugccccgccucugugccuccgccaacccgacaacgcuugcucccaccccgauccccgcacccgcgcgaagugggcccuccggucgucggcguacccugguuagcguggagagaggcaggcgcugagaucgaaggggccuagggagcccuggaccuucuuuucuugucuuuaaagcaaccgcggcucuucuacccacccgguggagccccucgagacccaccucucccggcuugccuguggcagagaagggggagcgcguuaaaugcuuggcucgcugcguugugguugaaaacgugaaaaagauuuggcucgcccgggagagaaagggggagaacuggguagcaguuauaccagagcuauuucuccguccuuggcgggcaguaaacccuccaagaacguuugcccugcucuccucagucucgcucaguccacccagugucucuccucugcgaucuuaaaucauacuuuaggguaauuauuuguaguaaguaaauaaauggccggguuaguaucucuaggagaaaguguggcuaaauauggaaaaguggcuccugauggaugagaggcccgaacucagcucgcuccugaaacacccuaggccaagagcccguucguuucagaauuacagaaaaccgagggaaacugcugucuaggacaggggcacguuggcgcugauguucuacaaauguuuaccgagcuccaacuaauggacaagcacugaaggguggucuuugcauacagcuucccaaagagaaaaguccucuccacccacccacucccgcugccauugcguucagaugaguucuuaaccccggcaccgagauucuugaaaguagguccacagccuccccagcacacuguggcuuuauaguccucuaaccucugggcacuuuugcggcaacucuggagggagauccccucuugauaaauaaauguccugggcccgaggcuaggcuggagaugcugcugcacagccagaggcugucaggucggaaaaacacgccugaagccuagcacacaguaggcgccuaacagcuaguguaacguagucucaucugagcccugcucacucgacggccgccgcuucuuacagccuuccuucucuucuguuuugcagauaacggggaauggagaccaacugccgcaaacuggugucggcgugugugcaauuagguaagaacccccuucuccugcccgggucaucggacgggaggccgcgccacgugagggcggcaagagggcacuggcccugcggcgaggccccagcgaggggcgcuuccccgaggggccagccugggcaggaaggaaaucagaaccaaaucgccaguggccucucccuguggcggggcgguggacuaggaagcagcggcgcgcuguguaccgaagccccccagccuacuccucccggcuggaaccgccggcaaccggggaggcgcagaaagaguacgccauccugccccggguugccagaggguccgggggacggggaugccgucagcucuuuccucuaacugggucuuugcucuuugucccucuuucuccuccggccugccucgccccucccccuccucccguccccggcuccuuucggccgcgguccgggacgccucucuccgcacguggggcgggcgcgcgcguggcccaggcgugcagccggcggccguugaaugucucuucuccaaagacuccgaaaucaaaaaggucgaguucacggacucuccugagagccgaaaagaggcagccagcagcaaguucuucccgcggcagcauccuggcgccaaugguaaggccgggagggaagcgcaggccgcgcgcugggcacccgccuccgggacucugggccucgggcgaagcgcaagaaggcgaggccgccagaccugacgcgccugcugcuugaacuuagacacuccgccucugggugggacgggaagcagccgucccagggacguuaauuccuuuccccaaauuauacugcacuccugagacccaacaccucucucucccucucgcucgcucccuguggucugauccccugcgcacgcuccagcaaaccucggcgucuaggcuggcguggaaaagugguccaacagcgaccucugucgcucguuauaucccgcugcgcgcagcaccaccagggcccacucagucacucaggcucucagccacgccccacccagacuugugggugcgcgguucaucgcgggaggcaagcaagggaaacuugaguuggcgaagguuugcuuuggcugguugggggaggggcggggggccgacaacaucccugaagagcuggagggcagccacugugcuuagcagcccaggguagaauggagguuugccccugucgacgcgaaccugccugaaguacugguugccaggccuuggguuuuggcgaugucguugcuugauuggcugguuucacucuggaggaaucgagggacauugccagaggaggucuacaggcuuauguaaaaaguuaaaaagucuccaaccuacgccacaggccuuuccugaauugaaacuuguucuauggggcggagggggggguguaagggauggaggagggaagaugccuuucuuuucaaauacauggaaaaaaaccccucaaauuuacuguuccucuauuuuccuggcuccguaguaaauaagugccuagccuuaggaggcuauugaccuuugauaaugugagcagauaaagcccccccccccccacagcccucggccccuaacccccucuuuccggauuaaaguguaagaauacaaauguaauaugggauggaggggggcgauuugggaccccggucaaaaaaacaaaccguauuacuaagaagaaaacaaaggucuugcauuggaguuuccccgugaaucugagagaaaaugaucauuuguugaaaugaagcgucuaaagcgauccagugcuucacgcccggacacugcacuacaccgccagucgcccugcugggccaguuaaacgcucacuuguccgggauuaaccccaugggguuaaaugggggcaaugcagagauaacgucgcgugauuucugucauuuagauuguguuaaauucuucuucuguuugauaaucgguaguaaaaauaaauuauuagaccguaguauguuugggauaugguuaaaaaucaagagcagcgaugacuucuggggagaaugcuuugcgcgggcucagcccuggcuccggccagacuagaggagcuccccaaucucgcuucgcgcggggcgggcucgcagucgccaagccgaggcugacauuucuuauugugcugggagccagagagacgcaaaaugucuccuucccccagucccuaccccagguuuccuagacauggggaaugcauucugaggacagguggagaagccuacgguaggaugggguccucguaggugagcaggaaacggcuaagagcagaggaguucugcuugcgccagucacaagccgcgcaggcgccccuggucguucgcuuuugauaacuagcacauaaagaacuagaaauaaugaaugauugcuuucuuaaccauuacuuucaggcccgcauuguuuuagugcacgugaaaggcucuuccccuacacucaauaugucuuuuucuacuuuuugaccgaaaagaaaaauugcugccuaaacacguuuaaugccauuaauuaagaaaaggcauguaaugggaagaaaugcugaaaaucuugauuuaauuggcuuuuaaggaacuaguagacgacaaaaaaaaaucacacgagugggcaaagcuauagcacugcugaaggauagagcaccuauccuucccugauuuuaaguuaacuuauggaauauccaaaguccuggccacagccugcuuguaaaacaaaaggauuuauuucuuguguuuuuuuaaaguuuuucuuugcuuuuaaagagaaaaaaaguucacaaugacauaugacuucuucaaaaggccgugauagucuauuacgcuacccucuccgccucugcccccaacgccgcccaaaaauaccauguccucguuaaagacuaaacguucuguauaggcagaguccaccucuaagcaguccaggcucugccuuccuucccuagugagucccauucuccuugguauccauugggcggaugcccagccuggauagaaccccgaaacggggguagcacgagagcgacuggagaccccuaaaagccagagguuugagagaggguggacgcagcuagcagaagaugguguagaagccagcugagaacgacccccuagagcaaagagaccuuucuuuggcuuuucuugcuuuggggguccugaaaggaacucauaaaauggucuucacccucaggaggaggacggacugacccuccucugucacuggcuuaaaaaguuucagggcggcggcucuggguuccgugcugaaaucggacugcacugcagccccuuuggaccugacgccuggcuuugcgucccgacaaggggcggguacuucccccggccucccccaggaacgcauuaauuguuaaauagcuuuggcccaguggaugggcugaaaguguucgacccaagucgcuggugugcacagacuuccucccucugggaggugggcuccauggcccguuguggcacccccagccgcgacacacaccuucacacgcggcagcagcucggucccaaccuucuucgaaggaccuggguuaacccuggcggccuuggcggccgcagaccccucuccgccgccccgcccccgcgccucucauucaaucagcgaauguuugcggagcauauacuacguggacuccuaauguacccccugaaagcaaauaauacaguuuuccucgccgucaugaagggauuuuaauccuaacauggacaccagcgagaucagcccagaccgucucuagcaaaacgcaaaaugguggugcgugggguggugaccaagguccugagccuugucagaaagaaggggauguguagagaaagguggagaacucuagcuguggcuagcgcggaagggacaggugcuugccgaagggggcaugaggcuugaggaaaaagcaacgaaauagggguaaggagaguuuuccauuuucuuuccuccgcccgaccuccgccaucccauucuccccuccccucccccaccccccgcgccaaucaaaucugcagcucacuugaaaggugccccgccgcguugugguuuuucacccccaggggaaauuguaccaguuguccgaaaguagucagucccugcggaucccugcccgcaaaaguggucuucacaggucgcguuccucgcugcugacucgguacacaaaguuucuuaaggcugguucggcuguuauuccucaccgcccgcugcuaauauaugcagcaguuguuagagcggcucgggggaaaaggaaauguauaacgaaagcuuauucgugagcaggaauauacuaauggaacaaucugaugucuucuuaauccuauguaaaaagcuuugucgucuuccuaauauugacugaauggguaauuaauggcucuucaucuaggcgaauacccuguaauccaagauaggcaaaagacaacaagcccaagguagaagacaaaaggcccaacugcagcggcguuugcccgccuccuaccccccagggucucugacuaggaaaguuuucucucagaggagaaaaaggcaggagugggagaauauauaccuaucauuucggggcuagacuucaccgcagcaccugaccacccagcucaguuuucuguuacucugucuuuccaccuccaguccuucucccugcauuuuuuuuucuucuuaacuccucuaggaugaccuccuaccaccaccgccauuaugguccuaauaaccuuucccccuaaaccccacaucuuucacuucagcaaccaaugaggcuguuuucugauccaggaggagauucuuuucuuuuagaacccaaugcguagagucuuugagaacuaaaguaguugguaggggaggaagaaauuaauagaaagggagagagcauacagaauuguguguguauguuaaagagcgaccaggaaugacagagucaacuucuuugugaggaucugacgggaagaguguccaagacucuaccagcauguuuuuaacaggcugacauuuuaauuuaaaccuuuagaaguaauauauuacuuggguuacuacaaugagguggguuccuuuuuuuuugucagcugacagcuuuuaaaauauuauuucgcuagggaaauaaaagcuucaucucagauuauagguggguauuuuuggauuuaggugauuuauggucaccaugacaacuaaugcugaauguuagcuaccagcaugucugggagagagaaaacagaaagaagggagagcaaaagaaauagaaaagggagauggacauaagcuggagagggaagaaaagagaaaaagaggaagacagaugaguguuuaauccaacuguuguuuaaaaaaguggcgggggggugggacuucauuuagccccuugccacuuccuucuuuccugaccuggauaucuaugcucaauuucauauuccacccuuccuuccccuucuccaaacacaugugcuauaccauucuccuuauuuuacuuaguucggcaaguaguugcuuucuggagacucagugacaccuaggaaaacuguggcaguaacaugcaaaugugaggaagcauuaacagcauguucguugagugauuuuagcaaaugcccccuccucuaaucucuuucucuucucuuccccaggccacugugaggugguaacucccacugccaucugaacacuguucccccagguaguuaccccaaaucucaaaugguugagcagcuagagcuguggguuggaaaaauggguaccauuugcagggacccagagaggguggcuguugcucaauauaucuacagacuuccaauucagaaaauaaucuuccccuuuugacaagccagagcuuuuuaaauuccauuuaggaaauggggaaaaggacagcuacagugaagcuuuuaauuucuggguuauuugguuccauagcuaugaggggugguggguaguggacuguuuucagcuugguuuguaugcagagaaaagccagauauuggaggggguggggcacuucucgggcaggaugcaaggucuccaucugaccucugcgccuuaccaggagcucacacacucacgcccaucacguggcuccaagcugaguccaggcgggccucguccuugagcuagcuugggcagggcaggacucccacccgucuaaggccuaacagcucagggagaugucuaauuaagccaucuucugggugaacucugaagacagacucuuuccaaaagucagagaucacuugguugagucccaggccagauugauacggagaguuuggcggcacagcccaaccgcucacugccauggccagagggacuuugcacaacuaacacugaagagugugaaauuaaauaagacuuuaagacugguaaucgguggcaaauaccagcacaaaacacggcugaccccaugucacacauuucccuccucuagggucuuucuuugaaagaauaagcaagaaaccccaaucgagacaaccccugaugucucccagacucaaaaccucacgccggcacugggcuuuccuucuuugccccacgugagccaugcagcaccucuaguuucccuaccaggaucccaccaauguucuccguauuggaaauuucuguguuagaggcugaacucauaguaauuucuaaaaccaauuaagaagaacuuagccagaggucacaguaaugcuggaaucacaaaaugcauaagauuuauuuucuucuggccccuuucucauccaugcugccuaugccugugcacccacaagucuuauguacauuaaaucuccaaaaucaaccaccaccaugccacagaguuuucacuggacaguguuucuuaguucccaccacauaccuccuuuuccccaugcagacuuaucauguugguguccugccacacagggggccugagaagaaugucacccaaucgccgcugcugugaguguguaaagugauuaggagauuaggagaauguugaaacuccugcuggaaaaaugcaaagaaaauccucacuuugagucaguuguuuacagagccagugugugugugcgugugugugucuguaauauaaaauggaugugaauauauauauacaaauagauaugguuuugcuuuuacuuuaaucugaauuaucuagauaauugucuuuauucaccacuugacuucaauggguccacacaaauuaggacaccuuaucuuuuuaggcaucuaggcugcugcugauccccagugcuuccaacaucucgcacacguuggcacuaugaggagcagucacgugcccuuggguuuuucaaccacuuuggaggcugauugagguccuucauacauguauauuugucgugaugaaaguuccaucgguagaguggagccaccagagcuuuuaucaaaauucuguggguuuaugagagauggguuuagaaaucuauauggcucuguggggcuucucggcuuucuaaaauaaggcauuaacacccaagcuuccaaaaauauuugcagcucugggguuugaaucuugaaaaacaaggagugaggggcuguguauacuaacuacaguggagauuuuuuucauucuuuaaugugauggagucccuucaugaaaugaagcuuuaaggggcaugguauuguggggaccacagcuauucugagguuuaaaagaagaaacuggaauaugauuaguaaacacauucagcagaaaagagcuggauucuuauugacuuaguuauaggucaucggcuggcagugcaaugggaggaaauauuuacuuuacacauauacuuuaugaucuugggggaauuagaggaaauucaauaagaaaacggcuagaaacauuuaaaacccuuauuuaaaagacuuaagcaaauuagagucuuaucagauuaaaaaccacuacaaauguaagagcauugucuucagugaaacgcuguggggucugagaaggagauucuccgccaaaucuccgggauaaaaugcgucauuuaagcaccagauaaugagcagaauguaaauuaauuuaaccuucuuuaccaacaggcugcuaguguaauguguauaauuuagugauaagauugcaggaccuaauauagcuggauguaugagccucagcuaaugcagaccugucacaugaggauguguuuuacucugagcaggugucuguauguguggaaugggguaaaguggaauaaaagguuaaaagcagaaaugcugauuuaaagcuuacuaugaagaaauuccucccuugcagcuaaauuauucuuaaagugggaugauacuggugaagaaagacugaaaaacaauucucaugugcgucuuuggacugcaaguuuaaaauggggaggaguugcagauaggguuuggggguggucagggcaaaggagagacacauaaguugcaaauauauuuguagucugcuucauccacuuuguuccacaucgaauaaguuucccaaucuugugaacaaggacaaggagggaguguuuuaaagauacuucaugcuggcauugcaaaucauugacuguaaugucaaacaaauacacauucagagaugauaacacuaacuccauaguaaaacaaucgcccaugcagaaacccagaggagauuaguuuguccucuccagcugaccuaugcugggggacaaaaggacuuucaaaaauuauuuugaauauguuuggauuucuuucuuuaauuucuuuggaaauuaaauuugcuuggaaacagugcuauaaagaguugaugucuccaaaggugauuuuuuuuguuuuauauaaauaagguuuugcuuuugcuaguugagcgcaguucuaggcuuuucgcccuuagcucacacacaccccuucugccugcuuggacuuuaauggcucaagacagccuugagcucacugggaaaagaaaaugacuguuaaaaauuauccuugaaauugguuauuuggcaacauucuuaauuguauggaaauucauuaaggcauauuucauauauaauuagcucaagguuguugauucuacaggcuuuauggauuuaaaucugauugauaauaaaguaaacaagagagucgaauuuaaagcguggcucucucggguuaggacgagcuuaauacaguguacaaggaauuugaaagaucuaggauaugugucuuaaucaacguuaaguagaauggauaagcuuucagcauuuugaaaacgcuggguuaggguuucucuucuauuguguguuuucugucuggggacuaauaagcaucacagagaacgugaucugaggcgacuuuuuauucuuguauaaauccagagugaaccaccaaacaguuguucguuuaaagucaagguaauuuucuuuugacggguccauuugcuucucgauuucuaauuuauuagccugccuuuucagggcucugucuucuuugcaauuaaagcuucuucagauuagcgcagcauucacuugacaggcuguuuggaaaauuuaagaucggagaggugauuuguugcuguuuuucaaauuuucuaguuuuaaguaacgugucuccuuuuuauauggggugggggauuggaaauggauguagugagacacaaagagugggugucuuguugauccuuguaccuuucucuucuugaccauuccacucucuucucccaagccuucgacuccuagccucaucucuucaccuuuggguucguacuaaaagccggaucgccuugggcugggcaggagcugaauucccgggagcuugccuguguagacccagugcgcacggcgaggcaguagcccggccccgcacugcugauaggugcaggcaggacagucccuccaccgcggcucggggcguccugauuggugcggagccacgucagucgcacccggagaagggucugggaggaggcggaggcggagagggcuggggagggccgcggcggagugacgucucggcaccaggaagcccgccucugguuuuaagauguuaggccaacagggaagcgcggagccgcagaucugguccgucgcucgccugggugccuggagcugagcugcggcaaggcccggcuccuguucgaccgcccgaggggugugcgugugcgcguugcggagggugcgcucagagggccgcgucguggcugcagcggcugcugccgccgcaggggaucuaauaucaccuaccugucccugucacucuugacacuucucugucagggcugccgcguggggggggggcgggcagagcgcggucggcguuagcuuuccuuauuggagggguucuugggggagggagggagagaagaagggggucuuugcccacucuuguuucgcuuuggagcuuggaagccugcucccuaaagacgcucugaguggugcccuucugcccacaucccaugucuucguuugcccgcugacuuuccgucuccggacuuuuucgcuugagccuuccggaggagacgggggcagcuuggcuugagaacucggcggggguugcguccccuggcucuccccgcagcggggaaacuccgcgccuagagcgcgacccggagcgggcagcggcggcuacgggggcucggcggggcaguagccaaggacuaguagagcgucgcgcucccucguccaugaacugcaugaaaggcccgcuucacuuggagcaccgagcagcggggaccaagcugucggccgucuccucaucuuccugucaccauccccagccguuagccauggcuucgguucuggcucccggucagccccggucgcuggacuccuccaagcacaggcuggaggugcacaccaucuccgacaccuccagcccggaggccgcagguaaggcgccgcgccgcccugcagacauucccgcucagcugcucugcgccacccgcucccucucgccccaaggaagucagccccuccggggggaggcguggugggaguggucguucgccuggcuccccgcagaacuuccgggagccggaauuuugacuaccccgcaucccuuuaguucucccucgaccggcccggcuccuggggcgcuaagggcgcgagcaauucugccgcccucucuauucguacccuggccucccuucuguuuccugggucacaaaaaucccagcaucuugauucgaggaccuucagaggccgccgaccucugucccuguuuuccucucggcuuucagcucccgaggagcuccacucguuaggaaauugccugaaaccacucagaaaugcccuucgcgaagaggcauuuuuuuuuuuuuuuugggaaagggccggcgaacuucggugcccaaccgaauccccacaucuuuuccuagccuucccaaaccgcauggaaaucugagcuuucugcgagggggaggggggucuguaaaccacgcgcgugugcgcgucccaggagauuuggugugucugcgcagagguguauaaauauacuugaaagcacaggcuauaaaagugaaugugccgcugcagugagauaaacauguaaauaaaacgugcggcgcugggggaggggaggaaauggggcgcggacacccacacuugcgccugcacaccccacaggcgcagcgcuccucgcggcccggagccgccgcgcgcacccuccuccggcgccaggcagcccagcucuuccacggcuucugccgccgguccaguuggcguccgcguugcaggugggcaugcugacgggaaaguguguguguuucguuuucagagaaagauaaaagccagcaggggaagaaugaggacgugggcgccgaggacccgucuaagaagaagcggcaaaggcggcagcggacucacuuuaccagccagcagcuccaggagcuggaggccacuuuccagaggaaccgcuacccggacauguccacacgcgaagaaaucgcuguguggaccaaccuuacggaagcccgaguccggguaggagccagcacggagucugggagggauggggggaggauguuguggagguacaggccaaguagaccaggagagaauguggaaggcagcgccgccugggagggcgccgguggggcgcagcuuugcaaaggcagaaggccucgcggcggccugguugcgagauuacaguucccucuccgaggccgacaggacugccgcccuggcucaggcucccagagcggcaccggcucacugccccgccaucccgcgaucucacgagcugggcugcaugggcaauccccugcacaggacauuguguuccuggcuugcaguugccagagcagagcuaauaaaaucccuaccaggccaagagccgcgaacaggcuccaaccugugagccuuuaacaaggaaaacccgccagagacacggaagaguuggcccucccugggaaaccuuugucccggcccuggcccagcuuuuucccuccugggcucgcgcuucuuacaccuucuuuacgguuguuucggccauucaggucucucccacacacccuauuuccuaguuuugugaucuccgggagcaaaguuuuaauacacaacuacuaguccucuuagaaggagaaagaaaaaaagaagaaagacuuuucugcuugguuuauuuaucuucucucaggaguugaacucuggaaauugaaacucacacccccucuucuaaauuauaaucauaguuuuguaaaaagggcuuaccuuaacuuuguagcaaaucuguacuuuauggauuggcaaaaaugagcucaaauaaauaacccaauagcaacguccugguuuaugcuggucgguggaagauuccaaauuuguuaggauucuggaagcagaaaacagaaucaagcaaaucaagcggcauccagaggcuuugcuguuaaaaaaaaaaaauuaagugcucuggguagaaaaaauaaagcccccgguuagagcagagcaaacaaaaagaagaaaacaacgauaaaaagaauaaagaccaaaaugcucucccaaaucagagggaaugaagacacucucuggguggcauuugugcaaggcaugaggcuaugcugguggauaaaaggccgggaagaaguugaaaaugguuuuaguuuaacuguccagagccagagcuggguccugggcggcgugguuuugagcaaggucagucuuucauuagcucucuugcacaucaagggaacgggccucucacguacucuucucgccugagcaaaguuuagauggccuaggguagaaauggcaaguaauuaaagacagagucuauggguuuucugggauccuucgaaaacgcccucccaccccgcccgcuauuccgcagcuccacccuagugcuuuguagccgcggcgcugggcucuccuugcagcugccucuccuuccagggcggcugcuugucgagccaagugggagugaggcgugcuuuuuauagcagucgggugcaaagaggaagggggauaaaaaggaaaucaagaaugaaaggaaaaagagaaaaagcggauuacacggcugggcccggcggagauguguaaugugaaacaucacuggugucagcucggauaucucaggccaggccucucuccaauacacaaaagccgccgucuggggcgacagggaggcccgauguggauugggaucgggguugcggcugggccaccggacacggguggaagccggccggccuggguggccgccugcaaagccaaacgacccggcugggccuggcgcgcggacaggccuguggugggcuuaggguaaagaagaggcagagcgaaagaagggggaaucuccaaaacuacccuuuccggguucccggaguuuaauaugccaagcuccuggaguuaacgagcugacgaagagguggucuuuugcucuuuauuugguuguuuugcuaggcgagaaagaguguuggcggccuagucccuguuaagggagcacguaccagggggugggggacgacaguggaggucagggaaggaagggaggaauugcgugggagaaagagcgauccucuagugcccuuccagccccuucuccucauccgugggucuguggcuuuggaauggaagcaaguuugcaaggugccccgggaaggguuggaaaagccugcugccccgcguuuguuuuacauuaaguguuuuuggaccuggagaaacgccuggcugagugaucaaaccguccgcaggucuccaugcguucggcugagguuuguggcguagcuccgagucccagcucgcaggccagagcagaccaggucuccugcgcuugguggagacccgggccaguaacugaaagcuggcccugguaucuuggugugcagggcggugcagugaagcgaggccagggugugugagugcgcuagcgugugugucgggggaaggcggggguuggccuccgauggaaguuuuaguaaucugcacuguggcaucuguuugcucccuugccccaaccgcccccagguuugguucaagaaucgucgggccaaauggagaaagagggagcgcaaccagcaggccgagcuaugcaagaauggcuucgggccgcaguucaaugggcucaugcagcccuacgacgacauguacccaggcuauuccuacaacaacugggccgccaagggccuuacauccgccucccuauccaccaagagcuuccccuucuucaacucuaugaacgucaacccccugucaucacagagcauguuuuccccacccaacucuaucucguccaugagcaugucguccagcauggugcccucagcagugacaggcgucccgggcuccagucucaacagccugaauaacuugaacaaccugaguagcccgucgcugaauuccgcggugccgacgccugccuguccuuacgcgccgccgacuccuccguauguuuauagggacacguguaacucgagccuggccagccugagacugaaagcaaagcagcacuccagcuucggcuacgccagcgugcagaacccggccuccaaccugagugcuugccaguaugcaguggaccggcccgugugagccgcacccacagcgccgggauccuaggaccuugccggauggggcaacuccgcccuugaaagacugggaauuaugcuagaaggucgugggcacuaaagaaagggagagaaagagaagcuauauagagaaaaggaaaccacugaaucaaagagagagcuccuuugauuucaaagggauguccucagugucugacaucuuucacuacaaguauuucuaacaguugcaaggacacauacacaaacaaauguuugacuggauaugacauuuuaacauuacuauaagcuuguuauuuuuuaaguuuagcauuguuaacauuuaaaugacugaaaggauguauauauaucgaaaugucaaauuaauuuuauaaaagcaguuguuaguaauaucacaacaguguuuuuaaagguuaggcuuuaaaauaaagcauguuauacagaagcgauuaggauuuuucgcuugcgagcaagggaguguauauacuaaaugccacacuguauguuucuaacauauuauuauuauuauaaaaaaugugugaauaucaguuuuagaauaguuucucugguggaugcaaugauguuucugaaacugcuauguacaaccuacccuguguauaacauuucguacaauauuauuguuuuacuuuucagcaaauaugaaacaaauguguuuuauuucaugggaguaaaauauacugcauacaaauugg

SEQ ID NO: 13840 - RNA, 2948 nt, Homo sapiens
caagguauauggcugcucgggagugaaggcgcggaggcccgagaaagggugagaagggauguggcggggggcuccuccggcccuggacucccuggguggacuagaaaagggcaaagaaguggucacaucugugggccagacuggugcgcgaucuuuggaggcgcagcagcaaggccgcgccagggcugagcccagaccgcccacgaggaggcccgccaggcccggagcagcggcgcgugcgggggcgugccgagcgcaggcucuagggccccugcuucgccccagcuggaccccgcgggcggucggugcagcucgagcgugugggcugcgaugcccugccugagacuucgggcuagggaugcgggcgggaagugggggugcggcggcagcugcagauuagauuccuuuuuuuuuuggccggagggacgugcaaacuucuagugcccgggccaagagggcgaccccggaggugcguagguggcccuccggguucccgcuucuccuagugccucugaaaauaccgucaggguaaagggagacaggcaguaagucuuaccaccaccgcccuuuccccaugucauuggccaaaaacugaacauuaagauaaagcagcuguuucagucaauggaaagcgguagggcgagguuguacccaaaacccgguuuagacggccaaugaaguccuaggaaaagccgccccgggggcacguucagguggagcggcugcaccucgggucguucuaagggaugggcugcgugguacccacggaauucauggguccaaaagguccuggucaccuguccaaacauccauccccuggcgcauggcgguugacaagauggcccggccacccagaggaaggaggauccgggacggggaacuucgcgccgggaagcuguagcccagagcugcagcucagcauucgcaagagauucaucuuuuuuuucucucguguucggagaaacagauaaacaagacaccgccucaucagauaagaacgucuccuucgaugucacggauuucaagagguagcuggagaaacugacgucaggaguguccugugaaugaacaucgcccgaggccuagcacccacagaagaaggguucuauuuuacucuacuuugcuugauauuauuuauuuucuaacaaagugauccguagucugcaaccuuaggcucugacaggcaaagcccauuucuuagcucuggggauggcuugcagggucuccaccucuguccacuuugguguccucuuucucccuucggcuccccaccuccaucccccgagcccacacacagcggggugaagcugucggggagacucgugggcaaccaaaugcaggcacccucugaagagacgccgagaaggcccugcauucgauccgggaggacauagaaagaugccaugaaguucuauugggugcagcaagccguuccccacgcacacuccccgugauaccugcccagagaagcagaagcaguuucgagggcuguugacacaggcagagcggggaaacgcgcccaagaauugggcugccacugguaugggucccaagucacauucaauaagcugcccaccgcuuucugggggacagcaguggugguucuaggucucaucuuuccagagcgacgaggauaaaaguuccugcccaggacugugugcgagggggucccgcacugcugcaaacucucagcggaggcagagaggcuuugcuguuucuggagagaggaagcauuggcagaggcagucuccgggcugugaggaauccacccucaugccuuaguguggguacgucaggucccagcaucagcgggccauuuccucaguugcaugaauggaggaaaaaccaaaccaaaccaaaccaaaccaaaccaaaccaaaccaaaccaaaccuuggcuguggacaaagaaaacaggagagggagaggauggaggagaaaaagagcacgagggagggcaaacaccuuaaacauuuuuugccguaagacuagaagaacuaggucuggaaagauccaucaaagucccagggugcagacacacacccugcccagggagagcccagugagucugaacuucucuuaguccuucugaaggaaggaaauuuaaaaagcaccucucacuaccaccaaaaaguaaacacuuuuaccauguagucauuacauguuuuugaauuuuuuuaauuguaaggaauuuagauggcucuuauagccauucuucugcagaguaacuuaagcuucaaauagcuccuguuuuccacaacuaccacugaacuguagaaauguauuguuacaaaaggaguagaaaugacuuuuaaagguaauuaaguauaauuaaauauaucuucaggggguauuucauuucuugcaggauucucuacucuucaaaaaaaucuaaaaucaacauuuacauuuuaaaaaugcauaaaauacucagcacagaagugaaugaaguuaugcaucccaaacacaguaaauucugcuuucuaucuuuucagauagacagucaacaaugggaaguccucccuuuggggagggggcagggaagggugggaggggccaagugugauaaauuuuuaagauuagaguaaaauuucccuggguucaucugcuagaaccugaaaagguaaaucaguuacguguuuacaaugguguuucuacuuaacccccuuaaaaaaaaaaacucgaauuaccauuuucucaaguucaguuaaugaaauguuugggaaccuggggaagaaaagcuauuuuuaaaaaaauuccuucugaaaaucugcuaccagaaauuccucucguuuacuuccagacuucuucagucaaccacguuucuugcuucccggugugcuuagauuaacugcaguuccucaggggguuuauaaaucaaucaauagggagucuauauucauaaaggccucugaucuaauuacacccccuccuuuuuucccccucucua

SEQ ID NO: 13841 - RNA, 3561 nt, Homo sapiens
aagcauuuuacugcacuguccuagaaaccuuauuucaaaaugaacauuucauucuuucaaaauuugcuuuuucaaauuagcaaagacaauccuucgucucucaaaaggaggaugccaaaccuaugugaccccuccgugaguauaaacacuggucuauugaagagcaggaaugacacaguaguugacgaaccacuucuuuuugaugugccuuuggguaugguuuugaaaauaagaaauucacauuuuaaugaugaucaggcagcacaaccugugucagcuuguaaguaggaaaccagaacccugacagagaugaagaaacaauuauaaccaaaauguacauuaugaaaacuuucugguaucacuguuaagauuuaauaauaauagugaaaagggaauuauaauuacaguaaaauugugguacacauaccauucugcagaaaguagguagcuuccauaacuuaugagaccuuauacauaauuuaauuuuuugcucaaaauauuaaucuucaaaauacaaugacagcaauuacuaccuacuuaucucuuuugagugauuuaaacuuuaauagugugauaauuuaaaugcuacuuauagauggugggcuaaaacuuaauugauaauuaauaguggaggauuaaaaauugccacaguuacagaugaugagaaauguacuuauugacauaaaauccaacaagggugaucagcugaaaaugccauguaaaaaaaauuauagccaauaaaugcuccuuucagauucauaagcuguugacacauuuuacccuuuauguaaaucccauucuuaaaacaguuuucuucuuggcacccugaaauugaagcuuuugaaaccuuaugcuccaacauauauagagaaaugaaaaacuguuauaauuuuuaaaauuuuaagagugguuuugcagauuuaaacuaacagaucuucauuuaaaguaggauccacagagcucuccagugucauuccugaaauaacuagaaguggaauaaugggcuauuucuuacuuuguaguuucuaaugcaauguaagcagcuuuacaaggcuuagcuguccccacugcccuaacagcauucuuuacuucauuugcaaggaaacaggaaguuuuuuucuccccaauuuuauaccaaggcacagacuuugucuauuaaaauuaccaauuccacuuuuauuuaguaaaauuaagaaauuuuaaaaguaccaggcuuuuuguccaucaauauuaauuucuuuucuuuuguuuucuuuuucugagauagucuuacucugucacccaggguggugugcaauggcgcaaucauggcucaccacagccuucacauucuaggcucaagugauccucccaccucagccucccaaguagcugggacuauaggugugugacaccacacccagcuaauauuuuauuuuauuuauuauuuuauuuuuugauacagagucucacuguaucucccaggcuggagugcaguggugcgcuaucagcucacugcagccuccgccucccagguucaggugauucuccugccucagccuccgagcagcugggauuacagacaugcaccaucacaccugacuaauuuuuguauuuuuaguagaggcaggauuucaccauauuggccaggcuggucgugaacuccuggccucaugugauccuccugccuuggccucccaaagagcugggauuacaggcaugagccuccacaccuggccuauuuuuauuauuaauagagacaagcucuuguguguugcccaggcugugauauuaauuucuugaugugaacaugugauugccucucagcaaaguuauuuuuugagcuauuucugucaucagacccaaaccgaauuucuuaccagcugcuaacuuuucucuuacaccauccccacugaguugagaagauggcuuggugcuacaugaaagggaaguggcaguguaaccaccaaaacagauaaucacaggcuauaaugucacacuaacuauggauccuaucucuuauuuguaauuaacuuggagaagaaaugcuaggucaaaaaugugcuagaggucaaaacagggacuuuccacaaagagagaucugaguccaacuuuuacuuuuuugacaguuaucaauccugugacugauucuugcagcauuauuugagaauuaaaugagcaauauauuuuaagcacguuaggcacuuaauauaugcuugcuacaauauauuguacuauacaaucuacauagcauauacugcuauuauauacuaauauauaauugcccaauaaauauuuagcaaauuuggggcauaacuaguaauauauuuuuuaaacuucuaugaacauuuaauuuugaaguaccuauugaccacacucacauagaccaaaacuuuuacuucuuaaaaguuuuucaauuauaaauuauuaugauuguuuuuuaagaaucaaaucauaauggucauggcuuuaaaaaucuuccuacauuuggucacauacuauuuauuacauauuauauaguuauaguuauacuaauacagaagggauagcccuagagacugagagcauaggaaacuccuaaucuauagcaaaaaaaauuauuauuuacaauagucagaaaaaaauaauuuuucaaucuaucaaagauacuuaaauagguuguauuacaaauugaauauuuuacaaaaucaaaguuuaacaauuuguaucacaaauaucagaauuuaucuaugcgauugagcuuuuuuggaacacuuauuuuuccucuaacacaaugccauucuuuccagacaguaagagucccaagucguccugguucauauauccauaucuagaccccgagacaguucaauaugcaugauacaauggcuacauauugcagguacauuuaaaauaaucagaauugcuagagagcuugggggcagaucaacaaccuccucguaucuaacaucuuccuaaaccacagguucucaucacaucuccuggagagauuuauuaaccucccacccccacuuccacagaugucaaggccucagcacuggugauuauaaaagguucccagacaauuacaacacgggaagcacagcucauguugagaaccacugcccugaauaaugagcguugcuacaaggcaguauaggaauaauaaagcacacaggcauuugaaaaagacauuuugcaaacuucucucaggaauagugccuuagugggcacauauccaaauaugccugcuuuccuuucuuuaaauaccuauucaagagacaaauaaaggaauagaaaauaagaaggggaagacaagaaaacuggaggcugcaccagagccaccuugaaaauguaaaggauuggugguuguuacagagccugccacauuuaguagaaucuuaauauucaggaaguuaaaauguuuucuggagugagaagcugugucaggaaaagaggauuagguaacaagugaccuagaauuaggaugugauucucccugaaggauugcugcagaggagauaaugaaagguaagggcuuuuccaagacauuuccacauuggacugaccuccaucuaaaaucuuacuaaauauuaacacaaa

SEQ ID NO: 13842 - RNA, 863 nt, Homo sapiens
ccaucauuuggugagggaaagacaguacacaaaaaaaauucagauaagacagaaaaaucucuauuacuugaugcuacuaaugaaaucaacccuucauccccaaauuaggacagauaauggacuauaaagacuuaggucauuccacggggaggagacauuuccuuaagauaagaaaguaaaaagccaguuuuguuaugaacaggggagaaaugcaaagguccugaggcagaaaacugaaagugucugaaaguucuggagugauuggcucacagugaacaagaagagaauggcaggaggugagaguggagaauggggagagagaggcagugcagagaggccuugucgguccugauaaaggaguugagguuuuuauuccaagugcagagaaaaaccacugaaggauuaaacaggaucuauaucuguaaaaugacaguaauccucugcaggacaauuucauacaguggaaagaguaacaccauuugauggagucuuuauaccuuuagagaagcuacuuacaaagacccaacuuaauagacaauugccaggaauuaaacuucauuauuuugauacuguagaaaguugaccuuuaguucuaguuggcagaugcgugcuuucuggacagguuagccuaguggaaugauuuauucuagagcaacucuaagauauuuuaaguaaaaaacagugccucugaggagaaaagaaggcuccauuucccaauucaacaguuguucauucauugaucucucagcugacuucuagaguaagaugcugcccuuuugggcagaaaaggcuaggcagguccaucuuccccacauggucagccagcucuccuuucagucccgggcaugguucacacacucugg

SEQ ID NO: 13843 - RNA, 16606 nt, Homo sapiens
ugguccaggugagcgggcgcguccccgcgacggcgcugccugcccgaggcgguucacguaaagacagcgagauccugagggccagccgggaaggaggcguggauauggagcuggcugcugccaaguccggggcccgcgccgcugccuagcgcguccuggggacucuguggggacgcgccccgcgccgcggcucggggacccguagagcccggcgcugcgcgcauggcccugcucucgcgccccgcgcucacccuccugcuccuccucauggccgcuguugucaggugccaggagcaggcccagaccaccgacuggagagccacccugaagaccauccggaacggcguucauaagauagacacguaccugaacgccgccuuggaccuccugggaggcgaggacggucucugccaguauaaaugcagugacggugagggggcacccgggcccagcgagggcucgugcuuucgggggauuggggugacggagauccuggaggugugagugacagaugcaaggcagaccuugacgguguccuucggcuguggaaaaacuuaaccacugcuagaaucuugccguucuagugauugagcaagcuggguacaaguucgcaccacuauuguuagaaugugagaggucacauucuaacggagagguguaccccccgucccauuugcauugcuucugaauuaccuuuucccccccucaauugcaccaaguugccgaagaacuuacugacguaggaaucaugggaauagaguggaacagacugguuuuagcucauuuuugcuucuguaaauuggaugaacaugcgaagcaaacugagaauuuaaaaaccaugccguauuaacuuucucuauaauugauauuaaaugguuuuuuuucugcaaacccauagacaauaacuugcgaccuuuguacagacuuuugguguacucgaguguugagaaaggguuccgauaacucuucuuuccuuagauaucagugacccgccuccuccucauuguugguuaacguuaauacaguuaucuucauuuacucuuuuaauauuuuuugaacuuucucuuugaaccugagaauuuguuugguggcgguaugaguacuaaucaacucaguauuucaggcagagauaguucuuuuguagcacauuuuugagugcuuaaauauuuuaauaggucagaaaaauauuggacuuuuguuuggaaauugaaaauguuaagagagcaguugggagaucauguuuccaauaagauuagccaagguuagagucucauuaugcuggcagcggaaaauaaucggggauccagugacuucauuguuggaaccugauuguauaggugaacuuaaaaggaacugguaucauguaaaccuaugaugccacaugcugccugcaauuuucaagauaauuucuaguuuuauguuaauagaaguaaaggaugaacuguaucuuguauacuuuaaagcgcugaacaggugcugagacauguugcauugcuucuuaaauuugugccuaaacguuaccaccuaaacguaugcuucaugaagauguuuuuauucuuguagaacuuguucggaggauuaagugcauaauuuaaggaucaaauaguugccuuuccuaaagcaaauguuacaguuuuacuuagucauuccuauucauuauacaaauauuugagucccaacugugcuucagauguuguucuaauuugagauucagcaguuaauaaaacagacaaaaaucucuguccguggagcuugaguucuggugagggagagaugggcaguaaacuaguaaauaaguaaaauuaggggaaguguggagucugaucagggcagacgaggggccauguuggaggcaauuuacucuucuaaauggguuguucagcaaaggccucacugaugaaagaauauuugagaagaaaucugcacgugguaaggggagggaaugugguuauuuggagaaacagcauuccagacagagggaauagcaagugcaauggaccugaggagaaaggccagucaaggaugacucugaagguuuuggccugagccaaaggaaggaaacgguugccauuuacagagauagggaagacuuggaaggagucgucuucauaaauuuauuagucuaggguucuagaguuuauuuacauuuaaaacaugccugaaguugaaugaauaccagccuuguuaaaauacuguuuuagucuuuuuauuuuauuuuuuguuaauauuuuugaggcaaggucucccucugugcccaggcuagagggcaguggugugaucauugcucccugcagccuccaacuccugggcucaagcaauucuccugccucagcuucccaaauagcuaggacuauaggccaugcccccacuacaccuggcuuaaucuuucuuuuuaaucuuuuucaucuucuacaggcuucucaaaauuuacuauuuggaguuuagaggaaggucucuggcacaaaaaaacacaaaggaauuugagaauuuaagaaauguuauaugccucagugaaaaaaaauuuuuugucuuaguaaguacucuacguuuaacggacaugugguuucaaguccaagucaccauacugauagauaauuggaucucaaugaaaaaaaaaauuaggcaggacguaauggcucaugccuguaaucccagcacuuugggaggcugaggcgggcggaucaguugagcucaggaguucgagaccagccuggccaacauggugaaaccccgucucuacuaaaaauacaaaaauuagcugggcaugguggugcacaccuguagucccagcuacuugggaggcugagguaggagaauagcuugaaccugggagguggagguugcagugagccgagaccgugccuccagccugggugacagagcaagacucugucucaaaaauaauaauaauaauaauaauaauaaaauugcuguuacucgagcagucucucuggaacaauucaaccuuuccuauauuuuggaauucaggugaccaaaucagaaccaaacagaacaaucccaaaucuggagaaacauggugauuaagggguauuuuuaguugcacgaaagagaucaagagagcuuuaaaaaaaaaaaaaaagagugaguuaaugguagggagagguuggucaaauaaagggcacauguccuugcuuuaccugagggacuggcauuauggagacuugcucccuuaguuuuggccauccucucuuggguaggaaaaaggccuuauugagaguuaaguauuuagggaaauaaauuugaugauccguuauuuucuucaacuuuuuucucccugacagcaaggaagauuuaaggaagaaaacuuuucgauuuccuuugaaaaauagaacacaaaacuggcuuguaaauguuuuuagaaugaugaauaagucauuaauuaauucagugacguauguuuucuaggaucccucuggcuguugugcugagaacagaaggggucaagggagugggggaguaaaaauggaagcagggugacgcaugcaggaguccagacaaaagacgggugauuuugcucagguugguagcaacagagguaaugagaaguaguuggauuuuggauauauuuugaaggaaggaccuaaaagauuugcugauggcuuagaaguuagguaugaguuaagucaaaaaugauaccacaguuuuuggccugaacaacuggaaggacagaauuaccauuaacugauauggggaagaccguggaaagaacaguuuucgggcauuaggaaaaauaauaacacauuuguaugcuuuugagaaugguucaguggagaguagaaauacugacgagggagagaauuauuggagucauagccuuggguaagugagaggggguaguuucuaguacauacuuagagaguuuggccaagagcauauagcauagcccuguuaauaggaacacagguagaggauaugagcacuggugcugguuaaguggguggauguucaaguucuccugauugccugcuuuuuucaguaaaguaggaauccaggucaucagcugacagagaagauggggaauggggauguuggagauuugaggaaaauauaaaagugaacagacuagaaaaauaaaguaauauaaggaccuuuuggagauuaaugaucaugaauacuuaaagucucaaguguuugggagugcagguuggaaucuuacaaaacucugccaugagaccuuugugugacccagcagacuacuucuugugcuugucaucugcuucauauucugucaggugaaaacaguuggucuaucuggaaguauuugcaucaaauuuagaaaaaauacauggaaaauaaucaacuuugucucagucuaugaaaaucuuuagauuucugcaguccauacaaaugauaaacaaucaagagaaggagcuauugcuuaagucaaaaauggaaauuaaugaauagucuuuccaugcaguuguacacaguggauuugguuuguauccgcuuacaaauuuuagaggacaauggccgcaacacaucaugguguuuugauguuacucugauuuuguuucuuccauuauugaguuuuugcuuuauuuguaaaaacuggcaccaguagaaaugcuaauuuuuaaaaugcuuagccauuuauaaaacuauaacaaaauuuaaaauauuaauacauuuguaacauuggugucugaaucaacuuaaccucuaauaaagaacugucuauauaacuugccuuguucagaaauaacuauuuuaauuuaaaggugaauuuagaauuucaaaauacuuuagaauuucucaggaaacuaguuacuuccaaguuuucaguuuuuugcuguggauaaagaauuauuuuaauuucaucaaagaauguuucccauuuuuuaaucugguaauuuauugggugcccacugugugcuaaauaucuucuaggugagcaagacuaaguccuuucuucauagaaaccgacuaauguuaauguuaauuaggucaauaaaugcuagaaagagagggggugcuauuuuagauuggguaagcagggaaagccucucugaagaaaugacauuaggaguuugccuugaaaaaaacuaaagaaccauacacauaugccccuuuugccauuuacacuggggagccaaacuuuuuaccagcauuuauuucaugguguuauuauccaguuuuucauguacaguagauguuggcucuuuauuacuugauuuuuaucaacuuuucuucuucagacaguuauaaccacuagcccuguuuggcacagcagccuccuacuuccuuguaccuccauucucauuuuugccaguuguccuucucuguacuaucucuuccucuuuacucuccuauggugggcauguuuuuaguuuuucugacuucauuugugucugaucauucucccauucaaagguaauuaucucuuaugagaaaaugucuauauauguacacgcaugcauacacauauauauguaucacugucauuacacacaucaucagcaucaggaauguuuuuauagauuugaaaucagagucuauggauuuagauaaaauacaaaaggaaggaaaaauagaaguacugcuguuguauguacauugagggaaguaucuuucugauuaaaaaaaaaaggccgggcgcgauggcucacgcuuguaaucccagcacuuugggagacugaggcaggcggaucaccugucaggaguucaagaccagccugaccaacacggagaaacuccaucucuacuaaaaauacaagauuagccaggcaugguggcgcaugccuguaaucccagcuacuugggaggcugaggcagaagaaucgcuugaacccaggaggcagagguugcagugagcugagaucaugccauugcacuccagccugggcaacaagagcaaaacucagucucagaaaaaaacaaacaaacaaaauaagacaauugagacacaugucuuuaaagccauaggcccauaucgguugucugagggugguaaucuuugcuucucauggaacagggugaggugccagaaaucucuagacuggcagaugggagggagggagaauguacaaggugucuaaaaaguuggaaacauaggauaaacauuauguuuuauuuucaaaugacacacucaauauguuuuucauuaaccacuagacacuuuuuuagaugauauacuucuaaauuuaaaacaguccaguuguuaaccugaacaauauauauuguaaauacacuauuauuccuguuuccagacuuuuugaacauucucugguguauuuauuguacuuuuuucagauuaacaacuugaccuauuucuuaguguguaucucuagauauguuucuaaacauuuugaacaguugauugucaaaaccccugacgaaagagaguuucaugaugaagcuugaggaacuagaaugggcuucccaagaauuaaaugcugauccagccuccuuuucugugaagagauuuauaguguguuagggcaaagaaaacuauagauaaauguauaguuucucaugauacuccugugagaaaaacugguuacuauuugaugacuucacggcugcuuggagagaggacucaucuguaguggaccucuguccugauuaauaucugcaucuuaaguuugugaauaucugggagcaacaggcaacacugggugaauaacucuagauuuaaaaacugcucagcagucgagaauggugaacugaaacuaacaagauugaaucuuauauacaaucuuauauuuagacucaaaauuaaauugcagaagugcuaagccucuagcaguaaguauuaaaaaguccauuuuagaaagaacugaugauuuuuuuuuuuuuacuacugucuauguuagcagucaggcacagcugaaacauacuguguuaggcuguuuuaauacaaguacuuuauccagcacaaaagguuaaaaagcccaucuuacccuacaguguucagucugaggugcuguauuuuaaagagaugugacaagcuagaagucaucagucuuuggaggcuggcugaugaaugcucaccaagcccaaaagagacucuagggcaaacagcaggguuucuuaacggauaaucuccauuuauaaugaauauuccaagccuuccaagucuucuguucauuaauucaucacauacuuauuguaaaaauucaucacaaaguuauuccaggcacuguucuaggcauugggaauccaaaacacaaaaaugucugcuuucgaggaguuuacauuuucggauggggagacauaauaaaauagguagauuagugauauaguauguuagaaggucauaugugcuacaaauaguauggucagggaagacuugcugagaaggugaaugucuuagucuguucaggcugcuguaacaaaaugccuuaaacuggguggcuuauaaacaauggaaauuuauuccucaguucuggaggcugugaaguccaagaucuagcauuuggcagauucaaugucugguaagaguccacuuccuuguucauagauggcaccuucuagcuguguccucacauggugauggauggggcagggcagcucuuuagggccacuuuuauagggcacaaauuccauucaugagagaucuguccacaugaccuaaucaccuccaauagucccaccuucuaauaccaucacauuggugauuagguuucaacaugaauuuuggggugaugcaaacauucaaaccauagcaguaaaggagaaacuagugucaggagaaagagcauccacauacaggaagagcagguucaaaggcccugggacaggagcagaccugcagugucuguggaacagcaaagaggaauagguugaggaagaaaggaagagagacuaggaagaggaugaggucagagaaaucaugggaagaccagguuauacaggguuucauaggcuuuauagacuuuggcuuuuguucugaauaagaugagaagccauuaaagcgucucugagcagaaaaagacuugaucuaacauauuuuaauacgaucauuugugcucgguguugagacuggauuauggggguugguguggagcaggggaaccaaaguagggcaaauaguuaggaguuuauagcaauaauccauuguggcuuggagcaggauugguaguaguggaggugguaagaagugauuagauucugaauauuuugaagguagagucaacaggauauacuguuggauugaaugugggguauaagaacguaagaacauaagcaaaaaugucugacauuuuugcucugagcaucuggaaggacagaauuacuguuaacugaaaacagcaaacugugaauggagcaaauuugaggugaaugucaggagggacagcuuaaguuugagaugcccacuggaccuuccucuguaggcccuuguaaguaggaagccaagucauaaacuguuuucuuaggaaugaaggacugggccgggcaugguggcucaugccuguaaucccaacacuuugggaggccgaggcggguggaucacgaggucaggaguuugagacgagccuggccaaccuggugaagccccgucucuacuaaaaauacaaaaauuagccaggccugguggcacacuccuguaauuccagcuacuggggaagcugaggcaggagacucacuugaacccaggaggcagagguugcgaugagccaagaucgcgccauugcacuccagcuugcugggaggcaaagcgagacuccaucucaaaaaaaaaaaaaaaaagaaugaaggacuaaaaguaggcgaugagaguugaaggaucauggugacucaucugugauagccugagucaucuacccucaucuuccaaggguccagaaacaacccuuccuuauggacagggcuggagaaacaagacgaagugcuaucauuggccuucccuuuucuagacucaucuuaaccauuccuuuuuguauacauuuuuccuuuagagcaggcuguagguuuuguuuuuguuguuacuguuuuuugagacagaguuucgcucuuguugcccaggcuggagugcaauggcacgaucucggcucaccacaaccuccgccuccuagguucaagcgauucuccugccucagccucccaaguagcugggauuacaggcaugugccaccacauugcccagcuaauuuuguauauuuaguagagaugggguuucgccauguuggucaggcugguguugaacucucgaccucaggugauacaccugccucagccucccaaagugcugggauuacaggugugagccaccgcucccagcccaggcuauagcuuuauaucuucgugagguuauacuacucucuugaggcuauguauggugaccuuaguugagcauggaacuucugagcaagucacugaaaccguuuauuuuuuucucuuucuuuuuuuauuuuuuuaaaauucauauauauauauauauauauauauauauauauauauauauuuuuuuuuuuuuuuuuuuuuuuuuuuuuuugaauacagacagagucucaucauguugcccaggcuggucucaaaaaccugggcucaggcaccucaaccucccaaagugcugggauuauaggcgugagccaccacgcccagccaaaaccauuuuucaguuauuaccuugagggguuccuuauuuugaugguugauuacugaaagagcugcuuuuuuacccucaauuuauuuuuggaggguaaccuugucuuuauaaaaucuaccaauaaauguuaaaugaaaauuggcggaauacuuugugucacuccuauguauccaacugugggguuguauuuggaaacugccaugucuuaggguaaaauaccugggaauaucucauuuuagaaggcaagauaaauuguagcccaaaauauuugaaaggauuauuguguaaaauagggaguuggcuuauuuuucuguuuccccaaggggcagaggauuguuuauagguagaacuuaaaagaaagcagaagaaugucuuaacaauugaugucauuucacaguagaauagguuauuucuugauguaggaggguugugggaaacauucaaagagccaguaggugacugguagguugaagugauuucuauacaagcauacuucauuuuaauguguuuugcuuuaaugcacuucacaaauaauugugggguuuuuuuuugcuuguuugcuuuuuaacaaaucgaagguuagcggcgacccugcauugagcaagucuaucggugccauauuucccacagcaugugcucacuuaguaucugugucagcauuuuuuagcaauaaaguauuuuuaaauuaagaucuguacauuggcuuuuuuagacaguguuauugagcacuuaauagacuacagcauaguguaaacaaaacuuuuauaugcacuggaaaaccaaaaaaauuuaugugacucacuucauuguuauauuggcuuuauugugaugaucugggacugaaccugcaauaucucugagguaaaccuguauuaaaugaggugagguguuucugaaguacccuccaaaauuuaagauugcuaugauaaugucaucuuuuuccuuguuacugaacccuugaugcuacuggggaacauuagccuuccaagucuucuguucuuuagaaguacuucauuagaacuacaguacuucuggaguaccguaguucaucaaguaucccuccuaaccuuuuccuuagauggcaaagaaguauauuuguggaaugguugacucggugggagggcagcaggcagaaugcguggucuuguaaugucuuguaguacuaagguuauugaaugaucaucagaugaccuugucuuccuuagccuuaggcuuugcccaaguaaacugguugguuaaugguuauugagguuuguaugcaaugaagcauuugugggaguugggaagauacugucuuagcccuaaaaaacaaaguguuagaauguacaggaaaacaggguggauuuaucuuucauacauaugaacccuaucuggcaagugaccucugaaaucuccagaaguccaggauaagcuuuuguauguuucguaugacauaggcuuacaaauaauuacauuuuaugaguugcuauauauguguauauguauauaugugcacauuuguauauauuccucaccacaggagaaauaaaaagucuaauuagcauucuuaaugcucaucagaauaaagacauaugcacuuauguuagcauccaaguaaauauuacauauuucuaaggcuaauguagcauauugaccuuuuugaguauguauuuuacuuuuaucauauuugaaaauuaauuaugauaccauuauauuuuauaggaucuaagccuuucccacguuaugguuauaaacccuccccaccgaauggauguggcucuccacuguuugguguucauguaaauauugucuuuuauuugauaaguuuuguaacugguaaaucauguaauacuuuuggugauauaagacuaucagcauguucuuagauucacaaauaauuuagcuggguguaagagugaucagguuuauuagauucuuuuuggcaaaacuaacaaaaguaaaugaaguaaaauuguuuuauuuuugaaucuuauagauguucguacuauuuaaaugauauuucccaauaucacauacauaguugaaaaguuuggaguacagaagugcuacuacuuagagggaaaaaguauagauaaaucauguuuucgacauuaaaacaaggcuaagugggauagcugugugguuguuguaggagugacuggaucuaagccaaguauuaugggaaaaaaauguuuaugagaaugauuccuagacacaaggauuuuguguauaaaguuauuuaaaauaauugaaguuauagauucagaguaauaguaucuuuggggaauggagaaauauuuaaagauuaaaaaacaaaaaaauuugaguuguaggaaaguuuucugugauauuucacauaaaguaaauuuuauuuggaaggagaggccacaaacacuuugaguauccaaaaaucauacuuaccuagccccuggagaaucuuuaauggacuuagccucaucuuucuuuuuuuaaaacuuauguuuuguguuuuggacaaauggaaauuuuguuacugacagguaacugugaguguucuaacgcugcagaauagggagcagugaggcauagcugagagaguaacauggguggguauggguaaguguaauggggagauuuauaacacagaaaauauuuguaggcagaaauggauuuuggaacuaucuauacagcagucauuaucauuuauaccuauuuagucuauuugaaugcaguacuucagaggaguuuugcauuucauugacaguaauccauccaaaugccuuuugcagcuuaacauugguaucccuucccugacaaaguguugcaaccaacacgacaggugcuaugagaccuguggcaaaagcaagaaugacugugaugaagaauuccaguauugccucuccaagaucugccgagauguacagaaaacacuaggacuaacucagcauguucaggguaaggaugaucugguggcuuggggaugaguguacuuuuuaaaguuguaucaaaugcucuauguuuuaguauaggauuuaccaauagaaaucuuucacauauauuaucuauugugacacagacuucaauuuucugaggugaggagcugaugauuuuauaaucuaaaaugauuuauagucacagaagcaaaaagcauuaggaaaccuugggagaguaggggugucuaaggcugagagagagaagaauucaucuaccuugugcccuaaaauauaucuccagucaucauguaagaaccuaaaguagcuaaaguuugaaacucugauuccaguugucuuaguccaucuggacugcuaccauagacugggugacuuauagacaacagaaaguuauuuccuacaguucuggaggcugggaaguccaagaucaaggcacuagcagauuuggugucugauaaggacucauuuucuaguucguagcagaugccuucuaacugugucuucacuuaguggagaggacuagauagcucucuggggccucuuuuauaagagcacuaaucacauuuaccaucuuuuggaacuuagacaccuccaaaggccucaccuucugauuucaucacuuuggagguuaggauuucaacauaaauucuggaaagacacaaacauucagaccauaccaccagugaauuuaagaguauagcacacuggauuuggaguaggaauuucuagaagacuugucuuauggguuucuguugggaagguccccagaugacccccagguucagugauuuacuaggaggacucacgggacucagcauauaguuguacucacugccaugagguauuauggugaagagauagaaagccaaacuagcaaagggaaagggcccuuuggugucauuuuuaaaagaaugaugauacucaccucacagaguugucauaaggaugaagugaaguauuuguggaaauacaaauaaaucaccauucaaauacugguaguuauaagauuucucuacugucaagccaaagaacauaucauacacugaaaucagaagaggcaaggcaggaaaggaaaauaacauuuuaagcacuuucauaagauacugugcuagauauuuuauucauguuuucauuugaugccaacaaaaaccuaaagagguagguaguguuauccccauuuuucaaggaaggaaacgaugguucagaaaacaguaacuugccccaagugagcauuuagccugacuuuaaaaucuguguucugucuauuauacaguauucuccaaauagucucauauuauagcccugauucuaauauccuaauaauucaugucaaggaagaaaucucugcugcagguaaucuugaauucacagccucuguaucccuuugcagcuuuuggcuaagguaaacuagcuguaaaccugaagcauagauagauuuauuuccuguuuucugauuuaagaagaaugugaaaccaaucaucuuguaaccuccuauuuaauagucauagccucuccacuucugugguugguuguuucuuaauggcaaagucuuuuggagaacuuugaaaauguuaagauuuuguaaugacaaguuucuuccuuaacaugaauauuuugaaacgaaaaguauuuggauaacuaaaagccacucugugcuauaucucuguaaguguaacauguuaagauaaucucaccuggauguuucagguuucuuagaauaagaaaaguaaauaaauuaccuuuucauagucuucaaaaaauuuaaaaaccuaacuggggccgggugcgguggcucacgccuguaaucccagcacuuugggaggccuuggcugguggaccacuugagcccaggaguuugagagcagccuggccaacauggugaaaccccaucucuaacaaaaaauacaaaaauuagccaggcgccuauagucccaguuacucagaaggcugagguggaagaaucacuugaacccaggaggcagagguugcagugaaccaagaucaugccacugcacuccagccugggugacagagugaggugagaccuugucucaaaaaaauaaauaaaauaaauaaauaaauaaauaaauaaauaaaauaaaccuaccugacuggggaaaaauacuuuugauuuauaugcucccauauccccaagucaaauuaggacauuggucaaagagauuggauuccguuuacuuuaagccucuuaacugauguaugaucaguccucagaagccauuggccauaaugaaauguuuugagauuucaauuuuuaaacuuuguuucuuccgcacauaaaacauuuuuucuuaaaaugcaaauuuaagaguauuaucagacaacucuguuagugauuauguuuuucaaauaaaaagaaaguuaaaacacugauuaaucagugcuauuuuaaaagacuuuuauuugucuaguuuaaacaauugggccaggcaugguggcccacgccuguaaucccagcacuuugggaagacaagucaggaggacugccugaguccaggaguuugagaccagccugggcaacauagugagaccucauaucuacuaaaaacaaacaaacaaacaaacaaacaaacaaaaauagcugggugugguguugugugucuguuuaaaauuaaaaauuaaauuuaaaaaauuuaaauuaaaaaugagcuggccaugguaaugccagcuacucaggaggcugagguggaaggauuacuuuagcccaggauguggagacugcaguaagcuaugacugcaccaugacacuccacucugggugucagagugagacccugucucaaaaaaaaaaaaaaaaaaaaauuggguuaaacaguugaaugcaaacaaaaaauaagaugcaugagacuaaaacuggaaaucuguagauauauauguguguauguaaauaugcuacagguugugagaguuuggugauuucaucuagcauacauuucagugcucacgagggauaugcuuguugcugugcuguaauguguaacauaggugaaaagagcaaugcaguugcccaacaguaaucccauuuucuuguuuugcagcaugugaaacaacaguggagcucuuguuugacaguguuauacauuuagguuguaaaccauaucuggacagccaacgagccgcaugcaggugucauuaugaagaaaaaacugaucuuuaaaggagaugccgacagcuagugacagaugaagauggaagaacauaccuuugacaaauaacuaauguuuuuacaacauaaaacugucuuauuuuugugaaaggauuauuuugagaccuuaaaauaauuuauaucuugauguuaaaaccucaaagcaaaaaaagugagggagauagugaggggagggcacgcuugucuucucagguaucuuccccagcauugcucccuuacuuaguaugccaaaugucuugaccaauaucaaaaacaagugcuuguuuagcggagaauuuugaaaagaggaauauauaacucaauuuucacaaccacauuuaccaaaaaaagagaucaaauauaaaauucaucauaaugucuguucaacauuaucuuauuuggaaaauggggaaauuaucacuuacaaguauuuguuuacuaugaaauuuuaaauacacauuuaugccuagaaggaacggacuuuuuuuuucuauuuuaauuacacauaauauguaauuaaaguacaacauaauauguuguuucucuguagcccguugagcauaugaguaagucacauuucuauuaggacuacuuacaaggacaagguuuccauuuuuccaguuguaaaauuggaaccaucagcugauaaccucguagggagcaaccccaggauagcuaaguguuauguaauaugccuagaaggugaugugaaugcgauucagaagcauagccacucccauuuuaugagcuacucacaugacaaaugucaucuuuugcuauaaccuuugccaaguuagagaaaagauggauuuaaugagauaaaugaaaagauauuuaaccuaauauaucaaggcacuauuugcuguuaugcuuuguuauuuauuucccagcacuuguuccuuauuguagauuuuuuaaagacuguaaccuuuuacuaacuguggucuuacuaaaauuugugcu

SEQ ID NO: 13844 - RNA, 17251 nt, Homo sapiens
cacuuguuagggagggcgggccuguuuccgggaggcgcguggggcuugaggccgagaacggcccuugcugccaccaacauggagacuuuguaccgugucccguucuuagugcucgaaugucccaaccugaagcugaagaagccgcccugguugcacaugccgucggccaugacuguguaugcucuggugguggugucuuacuuccucaucaccggagguaacucgggcugucgggcccgagaggcugaggagcggagaacugacccgccccgggaggcgcgucuguuccgcugacucucagccccgggggaagcauagcucugcuuuggaucuuuucugaggguggaggggaguucugggguccgaaguguuaacguccaaguuuauucgccuucacgcccugucuuaagagaauucguguucucacucccauugccuuucuucuccuucuagcccucccaucccagggauccgagucaaauauauuuuucaaggccaaauuguugcucuuuuuguugcuugccauacguuguuugauaaauguccugggaaagccuaauuuggcaaacuccguuuccaugguugguuguuugauaaagguccugggaaggucuaauuuggccaacuccgcuuccaugguuggucaagagcuugugggacuuuuaaacuuaucuuuguccuggaaucuuggaagagacuugacaaucuuuaguuuuguuggcucaaaccuaggguucuguguugccuuuugcaugaccuacaauaaauaucaauggaauuuucugaaaucacagguuugauaaauauuugagauuggagaugagauuugcagacgauacuguauuucagugggcagaaguugagaauuaaaaaaauaagauaaauagcauuacuauuaaacgcuucugaauugucuaucaucuuauucuguccuuuucaaauagaaaauugcaaaggggcguugccuuauguacuggugaguuggcaauccggcuagucuuuucagagccacuacccuuucaggccacaguuccaagauuuacuuagaacugugcuacuguguacauuuagauuuggggaagugguguacuuaacuuggaaauuauaaaauuaauuuagauuuugggaagugguguacuuaaccuggaaauuauaaaauuaaagcuacggauuugggauagcaaaaguaguucuacuuuuaagggaguggccauauaauuguuauuuucauagauguuuugugagaauaguuggcacugaagggggaggauucaaacugagagagcugaguucuagaaagcaccuuugaauuuaccuccuucccccaaucuagaauagugagaauuaacuuacguucauuuaaauaaauuacauuuaaauauuugaguuacauuuaaauacuuauuugguaacaagauacuaucuagcauugcauuagcauuaaccauuaacauuugcucaucaaguuaauagcuacuguacugaauaaacaaaauuuaaaaugcauguggcuuuuaaaaauaauagacuuuuaaaaauaaauaauauagaauaauucaguauuauuauugagugcucgcuucggcagcacauauacuaaaauuggaaugauagggagaagauuaccauggccccugugcaagaaugacucgcaaauucgugaagcguuccauauuuuugcacaguucacgaaggucguuggacaaaaaaaaagucauuauucaauaauaauaaugaauaaugcuaguuucuuuccuguaacccuuacuucccuuggagucggauucuuugcgagaagccucaguuuucuuuguggcccucuuuuuucuccuguugauuauuguaauggggagauucuuugucccaaccauugggggaaaguggaaagguugcuuuuuaguggccaggucuaugagguaucuuguaugaugaauugguuuugccacuggaagggaagaagucucuucuaaaaacugagugcaccuuuauaaauaaacuauuuguugcugacaaauagucagcaaauagauacugagucccguuaaguuucaggcacuagguacuggagauaauagaacaaaacauaaggacccugaccuccugaagcuuauaaugucauagaugagacauauuaaaugucacuuaauuuuuuuguccguuaaaaauguucacaaaaacaggccaggcgcaguggcucacgccuguaauccaacacuuugggagccugagccaguuggaucauuugagcccaggaguucgaggccagccugggcaacauggcgaaacccugucucuacugaaaauacaaaaaauuaaccaggcguggugguacacgccuguagucccagcuacuugugaggcugaggcaggagaauugcuuguacccgggaggugaagguugcagugagccgagauggugccacugcacuccagccugggcaacagagcaaggcccuguuucagaaacaaaaaacaaaccccaaaauuagcugagccugguggcgcacgccuguagucccaaguagcugggacuauggugcaggaguuugaagugggaggaucgccugagccugggaagcugaggcugcaguaagcugugauggcaccacugcacuccagccagggugacagagcaagacccgacccucucucaaaaaauaaaaacaaacaaacaaugguuauaaauacagugaaagaaaagaacaagagguuuuugagaaacuaaagggaguuggaagcaucaucuggauuggauucgauaugauuccugaggaaaugauauguaagccaaaaucugaagaguucggggaaaggauaugcuaggcagagggaaacguagggcaaaugugagaccaaaagaccaauuagguggccuuuguaguugacuuagacuauacaagguuuaugguaguggagauuaggauaauauaaugaaagauauguuggaaguagauucaguaggucuugaauucacuggguguaggggaagaaugaagugggaaggaaucuuacagguuucugguuugagcuccugaauagauggaaguaucauuuccugagauugagaaaacaaaguuuuugguggaaaauggugcaccagagguuguuuugggguaaaauuaguuggauaugucacaugugcagaugggagucuagaccugagaaaagaggccuguguugaaguuggucaacuaacagacauuucuggaacucccaugagacauugaagaguauaggcaaaguccaaagucucuguucuugaggagcuuacauguaauucuaaugguacuggcauuauuugagaggccuuggcacaucacauugagagucuuuagcacaugaaauugaaagcccugggaguucauuuuggagaaaaguagaagaggacaguggaccaaucccugagggccuccaacauuuaguucuuuuauaaaagaagaggcccaauagagagguagcaagaaaacaugaagaggaguaucacaaaagccauaagaagagguguuuuucaagaaauugguuuaguaaacuggauugagugcuucugagaaguccccuaagaugagaacugaaaagugucuauugaauuugacaacauggagaucauuggugaccuuagaaagagcaguaucaaugguugcagaagccagauuggauugaguugaagaaugaaggguaaguaagaaaggggagauggcaaguuugccuaagucuuccagaagaaagucugacucccuuucagaaagcaaagauagaaauaggauguuagcuaagaggaucugaagucaaggaggguugauguagggaaggagagcuugaaaauacaggagagaggagagauauccaaaggaauaaagucccugagaguccaagugggaauggacuccugguaauugcaaaagggaucccacauuauaggaggugggaaucuuccucuuuguagcuggaaagaaggaggugaggauggaugcagguaccagguauuuguagauuugguggggaaaagacaagggaauuccuauaggauuguuuugucaggcuaggauaagggagauaggcuuguuaugcuuaagaaaagcuggagaugaagauguuugagaacaguggagaagguagaguagauguugacagugggagauugagaaaacuauuagugcugaugaacauuaauguuaaugaucacgaugacauuaugacauaaugguggacauuaauguuaaugauuaugaaucucuaguauugccauucugccugauggcgugguuuuaaaaugucuccuuguuuuacauuuaagcaauuucucuaguuauuuuucaauuuauagaaacaaaucuaagcauaucugagacaauuuuugugaaccgaaguagagccuuuaguuuuaaauccccuuuauacuaaagucauuccugaguauuagcaacucuuauuggaugaauuuccuuuaugaaauuuguacuucauuuagauaucauacaguuuucaaaguaauucuaaaacauugaguugaaugucugaaugauuuaucagaacuuuagaugaguugggccacauuugguuauaauaauacaaucaaagcauuccuauuuaaaaguaaaugaaacuuggccgggugcaguggcucacaccuguaaucccagcacuuugggagacugaggcagguggaucaccugaggucaggaguucgagaccagccugaccaauauggugaaaucccgucucuacuaaaaauacaaaaauuagcugggcaugguggugggcgccuguagucccagcuacuugggaggcugaggcaggagaauugcuucaacuuggguggcggaguuuggcaguaagccaaguggcgccacugcacucucaaccugggcgacagagugagacucugucucaaaaaaaguaaaugaaccuuaagagacaaugaaaacuauaauccuguuuucaaaaauuaguaauacaaucuaaucuguucuguugucuuucuuauaggaauaauuuaugauguuauuguugaaccuccaagugucgguucuaugacugaugaacaugggcaucagaggccaguagcuuucuuggccuacagguaaaagauaccuuuuugaaugauuugguggugggaaagaagguugcugugguaugcccacuuauuuaaaaauagaguaaaaccuaugggauccauguguauuuagacaacagcuguuuuaaaaugcuggauucugaaauggcagaaagugagucaaaaacaagaguauauuauuuauuuauuaagaaauaaaguauuucauaaugauguaucaccaauuuacaguagggugucaguuuaaacuacauuuauagauuguucugggggucagugaacuauagcugcuuuuuuuuucuuuuccccaaaaaaguuuuauuggaaguaaguaugcccauguguuuuauaugaucuauggcugcuuuuaagcuagaguggcugagcugaauaaguaugacacaaaccauauaccccacaagccuaagauauuuacuauauggguauuuaagaaaauauuuuuggacuauacccuggucuauaccauuaaauaacaaaaguauuuuugagacuuugaggguucuguuucaucagugaaaccccguuccagugugguuuuguucaccugaacaaugcuuauauugcuuucuaaaauuuacuuaauaucuaccaaaacauagcuauauguuuauauuugcaguaaugcuauuuaugcauagaauauuucuggaaagauuuauuaguauucucuguggaggggaguuaaugacagguugaugguaggguggcucuucauagugcccucuuucacacuguuugaauuuugaacuugguacauauauuguguuuucaaugaaaacaauugaccaaaaaaaaaaaaaaauacccuguuuacauaugccuauguauaaucaucccuuuaacgagaaauuuucuucuugagguccuugaacuaugagaauuugauaaaagcucuguaucccuagaaaaaucacacacacacacacuuuuacauauaauuagagggguuuguaguucacugaaguucuuaugggacccauggagccuuauuuaagaacaguuucuuuuuaaaauauuuccauuugaaacaagaaguuuauuauuauuaacauaaaacuucaagaaacacaucuaaccaauucaaaauuaguuugaauugauaguagaaauuuaaauagcauaacuuuuuaaaaaaagcuaaccuagaccgggcgcaguggcucacgccuguaaucccagcacuuugggaggccgagaugggcggaucacgaggucaggagauugggacuauccuggcuaacccggugaaacccugucuccccuaaaaauacaaaaaauuagccaggcgugguggcacgcgccuguagucccagcgaucugggagguggagguugcagugagccgagaucgugccacagcacuccagccugggcgacagcaagacucaaucucaaaaaaaaaaaaaagcuaagcuaaaguucuggguaaagcguucguauacauaaaauaugaguauuuauuuuacauaaacaguuguguuaguugagguuuuacgacauuuuuugaaugugaacuccaugaagacaaagauuuuugucuguuuuauucauuguuguauaucccccagaaccuaaaacagugcuugcuaccuaauagacucaauaaauaucuguugaauggacagaugaauauccagagguauaguaaaauaguuguaaggcuaagaauaagaaauauagcacaaaaauguuuuggcacaaaaacggaaauaggaauuucaauuuaagggaaacauuucuauuuguuaucuuucuauggucauucuuuucuuuuccagaguaaauggacaauauauuauggaaggacuugcauccagcuuccuauuuacaaugggagguuuagguuucauaauccuggaccgaucgaaugcaccaaauaucccaaaacucaauagauuccuucuucuguucauuggauucgucuguguccuauugaguuuuuucauggcuagaguauucaugagaaugaaacugccguaaguuauuuguguaaucagcaccuuauguugcaaauugguaaaaugauuaccuggaaaauguaaagucauaggacauuuaauuuaacuuucauuuacaugggugaaaaauccagaaaccaaauauauuuguaacuuggucagguuacagcuauaguuaauaaaaauugaaacuaauagaucuucuuaguuguuauccccaugaauguucaugagagaaaauuuaguuacuuuguccuggcaucaaugacugaagauagucauuguuucuuuuuuuuuuuuuuuuuuuuuuuuuuuuuugagacggaguuucgcucuuguugcccaggcuggaaaugcaauggcacaaucuuggcucacugcaaccucugccucccgggcucaagugaugcuccugccucagccuucugaguagccaggauuacaggcaugcaccacagcacucagcuauuuuuuguauuuuuaguagaggugggguuucacaauguugaccaggcugaucuugaacuccugaccucaggugauccuccugccucggccuuccaaagugcugggauuauaggcaugagcuacggcgcccagcugucacuguuacuuuaaaaugccuuuuggcuaaucuguaacacagaauuccaguaguauuaaugguagggaauagcuucagaucacucacuguugcugcucuuugaauauugguaggaagaaaacccauuaugccuuguaagggaaaagagaguuauugcccuucaaaaagauaggaaaaggauauuuauauauuuguguguguguguguguguguaugugugcguguuuaauguguauuuaaagauuauuuugauucagaaaacuuuucaauaucuuuagaggaaaaauaagaucguuuauggcaucuuucauaauucuguuuaagauuauuuacuugaaaugugaacaaauacaaucacauuuccauauauucuaauuuaauucauggaugcauuaguaacuacaguaacgacaggaaauuugggcaagcauaccacaaauauuagcucuuaguauuuuauuuuuaguauuuuauuuuuuagggacuguguuaaacaucaagugucaacuauacugauuucuuaguguguuugaauuuuacaaauucacuuguucugugacuuaaccuguccauugucuguaacacaccugggguagaaugggcaaaaguacaugaugaucccacaaucaucauguucccauuuuaguccuggcaggaugggagggaaagcauggaguucuuugucagcugaauaucuguguggccauauagcugcucaguuuccucuggcagcagcucuuuuuuuuuuuuuuuuuuuuuuuuugagauggagucucacauuauugcccaggcuggagugcaguggugcaaucucggcucacugcaaccuccgccucccagguucaagagauuuuccugccucagccucccaaguagcugggauuacaggcgcccgccaccacacccagcuaauuuuuuuuguauuuuuaguagagacaaguuuucacuauguuggccaggcuguucuggaacgcuugacuucaugaucgacccgccucagccucccaaagugcugggauuauaggugugagccacugugcccggccagcagcucuuauuuucauuuggggaaggcauuucuggccauuggcuaaguugugugaagacuaagguacuccagccucuuauuguuccuuguuuuucugcuccuaguggaaguaagucaccauagccugguaagguguacuuguauagaaaagacugaaguuuucauuagcagagcaagaaaagaggagacucccagauagaauaaagagguuacugaaaggcucaugccuguaaucccagcacuuugggaggcugaagcgggcggaucacaaggucaggagaucaaaaccauccuggcuaacauggugaaaccccaucucuuacuaaaaauacaaaaaaugagccaggcauggugucgggugccuguagucccagcuacucgggaggcugaggcaggagaauggcgugaacccaggaggcagagcuugcagugagccaagaucgugccacugcacuccagccugggcgacagaguaagacuccaucucaaaaaaaagaaaagaaaagaaaagaaaauuuacaaccaaaacaaaagaaaccuuuggaggcaugugucagaacagagaaaguguccugguuuugcuuauagaaucaaauauguucucauucuaccuacuguuuucauucuacauaguguuuuccuucuuuauaguuuuacguccucuuccuaggaaugagucuauuaagaaaauagguguuaucuuuuagcuuuggcauuugacuuucaggauaauagagcuaucugcuacugacagaaaagcuuugacaaguguuuaauacucuggauuaccuucaucuuacuuuugcaaucauuuaugugaacauuugucuuccuguccacauucuauaggcuaguauguaacaccguugacuaaauccaaacuuuaggcuagggaaaaaggguauacuuucuggguuucgguuguagauuauguuuagaucuaaucaaaacaggacagugguccaaacagaaaauugcuauuuucuguaucuuguaaaucuaggauuugaguuuuuaagaugaauuuaugguucccuuucugauaucauuucucaucugcagcuccuaaugccugguaccuuggguauggagugaggagagacaauggacaguuuuauauaagaaauggaaguaaugauacuaucuuuccuggaauauuugcaggccccagaggagaugaugagcaaggacuguuggccuguauuacacacaacaggguuguaguuacuaucccagcaaggaaaggguguaucuuucuucuuucaugcaaauuaucuaugaugaccuaacaguuugauuauagugaguggacuaaccacaacaauaaaaaagaugucaaaaaaacaccaauagccacugguuuuuccaaaucaacuauguuucuagcaucugagauaaaggauggcuguaucauaagaugcaccaugauaaccuccaggguggaauucuuuuuuacaaagauguuaccuuuagcaagagaugccuuugaaaaggagaaaacaguagcacugaaacaguauuacugguucuguuuucugauuuaugcuuuuuugaaagaccugauguuuccccuauugauauaauuuuacuaauuaaaacauguuuuauuugaugucuugaguuuugaagaaacgucgaaaaugaaugacuguuggcugggcacaguggcucaggccuguaaucccagcauuuugggaggccgaggugugcagaucacuugaggucaggaguucaagaccagccuggucaacguggugaaaaccagucucuacuaaaaaauaaaaaaauuagcugggcgugguagugcacgccuguaaucccagcuauuugggaggcugaggcacgagaauugcaugaacccaggaggcagagguugcagugagucgaaauugugccacugcauuccaggcuuggugacagagugggacuccaucucaaaaaaaaaaaaaaaaaagaauaaagaaugauuguuuauuagcuuugcacacauagcaguacauuuaaaaggaaaaaauuaaacguagucccuaauauuuuuauuaguacagucucaaaggaguaauuuucauugugaaaaugaaaauauucuaauauaauuuaugagauaauguaugugaaaucauguauguaugcgucuguauguucacugcauuuuaaauauacauagacucaaaggaaauaauguucgguuacugaguagaagacugguacacguuugaacuugauucuucugaaaaaauaaugaaucuucauuagauugucuuuagccuccacucuuagggcagcuuuaacuuaaaagcagaaucuuuuucuuuucuuuucuuuuuuccuuuuuugagacagucuugcuuuaucacccaggcuagagugcaauggcgcggucucggcucacugcuaccuccgccucccagguucaagccauucuccugccucagccucccgaguagcugggauuacaggcaugugccaccaugccaggcuaauuuuuguauuuuuaguagagaugagguuuugccauuuuggcagaggcuggucucgaacuccugaccucaagugaucugccugccucagccucccaaagugcugggauuacaggcgugagccaccaugccuggccaaaagcagaaucuuaaaaaaaauaaaaauaaaagguggccugugguggcgugguaaugcccuaaagucaggugagguguucaauuggagauggagggauggguuccuacauucaggcaagucuguuauaaagcuguauaaaacuacuugaaauagauacuaucagauaauugaggacaaaaggucugccuuauuucagcuggcaaaaauggcuuuuuagcaauuucaccuaguguuuauuaagcuugagaagaaaagcuaaggaucuucuggauaaauccugagaucaugggaucaguucagaaaacaaguucucuuaaagggagaaaggaauaaaaaauaugaauguaauaauauuuaaacuaacaucauuuagggaaugauaugcugcauauaugugauuccauguaauugaaaauacauaaauacuaaaacauuguauucauuuucgacagacccucuuucuaaagcguuuguuguguuguauuacacguuaacacucauauuuguauguagcaaauauuuauuugauaacuguuacuugcuggacacugagauuaaacauaauuuaaccuucuccacugaggucauuuuacauuucuguuaugcauaguacuacuuuucaguuuuguugauuucacuggcuugucacuugucauggugaucaguauauaccuauuguaauuucauccuuucccucuucuucuuuucaguuugcugguuauucuaugacuugagggaauagauaaccuagcuauuaauuaccuuuuaaaucaguucuggcugaaggagagcuuaauggcuuggcuuuguaaccauacuuucagauguuugagaaucucuuucauuuccuuccagauuuggagcuauauuuuagagaguuaaggcuguagagaaacuagcagcuggauuguuucagcgacuaaaaagcugauauccgagguucauuuuuagcaaauaagggacguaauucauucuaaagaaacaaaacauuuguacagcugcugaggacaauguguaguagagagggugaggaauuuggaguccaguuuuggccugccacuuaauagcucugagacuuuggauuaguucugugaacucucuuggccucagguuccaaaccuguuaaaugaaguauuaauguaccuuggggaguuacaguugucaacauuaaaugagaaggugugcucucaaucauaauguaaguguuaaucaaugucaguguuuucauucuaaagauagaguccuaaaaguucuguuucaaguuagauuauggccacaguuucaaaaauaaaugaauaaaccauuacuguuuuuguuuuguuucguauugagacggagucucgcucuguugcccaggcuggagugcaguggcgugaucucggcucacuacaaacucugccucccagguacauaccauucuccugccucagccucccuaguagcugggacuacaggcgcccaccaccaugcccagcucauuuuuuguauuuuuaguagagaugggguuucaccguguuagccagugaucuccuaaccucgugauccgccugccacggccucccaaagugcuaggauuacaggcgugagccaaggugcccagccugaauaaaccauuacuguuucuaaaagaagaaagugagguuuccauuucuaggaccauuggaguggguaguagaccaggagugaggagacuuguguuuuaaugcugguuuuguucuuuucuggccuugugauuuuugagcaaacgacuuaauugcugucacacucuucaucuguaaaaugagacuaauccuuguuucacacaccuuuuuaagauuguugcaaggguuaaaugcaauaaugaaugugguaguguuuugagaagcuucuauuagugcuaaccuagcacagagcuugccuuaauauacagaggcacugagugauuauugaaagaauggccuuaaagauuaaauagaagguccuucaugguggcuucuccugucucuaguugguuuuugaguucuugauuuacuuuuuauuguauuuaucuacgguuuuacuuauguaaaauucucacaggccugaauauaagauuaugaaauuuucugggucaagagagggggcuaaaugauugaguauauauuauaguaaguguauuucaacaauuuuauuuuuauuucuuaucaagaaguauaguaauguauuuguucuucuuuucuuuuuucuaacaugguaucguuauaacauuauaauauuucuuaguaucucccaaauuguccuuaagguaaaacuauuuuaaguuuggcagcuuugaacaggacaugucuauuuaaauauucuuuucuaucuaaauauagguugacaagcaugggucacccacuaguuacaaggaaggauaccauaauauauagcuauauuaagagauagaguacaaaguguauauucacauauagguauaugcaaauuacaagaaguuacuccuaaugagucuuuaguacucuuguuucauaguguaagcuagcuguuggguaacuucuacuacagagugcagauauuaguggaugcuugcuuaaaaucuucuugaaccuuuuuuuuuuuucuugugaagcuuauguuuuaaaguauccuuuuugugacacaucaggcauuauaguagcaaauuuaugugaggucuuuaaauucaauguauauauccaaagaaccuuuuaauuuuuaauuuuuuuuuuuuugugggggacggagucuggcucuguugccaggcuggagugcgguggcaugaucucgguucacugcaaucuccgccucccagguucaagugauucuccugccucggcguccugaguagcugggacuacaggcaugcacuaccacacccagguaauuuuuguauuuuuaguagagacgggguuucacuguguuggccaggaugguuucaaucucuugaccucgugauccgccugccucagccucccaaagugcugggauuacaggcgugagccacugugcccagccaaaccuuuuuauuuuuaaauuuuuguucaguuuuggauuugggaggaggugagaaguaucugguugucaaggugguuguguuagaugaaaguucucuuuacucagaguguguggauuggccaggcugauacagcagaaagaagagugugugaguucuagguugauugcauuggcugaacauaagucuaaucauacagggagucaagugaguucagaagcugaaagggagggaagucacauuuuugaguguuugcugugugccaagcacuggaggagaccucaguauugucaaguaguuuuuaaaucuuacguuaccagugaagaaacuugggacucuaaaaauagcagcuaacauuugugaagugcauguaacuacgaguagcaauuacuauaugaguagauucucuuauaauccuuaaaacccuuugagguaacuccauuuuacagaugaggaaacugagugagguuugccaggcucaugcaguaagugguagaagcagggucaaaagaagaggcguucugaagccgucagugaguauaagguguuguaaaccuuuuuuuuuuuuuuuuuuuugagacggauucuugcacuguugcccaggcuggagcacgggguuucaccauguuagccaggauguuuuguguuuuguuuuguuuuguuuuguuuuuucuuuuuuuuuuuuuugagauggaguuucacucuguuugcccaggcuggagugcaauggcacaaucuuggcucacugcaaccuccaccuccuggguucaagcaauucuccugccucagccuccuaaguagcugagauuacaggcgucugucaccacgcccagcuaauuuuuguaguuuuaguagagguggguuuucaccauguuggcuaggcuggucucgaacuccugaccuggugcuccaccuaccucggcuucccaaagugcugggauuauaggcaugagcuaccaugcccagcccaacccuuucuuaauguggauacuuguacauaauuuuuccauuuuuuuuuccugauccuguagauucuuaauuaauaauagacuuuaaggguuuauugccaaaggaaagguuuggaacuuuuauaacaccagauuuaaugcuuuaauuuaaaggggauuucagggccuaacuugcacauuuaauaaaaggaucuccuguuugaccagcaugaaguuugaccuuaccagcagguacagcuaaagcuccuaacuguuauccagacauuuccugaaguauuagagguucaggggcagauguuugugcacacuuuuuugaagucucagaggcucaccucccaguccugaauagcuucugauucucccacuucucuucugguaauauuagaguuuuuagaaauccaaaccaguuucuuuacauaaaaaaaauuuugauuuuguugcacuucugagagccuaaaauagauugauucugacucuuaacuuuaacuuuuagauaucauuuucuuuucuuuacuuccuuuucuuauucuguguuguuuggcauacugcuuuguaacuuuaagagggaagggccaggcgcgguggcucacaccuguaaucccagcacuuugggaggccgagguggauggauuaacugaggucgggcauuugagaccagccuggccaagauggugaaaccccgucucuacuaaaaauagaaaaaguuagcugggcgugguggcggucaccuguaaucccagcuacuugggaggcugaggcaggagaaucgcuugaacccaggaggcagagguugcagugagccgagauugcaccauugcacuccagccugggcaacaagagcaaaacuccaucucaaaaaaaaaaaaaaaacuuugccgggcuucacgcguguaaucccagcacuuuggaaggccaaggcaggcggaucaccugaagucaggaguuccagaccaaccuggccaacauggugaaaaccugucucuauaaaaauacaaaaguuagccaggugugguggcacgcgccuguaaucccagcuacuugggaggcugaggcaggagaaccacuugaacccgggaggcggagguugcagugagcugagaucacaccauugcacuccagccugggugacaagagcaaaacuccaucucaaaaaaaaaaaggaaaaagagggaaggauaguagaacugaggcucaguaauuuauuuguauauuggggugaggggggcaaaauaugaaauaaggaccauaauaaagaaucacgcaauuauauuuuuggauuguuauuugauauaucauaaaauuuguuuuggcauuuugaaauacuaugauaauaagagaauauaaaaacaauucuuuucacuuuuugugcuuauaauuauauuucugcaggggcuaucugauggguuagagugccuuugagaagaaaucaguggauacuggauuugcuccugucaaugaaguuuuaaaggcuguaccaauccucuaauaugaaauguggaaaagaaugaagagcagcaguaaaagaaauaucuagugaaaaaacaggaagcguauugaagcuuggacuagaauuucuucuugguauuaaagagacaaguuuaucacagaauuuuuuuuccugcuggccuauugcuauaccaaugauguugaguggcauuuucuuuuuaguuuuucauuaaaauauauuccauaucuacaacuauaauaucaaauaaagugauuauuuuuuacaacccucuuaacauuuuuuggagaugacauuucugauuuucagaaauuaacauaaaauccagaagcaagauuccguaagcugagaacucuggacaguugaucagcuuuaccuauggugcuuugccuuuaacuagagugugugaugguagauuauuucagauauguauguaaaacuguuuccugaacaauaagauguaugaacggagcagaaauaaauacuuuuucuaauuaauaccuuuu

SEQ ID NO: 13845 - RNA, 1024 nt, Homo sapiens
ugucuuuuuuauauggguauaguauucaaaguuucuguggugaauuacagcuuuaaaaaaacuuuuuuuuucagugaguuguaaauguagcugauugugggaggagguggaauuaauauccuuccccuuaaaacauauuuuuauacuuuuuaacauuguaagaacuaucugaugauagaacucucacaggcaaauaacuaucaucauguauuuuugcaaguaauacauuuagcaaagcaucauuauuuggucaaauauuuguauuuuuaccaugcuuccuucauauuuuaaaauuuguuuuugaaaaauauauauccuagcagaguuccuuucaagaaaaggaaauuaauuguguaggcugugaugaaagaccugagaauguuguucuugcugaauuaaauguuuacuuuaaaaaguuugaaaagcaaaaauuucuaaaacauauccaaauuuaucuagagagcuuauugaaaauacugucuuuauuuuauuuuucuugccuggcaguuucccuccuuuguguuggcuggugguggauauuuuaagauuuuuuuuaaugcuguucaagcguacuugggaaaaagccuuuggcaaguguaguuuuuaaccuugaugcagaacuuuauccuuccuuuaaauucuucuccuuauuucuguuaccaguuuuccauaagaugagaucucugaaacauuaguguauuucugcacagaaaaucauuuuggaugauguuaauggaaaccuuauuaaaugggagacugauuccuauccguuuucucaguuguucccuccuaauauggaugaggaagccaauaauaugagaaaauucccauugugaugguuugcuuaggaauauaggcagagauuuuaaaacaugauguguuuugcuuucauuuaaaaaucauuuaaaaagucaagucuuaaauaaaguguuauauuuccaauaauuacuuuucgugaaauuccuauuucaaaauugcuuugcaagaaaaaugauucacuuuuuuuuuuccacccgaauauaga

SEQ ID NO: 13846 - RNA, 76327 nt, Homo sapiens
ggcggcgagucgggcgcacgcgcacccccugcccgccccuggcgccccuccccgcgggcggugcagcuaccccugcagcgccuccccuagcuagaagggagcgggagggggcuccgggcgccgcgcagcagaccugcuccggccgcgcgccucgccgcuguccuccgggagcggcagcaguagcccgggcggcgagggcuggggguuccucgagacucucagaggggcgccucccaucggcgcccaccaccccaaccuguuccucgcgcgccacugcgcugcgccccaggacccgcugcccaacauggauuuucuccuggcgcuggugcugguauccucgcucuaccugcaggcggccgccgaguucgacgggaggugagcugggccccggggcgcccucuccuccuucccgcgcuaauuucacacucacugucuugggucacuuuuccccgcgggguuucguggucagagaggcgucuccuccauccagaaguugggccaccgcacagcguggcgcgaggagagcgguccagcggcuccgagugcccgcccgaggcggagagggcgcgcccuugcgagucugggaccccauccgcggccccccgagggcgacucgccccggcucgggaauuaggacugagggagaggagccgcuggagccugggaucucggcucugagggcgcgguuuagccaccuacgccgaggugacgcgcgaaacaucccuuacccgggaaacucccgcgccugaacuagacggcucuucacuggggaagcuuccaggcccccggggggaggcccgggcucugcucagggcucucggggccgcucacacagagagugggugcgagucagcgacugggcuacgggggagauuugugggccucuccauuugguuuucuugagggaaggagacucaaaaugaggaccggagggugggcgcuccgugaaugugagcaugaguguguggaugugugugugagagcgcacacacugcgccgcuccucagacucgggcgagccugacggcggcgugcugugacagguuccaacaaccucgggccgcgucuccgcugucacucagccgguccucccgcgcuccggggccgcuccggugugugagagacacugggucugucgggagggugugcucggucccccucaccucugugcaauuacagacuaggcucgucccgggugcagauggcugcugcgaaaagagguuuuacucuggcgcacaccgucgcccggucgccuuccuucagcgaccucugcccccaccccuccguguaggucccugccuaguccuaaagaaagaugccgcaccuguuuuaccuuuaaucuuggaacgaaucaauuccacaauugauucgcuuucuuguacccggaggcgaacggaggggaaccaguggagcgccaagaaaaagcacagcugcuuguucacuaccuggucggaggaaauagaaaguucgggguuauuuuguacuuugggccuggggguagaaaggcagguaaaagaaaaggggaauugaaaaagauaaggagacuuuaagaaaacgugauagcagccagaguguagaccuuuuuauuuuauuuuuaaaagcaauucugugcucacauuuggguauguuaugcauuucuugcacacauauuugcaacaagaaacccaucacaagauaugcauaugaugugaaugcauauagcuuuuuguaacuuuaaaaagaugucuaaaacagcaaauuaaaauguugauacccagaggaaaaaagucauuuaggugugacucuaaacaaggaaacaauuuagcaaauaaugugucaacguguaaucagguggauaaaucuguauccugaaauuacuuucuuuaggcauuauuuacauuagagaggaaaauacuaugaauuguugaucuaagcacguuucaaaccacaaggauacuugagauaucagcuacacuuuaaacucuccuugguuuuauuuagacuuuuuucuaguacuuuuuuguuuuuuuuguuucugccacaguuaugucucaaaaagagcucuguuacacuugauuuuugagaaaccuuucugcuccuucccccauccaccuuuuauaugaggcagaaauuuuuucugcuuugacaugucuuacuuaauacuuuucaguuuauggugaaucagucaaaccuggcuuucaccccaguaacaggugugggucuuugaggaaucuguuuuauuucaagcuucagaaacuauccugugaguggcagccuugagaauuguugguguuagcuggugcuauuucuacuuaagaaagcaucuuucccucccguuuuuucuccuacccuuguguguugggggaugggguauuuaacugucugaaauuugacauuagaucauagcagaacuauuucugugaagguguuuuaaccuuaaauuucugcaggcauaaaagaguuuguagaaaauuguugggugugguugacauuuuuucugaaguaauaauacagaggaaauuaccuuucuucucaaaaguguccuuauuuauuuugaaucuuuuuuuuugguagguggcccaggcaaauagugucaucgauuggccuaugucguuauggugggaggauugacugcugcuggggcugggcucgccagucuuggggacagugucagcgugaguaucaagccuggggacuucaguucccugggagguguggcuuuccaccuuguucauggcuucaccccacauaucagaggguucauuacugagcaaggcuuggccuugcaggucugacuuggggauuuucagguacaguccagacuccuuauucugcuucuuuucagcuuuagccaccuguauuacggcccagcuuugucauucacagagagccaccuuaaauguuucuuuuagcauuuuuccccccaaaucugcaucuccuuccuguuuucuuaccagguuuauuucucucucucucucucucucugucucucucucucucugucucucucucucucucucucucucucucucucucucucucucucucucucucgcugacucgcuugcuccaggcugggagauggggauaagauaaugagucuagaccguauuuacacuggggauaagauaaugagucuagaccguauuuacacaaaauaaacucugaaccuuagaguacuuauauaauccucaccauagcuguuguguaaaguggcccauuuguaaauccuuuuuuggacugggguuguauugacaguguuuuaaauggaccacccaguauaaugaaacaaagccacugaaacaacauuauuuguaaguucuauaaguaaccaaccucauguaauaaguaccaaaucagaaagcugauuuucaccuuuucugugaccacaaauggauauuuuaaugguaaaauuuagagcuacaucaaaagaguuugagaaauuuaggaaauuuguccccagcauuuuaucgcgaucuuaaaauuguaucucacuccuacugcaaaaaaauagucuucaaaugaucaaguaccuuuccagagcacccuuagagugcuuggggcggggguagggggcacuucugguaagaugaugggaacuaaguuggguucuacauugggauauauauuuuauugcuaaugaggaggaggcuuagaggaagagagaagggcaguuacgaaggcuagagcuggcaauggagaagccugccuuagagauggguugcuagugugaggagucaggcaaauuuaaguucaggaaaguuaggaguucccucugcuauuuuaauuuuugaggaugcuugcaaugucuuccuuaauuuugugaaagagggacagugacagucacagauugacucuaauugcacauaaagaccacaaucucugguugggaauagaaagguaaaggaaaugaauguuugccuaccugguauggaauuugagaaccaacagauucuaauaaccaaaaugugaagaaaggacccuucuguuggcccaacacaccuacacauaacccuccugagugaaaaaugaguaguucuauaccugcagucuccagcugugcaaauacuucugauacuacagaagacuaaauuccaccaggcaccauucuucuuuuuugaucaucuucccuuaaaacaauauugaauagacuaaccagugaguguacagcagcuuugccuacuucuuuuguuuacuggaaacuggaguuaccaccaucucccuuuaacagaauguaauugaccccccgugcaaagggucuagccaagcagcucgcacauagcaguuaggcaaacauucguuugcuucaccuuuuauguuuauacuuccaaaaucaaaguaguuccaagguuuucuauguuacagugaaauaaaaucccuuucaauuaaaaaggcacaaaugguucuuuacuauuaacauugaaguuggugagguuguaaaaauuagcucaaaggugaauguuuccuucuguguauuuuauuuuuccagcaucuuagauggcgcaaaugucucuugucaguucagaguucugccugucuuuguuuugauauaagcagguagaggaauguggggcugagaaguaagcuugaaggggcagaacaaaccaaaaagaggcugaucagauugaaugaaauaucucugaaaacucuugauuauuuuaaagaaagucuuuaugaaauuaaaaguuuugucacuacguuuguucaagaaaaugccuugcuauuguauaacaauucaaucuaauaugauuccuuauaaagauuccaaagaacuucuagcgaauuuaaugugagaaauguuuuugccuuuucgaccuuuagauaaucauguaguucuuucccauaaggaagggcuauucucccuuccucaucagaggugcucugguucucuucuuuucugaaugauucacuuuggaauuuuccuucaaaacagcauagcaaaacaaaaagaaacuauucccauuacugcauagaucuucccaacuuaucccauagaagguguguuuguagguagggaaagguggugguacccucauuauauuauuuaacagaccuuaugccuuagugcagugacccuuuggugaguguuuauuccguuugguugagcauuugugagauguuugacuuaauauucaugugagucaaauguacguaucuguacaaaacaugcugcccuucauuuucacuugcuaucuuccuauccauggucuuguuuggagaaaccgacuaauguugcaggaugcuaaagcugguagaccucuccuucuggcucacuaugucuaagcagagccagauauagcugggaaacuuuauauccuucccucuaggacucaggaaggaaggaucagagaugcuacucaaaugggcauagaaccuguccugcugcuuccugccuguaccacccaacauucuaucccaacauuccugccugcuagggaaagcaugacccguuccagaaauaggcagguuguguuuucauaguucuuuuguaggucauacccuugguuguuuuuuuuuuuuuuuuuuuugauucuuuguuuuguguucuugacucuuaaacagaucucuagcauauugaaaauucaacauuugauuuucuaacugucaugggcuuuacuuuuauugacuauugauguggcuguuuauugucaggugaaaauuuuuuaauauguucacacacugaugauugcauauuugcagcacacagcaucuuaaaccacucagagguuugucacaaaauguguguuucuugcucuguaauuuuuuugucauuuugauggcauauuuuaauuaugcuuuuauuucucuccuucuaccaaguggagaccucuguaacaaagauuuuucaggguugcauauuucaucuuuaaaagcuguguacacuguggaaacaauuguuaaccaaaagcacuagauaauuuaggauaacugaguucaaguucugacuuuuguaccugaauaggugucuaacauuucucagcuacaguuuucuuauuacacaagcauauuuccaagguauguugaagcucuaaacugcaacugaaaacuuccuuaauguagaaaaacuauauaggaucuaaauauuguauuuuuguaugguuguccuucuguuuacucggagauuugacuguauauguggcuuaugacaauagcauuuuuguuaaaagcauuuuauagaagugugaagaaaaacuaaaaauacaaccaguuccaagguuuaacaaaacuauuccguuucugaguucuuuggcugucauugagcaacuugugguuucugaaggaaauuaugugaauuaggaugguuuuguaucauuuauccuuaagaacagggaaaauugagauguuuucuuauguuucugcuggagauuuuggaaagaugugaaaccuacaccuacagauugaccuugcuuaguuagcucugaaccuccugcugccucuuccacguaaagugaaaauuuuggauucuuaucggcuucagauaaacuuacagguuagugaaacauagggacugagauauaguaauucauucugaagcuguuuuggaguggucaaauaauuuuaguuggauaauauauauuacuggcuaaugauuguggauauuggaagugaugaaaaaauuauugaauuauuucuuucugcauuucaaaugaaaaggcuauuaguuugagcagagaauuuugauuuaguaaacaaaauauuuaaauuucauguuucauuucuuucuccuaucuggguucagauacucagucuuauaaauggaacaugauuuauuuuugcucccuaaacugguuauuaacuuccuguccauaaucacaaaacuauauagauuauauauuucuuugauuauuuggauuuugaauacucucuuuaaaauaaucaagagaaaauuagagcuguuagaauguuagaauuuguuuugaaggccacacauaguguucccuccacagagagguuauacuaguaaaugccuuucuauuugaggucaacaacuaugacaacuuccauugaacaugaguuaguauuuuaaacguaaagcaauuuuuauaccuguaugcacccaaaaaguaacaggggcucucaaaagggguggggauuguacuguuuacauguauauugaagauugcuagcagaauucuggggccagcuugguggagcggaguacacuucauuguccuuaguguaguagcuuccuccucuaauuuugaggugagaaugcagaaucuguuuuuuguuuguuugcuuuuagguaggaauaaaagcaaggcaaggaauaauuuugauuacuugcaacauuaaacuugaauccacaaauccuuaggaagugaaguuuuugauuaagauuauuuaacugccacuuuccuugaaagguuguuuaagaacaucauguaccuuuggguaacuucaaguggucuuggaaugcagauuccaaaguaagaucagcguugaagaaucuugaccuuuucaaacagguaauuuguuaguauguguagucuucaaaguuaaguuucagagaaauugcuuugcucuuuuauucuuuuccccaaucagaacugaucuuuauguaauacuauuaagaucuacuaauuuccugaaaucccuucauaagcuuaaucuggccaggucuuaaccuuuauggauuagaaauuuuaguacuucuuaagcuagaaggccaggccaacuaaagggaagcacucuccucucugccaguucagcaacuagaucuguccucaaauaccugccacagggauaugcugcuugaaguugcccacgcauguacacacugggaccaagaaggcacuucuggugccagaaacaacacuguguuugcuuuguggaaauuuuugauaugcuuuaaaaaauguaggugucuucucccucaccuccuguguguaacuuccagcauuucuuuuuguugcuuuuuaucuacagaauucauguucuuugcauuuugaguuaguugaauccacuguaugcuuuccagaugauaauuagugaagcucaaugauucuaugcagugucuuucaguggguaagggaagauauucaucacaggggugggccuucaucacaggggagauggaagggcaagggagagggauucugauggccuaacccucauuauugccccccacugccacaugcagacacucuugccgcuuucccauugauuuugugcaauauuuuaaauuuuuccaccaaucuuuggaaaauauuaauuuauuuuguaggagaaaauguauucauuuccuuaaauaucccuccucagagcaacaagcaugauuaguuuuugguauacuuuaaaaaauauuuuaccuacuuauggguaaauugcaauagaucucuccccuaucacccacuuguuuuguacaaaugaaagcauacuauauacacugcuuuguaugcugcugcuuuuucuuaacuguacauguugaaagguuuuauuuauagaccuucuuacuuuuuuuuuuuuuuuuuuugagauagggucuugcucugucgcccagguuggagugcaguggcauaaucuuggcucacuagaacccuuaccuccugggcucaagccauccucccaccucagccuccugaguaguugggaccacaggugugagcgaccacaccuggauaauuuuuguauuuuuuguagugacuggguuuugccauguugcucaggcuggucuccagcucugagcucaacugaucugcccaccucagccucccaaagugcugggauuauaagcgugagccaucuugcccagcugccuccuuacuuuuuuaugcacucagcauuccauuguauggcuauacuguaauuuauuagcaagucucuuacugaugaacauuuauguugauucuaauuuuuugcuaacacaagcaauucuaaaaaaacuuugaacauauguuaaagauguuguuuugcauguucuuaguguuucugcaaaauaaauuuuuauauguggucaaauggcagauacauuuguaauuuuuaucaauugcccaaugacuucuuacucaguagagaagauaguuuaaggggaaagacugaauggcgaugcugacccaaaggcuccaacaaucccauauccagagucugaucuuuccuugauuuuaggauucuuugaucccuuuucuuucccaagaaaucccucugacaacucagugaauguccaucugcucccaucaucuguuucccaucagaccagaggcaaugggcugaagcuaggagaauggagugagauguguccauuugccagggucucccaguggcuuccugccuaucauuuacuuguaagaaagagccacgcauuccuuuaggaauugcuuaauucauugaucuuuuauuaucuuuguaguuuagccauaauuuuuuuuuucuuugagacggggucucacucuguugcccaggcuggagugcuguggcaggaucucggcucacugcaaccuccgccuccuggguucaagcaauucugccucacucucucucgaguaguugggauuacagguguacaccaccacaccuagcuaauuuuuguaaucaacugauggaguugauauccagagacaagauacagagauucuguaucuugauuuuuaguagagacagaguuucaucguguuggucuggcuggucuugaacuccugacuucagguaauccacccaccuuggucucccaaagugcugggauuacaggcaugagacaccgcgcccggccauuagccauaauuuuuauaccuuuguguauaguaugggcuuuuuuuuuuucuagacuuauaaccuauuaaggaggaauauguagaauucugagaucugaauaccauuuuggggacaccguuuaugauaaaaagauuuucaggaaauauuaagacauuuuuguaccaaaauacuuuuuguaguguccuuaaaaccauaggggcauauauuuucuaauaguuauucuaauccuuauuccaauuauauacuuaaauugucuccuuuuagaaaaguaagaaaugcaugauuaggugaaaaauuaaaagacacauacuaagagcaagacagcagugaagguaaguauuucuaacuuuccuguuuuccugacaccuaguuccaccuucccacaggcuaccacuguuuccuauugauccuuguagagauuucuuaacauuuucaaaauuucccuuuuucauaaaugauggcaugaaguacaaacgguucuguaucuugauuuuuuuuucauguaacacuacguuuuggaaagcaguccucauuaguuuauuuaaaccugacucauucuuuuaaauggcuauacaguaugccauuacaugaaugaauguacuauaauuaauuuaaaaauccccuauuuauguaccuuugagugguuuucaauauuuuguuuuuacauaacaugcugcaaucaauauuugcauauaucaucaucacuguuguauaccuuuagauauggaggacauaucuaaagacauuugauuucuguauuaguauaguaauugaagagguuucauuuuauugcuacaaauuuucuuauguuuaaucuguaauguaaaggagaguaaaucauggcuaauauuacagaguagaaaccuucuguucagucaucuucuauuuuugauuccuuagaagauaccuuaaaagauaaauuaaauugauuucuuuauuucuauuuguuuaugcccuaucuuguuugggaaaguauauaaaguggcuuccaggaauucacacaauuaaaauaaggaaauaggggcuacauggaggaaaauggggguaaaauaaaaauauuaggaggaggguuuuucaaaugcagauauguaagccauaggauccuacauauguccuacaauuuggcuacuagcuucugguagccaaagguaaaagauguuauugcugauuuaauuuguguuguuugucagggaaaaagcaaacaaguuaugugggaggaauuaugguuuuacugcauguaguucugaacgaagacuuucacguggcccuuuacggagugggagugaaugaugggauggaaggggccacagcaacauuccuaucaugaagccaguggugguuuuugaaaagcuguuucauagaagauccgucaacauaagaugaggcccuuacucuaaaaguacaguucacggaaagcuguucuauacauaguuuaagaagcauuaugugcauagcuuucugacguucagcuagauacagcccagaauaucuagcugugauggaugaacuguauaggguuuuggauggacagcucuggauuagacaagauaguuucagguuagaaucacuaacaauguucugaaguuugcuguauuauuuaacagauuaaaggccaguucauuuugucuuucuuuuuuaagucgauauauuuugaagaucaguaaucaacuaauggaguugauauccagagacauugugaauagagcagggauagggccccgccuaggcuccaguaaaaggaggaucugcaaagaaauuagugggagauuuuuuaauaucaauuuuguauccauuggauagcaauauauaaauucaccaccauuuugcuauauacauauucauuuccaugccaguuauggcuuggaauaaggaggaaaggcaugaacauuguucccaggcaucauuuacccuacugaugcugauacauggauaugggccagugagcccaggaacaacagaaucccugaccagugcuuauuuccccaaaguuccugauugcuauagguguuccggggagucaaaguaaccucaacuguuuucuuaauucaccuggauuuauaaggguugauuuauauaaguugcuuagaccugaacagacucaaagcagagucuguaggaaauacucugcauaucaacaucccguacccaaaccuaagucaucuuuucacuggggugugcggaagggcugauucucauguacucuugaagcccuaggcaauagaaccugaaauccugaugcacauauacccuaggauaauuucucucucaaaaaaaagcaaauagugauuuuaaaaauuaugacucaaugcauauucugagagugcagcaauccaguaagugucacaucuccuugggaggaacaaagagaaggucuucaaacgccuuuucugcagagacuagcgugaaccaagaaucucccugucugaauugucaccguauaucaacguggcagcgagcugagaaaguuagcauugccagggccgagguuuucugucuucacgguaacaaacaaaugaucaguccucaaagauaguaaaauguagccaagauaauuuggcuugaaaaaaauucaaagugaugucaauaaccagcuacaaccauagaaaaauacuaguagcauauugauggugcaucccugggaacaugccagggcaaauuggggugcaaaauacaccaguuauuuaaaaauugguauguuauaagguaaagaauucauuaaguaauaucaaauacaaauaaacuuuuuauuuugauucacuaaaacuucuuuuuaaguuuucugauuuuauuacuuaauuacuacugauacauaauuaaagaauuauggccauaauagaauuccuaauaaaauuucuaauaaagccagaaugaaggaguauauuacaggccagacaugauaaagcauuaugaugugugguaaaauagugacaucuauuuuuucauucuguauuauuuuauaaauuuucuggagaauuucaguuuaaacagccugcugaaauacuguuaaaucaaccuguuauucuuaacucugaugggaggaaacagauaugaauaauaaaaaugauuucuuagcuuuagaauauaguuguugcuuuggagaacaaaccguuuuauuccaauuauuuuuuauuaggagacuucauuuucugccauacauuagcuuugguagauacuagaugccaggggagugcaaauuugagaauaaggauuuggcauggguuauuugcauguugagagucaagauuuaacuaaauuuuaaaaccaaacacuucauuugaucaauaucuuuuuaaccauucuguagauuaauaauauaaauucuccagagcugacauuacuuugcuauaacaucaucagaucacaagauuaggguugccuuuuguagauguuauucacuuacucugaaauguuaggaaauaugucaucacaguuuaaauuuguaguaauauauacaaaaggaaaacacaacuaggaauuuuggauuuaugcuuacuuugccaaaaaccauguugauuuucaaaaaccuuuagccuuuuuuuuuuuugagacggagucuuccucugucacccaggcuggaguguaguggugcaaucucggcucacugcaaccucugccuccuggguucaagcgauucuccugccucagccucccgaguagcuaggacuauaggcacccgcccaccacaccaacuaauuuuuuguauuuuuagcagagacaggguuuuaccauguuaggcaggauggucucgaucuccugaccucgugaucugcccgccucagccuuccaaaguacuggcauuacaggugugagccaccgugccuggacuaaccuuauuuucguaaaucaaaguuccuaaauucaguuucuaaggaaagccccuaaguggucaaagguguguguugcugaauuucagaaacaaacuccauggauggacuuuccagacauaaacuucccaccaaaauauuguuccaaaguguuuagugccuccuauuuuauuuuaguguuaagauuuuguagguacuugguaauuaucagcagaauauuuacauaccaacaaauagcaaagccauugauaauuaauagaaaaacaaaaucauagcuuauguuuaguuguauuuuuuaguguauuucaguguuuagaguugauuuuauauugcauauacuaacugugguaauaguuucuacuggauagauuauuucaaguucacaugauuauagaaguauuuuaugaaguuugacauagauaauggugguuucagggucccuugucucuuggguugaguuuuuacaucauugaagaauuaaaagauugugucuuggugucuauguauggccaagaauuaagacauucugauguacaguuucauuuucuaacuaaggcaaaaauguuuuuugaaacaauuacuuuuuaggauaaaaguauaaaauuaugaagaaauaauguguagguuugcuaaauguuguguucuuaaaucuuguguugaggucugaugaauuuuuuuauaucuuuaauaguucuaaaguaguguacugaaaguuaggaucauccauguugcuacuuaacuuguuguccauagggucuguuguccuggauguugguguuauaaauguacagaguuagguaguuuucugugaagaguuugcaggcuaauaucacuguuuuugacaaugaaaaauauagcaugaaaauuaagguugggguauggagaacuuucuagagcuauugcuuuuucuagcugaugauuaagguugagaggcagaaguacauugugucagggaggaccuuucccuuuuaugcaugcaccuggcauuuaucaccuuuaacaaagugugugugucaugcugugcugcuugcuuaaggggcuguaugccuccagucugagucacaugguaacugcaucagcagucuuagccuguagcauuuuauuauuucuuuucaaaguuuacacuuggccuaauacuuagacauuuuauaauucuuuacaguaaaugaaacuauacaugagaagaugggcauaccuuuggauuaaaaaaaaaaaaggcucaguucuuuaaaguuucuuauccuugauuuuccuaacacgguccaaaguucaggacuggcuccaaacccauaaaccuguguuuagcaagcaagaaacauaauccccagauaguuuaguuucucugguuuaugagucacaauuucauaaaaucaucagagugcuuauuaauuccaaccacguauaguaaagaaccuucagaugaacugaagcaaggguucuuaggcaaguugccggagagaguucuagaauucuaaacuaccugaguagcuuugcugaaauguugcuuguauuugcuacuguggccauuuuaugauggccauagagcaacagauuaucaagagaaaaugagacagauuuuucuguauuaugugcuaugaaugaauccuauuuuagugaauguuuuaaugggguuuauaccgcaaaaaaaaaaaauuguauguaaggcauuuauuucuggcaacuuucauaaaaauuguugugaugguugcauauaaaaauuuccuuauccuucaauagaggauaguucccagaaacuuccuagaaguaaucuauuccagauuuaacauugcuuugacauaaaaugcaguuuuguguaguuuuaaaaugcaaauuaaaaaauauaggacauuggcuaaaauuuuaucuugaagucggguauauauugauaccauaaaacuuacuagaucuauguauuucaaggcuaauuuaugccaaguaggaaaaauaugacccaaccuuaagauauuacaaggauaaaauagacuauacaaaacuguuuggcuauuugguacuaauacaacuaguuagaacauaaugauguuugcuauucuuuauuaaguuguuuuaccuuugcuuacaauaauuuaaaguauuuuuccugauaaauuugaugacucaaaauuggcaauuaaagaauauuaaagaaacgguauccuuuuauauuuuuucugucucauauauaaccauagucauaacuugugugauccagaauguaauuugcuauuuacacuuugauuucagcuguuugcuuagauuguaccugauguauuuuauuauucuauuuaaggaaugugucaacaucaagauauggugaguucuuuucaaaauaacaguagaaaccugaccaauaugaaaaaaaaaagucuagcaagcaaauguaauuugugucuuuaaaaauacauagcaaucauucuggaucaauaguuaaauuauugcuucaauuaaaucaaauuggacuuagaauuuuuuucuucuuauauuacccaaaggaaggccccauucaccuaauuuuaaauuauacaaauuauacaaauaaauauacaauuguaaauuacaguggauauuuaauccuuuaaaggcauuaauuuagcagagaagaauaaaauuaucccuuuucuuaccucuaaaaucucuagguugaucaaacacugaccauuauuaguaccauuucaaguuucuucccuuuacuuucaucaaacuggguuauuuauguauguucaagugaaauggcugugcuuucaugguaauucuuguugcuauugacaaccaaagcagccaugcaagaagaaaaugcuguggaagggaagaaaaaaauuauauuuccuccccaaaguuggagagagaagggaacauacaguauguaagaaacagguaaguaaaaauauaucaauuuuaaaacuauuagccuuucuuacuaauugaucaaaaguuuaaauuuuuucagauguguuuuccaacuccaauuuaaauaaaaggauacugucucuaggaaucagaaauuaauauucuggaaaugaaaaauuggauuugaaaauacagcaucacaaaaggucugaaauauuuaaauuuagaauuuggacuauagaagaauagcauaacuucaauuauugguuaauauuuuuguuaugaaauguuuuuuuauaacaaaauggugacuaaaauauuacuauuuuaaacauguccuagauuuuuuuuuguuucagaaaagcacugaaaguugaauauguguaagucuccgggaauguaacaaguugauaaauacccaaguccagccuccuuacagagaaaagaucuggaauuucuuuuuuuggacauuuguuuugcagcuuucuacgucuuaaggcagagaauagccaggauaaggugccagcucaaagguuagaugaacauauuucuugaaauaauuuuggcuaaucuaugucuugaaaggcauaccuucuaaauaauuuuacaaagcuguaaacaaaacauuaguuguguuuuugaauugcuucuuuuuaggaaaacuauauuucuuagagaugugcuuauucuauacauaauuauaguaaguuaauuuuaauuccauuauuacauuaaacuuuuccguuucaguugauuauuccuuucuucuguuuuaugaaucuaauaaauugaccuccauucuaagcuaaaggacaguuuauguuuuuaauacuuaaggaagcaaauauaaaaacaaaguccaccaaaugaaauuacuaacaccagccuaucauuaaccugagggaguuguauuucauauucauuaauucuccauggaacaauucagguaagaaauauuuuuauuguaugaaauauguuaucaguuauaauagcacuuacgggcauuuaugcucuuguuuuagguacauaaaggguuccuuguuuaagauauuuuuggcaguaaauaaugucacuuaucacccuaugacacuuuaguggaaaacguuggugaaauauguggaauuguaauguuuaauggaauugauucuaagaagacaauguucuuuuuguuuguuuguuugaaacagagccuugcucuguugcccaagguggagugcgcuggugugaucuuggcuuacugcaaacuccgccucuuagguucaagugauucuccagccucaggcuccugaguagcugggauuacaggcgcccaccacaaugcccggcuaauuuuuuauuuuuaguagagaugggguuuugccauguuggccaggcuggucuugaacuccugaccucaggugaucugccggccucggccucccaaagugcugggauuacaggugugagcuacugcacccggccugagaauguucuuuaaacugauugaagaaacuaucacaugucaugaaaaauguuuuuaaggcagaauuuuaauaaaaaaaauauuugggaacaaaauugauaguacuagaaauagaaguucagaaauuucuuuguucagggagacuuaaagcauauguauuuuaaaguuacuagcaguuauaggauugacuaguagagcuauggcuuacauuagggaggcaaugccaaggaaagaauagaaugugugguuggccaccaacaucuggguucaggaacuguuccuaugacuuaccaccuguaagaaacuagacauuuuaacuuuucugagcugcaauguuguaaucuuuaaaucuaacuuugcaagauucuuacugguuauaaggagguggcuuccacaguucuugacagauguuugcuauuauuaguguguucucaauauauacaauacaaauggagaacucugagccgaguuuuacuaggauccauccuaggacagaugguacagcacauuuucaaaugguuuuguuuaccauaaucaucuuuuggaaauaaucaauuggaaguagaacaauucuucaguuauucauuucuaaaaucaaaacuuucaugggauaguuuucugugcuucugaaccguuuuucccauuucucuaauaauauccauccauaaaccuccgaguggaacaguuuugguugucuaacaguguuugugcuugggaaaugaauugaagggagauggaauugaauuguugaaugugagcauuuagaguuccuguaauuuauccguauaauuauuugagagcuuacuagagguaaagagcuaaguuaggugcugggaagauacaaaggugaauaaaacagggacccuuacuuucaagcaacucaauuuguaagaugauuggcucuuauuccuucuaugauucuuaaauaggaaaaaguuagggauaaagauuugagggaguucagggaaagaaucauuuccugcugaagaggaucaaggaagacuucaugaacucaaugguauucaguugauacuauauauauauauauuaucaguauaucuaguauauaguaucaguauauacugauagugagugacaugaaugccuagagcuucauuuuacugggaugauaucugcaguaguugguccuggaucaugcagguaauagcuggcucucucucuccauucucucucucucucucucucuauauauauaauauauaaaaauaauauaauauauauuauauauuauaauauauauauuauauaaauauuacauauacauaauauaauauauaauauauuauauauauagagagagagauaauggagagagagagccagcuauuaccugcaugauccaggaccaacuacugcagauaucauucuaguaaaaugaagcucuaggcauucacgucacucacuaucaguauugaaagcccacagaggaaggcaauacuggguaagaggcauguuuuaguauaggauucugugagagcauaucuuaaggggcaguagcccagaccagcagugauggaguggugauggcccagcugaaucccgagggauaaaucagucaagugaagaguauccugggcacacagaaaaaugcauuuaaagcucaguagccagagggaggagcacauuccgagaacuguuaagaaucucaacccagcauaugugggguauauguuugaagggcaucugaugagagacgcagugggagaagugggaaaggacuccuggaaggcuuuugauaucauauuaaauacauuugccuuaaucacaaaguuguagaggaacacuguaaagauuuuaagcagagaaauuaauauuuuagaggauagcuggugguaauggaucagaucuagcacucaggugaauuuaguuuugcuuggaguguuuguaguugucagugucucacaggagacacggauauaaggguugguucaaaaaucgguaggucugcauugcugcgaggagucuaucagcuggggccucuuaaguagcuggcccauuuggaagaaguaugugccucauuucccuguggagcucacuuccuuuagugcaaaugccugggaccuguaggaagucaaccuggugagaaauuaggcuucauuuuaaguagugguggugggaacaaagagaaggagagggauugaaagauacugaaaagaaaggauggagaggcacacaguguuagggcaguggcgggggggcacaugggcuuggcagacagacuugcugcaacuacaaauuguguuuuugagaaacuuaccuaaacagucugagcuacagcuucuuuuuugauaaaauguagauaacaguccuaucuaguaggacuuuuuaugaggaucaaaugaggaaacccaaagcguuugacucagcaacuggcuuauauucacauucaguaacaugguggcugcaguauuuguaaugcugguugugaaaggugaagaagauguaaucaagauuacucccaagucucuaggacaucauuuggugagcuagagaacacaggagaaggugcagauaaugauuucaauuuuggauauguucaguuugaagcgcuugugagacuuugaaguagagaaacuugauaugugcuuggauugcagggugagaucugaacagaacacaggcuaugauuucauuucuuuccacuauucuacucaaaccuuccuuccuuuuccuucgucaacuucagucaacauugauuauugccacaacuaucuccacggaggaacagcuuuaaacaguagaaaaagaaugugggauagguaaaaaucuguguuccacaucugcuaaauguuaucuaauaguuguaaguucuugaaaaaaaaucuuuccaguuuaccguuuuggcaaagcauuguaagcaacuaauaauucaacauuuguuuauaucaagggcugaaaaaaagucauccucuacaaacauauuuucuuuuuuucccucuuuugguugccuuuuuuuguuuuacaucaccaccacuccuaacucuaagaaaauauuugacuaaaagugaaucauuguuaguagugaauucguacuuuuuuuuuuuucuaugagacauagucucauucugucaccuaggcuggagugcaauggugcgagcucugcucacugcagccucugccugccagguucaauggacucuccugccucagccacccaaguggcugggauuauaggcauacaccaccaugcccauauaauuuuuuuuuuuuuuuucaguagagacggguuugccauauugcccaggcuggucuugaacuccugagcucaagcaauccacgcaccuuggccuuccaaaguacugagauuacaggccugggccacuguacccagccaagcacauuuauuuuuuaaguuuauauucuguccuaauacaauguauuaaaaaugagcccugccucaaguccuagccuaaaugccacuuucuccagucugcuuuccugauuuucacagcaggaagucuucuguacuuccucuacauauaacacuugcaugaagcauaucucacauugcccuacauugugguuauuuauggaucuauauuauuuguucugcuagacuauuaguuucaugaagguggaggcagugucuuauacaucuuuacgccaguauaacagcuucugcaaugccucguccaguucaguucaguacacuuuugaagguguaagagcuagucauuucuauuuauuaauaaaagggauuuaaaaaaaagauggacaagauguaaucuuaauaaacauauugugguuuucaggaaacaguuuaaugagaaaaugaauauauuugucucccuaccuuaugaccuuauuacauaucauagaucuucacucuugcuuuagauucuaaacagaaaucaauuuaugugcuugaaaucacauaaagguaaucugauugugucaucuacugcuuacaguccauuggcuguucacaauuauggguagaaucuugauuauuugaguagaagccuuuucaggcugacauugccuuaucaguggaggacuguuucuuguuguaggcccagucgcaguggacggcccuuggguuuccagacuucugcugcuucaugccuguuggcuuuucuuaugcugcucagucugagucaaaggcccuucacccauucccauggugaauuucuacuuauccuuuaaaauucagcucacauuuccucuugaaaguuuuuccugguaucuuuccuauuccugccucccugcagagaaaugccuucuucuguauucuuuuaacaccuuguacaccugucaugucuaucuuugucaggagacuguacacuacagagcaaguacuguguauuuaaagagcucaaagucuagugaaggagcuagauaagaaaaacaacucugaaaauaugguauaagauauauauauuuaaaaguaaaccuguauauacauauaauuuaugauagaaguaugcacagaggcuuaugaaagcacugaagaggguaugaacucagcaugaggcgugaaaaucuugggggugauauaauggucaaacugacaggugaagccugucuagauauuaguguagcagacaagagggggaauggcauuccaugugaaaguguggagguacucgagaguguauuucuaagaacugcaauuaacugcuauauuugugaaugugauuggaaaugaggccaaugggauaggcaagggucauaucaugaaauaugguacugaaugccaugcugaguguuugaaauaguauaaugaucuacaugaacaugaugaggagccagugaaugaguauaaggagcagaauggcaugcugaaaucauggguuagggaggucccucuaacaauaguucaggccuggauugaaguccaugauguuggacacagaaagacuguugugccaucacuuacaugaccaaucucuuauugauggacauuuaaguuguuuucaaauuucuguuuaagguucuucaacagauaaauuuggaauaauuaucauuuucuuuagaaaacaaauaagcaaacuaaaaacaccugaaggucaaaaugacaaaucucugacaucauauuagucgaggcccaguaacaaaauugauuuaauuuuaaaaauaauuaauguauacuucaacucauguaucagugacucuuuuaaacauagagauuuugguugcuaaaaaaggugaugaugguuacauuaaaauuuucuggccuuuugugaugauucuuuagcaaaccugcucaaaauuacaguaucagauguuuuaaaaaaugauaauuuucaacugaaagaaauacuguaauguauuucaucauauucuaugaauucuuacauuaugaaagauaucuuuuauguuucagauaucuauuauauuuccuuuuugaaagaauuuuuucuagcacuacaucuuuuccaaaccuuuuugacuuuccuaagccuguguaauuaaucacugccuguucuguguccuuaacaugcaucuguuaucaggacaucucugcuuacuucuguuucuccuuacuagacuuaccugcuggaggaugagaacuugcucuccuauucauuuuuauauccccaauuuuuaauauagugucuuagacacuggggcguuuccuccuugucauacuuauaauccucaucauaauuagcauuuuauugagcucuuauuaaugagauggguacuguucuaaguacuuuauuuggguuuucucauuuaguccuccaauaaaccuaugaguaagaucucuaaugaaucuugugaguuuacugguuuuuaaauaaaaaauggcaaugagagcagagagaagcuagguaaucuguauagguugcacauuucccgagugguagagcugggaucccagcagucuaacugcagcaucuaugcuuguaaaccuuucucuaaauuacauugaaaaguuaacaacuacucacaaguuaaauaauaguugucuguguauucauguuauuguacuccuuuuuauauauuucuuccauguuuuguauuaaaaaaauuuuaaauccacagaagaguugaagcaauaggaacaguaaauacccauauauccuuauuguuaacguuuuacacauuuuuuuuucucucuuccuucccgccucacccuucucucuuucucccucaaccauuuuuaaguaacuuacagaccuaaugacacuucgugccuaaacacuucagcauucaucuccagagagcaaggacauuuacuuacaaaccacaguaucauuucacacuuaaaaaauuuaguauugauauaauaaugcuauguaauaaacaauccauauuuagauuucccuaauugucccaauaaugguuuuuauggauuuuuucuuuuugauccagauccaauuaagaaucaaacacugcauuuaguugacauuccucuuuaauuuaauugcuuuaaaacaauucuaccacuuuuguuuguuuauuugcuucucgacaaugauauuuuugaagaguccauaucaauugcuugguagaaucuaccacaguuuaaauuugucuguuguuucugcaucauuagauuagaacuaaauuuauuuguaagaauauuauauauagaugaucaucuguuaugauauuccuugugcacauauguugguuuguccuacuauuggugauauuaaguuugaucacuugaugaagugguauccaucagauuucucuacugaaaggcaccuuuuuuucuuuguaauuaguaaguaaccugugggguaauacauucacacuguuuugauacccuguuccccaacaaacuuucacuuggugaaaguuuuaacaucuauggauaaucuuuccucaaauuaauuauuucaaugaugauuguaaaguucuguuuuucaaauuucgccguuccuucuacauguuaguaggcauuguucuuuaaagaggagcucagucuucuuccuauuuagaaucacuucguaaccauagauucuuuuuuuauucaauuguuaucaauaacuaccguuauucuucuugaugcucaaacaaucccaaaucuagucaguggaacuccuccaagccagcuucuauucuuuucacaugucucuaccauucuuugagugcuuaauugcuuuuugcaacagaaaacuuauucuagccucccuccccuagcccucauuccuuuuauuauuuauuuucuuuagaaaacaaauuagggaaugaaauauuuagaaacaaagauccaggugcuagcugugggcauugcuacuguuacucuacuaaaaaaaaaaaaaaaaaaaaaaaacuucacauuuccaaauaaauaguaacacuuuuuaauguguucuuaacguuuuauuuggcauuaaucuaaauuccccucuagcacaaugaaaacagaaagagaaaguuaaaauuucaaguaaacugaaaacaacaauagugcucagaggauuuuuuuuuaagugaaaagggauagugcuuaauuaugacaaauaaaagcuaacuugagaugcacauauacagaugcagccacuuauuuuggcgggggacacuucaggaauuaaaauuuaaauagcgagagaucaaauagauacuugguaaaugugucugaauuggauguucccagacacaaaaauaaaaugaguuauugacagcucuugggagacaacauuauaaagacuagacacguuauuuauuuuaacucuauguucuaaauuaccauugaguaauugacauucguauuugacuaugguuugugguuaaguucuuaauugcaauaauguuaaauaaaaugugaagcccaaagcaaacaacaacaaaaauuauagcaauacuucaacagagguaauaauaauaugcugcaucaaugguucagaauccagcaucuacauaaaacaagcaacaggguaaugaaauuauuuucuuuucaaauauucuggcagagcuacuuuaguuuucuuaaguuauagauuguggucuuaacugcaacuuuucgcuccuuuuaagaaguauuuaaguuauuuaaauguuacuuaaauacuuuuauguuuuuaaucauuauuaacauucucuaccccucucauccuuuccugcuuaguauuuuguuauaaucucacucuccccacuuccaaaugcacucaaaaaugcuggacuuucuggucuuuuucugaccaccagaagaaguaguggauugagcauggaacugggauaagacauuuuuccugaaauuggucaagucacuuaaucuuuugcauuuuuacuuguuuacuuguaaaaugaagauagugucugccucucuccugccuuauauggauaucaugaggauaaauucagucagucauaugaaaugguuuugaguucuguauucaugagggcauuuaaugugucuuauagugauaacaaucagaggcauuauuauucaguuuuuacugcagcaggaguuuagauuugaccaucagauaauugacacuauaguacaggguauuaggaaagcuggaaagaugcuuuccccuggagaucuuggacaguaggauucuucuagguuuuguucugcucaugauaugcaauggcucagggcacuuuucagaggaccacuguacaaucucccuccauuccacccagguccuauuaauauaguagugaguuguuucauauugccuucagugacuuucccuuuuccaaggccaauuaccauuugaaaaagucauucccugucauauuuucuuguucugcucaaaugaauuuguccauaucugaauucugugaagcuuguuggguguaaaaacagcuuuucaaagucuuccaguuucauaucuauuuguucuucugcccuacccuugcauguuucucuguccccuuuucuucugugagcauaaccuggaggacaagguuuuuuguucugcuuuuaguggugccaugucugcauaauaacaugauguagauugaaaaaauuacaaaugauucuuggaauucuaaagauaaucuuauuucuauugagaaaauccuucucaaguuacuaacuaccauugagauuggauuggcuuuugccuuauuacuuuucagagccuccaucugcuuggguaucucaacauauccuuaguuuucaaauguuggcacuuuacucccagcaugauuaccuuacauaagaaacauuauaggacugaugugggaguuuacuuuucucauaacuuauuugauaauucacugcuuauguuagaguuagaaacuauuguccaacucucagagacccaguuacaucacuuaagauggauauuuuuuuuuuuuuuuugagaucaagucucacucugucgcccaagcuggagugcaguggcgcagucucagcucacugcaaccucugccucccagguugaaaugauucugccucagccucccaaguagcugggauuacaggugcccaccaccacaccuggcuaguuuuuuuguagagauaggguuuuaccauguuggccaggcuggucacaaacuccuaggauggauuuuuaagacuaaaauuuuagauugcaaucaaacagaagaggcuuggacaugugacauuaaagagcuauguuuguuuugccaguugaaacuuguuucuuuuucuaguuaaaacaaugauuuagagguuauuuugagggcacuuugaagauuaugcuacaggaaugcuagagagcaaauuuugagagugauugcccauuuggacuuaauucuggcaacugauuuugggguaaaaugucuaucauucguugauuaucugugauuuuuaccuggacuuuacuuaagcuuuauuaaguugcuaaaccauauuuggaugcuagugauagcagaccaucaaauacggcccaaacuucuuguucugauccacacgaaggucagagaagcaaugcugccuuuucugauagccaguagcaccagcaggcacguuguuuacuccaaacaagaauuuuaauauuuuugaagaccacugaaaauggaucauuuauacuuuuuuauuuuuuugauaaggaagggaugaccuacuauucacagaguaaugcaguuugcugaaaagguugguuuuugcugaccucugagagcucacauuacaguggaguguguuauuggaaggugagccaguuuauacagagguugggaauuauuuuucucuaguuuugaaaugguuaugcacuuucuaaucuaguuauuuagauguagaaauaaaguuuuuuuuuuacauuccccugaguauaugguauuguagguauaaaauaaauuugaugaguuuuauuucuguacuaggaucuacucauaacucuucuauccuaaauuuguaucaaaaggaaaccuuugcugucuugauaauaaacacagacuaaguccagauuccacagucuagugaucaaggaaauucaggaauuguauuuagcuacaaguaacgugacacaaagaacagugcccuaaauugcuaggauggugauuuaggguuaauauuaugacuucuugcucuacccucuuuccauucucaagaucgccucauggucauaaagaggccacugugguugagucaugacaugcacguucuaggcgagaacacagaacaagccgugcucuucagcccccuucuuacacagcauuccaaagccccaccccaucacuucugcuuucaucccauuuagccagaacuuagucauuuggcugcccauaucugcuaaggagaauagggaacauaguuuuccauuacuaacccaucccccacucaaaaaaauaaaaauuuuaaaagccauucuauauuaaagcagaagggaaagagauauugguaagaauccagcuggccuuuugugaucugugucagccuuucuuuugaucucaucugcuguuuuaagcacuuuacacuguagccccacgagaacacuuugcacucacuaagaagcaguccccuuugcugcgccccccccccaccacuuugcuuauauucugaaagucuuuuguuuccuauuccacugcucuuaccucuaacacacugccucuaacacaccaaccugcaguuguaguuauuacacacccuccuugguucuuucaucucucuaucacagcccuuguugugguuuagccaauauauuuuaguuccacagcuaaauuuucauacccucuaugacucucuaauccccugccacacuugccuacuauaauacauuauauauauaacaaauguuugauacguauuuauugaauuccauuccagaacuaaugccagcaagauaacuuugugcuauauaggagaauaucuuuuugugcaacaguuuccaaaggguuuucuuuuucuaagaagaaagaaauugauuguaucaacuuuaugaguauccuaccgcauuuaauagccauuggcuaaucuaaggguuccugguuacuucacugaauagccuaucagaugggagugcaaacaacaguuuguuuugaaauaggacucccuaaacauggaagaaacauuaacaguguuggccuguuggaaugugugcauuugaugugcucaagauuagggcacucugcuugagaacaaauaacaaaaaagggagaggaaacaauaaaaacuuugguccuauaaagcaccugaaaguacuauaaauugaugguucucaagcuggucaggggguccaaaggcuacagccugggggccucaaguuuaauuguuuuauaaaguguccuaaauaaauuuuuuauguuuuuaagugguauuuuuaaaacuacuuuuucaugcuuugagagaguuuuccaaauuccaauuauuuuaagggguuauuuccuggacuugcacuuaacgauuuugagauguuuacauuuuuuucaauauggcauucugugugccucagugauacaugguuauccagguugcaugcauauauaaauguuaagauuuauggaaggucaucuuuuuagauuaaaaagaauuuuuuuaagcugguauuucuuggugauagggccuagaaauuauguagaguggcuuacuucuggaacuuauuuuaaacugcauauaaaccauccgccuaguguacaguuggcuaaagaguaauauuagaaggcccuccuggacaguuuauuucauuucauggauaugaacacaauuguuucccuuugaauuuaaugccauguuuaaaaucagauuuuaagaauuuuccaagggcauuucccuaucauuuacacucugcuuguguuuucuuucuguagucuuuuacauuaaauaccuccuacagagcacugccuaaggauuuguggugguacaggguccaguugggaugacaaacaggcaaggaaggccuggaaguaaaauuagcaaagaggcccuguggaauggaaggugagggaaggguuagugacaguugggggaggaaagguagaaaaaaaaauaacaugcacaucaguuucgcaggaguauuagagucuuaaaggaaacaauguuugauaauuaucagagaggaaacugggagcauagagcauaucccagaauggagaacagcauggguuaaaauggguaggaacaggugucaggagcuucaaaauucgggaucauuguugaguccauuccccuuggucuucaaggacugucugcucuucacucaaugauuauugaagcucauuucuuccugucaccaacacaaaucauaccuucuucacgucagaccuaaacuauuucgcuggccuugcaacuguucucucugccucuaaacucuuuccaguccauccuacauaccaucaccagagcuuugauaagauucccagagcuuugauuuuuaucaggcaguuaugaugauaaauguauggaaacuucccauuuccuagagcuaaagugcauguuucucauucugaaauguagggaacauaaucaucugauaccacucaccugauuguuucucacucuuccuccaccauuuacccaucucuuuagcuuaaugaguccccuguguaucucccaacuaaacagcggcuuacuugccugugaaauauucuucucuuggguagucugcucccuucucugucuacucaugcuucaagauucaacauaagccuccucuaugaggcuuucugcacguauguauauggauuugcuuguguaaugauuucuucacagauuucauauugcugauaaauaaauauuguuuugaauaagaaacgugguuuuguauuuuuaucucaauuguagacuccuugagaccaguaccaugcuauacaauuauuuuucaucuauuauagugucuggcauagggacaugcacauauuugguacagaacaagguuuccgagucuggcacgaugacauuuugggcuggauaauuuguuguggcggguugucugaacauuuuaggauguuuagcagcauccuuggcgccuauccacuagauaccaguaguauccucucccuagugugacaaccaaaaaugucuccagacauuuccaaauuuccacagggguaaaaagugccccccaguugagaaucacugauagagaauaaacggaauaaauuccaauuaaacagugaaaauauuugagugaugauuuacagaauuuuaaagucuugagaaaguggaacucaguugauggaaaagagugaaugucaaacugagaacguccuauuugcuauguuagggcauagaaaggccauuauagauugaaaagcaguuguaaugaaucuuaggguuaagaaagaucaagauacagaaauauccuugaauugaaguuccaaaacaauguuguuuugguuuuuguuucauuuugaauccuuucauacuuaggaauaccauuucuaguaaaauaaauauuuuauguuuaguuagaaauuuaucuguauuucauacauacuuaguacuuuuggacuaagaacugcuauuugaaguauauuugagggaaugaguuugaaauuuugggugcaggacauuauaaaguuguaacuaugaauaaauaucaguuaugcuuaugcauaguuuuaccuaguuuuauuugucuauuugaguauuguccuugaauuuaaaauuuuuuucagccccaacugauacacacacauauacauacauaacacauguguguguguguagcuuacagaguguuuauaggaaacugauuuuguauacuuuggcuacuuuguuguaaguucuaguuuuuuuucuuuuauuauuaaacuagugcacgacaucaaugcuauaugauugguguuucguugaccuagaaauaaugcaugccaucuucuuuucacagcugugugccaaccacgaugcaaacauggugaauguaucgggccaaacaagugcaagugucauccugguuaugcuggaaaaaccuguaaucaagguaggaaaacagucugacauaaauacacaaucgaagacaccucuaucacucccaaauuaaaaauauucuuaucucaaacuacuuuccauggcuauuuuuccaaaauaugugagcugccauuuugcugauaaauaaaaauauauuaaugauaaauauuguaaaauuucuuuuaucaaaggacaauuaaacaaauuguauccucuuauucucugauacuaauuaaaauguauuuugaagaaaagaaucccugcaucaguaauuuagaagccuucugguacuccuuguuuuuccacuaacuaguuggaaauccuuggccaaauaauuaaccaccucagaccccagguacugcuucccuuuaaugccaaagucaaguaggggauuugauuugaaauuuggaguuuccuccuaacucugagcccuucgauucgugauuaaaucucccuucaacuacugaccaguuuggaauguuuccaugauaaauaaaaaugauuaauuuagcaagcacuuuuuaaaaaaaucagcaucaguuguuuaaagcaaauauuuauucaacacucauagugccccagguauuuuauauauauaauccauuuuuaucuuuacaacaacauuaggaaguagagcauuauuuauuauaauuaagguauaaucuauuaauuauuaguccauuuuuuauuuggagagacagaggcauaggaauauuaagugucuugcucagguucacagaguuaguaaaagagcuagcaugucaacuuagagcuauggcauauauaauccauauuuuuucuacuauacuaguuuuggauaaaaaaauauauuuggaaaugugauccucgaacucaugcuacaaagucagacaaggcuugucuuguuaauuaaauucaguuaaaaauuuccauuauuggccuggcgugguggcucacaccuguaaucccagcacuuugggaagcugaggcgaguggaucaccugagguugggaguucaagaccagccugaccaacauggagaaaccccaucucuacuaaaaauacgaaauuagcugcgugugguggcucaugcuuguaaucccagcuacucaagaagcugaggcaggagaaucacuugaacccaggaggcggauguugcggugagccaagauugcaccauugcacuccagccuaggcaacaagagcgaaacucugucucaaaaaaaaaaaaaaaaagaaaaaaaaaucauuauuaggaauuaaacuaaagaaagauuaggguuagauuucacuaaauagauaagugucaaaaauaaaaaagauaagucaauuuuuacuuauuuuuuaaauuauacucccuaucaucuuaaaugucaggugaaauaaucauauggugucuaacuaucccuuacauacuuacuugaccucaucugauauagaaaugauauugcugaaauacuacuguucuucagugucugauacuuauuccaagauacuccuugagguaugucauguaaacuaaugauuuauagacacaguuuuuuuucacuauuuauuuuuauuuuuuuaauuuuacuuuaaguucugggauacauguggaaaacaugaagcuuuguuacaaagguauacaugugccuuggugauuugcugcaccuaucaaaccaucaucuagguuucaagcccugcaugcauuagguauuuguccuaaugcucucccuccccuuaccccuaacccccaacaguuccccucccuguguccguguguucucauuguucaacucccacuuaugaaugaaaacaugcaguguuuaguuuucuguuccuguguuaagacaccguuuuuacaaucauccagaacauugauuuuugaaaacauacucaaaauggugguucaugaaccaucagaugaaauuauucaugaaccaucagaugaaauccacacuagcaaaaaugacaugucccaaugguagaagcugcuauucuaaaguguguucuuguauuaucugcuauuugauuuagaacugauuuucccaaugcuuguuuucucucuaauacucuuuuuaacuugaaauuuaccaaacauaccugcauaaucuuuuuaaauaagugaugcucuuauuaucucaguuugcuccuuaaaaaacuccacuugauuuuucuuccccagcauaaguuugcagguagcaguguucugguuauuggaugccaauguucaucuuagaaucucaguauacuuuuuuuaaaguggugaacauaagcccucagagguuucauuaauauaucagcacgguaaaauauuguuguccaaaugugaggauauaaaauauaaagaagacgauuaaaauaagucacuuuugagauugcagagaaauucauuuaaauuucuuugcagaagcugcaucaacuuuaacaugcuuuaaagacaugcuaaaaguauuauugaaacaaaaguucaucacuggguagcuccuauuuucagaaaaccaguuuaacauguacuuuuuuuuccuguaacacauaccuauuucucuaaagaaaaaaucgaauguaucaaguuaagaucuugcuccccaaaaccauauuccuuaaagagaagaggauuugauuaguagcaaaaugggauuuuacaccugcaaaaauagugcugacacugaaaauguaauuucaaguccaguuuugaaaauaaaacuacagcuuaaaauaaacuuagguguuuuaaucaucucuuauuuugcccuccucacaaaaaagcaguguggcagguuccugauggcaagguuuaugcuccuugagagcagaaauccuuuuuguugucucucugauuucuaaguuccugaaaacuauuauuaaagugacuugcacaugguaaaugcacacuaaauauguuaaauaaaugacaguuucaucuaaugguucuuaguccugaacacuguggaagcuugaaaggguuccaccaguucuugguacagcaucuuagagagucucugcauccauagacuugagggcccugucaggaucagggaagcugccauguguggccugguugagugugagagcugccuagagacuuccauaaaaguuguuagagaaaauuguugauagugccuacauagcagauuaacuuaaacuguuuucauucaggcccacacauuuuaauaaaguagaaaauaugcuucacagauaagggaaaucaaacaggcuccuuuuuucuggaggagagaaaugucaaaaagaauuaaauuugaaauaacuuuacagaacuggaaauuagcuuuugauuaaaaguagcuuuugguauaugacaaguauucacugagaauuuuguagcgaguuauauacuuuaagaaauaacccccagaaacuugcaucaugguguaaacagcuugaauaaacaagugcuuaaccagugccuuuagagcugccugggaaacagccagaauaccagggcaagcugcauuuuggaacugguuuaauuuaguagccuugccacaggcuuagugugaucugcuuuugguggcuugaucuuccccacuaagucauuuucuggauuuguuacaccuagaacuguuaggaaauuacaggcuugggcugaucauuaacauacuguacucuacaaggcacacguuaccuuucaaagcagaugaaauucuaaccugaauucuggcaagauucuuugaucauuugcuuccuuuacuuuuacuuuuauuuaugcauauuucccuccuccuugaguuucuguaccaacacaaaccucuuuuucccccagccagaaaaaaaauauuauuauagauaauaaucuuuuuauaacuuuuccauuggggaaugauuuuuaguauguaaauauaucacugcauauucucagaaaugaaagacauucuuaggaauuuacaguguacuuuauaauaauuucagaagaaaauauuuauaaaugucaauuccuaauguuuuagcaugguuuauguuucauauguugaauucuuuaucauaaggaaagaauuggagucuuuuaggucagaaccagauacuaauuuuguggacuaguuacaucugaaaguugacugcuuugcuaagcacaaaaaucuaagggcuuuaacucuaauauuaaggugguuaccuacagccguagguuuugaaagauguaugguuccagccgggcgccguggcucuacccuguaaucccagcacuuuggaaggccgaggcgggcggaucacgaggucaggauaucgagaccauccuggcuaacacggugaaaccccaucucuacuaaaaauacaaaaaaaaaaaaaaaaaaaaaauuagccaggcaugguggcaggugccuguaguuccagcuacucgggaggcuguggcaggagaauggugugaacgugggaggcggagcuugcagugagccaagaucgagcggcugcacuccagccugggcaacagagcaagacuccaucuaaaaaaaaaggaaguuguaugcuuucaacucccaaaaccaauguucauuugauuuggacauuuaacuggcuauuaauaacauaaugguguugaaacagaacgugauuguuaagucucaacucucuucuuugagucucacccaucuuauauuuugguaagcuaauaauggcaacaguuaacauuuuuuugcauaaagcuucucauguauguuccagaagcauaauuucuuacauuuaaaugauaauauugacgaucuauuaugcuguuauuuaaauaaaaucuuuauguaaaucauacauuugugcauaauuuuggaguauuuuaaacuacuauuguacaacgugauaguguagggaaaaaaaucuuaaguuggucguuuacaacuucaguguccuuaaauagagcagguggauuauaaucaauauuuguauaauuuguuuuuuguuuucuuccuucuguguaugacuaaauaauacuuuuaaaaaugaugaucucuuguuuggaauuuuuuaaaaaauuguaugacgauggauuguucauuuauaauguguguguuguccuugggaaacaagaugacagugauacauuuuuaagaaaauuaaaggaaaagagaaaccagaagaaccagaaacuauuguuuauaaaguaucuaaugcauucuuuuuaaacucuaccaacuguauguaauuguuuaauauauacuugcaaagauuuuuagggcuaaaauugacaucaguucaaaguugacucuuauuaccuucuuccuggugugaagacgagcacaucccagcuccucuugaccaaggcagugaacagccucuuuuccaaccccuggaucaccaagccacaaguuugccuucaaggggugagcgugcauugucccagguggucugcucuucccaccugcauggcuuccugcaguuaugucacuucuugcaaauguucugaagacuagcccaggaguguccagccuucagcccugagcaugagcaagcagcaggaauugccaccuggugcugauucucugugcucugaaaagcauggagcccuacuguccuuuuaaugcaucgaguaucauugcuuuucuuucucuuuucugaauuuugaaauauguucuaaaaacagauagcaaaacaacuuuuuucauauguaggcaaauucaggaguuccaaagcaacugaaauuggggguuugaugccuuuugccaaggagauuuuagaaaucaaguccucuuccccacucuugagguauagaguuuuagguuaucugaaaaucaaagcauacauuagugaccuucuuuugguauacauuguguaacaucagauagccuaaguucugguuccaagagagcacuuaguugcuauuugauuauaagcaagucauuaaccaaucaguaacagggagacaguaauuccugcccuauuugccugugggguuggcgugagaauagaaacaccaaaaauauuaaugucuucgucaugcuggaaagcuuuguaggaaaauaaugugguagcauaauuuuacaguuccucuuuuaggucauuuuaucucuaacccauucauagguuuaagaacuuagaauaacugaauuaaaauaguugaaauuauuaaucauugucucugcugagaagaaauuugaugcauuuguauauuuucuacacaaggaauuagggcaaaagaauuaauuucgguccuuaauaauuaaaaaauuaaaauuuugguaguugacauauugacaucuguuugccuaugacauugcccgauuuaagcaccaaagcggggagaaagucuaaauguguuaaaacaaaugaaaguuuauuuuuaaaaaauccaguaaguuaguuaucucccgauuuuucaagcuacuuuucagugucugcaugcuaauaaaauuucugauuuuuuuccugaaguuuaauaauaaugcugugcagcuugcauuuccauucuggaccaguucccuucucccucuccuucucccauccaagcuccugaauccaccaaccuacugaaauguauuccugacaauaguagaugcacuuuaagacuuguauacauaauaacugaagcauuugaauguaagugguuuauuguaaaguucuauccuuuaguauaagauaagcacaugaaauaauucauuaaauuuuuuauuuuccuauuuuauagauuuuccuuauauauauuauaaaccuccagagaaaaaggaagauaaguaaauuuaaaauaaaaacaccaaaguuuuauuucuagguucuuuuaucaacuuuuaagauuuauuugagacaguaugaucaaugacuucauuuuguucugcuuauuauuguaggaguauuuacuauaauuuggaaguaauuuauuuuugaauuuauugcuuaauugaaugaucuccaauagauugugauaaugaacacagcauuuauagaaagcagcacauauuaacuuacuuaauauggcacuaggucaaugagaaaagaagguaacauaauugaagacaagaaacucuuaagaaaacugaggacaaaaaggcuucucaccaggaugccagaugcauuuaaucuuuugaagcucuguacuuuaggaaaagucugauauuuggcaaauuuugauaaacauggaugacuauggaauccuauuuuauaguaucugaaguggcuuucauaagggucauugugaaguuuuuaggagacaccugccuguggcagaugggacaaugauggcagucacuagggauauuaacaccagucagcugucagggaauaucauccagaccaucagcagcugguagaguacagcuuucucaauugcuuuccauguuuuggauacuuauaugcccguuaauaacagguaaaauagccaguacaucauuuccacauuuacccauugaauguugcauguuuucuuccuuucacauauucauacaguccagauuuuuuuuuggacucaugacagcacauuggcuuuucuuuccuuucaguuucaugauucuuaaccccaaagugcuuuugccaugggaacggaaggauaaauuucggucgaagccauucucuaaaaccaccagcagcuccaguccagauuaugaauacuaccauagcaauccuaaggggcccuuuauuggcccagacuggagccaaauuguagaagagcugccccaacugggcuucagguuuaguucagggacauagugucugaagaaauuuccaucagcauaaauacuccuuguuuaugagcugccugaaacuguaaacaccgaauccauucccaucaggaacucacaaaaguuucuguuaugcuuugaaaauaaaccuagggauacuuaacugacauguaaagaaaaauccaucaguauccuuuucucgagauauagguuuugauuuuacuguguuauguugugguuuuguucuguuuuuguuuagugcagaaaaauacuuaaaacacaaagccuuucucuaacaccauauuugguuuuaaaugcuauuugcuauaauaucaagaagauuuaucaaagacaggugugacucugcaggaccauauuaggaacagucauuaacuccucuuagaagaugagaaaaguuucccucucauuuuuaguaaauucugaaauacaaaguagaagaauaugggaaggguagaaaauuucucagucauucuuccuugauuuuugcuucaauuaacagagggagaaaacauuuuugauacuguaaucugcauggcgcuuucugugaggaaauuuuuuuugaaauauuuaaaaugugauuuuguuuuaaaaacccuuaacuagucaagagacaauaaaguagaaaauugaagaacgcauaggagaugacaaaaguauuugguuuauuuauuuaaccuuuccgggauuugcccagcucggggucugcuuacaguugcauucagggcagauaaaagaccuacuuggaaaaucaguaagauaugaaaauuuuuuuagauguaauaauuauuuggugguuuuaaaacauaauggaacuuggugauuuaguuaaaugaaauauacagauuucuaauaaaugagcagaucagauugaaauagauuagauuugaaaacaauuuugucacuagacauauuaucuauauuuuuuauucaaugacauggauuaauagauaauuaaauuaugcuaaauggguacuuaugcuggugguuccagacaaacauguggucacauuucuuuuuaaugaagcauauauuuugggcauuacuauuucaauguuuauuugucauuaugaguuuuauguucacuugaggcaguguuuaauuuagguuaaaaccuuuucauaauguaaaauuuguugauucauuucauauugauacuuaaaccaauaaaccugaaauacaugacagucuauuacauuuuguccauuaguguuuccauaugccuuuuuuaacugcggaauaaaugaaaauauguugguagguuuuuuaaaguucauuuugugacuugaaugcauuacuaaaguaggaaacugaaguuucuucuuuaaucugaaaucauauaaaaucuaccagauugaacaagaaaaacuacaauauugaucacucuuaauuuauuucguucuuauccucugaaaauauagccuauguagccuuccuuugggaaggucaaagcagucaaauguuuuaaaaucuguauacuuccuguaaaguaaaauauucucaaaguccaagccuuaaggaggccaaugccuuauccauuuaaaguaaaauauucucauguaauauguucuuuaaacagagaaaggaagacauugaacgaauaggguuacauugucaggauuggaucuagcaauagaacccaaauauuuugagaauauuggcaaacaguuguuagcugauagagcaucucugcccaugaggacguuaguaugcugcuguuucuaggguugauaagguaggcaccuguuguugagaauuuuccuaacuggccuuuauaaacagagauccauaaaggucauggcgacuccugguugccccuaguguaacguaccuucaaauuaauauugcaugaacaggaucuaucucuuauguaaaugacaguuacuguagcuugaccuauuuuucucuuucauuuuuuaauauagaaaagaauuuuagauggcuuacauuagugcugagguuuuguaauuuuucugcuucaacccacauuguuuucagaucuaaaugaguguggccugaagccccggcccuguaagcacaggugcaugaacacuuacggcagcuacaagugcuacugucucaacggauauaugcucaugccggaugguuccugcucaaguaugucaagaaucuuaacuguuuuauaagugcuuugggcuuguuucuguugugcucugagagcuugcuuuugugaaaauggccuccgggguucuccuaaacaagaugugugcguguguuuauacuuuugccugaggaauugaaaaucaaaauaagaggcaccauuuucgauguauaauacucuucuaucacgggugccaauauuaaauugauuaggaaaugguguuuagaauaagaauuacaaaacuaaguauguuuucuaauuuuuuuuuuaaacauguuuacccaugucuucuaucugggcauagaagaaugauuccaggcuaaaaaaaaaaaaaaaagaacacuacugacuauuuagggacugcucagacagaauccaucaggucuguuuuguaauuuuaaaucauucauaaauauuuucuucauuuuuauauuucauuauaaaagccuuuaggcuuuuauagaauuuuagacucuaauaauagucuaagacuucuaaaaaacaauuucaaauaaaaaauaaaugaauaugauaccagaaaaguaggauucauguuuauaaggaagaaaugcauguuuucaccaucauuuggauguaaaaaauggacuaugcccuaaaauucucuauaggcugacuccugaauugugguauucauaugauaucugacaauuaaugacuugauuuuuauuuuuacugaauuaucauuuaacugaguugcauaaaauaaaguuagcuaauuuuauuuaacauugcauaaguauagcauggaacuuuuuggaauuaggugaauacauguuuaacauugugcaacucaaugggaaaucugcuguuccccuagagaaauuucaugggcauuugagacaguuacuuggaugauuaguuaagaauagcguuuagcuugaguaaucuggaaaaauaccucaauucuucacuuuccuuggccacuggaaaaauuuccagauaaucuauauaugauaguuuuauauuugucuuuuaaugcuuucuuuccuucccccuuuuauuuucuuuagauguuugauaguuaaggccucuuugucuucauuguuguucagugucacugauuucaggacaagugaaaaaacauagcuauuuccauuacagauuuuguuuucuaccugucugagucagccagucacucucuuuccaggugcccugaccugcuccauggcaaacugucaguauggcugugauguuguuaaaggacaaauacggugccagugcccauccccuggccugcagcuggcuccugaugggaggaccuguguaggugaguuguaaaaucaagcaucucugucagcagccucuguaggauaaagggagaaagugaaaggugaugggaauaaggaaaaaaaaggcaauuacuuacaucagauaauuagcuaucguucagaagauaucagaugucucagaagaggacaucucugugaauggauaaugggagcguuguuuuuuaaaaaaugagaaauaggaggaggccucaggcagagggaacccuaugugcaaagacacugcaguucagaggagcacaauguuuagggaaacgagaagagcucaguauuccuagaauguaagcggcaagggugagcaaugagugaugaagcugaauagcuagauuguauguguuguucuucaggccucagauuuuuuucugguaaauuaggaaggcaguguaggauugagagucuggacuuugguuuuaaaccuggcucuuccauguacuagauauguaaccuuaggcaagagacuuuguugcuuugagcuugggucuucuuaucuuuaaaauggaaauaauaccacauagaacugguaggaagauugaaugagaucauggaugcaaagagcuuagcacaauaccuagcauguaauaagccuugaaugaauggaaguguuuggugauuagaguuauuuacugaguaauuucuauacuccagacacugugcugagugcuaggauauauagcaguggccuaagcacacaagauuuugauccccacaaagcugacaugcuaaugggggagacagaaaagaaacaaauaccccauaaaauuacagacaaugccaaguguuaacaugagguacugagagaaaaacagaaugugucuauuagccuuaagguaagaccuguaucauuagccaugugaagaaacagccaagcagcugaagacauugcagggcacugcggugagagagagguuggccugugugagguuuuucaaggaagaagguccauguagcucaaguacagggugugaguaugaggggugguggcuggagauauaaugggugaaguaggugagggugauuuguugcagggccuucaaggacacaggggaggaauguggauuuaauucaaagugcaaguagaaauaguuaaaagauuuugagcacaguaaugauuugauuguauguuuuaauggaaucauuuugacaguuggguuggauaugcuuuggaggggguaaguaacagcaaaaggaacuguuuugaggcuuuuguaacagucuaacccaagagaugguggcuucaaauaggguaguggugguggauuaagagaaaaguagacagauucaaauacuuuuuuuuagagguagaauuaacuggacuugaugauaugggaguuaaaggaaagaggguuguuucuaauucaagaaugacucauguuucuaguuuaagcaacuugguagauacaggugcaguaugugcuaauauauagagugcaagaaaauaauaacuuggcuuagaaggcuggguugaaauuuggauauguggaauuuauguugccuguagggacaaccagcuagauaccguuuaugaugagccacuauaugcuaggcaaccauuuguagucaguuauuuauuuugaaacccacucugucuuaacauacccuugcucuuccuaaaaugcuauugacuuauguuucuagauguugaugaaugugcuacaggaagagccuccugcccuagauuuaggcaaugugucaacacuuuugggagcuacaucugcaagugucauaaaggcuucgaucucauguauauuggaggcaaauaucaaugucaugguaaugaaacccaaccauugcuuuguguuguuucuuccuagagcacugaaaggucucguaauuguggugauggcuggaaugucaggggcaggggagaguacuggcguuaaguuaaaccaacagacauccaguuuaaccacugguaguucucagucuacauguaguuuauuucuucuguuuaucugccaauauuauguagaucaucacauugccaaaaaaaaucauuuuugaaacuguauauauuuuuuaugucaucauauuuaucuccuaaauaagucucuucuuuuccuacuuucugaugcagacauagacgaaugcucacuuggucaguaucagugcagcagcuuugcucgauguuauaacauacguggguccuacaagugcaaauguaaagaaggauaccagggugauggacugacuugugugugugaguagcacuugucucucagcuuuaaauucuagcaggaaauacaggauuacacaaaggccauugcuagggaaaauaaggaauaagauuaucaaagaaguauaauugucauaauugguuauauuugucuuugauuuccacaaacaauaaaaucacuugcucagguacuuguaaaaacuaaggacucaguaauacacuauaaucuuaagaguauuuuaaucucuucacugaaaucucucaauauuuucuuuuuagcuaaaaagaaauuauugaguccucccugagaauuugcuuuuguuaaaauuagaaaucauguuugccauuagcguuagauuuugauggugggauaaucuggauauauucuacauuuuuuucccucuguuuuauugcuccuaacucugcuauuaaaaaaucauucccggccaggcacaguggcucaugccuguaauccuagcacuuucggaggccauagcagcaggauuguuugaggguaggaguucaagagcagccugggcaacauaaugagacccugucucuacaaaaaaaaauuuagaaauuagccagcugcagugcgcauaccuguagucccagcuacucaggaggaugaggugcuaggaucacuugagccugggaucuuaagacugccaugagcccagugagcucugaccaugccacugcacuccagcuugggcaagagagcgagaccugucucaaaagaaaaaaaaagccauucccauauuuauuuccucuacauucagaacuguuuugcuuuuaaaauuuuuauaaguuuuauuuggaguagugguuauguaauagauaaacaugaaaaaaacccaaaagucauaauuuaacauacauuucauguaacagaagauaauuuuuuaaauuuccuccguaaaauauuuacugaaaaccauggugcauaaaaucaugaggauuaaaggguuuuuaaagagucauguagucauucccagucuggaauguaucauucaggcagauuaaauauugauucuuuuugaugaagauuaucaaggaaaaagauuucacagaugaucuuugcaaccucugaaaaugucuauuuaaaagcaguuguaucuaucaguaaagggaaauaaaaaccgaccauaaaacaauauguagaacauuuacucaagcuguauuuaugcaaauugaauuuauauaaaguguggauaagaaaaguauuugucuuuagacaauucugaacacaauuuuauaauauacacguagcauagggauacaacguagauucuaacuaugcauuucuuauauuaaaaaaacuuagaaugucucugcauuuuaaaaauucucauugguuguugucuguuugcacugcacaaauauuuaaaauguuuuuauguugcaaauaauacauauaaauuauuuaaacacaccaauauauuuguuacauacauccaaaggaugaauauaugaauauauaugugugugucuguguguguguauauauauauauauauauauacacacauauauauuuguuauuuggaaaauaguaugacuuacaguagguaauauucuaaaugugaaaaaugauaccaguugucauuagauguuuuuaugucugucaguguaaugcuucacuuuuuagggaggaaugguuacauacugauuuaagucuuugacucuuucagauaucccaaaaguuaugauugaaccuucagguccaauucauguaccaaagggaaaugguaccauuuuaaagggugacacaggaaauaauaauuggauuccugauguuggaaguacuugguggccuccgaagacaccauauauuccuccuaucauuaccaacaggccuacuucuaagccaacaacaagaccuacaccaaagccaacaccaauuccuacuccaccaccaccaccaccccugccaacagagcucagaacaccucuaccaccuacaaccccagaaaggccaaccaccggacugacaacuauagcaccagcugccaguacaccuccaggagggauuacaguugacaacaggguacagacagacccucagaaacccagaggagauguguucaguaagucuaauaaauguuagcacauuuucaauaggcucuuuauaaugacuuuucaaccacaggccaugccuugaauaagaaugaaacucguaagaagaacuagcuauguaaagucguaugucccuauugacaaauauuauaaagagcuacauaaagagucagucuaauugggcaaguaagaaagaauguauguagcaauggaaggaauauucacaaagucauaugguagaugacagcucuuagccaguaugggaauucugacauaguuggauuuacuugaaaacucucagaggugggaacuuaacuguauuccaugcuauguuacuuuuaaucuaacccuucauucauucagucagugaacauuuuugaaugucuuuagagugucaagaaggccuuguauuaguuauuggguucauguaaagauaaaacagaaaaggucacagucuggugggaaagaugguuacucagaagauaccagugguaguauguuagugaaagagaucuguguaggacacuaugagaggagaaugaagggauaccucgucagucuuuggguagggaauauucagggagggcuucccgagugaaacggagcaaaguggaugaggaaaggaagauauuauaguuaacagggacagcccaacaaaugcaaagaaguaggaagcaguguaauaggcaguagacugccaguaaauuggagggucaugucagggacagaugagagaagcuggacagcuaccccuuggauugcuguaaacugauaguuagaccuacacuggggcuggauuagaucaaagacucccagauucuuagcaggugacuagguaaaggguagcaccaccaauggagauagaggauucaggaagagaagcaaguucugaaggaggaaaagguuguuaauuuauuaccagaccaaaauuugcauguuauaacuuucaucuguuccucauauuuaucugcuuguccugugucacuucgcuuauucuuaauuaccuuugcauucacucuuccugucuccuccuuuauacauuaccaguuuguuuuguuccuuuucucauuccucuaugaugaagcuaaaguuugugccuuuuauauugaauaccuuuauaacuuuuuaucaggugaaaaaaauacugacauuuauuauucuuuaaaggggaaaauugggaggcugaggcagaccgaucgcuugagccuaggagguugaggcugcaguaagcugugacugugccacugcacugcagccugggugacagggugggacaccaucucaaaaaaaugaauaaauaaauaaacuaauaaaggggauaucagagccgcauuuugcuuguaugugacucucaauuaaauuuucuccucuggguaauuguccauuuaaagaaagauggaaauucucuaauucugauauagucauguauguuuuggauaaucaauauaauuuuuaggggaauuagaugguagcucucaaaauauacauuuuauaugugcauaacuauuuucugaaauuuauguuuuuguaauuuucuccucacccccucucuccaucucagauacugucuuuuucucccuauuacucuccuuuuuaaauucucaucauugugaucauacaaugggauuuuuaauuuaugagugcuuaaguaauuaugguauuuacauuauuuugcugccuuaggauaacagggaaauuuggcuauuuaauguaagaugauacgcuaaauauuuuuuucauuaugaugaaagaauacaucuuucugagaauuuuaaaaaauccuuucucuuuuuaaaauguuucucuuuauuuccaguauuccucucuaugccaauacauauaugaauuaaaaaugacauugaaguucaccaauaaaauuuagugcaauaaaauuggggaaauacagaguuccaaugauguuugggagcauucauuauaagagagugugaucuuaaagacaugcucugggaaagcauugccuugaucaaaugccaaggcuguugcaugccacagauagcauugcugccuuuagaaacuccugccaaaaauuaaauuccacucucauuucaucuucagcgauagcugcuuauuaagucuagcaugugugagaaugcuuuagaugcuuuuugacuugcugucuugugguuauagcauauauucuaaauaaggcaaaggcucuaaguuuuuaauucaggacaaauaaccagugucuauucacugugaaaacauuaaggaaccuuagcacuauuucaguucaacaccauuucuuuacugaauauuuucuucacuucuggcauaacuucuuaaaucauccuuauucuccgagacaggucugagaauagaauuuagcucaccucauuucauaaauuuuuaggugauguuaauuauggccacuauuuggcagucuccuucaaauagcccuccacuuuguguuuuucuuuacauugaaagauauuuuuaaauugauuuuuaauugacagauaauaacaauauauuuaugggguaugaaagauuucuuuuaauggaagagguugugaaagagagcuuuuccuuauaauguaugugcguuguugcccugagaaaagacuguaaagauauucuaaaagaaaaucaaggaagaaaaauauuauaacaagaacacaucuucagcccagaccucucccccaaacucuagaccuggaugucagcugacugcuuaaccuauccaguuggaugaaaauagacgucucaaacucaacauguauagaauuguuccuuuucuucccuuaaacauccucuacucucagccuuucuuaucccagguaaugggaccucuaucaccuguugcuaaggucuaauaauguggauucauccuuaauuacucuucauacauacagucaauauguaaggaaauccuguuagcuguaccuucaaauuauauuuaagugugaccuuuucucaccaacuccagugcuaccacccuggcccaagccaucucuccccuggaauacaggcccaaaauccuuuauccaaauaacuuauggaauauagcauuuuuuagauuuuagaaaaucaguaagguacacauacuauauaguacacacugaaguagugaaacauacugauuuuccucuagugcuuuuacugugaacauaucaauguuaaggaaaggaaaaugauauuaacucagagaugaugucucacagcauauauuuacuagcuugcacaaauuuuuuaauguuagcaagauuuaaggcaaauuuuuuacuuauauuuuaauuggauccuaugaugauuauuaaagaaaaaaguaguuaucucuagaaaguauaaauugagcucuuggcaaaugugagcaaaaccagaaaucagauuuuuuuaaaguuacguguacauuugucuauagaguuauaauuaaaaguauugugcucauagccagucugugaucuggggcauauuauuauaucuuccuaugccuuaaaacaauguuuccuguaaguauaaacaaaguaccauugacacugcaguuuuuguccauuugcuacuuccaaaagaaagggguacaaaacagaaaaguuauuuaaacuuuaagcaguugguuagauaugguaguuauaaugagcuuugguauuuuaauauggggcuuaaaaauuuucaucuaaaccaacauuaauuaucuaagugugauauccuuaggaggucuuuguuaaguccucccaauuauauccagcaucuccaaaggugacugaagucccuucuaauaacucaucuaucaggggaacccgcccccaauauuuuaacauagguucuuucuauuuuccauaaguguccgcuggcugagaaauaaagagaaagaguacgaagagaggaauuuuacagcugggucuacggggaugacaucacauaucaguaggaccgugaugccuaccugaccugcaaaaccagcaaguuuuauuaaggauuucaaaaggguaggggguacaagaacagggagugggucgcaagaucacaugcuucaaagggcaaaaaggagaacaaagaucacaugcuucugaggaaacaggacaagggcaaaaucacaaacuccugauaaggguccagcaaagaucacaaggcaaagggcaaaagcagaauuacugauaagggucuauguuuaguggugcacguauugucuugauaaacaucuuaaacaacagaaaacagguucgagagcagagaacuggucugaccucaaaccuaccaagguggaguuucccaauccuaguaagccugaggguacugcaagagaccagggcauauuucagucauuaucucaaccgcaugagacagacacucccagagcagcuguuuauagaccuccaccaggaaugcauuccuuucccaggguauuaauuauuauuauuccuugcuaggaaaagaauuuagcaauauuauccuacuugcacaucuguuuauaggcucuuugcaagaagaaaaauauggcuguauuuugccugaucccgcaggcagucagaccuuaugguugucuucccuuguucccuaaaaucgcuguuauuguguucuuuuucaagguguacugauuucauauuguucaaacacacguuuuacaaccaauuuguacaguuaacacaauuauagugguccugaggugacauacauccucaguuuaagaagauaauacgauuaagagauuaaaguaagacugguauaagaaauuauaagaguauuauuugggaacugauaaauguccaugaaaucuucacaauuuauguuccucugcugcagcuccagcuggucccuccauucggggucccugacuucccacaacacucaucccaccacuggagcauuuuuccuuauauuuaaccuaaauuuaugaaacuacaguuuaugcauuuuuaauauugucagauacucaggguuaauggacacaguuguucauugucuccagaucccauacuccauguacucaaagacacuuucaggagaugacucacucuucgcugggcccaauaauuuauauuuuauuaaucuuuucuuagaaaugcuuuuuuucaacccacuuagcaaucuuguugacugguccuuugaacauucuuuauuuuccaaaucugucacaaaugaucgagucaaagauauauaauagucaaaucugacccaauacugaucacggggggguuucuuuuaacauguuuuguaaucuaaaucauuucucuuuguugcaaaguagagauuuaugggcagcuauuuaaucuccagauguuuuuuccucaaauggccacauagugggcagucaaaaauauuuguugaauggaaugaaauggaauuuuauauuggauuuaauuuuuuucauucuaaguaauccuucauaugcuuaacuagcuaaauuuuacuuguugguucugauauuccuuccccaaauaaucaaaguuaauucagauuaugguuuuuuuucuuauccugauacagcuuaauauagccauugaaaauauucucuagaaaauucuaagucuaauauacuucuaaauuuuaagcaugacacugaaaaauagugaaaagcauagaaaaggaauaugaaaauagcauugaaacauuuggaauuaagggguuuuaaccacuacuaaagauagaauauacugaaccagaaaaccuagucuugauuucuaccucuauuuaugagguacaugacuuuggacuaguaugaguauuuaugagguacaucacuuuggaagaguuacugugcuuuccaccucaauuuuuucaucuguaaaauugagggaauauucccagcuauccuuucucacugaguagcuucaaagaucagagauaagggaucuaguguuugugaauucugaguuacuaugaaauguaaaagauuaauguguuuuguuuaucacuguaaauaaccuugauggggagaacuuaugugauuuaagguugcaacuuuuuaugugugaugugaaauauuaaacuuauuuuuaaaauaauuuuuuugagacagagucucacucugucacccaggcugcugcagcuucaaucucucaggcucaagcaauccuccugccucagccucccaaguagcuggguggcuauuuauuuuuauuuuuuguggauacaaauucuuacuguguugcccaggcuggucuccaacuccugagcucaaggaauccucccaccuuggccuccccaagugcugggauucuaggcaugaaccacugcacccagccuaaaaacaauuuuagcuugagggacccuagguuuuuuuagguuauaugacuagaaauauaauaagauguauuuacagggcuaauccggugggcaugauuugagcaacacuaaaguuaucugauguagcguaaaauucuuguuguuucauuaaugagacagacuugugcuucucaaaguguguuuuauagagcauuauuucucugaaauauuacacaguuguauguguuaaaaaguucuuaggucaaauacauuuaagaacuccuagguuuagcuaaguuaaauagguuucuuaacuguaggacuucucaauacuccaaugugcuaacaauauugcaaaucucuaagagaggcauguaauguaucuuuucccaaguuguuuuaaccaugggauuauuugaaucuugggauuagaguuuacuggaaucaacuuuaggucaggcugggcuaaacuaggaaguauggagaccauacuccacaaaacccaguaucccucacuaguuagcucucguugccugguuuuugagacuaauggguugaucuuggauuuaggaaugaggguuggggagggcagaaaggugcugcacaaacuuagccagaaaagcagcuauaaguggugguaugccuguauggacaccauagguuugcugcaggggauuguuaaaaagccacuuuucaaagacaaaacucuggugucacagggguaggagcaaucccagggcaaagaaacucagaaaaacuuucugcagaacccaaaguaaaggaaguuagggggacaugcuuucuguucuagcaauauauaaugaaaucuuauauaacuauuaaacauguuuuauggaaaauauuuaauaauuuuggaaaauacccauguuacaaaaauguuaccugaaaaguacaaagcuguaccugccauuugacuccaauuagauauaaaauacaugucugcauaugucuggauguguguaaaagucugaaagaaaaaagaccaaaauaguaaccaugaguauauccuguuuaugauauuuugggcgauuuucauugucuuuuuguugucuuuauccaguaauuuuuaaacuguucaacuguacuaucguugauaacaguaauucauuauaucauuaauuccuucagagagggggcagaguaacagaaccccacucuucucagcaggaaagugaggauucugauucuuaaucauguuuauuuuauuuuggacauacugaguuuuaaaaauucauugaagguuuuauuaacuucuauuuuuaaccuuucagauuuuccuuuacaauugaaugugauagcuauguccaauuuuagcuaggaaauuuguauuacgagagggaauauaacaucacuuggaccaggaaacagauuuuuuuuccccaguguugucagaagcccauuuuaacuaaaauaacauaggauguuuauuaacuaaaauaacauaguuauuuuaugcuuaucuuaagauguagauuccuaauccuuaugacacauuuacuaaaucagacuuacuagggaaaguaucucucagucuuuaucuuuauuuauuuauuauuuauuuauuuauuuuuugagacacaggcucacucuuuuacccagacuggagugcaguggcacaaucuuggcucacugcaaccuaagugauuauugugccucagucuccugaguagcugggauuacaggcgugcaccaccacacccagcuaauuuuuuuuguaauuuuaauagagacagggauucacaucugaguaggcacacuuaguccccaacacucaaccuuuuauucaaccagcggugagcuggaugugaacaugacagacccaguaggguuccaaugccugacaaccugcaccugucaggaagagcccccuccuuuccugcuccccugcaacacaugguuauuuuaauagagacaggguuucaccauguugcccaggcuggucuugaauuucuggccucaagcgaucugccugccucagccaccgaaagugcugcgauuacaggcgugaggcacugugccuggcuguucucagucuuuaauguguacacaaauuacaaggggaucucguuaaauugaagacugacugagugugucuggaguaggaccagagacucugcauuucuaacaaacacagguaauguuucugaucugcaguccccacuuuggauagcagggcucuuucuaaagcauaauggcagcuccaacccagcagaaccauauucuggauggagucagaacuagccaaauguaggcuauuuaaaauauagcaauugugccuaggcauguguccaccugacucauguaaaauaaaaagaaaaggcguuaauagaagccagauuauagaacauaauguuauuaauauguaucaggugcucuuaugaguggccauaucagagaaccagccucauuguugcuguuauuacgcaacaugagacugugcugcaauuccaaguaccaagcaguaagaagaaaauuguuuucuuuuacugauugcugcguguuguccugagguuuuuccccucaucucucuucuacagauuuuacagagucuguggcuaguucagucacauuguucuuagucauggaaauauuauggucuuucugauucuguguagugauaaguaaaaagauuguuucugcugaggggugaaaaggucuucaaaguaguuugcuuucuuguaaacaguaagaccugcagagacccugagaagaugccugauaucuccuugaaaauuaaauuucugcuaguguuuugaaggagcgaauugucacuucucacagguuaggaucugcugcugugaauucugaaaguuuucaagauuuuugauuuauauuuuaauuagauccuaugguagcuaguaaagaaaauaucauucucuccaaaacguauaaaugggcccuuggugauugugaccaaagucagaagucagauuuuuuuuugaaguuacaugcacauuugucaauagaguuauaauuuacaaguauuguccucauugccagucuguaauuuggggcguaucauuaaauuuuccugugccuuuguuuucuuaucuguaagucagggauaguaauaguaucuaccucauugggcuguugugagaauuaggugcagagguaccuauaaaacuuuuacuguagugcuuggcauguaguaauaacuuaauacauauuagcuauuacugcuacuauugauguugaauucauuuauauaguaaugauaacauuuccuacuuaauucauaaaaagacagccuaugcuguuuucuuguucugaguuuauauguuucucaugcuuuuuauuaugguucauuacaauuuuaauguuauuuuuaacuaacuagauccuuuugaaacaaauugguuugcaagugugagcuguuaggugcacagagaaaaaugaaaauagaaacuugcgauuuuauucuaggcuuguuaccaaauauuuagaauacuguguuuuauuuagguguuuauagucucauuagacaguugugauuuuaaaauagagaccacaucaucucaacuucuuuacugugaaaauaaugacaauagucuuuucagagaugaaucugucuagaugggaaauuuacaugauugaucugaugagugcauccagccugggcagcagagcgagacucuaucuccaaaauaaaauaaaauaaacaaaauaaucugacaaguaguuuccccagaaaaucugauuuaguaaauguaccaaaaggauuuagaaaucuacaucauaaauaaacauucuauguuauuuuaguucagacccuauuuuaauucagacuuccuaugggauaaaaacuuccauucuuucuuuaaauagauucuuuuggcuugagugcauuuacaccuguccccaacagcuggugggcuucugcucacccuagacgguguucaugcugcacucaguccaagcagcccuuaucagagagucuucuuaccacuugcauucuggugcgaaggacucauuccuggcagagccuaaccuucaugggaaccauuggcuuagaagagaggagaaggggaggccgaggcagguggaucacuaggucaggaguucaagaccagccuggccaacauggugaaacccugucucuacuaaaaauauaaaaauuagccaggggugguggugcacaccuggaaucccagcuacucgagaggcugagacaggagaauugcuugaacccgggaggcagagauuguagugagccaagaucgugccucugcacuccagccugggugacacagcaagacucugucucaaaagaaaaaaaauuauccugucuccgggcagugucucugagucuuucuaaaacuuuauuaaaaguuccuacaauacauaaaggagaaauagguaugucacaaaaauugggcucauuguugauuagcaaugucuaugcuccaccuuucaccagagauuuaacuuuuuugccaauuuugcucuuuacugucagcccaaaggugucuguggaacuuuguagauucuuccuaugggaugaaagcuuugacaaacaaggucuuauuucugugaguccaacaacccuuuucuuuuggcuuauaaugaauagauggcuaaaacuuuucucuaacaugguuaaagaaauuucagaaacuaauuuccagcccuuuuauuugcuuuucucucugaucacuuaaaauugugaugcauauguccugcaucuguagagagaauagggggagagagagacagggagaggaggagagaccaucucauaaaacucuugucauucaucccuacgcuccaaucugugucucuaaaagccucuagguuuugccaccagaaacagccuucagaauauuggaauaauuacauauguaccauucucuucaaugaacuaaacuccuaagcauagaaguaauuuaagacaguguuauuuuuaaucauuuaguccaacaacaaaugccagaacuggccuggguaaugccauaggaaccaccuuguuuccuaugaaacaggaagagaauuugcaaaccuaccuuuacuaaauaaugcuuacauuuugcuauaguuacucuuggcaagaaguugagcagugggagguguauaugauaauauuuacauuuacuucucugugcuuacuguuaauguuuucuggguaaaaauaugcaauugacuauuugggaaacuucauuugugaacacagguuauauaugaucacaucccuggggaaaauacauauuuaguagaaagugccuggccagcauuucuuacaagaacuuuccugcuccuuuuuguggcugauuuuaccccugacuccagggcccaguagccauuagaaaguacugugcuccucagcccaguccaaccaugccuuuauccagcugucacuugcuucaguaccuguacauucccuuucuuuuaguuuaugcagaaggcuguaagaagcaacaggcaagacauaucuuuugguggguaaaacauggaccaaugguauaaagauucuggggacauuuucuaaaaauauaugaacauucaugguugauguuaauuuuagucauaauuccccuaugacacccacucucaccuucuuccuguucauucuccaagcuacuaccagaauggucauuucagcaugcaaaccugaucuuggcaauccucuguuaauccuucagaggccgccaguuuccaccaggauaacguccaaaauauuuacaaggcuuuaaaagcuccugcacacucugccucuaucuccaauuccauuugaugcccuuccuccugcaccuucuugcugccucccucccccuguaaggucuacagcaauucugauguuucaguccccucucuuuucauucuccagagccauagcucauaguacuucuucuuaugucauagagaaagcaucacuucucagagauuuuuaugacguguauccuccccagccuagcuuagccagucccucacuccccacucccguacucacuagcauccucugcuucuuuaaagcacacauuaccuggggaaauuguuaaaaaucugccuucacuucuagaauguagaucccaugaaggcaagaguaugcccaaugcuuuauaacaagcucuuagcccaugcuuuguauagcugaugcucaguuucuugacugacugcauaaaugaguggauggaguagaaggaggcaggaugcauggacagaugguggaggaauuguauugcuagcacuucucugauucuuuuuuaguuucuaaauuuauaccauucuaauucuaagaauuaaugguucaacugcagagaauagcagguaugcauuuguuuuuaugaaauauauauauuguguauuuaaguugaauauuagccaaaguaucaagcagggaaagaacaauuagaaaaaucauguaccaaugucuauccugguuauaguucauuuuugggcaaggcuagucauucauuuuaauuaacauuuucugcauugaucaaaauagcucccuugaaaucaaagaaaaguguuugaauuucacaaacauauuucaauuucauagccuugcguucaacaaguaucaagccuauucuaaguucucuuugaguaaccaaaauacaaauaacagacauauaauugcuauuuauaugugaucuaacagaacccucuuuuauuuagaugucuuagguaaguuuuuuauucauauuuauauuuuuucuuuuuacaauccuaaaaacauagaauuacaaaaaaagugaaccaauacaaaugaaaaaaaaaauuucauuucuaauacuuagauuaccaguauuagcauauuggcauauugguguauuuaucccucuuuaguccuuuuuuuuugguuuguuuuucuuguacaugauugugauaauaacauaauacugcuugaaugauuuguucugcuacuuauuucacuuaauauuuucacauaaacucuaaaguguaucggggguggguaguuuuuuuucucuugaaacuucagugggaugcucuuaguaaucccauacugguaugugugaggaaggaaaauuaguuaaauaauuugguaugguuauagaguagagcacacaaaauuguaagaaccaauagcuucugagcacuucuggucucuaaauuccuuggaauguuucccaguggauuguaaugaagguauacaugaucaucugcugcuaaauuaaaugguucuuagaaaccaagaaccauuuaauuuaauauuaauaauuuauauuaauaaaccaucugacauuuuacaaguuguuacuugacuaauucuuuguguugccaucuucuaacuguaugaucuaaucucuuccuuucucuucaaccucaucccaugccgcuuucuucauuucucaacauccuccagccauugugaacuccuuucuuuaaauuuuccaagcacuuucuuugugcuugcugccugaaacccucccucuuccccaaccccaaugcuaugcuuuuugcuuggaaaguuucauucuuccccuuucaguuuaaacugugcuuccucagagaggaccucuugaucucccuuuuuauaaaacaggcucccggugccaggaaaccuuuacaucaacacucgauuugccauuugauaguccuucaucugggaggaaaaaaaaagacggaggggagcuugaaaaacugucauaaugucccuggaauaugguacuuuuaagaguugagccuauuccauuuuggagaugauuuauauaaguuacaacaaaagaaggggacaaaaacaugauuguucuauggaguuuuuauaacuuucugucacaagaaagcacgcuugucuacaauuuuguaauauuucuaguaaauaaaagaggcacuccccgucucagagcaccaaauaaggaaaguguaauuggaugucauugcugucagucagcugggcuauaaaagagagagugggguugccucauccccuggguauccacagucagcugugucccuagagcuucuuuucuuucauugcugcccagcuggguauauugcaaguauggauuauaagaggggaagggacuucacuguuuuaacguuugaaacaaaaaggaaaaaacucagaaguaguaagcuaaaaacaacuugugcaaacguucugggauuauuacuuaauuuuaagaauuuuugcuaaaaacaauaggaacaucguugaaaaaagaaccccuuugagugaugacuguuucauaguguucuacaucuccuacucccugccuuauaaaaauaaagcuaauuaauugaaguucuggcaaagagaagggaguauuccuuggccuuugaccaagaauuccccucaccaccaugaacauucccacgcauuuccccaccaguuacucuccaugaugucuuccuuccuaacucuuaccaaaaucucaaauuacagcacucguuuaucuccauauuuaaagucugcuucucccauuagaauucaagccauguaagauccagacccucagucuugucuaccccguucacccugucuccuuagugcccgccacaguggucggcaucugcuuggccaucaaauauacacugauugaauaaauaaaucaaugauuuaaagaaaucaauuauuuuuuuaaaguagauucuuaugcuuugucccacuuguguccuuugaggaaaagugugaaauacuaccugggguucuaacaggaucuuugcauucacuuaguaaacacuuauugagugccugucaccaggucaagcccuggaaaugccacccaaauaagacaugauugaugcccuccaggaccucagagacuagcagagggacagacacauguguguaaauagcugcaauucuuuaugaaaguguguaauaggggcuuauaagcaugaacucuugagguacaagagggaagaauuugauucugccuggggcagaaucacuccacagaggccgugauauuuaugcugggccuugaaggaagaagagauuuuuggcagguuaauuagcaggaaagagagcauugggucugagacgugaaaaugaauggcauguuuggacagcauuguguauuuuggugggguagauuguaaacucuggcccaagaaguuugaguuugaucuuaaaggagccagggaaacuguuuaagcaagggaggccaugguaggaaauguauauuagagugcaacaaugugcggaguucacuggggguggggaguacaugcugugauuagaaaccaaaccauucgcuuccaucauagguauuuucaguuaaaacaaccuugauuuaaagaucauaauaauguaucuuucguagagaugaacuuuagaauuucauagagaugaauaguuggcuagaaauugguugcucuauuaaaauguauuuuccagauaaagacuuuuuaaguuauuuuuguugaauuuuagaaacuuuugaaaaucauuuuuaaaaaauguacccagaucaagguugcaguauaaaucacugcagaacaaaauucgugaaucuucaugugauauauaauuaaauauuuuggauucauccagaugaauaaaaugacuaggccuuuuccuccugcccuuguuaaagguaaugccucuuuaucaauacuucacacacacacacacacaaaaacucaaaaccuuucucuugcaguuccacggcaaccuucaaaugacuuguuugaaauauuugaaauagaaagaggagucagugcagacgaugaagcaaaggaugauccaggugacacuuacacucuuagugccaucauaaugacauuuuauuguuucucuccaugaaaauaacuuuuaaauguagaucguuuggaccauuugggaaaauuacaccuguuuucuuuaacaacucagauuuucuuuguaguuaaaucaguugagcaaaaauaauuaugaaucauuuucuuuuuuaaaaaaauuuuaaaguaguacuuaaacuguaaaaaggaaaucauauuuuauaagugaugauguaacauuguuauaauuuggcaacacuuguguguucuauuuuuacagaugaugcacuauugugcugagaaaagauuaauguaauuucccuuuggucuuauggaaagaagcucugguuauauggauaggagagaacacuuguugucuagauaccccuaguucauagauucauuuguuguuuuuuguugauuuucugauccacucaucuuucugauuauuuccuuguagguguucugguacacaguuguaauuuugaccauggacuuuguggauggaucagggagaaagacaaugacuugcacugggaaccaaucagggacccagcagguaaaaccauuucauuuaacuuuuucugguacacauuucaaugugauacuaucugaagacuccacugcugcuaaucaagucuacuguaacacaucucuguguuuacuugauaaagauggucaaaaaggaccaugccuagcauuuauauuucauuucuuugaaagaguuaaauuuguuagcuaucaacuagcacuauauuaugggagacaaguaguuaauuaaaaggucaacuaauuucucucaaaaagcuugauaaauaaaauauuuagauuaauucuugcaaauaauucuuaaguuauuuguagcacccauucccaggaauaaaagaaguaauauagugguauaucagccaugguaauaggcauuccccaguuguuuuuucuuuguuuuucuuuucuuuuuuuuuuuuuuuuaagauuugagugguaguagaagaacacaguggaaauuucuauaaaguugugauuauccucugaaaaaauuucacucuaacuugggugcugaaggaaaugguuacgaaucaccaccacucauuuuauaacaaaagguagauuuagacauaguuccuuggaacucaaaggaguuuuaaauugcacaauuccuauuaaucuaaaguuuuaguacucauaagacaucuuuucuucuagauucaagauagcuuuucuccccucaguaguuaaaucuuuuuuuuuuuuuuuuuugagauggagucuugcucuguugcccaggcuagagugcaguggcgcgaucucggcucacugcaaccucugccuccuggguucaaugaauucuccugccucagccucccaaguagcugggacuacaggcaugugccaccaugcccggcuaauuuuuuguaauuuuuaguagagacuagguuucacccuguuagccaggauggucucgaucuccugaccucgugaucugcccgccuuggccucccaaagugcugggauuacaggcgugagccaccgcgcccagccagaaguuaaaucuuuuauggauaaggccuacuuaauggaagggugaggaguuugguuucauuuuuuuuccuuuuuauacuccugauucuagauuuuaagaagauacagaaugugaaggaaaagcuuguuauuucauuuauuuuaaaagccuaguucuugaauaccauacuggauaagagcaccaaacacagaaaaguuaacuugagagagcucaugauaucuuaaaccagcucuucucaaacuucacugugauugcagagcagcugagggccucauuaaaauacagauuuucaugcauuucuagcaggcucccugaagaucucuauggugguccucaacgcacauuuugaguaacaagguauuaaaaaauuaguccaaaaauauauucauuacauccccuaagguugaaauagagauuuacuuaaaaauuaaaaugugaauuaaauuccuuaaaauaggaauauucaauaaauucaaauugguucauacauuucuuuucauuguaaaagacaauaucauuuagugccucacacacaguacucucagucauucuugcauuacugucuuacucauuuaaaguuaacucugagcaggacagcauuaucauuaaugucacagauucugugaauaagagagaaaccaacauaucuacguguguguguguguguguguguauacaauauaaaauaccuaugacaguccuagcuuauuuaaaaucucaucaauuuuauuuaauuguagcaauuaaaauaaauuuauuucauugcuacagaguuguagcaauuuacacuccuaccaacaguauuugaaaaccauccccaacagauauuauaaaaguauuuuuuuaaaucucuaccaaucuuauaggugaaaaggaaucucuuuuaauuuuacuuugcauuucuucuauugugaaaaguugaucauguuuuaucauucacucgaggagcaaauaauauugucuuuauuucacaaaggaaauauugacacccagagaaguuaccuguuuccuaaggccacagagcuagagagugguggaauuaaguccaaaccacucuguacuacucaugcaggcuccuagacaguccaauacucagaacaucugcagcauuauuguguuuuugacuguaccacaggcuggccucaguaggugugcaugugguagugugcaugaucugauuagcagaucacagaccuguagauuagacugacugaccacugaccuggaguaguuugcuacagaaggagggaucuuuggcagucauguaugacagaauggugaauaauauuuauggucauaaugaaugauuccuucaaguaaguuacacuggggagaguaauucaugcuaaacucaggagaauucacugcacuucuauguaaacaaucuauguaaaauacuugaguuuuagaauuuaaauacuguauuuuagaaccaauuuaguccuuuucaacauuuuuuuauuauucauuauauuuguaaauguuuaaauuuguugugacccaaaucucccuuucucucugauggaaaaaugagaagaggguuagaaauuagaaugguagacaaagaaauuugaaaucguuauuggaccguguuaguacagagcaaauugaaaggaagagaugccugcuugagugauuggauaacucgugaugauuggcuacggucccuggaggaugcuuuucuagaauugguccaaguuuuuaccaagaacuuagauaaauaggacauugaacuuaauauugaagauaaacugaccaaacuacgguugacucaaaucuggagaggaaagugacuaugugugcugauacaaccagcauucgaaaaauuagauuaaugggucacaauuaagaaggugaaauguaaugggguugagucgaaguuauggcucauagucgagaaaccagucacacaucugagugagggggaagaccugacauaucacuaaggguagaagacuuuagaguuuuaguguguaaugaaaucaaucuaagcgaaccuugugauguugcugccagaaauauggaccaucucuauagaaauaugcuauguuucaagaaugaaaauccacuuugguuaaguggugaauccacuuuugagaauucuuuuuuucuaauaugagaagaauagaguuggucacuuagaagaggaugaccugcauggaaagguaucuccaagcuugugaaaaacaggcaaaggaaccauaacguuuagccuggagaagaaaugaugcaucaggguuccuuuucaaauaauugacuaggguuagaguuguucucugugaccgaaaggggaugagaauaggauugauggguaaaaaauacagggagauucauuuuggcucacugucaucuaaaaagagaacaggcugacauggaaagagugaguuaucuugguggaagcauuugacugggugacauauggcaagauacuguuaaaagguuuugagcaucagaugaaaguuggauuagaaaaccucuaaaccagcucugagagccugauucagaauggaauguggaaauagucccaagaaauucagugagcaggauucuagcuuggaaagaaggaugggaagaccaaaagauggcagagaguuggaaggcaggauaugugaggauggaauugcagaauauauuuuuagaauauguugagagaauuauaacccagcacugaugggaaaauacuaauaaagcuuaccuuuucaugguuuuuuauucuaggaaauucagguggauggaguguauguguguguguguguguguauguguguguguguauguauguguauguguguguguaucacaugugaaggccagagaagaauauaaaaaaucggcuagacacaguggcucaccccuguaaucccagcacuuugggaggcugagguggguggaucaccugaggucaggaguucaagaccagccuggccaacauagugaaaccccgucuuuacuaaaaauacaaaaauuagccaggcgugguggcaggcaccuguagucccagcuacucaguaggcugaggcaggagaaucgcuugagccugggaggcagagcuugcagugagccgagaucacgccacuguacuccagccuaggugacaaagcaagacuccgucaaaaaaaaauaauaaauaauaauuucuguguauuauucuaauuaccaagcuaauuauuuaccuauuucuaucuagauuauaccacuuauaaaagaauauguguuuggauauccaauuauggaugauuuuaaugaugugcaguucuaauccaagauccagauuuguaaauauucuuauaugcuaauauuucuaagaaaacucucaaaacucaaaaccuuaagaaauagcugcaaaauaagugcauuugcuagcugccuuucauggugcuauuagguuuuaucacauucagucacagugagaugugaaauuaacaaugccucuaagaaauggaaaauugugcugcugacagacauggugaugcgcugcagguauguagcuguggcccuggggacacacccuucuccugugugugucaaagcuagaacuaaggcccuuuuccuggaaccuugaucucuggagaacaaggauuaagggcaacugacucagcacucugucugccacugauagcuacaaggaauuugcuuacauauguaucaaguaugccagcauguacauacaaguaugucuauuucagcauuaaaacauuauuuuaaaauacacauaaauguaaaauaaaucaacaauauaagugaaagcuuucuaccaucccugacucccauucaccacccagcaagaugcagccaguuucuugauuauguucucagagagauauuuuuggauacaauggcauucucuucugugccuugccuuugucacuuaucgauacuaccuuaagaguuaacaggaagaacauggacuuugaagccagaauaccuggucuggaacccagcaccaccacauacuagcuuugaccuugagcaaguuacuuaaauggggauaauaaguacuauccacuaaacauauguaaggcauuucaagcagugccucgcccagaguuaccacuaaaauaguauuagccauuguggcugaagcauguccccugucaguacauacagaacacccucauucuuauuuauggcuggcugcuauuccauuacucaucagauguaccacaauguauuuagccagcccuccacagaggaacauaaguuguuucaagacuuuagguaguucagacaguagugcagugaauaacccuauacauucauuauuuaauauauguuagacuauauccauagaauaaauuccuaaauguggaauugcuaugucaaaagagaauuuguauuuugaauuuugauagauuuuauuaaauugcccuuuauaaagguuguagcaauuuacacuucuuccuacaauauuugaaaaccauucccaauauauuauaaaaguauuuucaaaaucuuugccaaucuuauagguuaaaaggaaucucuuuuaauuuuacuuugcauuucuuuuauugugaaaaguugaucacauuuucauauauuugucauuuuuucucugauguucuuuauuuuucuuuaguauuuuuauugauuuauggaaguuuucuauacaaaaagaaaaauuauccuuuuuuaauuuguugcaaauauuuaaaaacauuuuuguuugucuauuuuaugguauuuuuaucuuaacaugcaaauuuggaaacuuaaauguucuucaguaagaaauuggcuaaaugguuauuggcauacuugcagcaaugcaaaguguauuugcuaccauagaaaaaugguuauacaagaagcaacuuacaacacugcaaauauaguauuccuuuuuuuaaaaaaaguucauauucaugugcauuuaugugaauguauuacauaagaaaaguucagaagucaaaaccuucacaaauaccucuagauuuugugaauugaaaauuuaaaggcaccaaccacuacagaauuaaaaauaaauaaacuaacauuuuauaacccaacuuucuggucaaguuuugcagcaucuauuauuuacccucccuccccaaaauucuugagauauugugauacuguaaacugaaugaauguuuaauauaauuguacauuuaucaccagaauuaugaaaucagaagugaaaauuuuaauagguaacuugcuugacacugaaucaauuuuucccuuaguuaauguuccaacuuguaucauuuccuuuauuacaaagggaacgaauucuucauggccaaaaaaaaaaaaaaaaacggcaaaagcaaaaccuggugcgcacagaguagcucuacagaggaagaacaaucauaaccucauuuaucauguuguaaauuuuagaguuuuaaaugcauaugcaaagaauaccuugguguguuagguugucuuguuugcagguagcgucuggcagaaugguaucaguguacauuccacagggacuuaauccuuguuuucucgaaacuugcagguuaacuguaauaaccuuauaucuuagucuuaaccagaguaccugugaugauucaaaagcugacuuauagugagacauguaaauauuuuggcccaaaauauuguuuggauuaguuuguggaggaaggggacaagggaagugggagaaagauucuuaagacauuauguauuuuuagugauucaaguacgugaaucaaggaucuauuucccugcaguuuuuugcuguauccuuggaacaucauucguugauucaaacauccuuaaacaccugcugccugcuagcaggguaacacagagguuugggggaaacuuugguucagacuuuuaaguuguucacaaccugcuggggagcccuuagcacagaggcuggcacacaguaagugcacagaaaucaccugugaccuauagagcuccgacgggacuuguuagagaagacacuggaauaaaaaguuaauaccaaauuuuaucauguccuguauaaauuaagcauaagaaagagaugauaguuuauaucuguuaacugaaaacuaaaugggauuacuaccaaaauagauacacauguucaacauuccaaccauuuuucuauggaaaaaccaguguugaaacauacaguguguuuucaguugacugagauaaaauagccugagggaaugucauuuguacauggaucaaguuucaaaauacuacuugcaacuuucucucucuugagaagcagcaccccccacuucacugcugcuuaaccauuuuuuuucuaaugcaguuuccuuaacaacagagggaagaaaacucuguagcccuagggaucugagaacaucaucaaaguggucuaucuaaagugaaaguuuuuauuaauauuuguguucauguauauauaauaggacauauuuauagaauagauaugauauagauuuguuuuacuauaaaaauguuuuaaauggcuuaccuccaaauaaaauugaagcuccaggaagacggggaggguuuccugaauaccucuguaucuuccugguguuagauuuacaccagugugagaagcucugccaacucugauuuuuuuuuuaaagaaccuuuacguuuagagauuuuuuuuuuuuaaguugggggaggagagaauaagcagauauagggcccuuuaaaucaccaucugcuuuacuguucagagguuaauuauccaccagaaaauucucccuagaaauuuagggucaguuuuaccaaaccaccaagccagaucgccagggguguuggacaacguuaucauaaacuggugagggucacaagguggugaauguguauauguuguuguaugccuauaugucugaucauauuccacuggaaauauucauaguguuugguuacuaauuauugugugucucuggcauuacuuguacuuuccaugagcaaaguaagugaauguuuucuguaaacacauaccauagaacuuaagacaggcauacaaauaagucauauuuuucuucuucaaaaaucuggaauucuuuacaaagaaaagaaaaaaaaaaaaaaacuaaaacuccuguccaugcugcuuguucuagaaagggauauuggcacauacacacagcccugcuuuucccauuccagguggacaauaucugacagugucggcagccaaagccccagggggaaaagcugcacgcuuggugcuaccucucggccgccucaugcauucaggggaccugugccugucauucaggcacaaggugacggggcugcacucuggcacacuccagguguuugugagaaaacacggugcccacggagcagcccuguggggaagaaaugguggccauggcuggaggcaaacacagaucaccuugcgaggggcugacaucaagagcguaaguagauccacaaaggaggcaggaccugggacguuuuccuuucauaggagaacucugggaucugaauuugaagaagccuugcugugugaauucaggcucagauaaagguuuggguuuuuuucugggccugaugacuccauucagugucucuuucugaaaccacuuucugcuucuucauccuucuucauugcaaccugugaucaccaccucucccuaacccugguaaagauccauuuuuuuuuaauggaaaaaaaaaucuaggaauagaaaaguuuuuuugguuuuuuuuaaaguugaucaacagaaacuuccaagggugggguggugagcuuaauuguuccugcuuucccuuuccuuuuaauuccuuagauuucaaacuuuuacuaccauaaauuacccaggagaugguucuuuuuucuuuuuugaaauguuucuuucaaguucaaauuuuuuucuuuguuucagagaucacaguuaagcagcguagggugggaacucagaacuacaauuggaaagcacuauucuauucaggacaggaugugggaagugcuuugauggaauauauaaauuugaucuuaaguaaucaagacauagguagcaaaaaaauggucuagggcaucccaacaaaauuaugaaugcauuugggaaaaugucaucauuuugcuggugcuuaugaaacuugcuguugggagauaccuaugccuguauguagguauaguuuauaagaaaccauuuuagaaagaaaagauagauuccauuaauacaguuuuuaucagaguacuuggauuuuguuuaauucuuacauauuuuuucuuaaaacuuuucucaguauuuuuauuguuuagagaaauaaaacaagauaaucauuuuaaaucauagcacuuagguuuucucuuguuuuauaaggagcaaggaugcucuauagaaaauauaauguaagaauaauaaaaguuuuugguuuuuacauagguaaagcaacagugugauuggauuaugguguuugauucuauuccauuuucagcaagaaagcgauguuaaccacaaaggaacuaagaaacauuuaagauaggcugugugauuaugaucuuucagaucuuuggcuccuaauaucuguuccuuuauauucuaucacacucuucuaacuuugguaauccuugacaaaagugugcacuuuauaaacaauccuaaaucgaauuggucuauagcuuagaauggcuuuuuaaagaauaauugauucugaguaauguggucugaugaacaguuugaugacuucaguuucuacugaaagagaagcuucagugauacuggcaacuauauucuguuuuuuuccuccugcaaaauaaguuuaaaauugguuugggggaagguuugccuuuauuuuugcuuaauaaggaggcauuagaaaggggcagaggaggcuugacuggugugugcauucucucccuaggucgucuucaaaggugaaaaaaggcguggucacacuggggagauuggauuagaugaugugagcuugaaaaaaggccacugcucugaagaacgcuaacaacuccagaacuaacaaugaacuccuauguugcucuauccucuuuuuccaauucucaucuucucuccucuucucccuuuuaucaggccuaggagaagagugggucagugggucagaaggaagucuauuuggugacccagguuuuucuggccugcuuuugugcaaucccaaugaacagugauacccuccuugaaauacaggggcaucgcagacacaucaaagccaucuguggguguugccuuccauccugugucucuuucaggaaggcauucagcaugcgugagccauaccauccuccauccugauuacaaggugcuccuuguagcaaauuaugagagugaguuacgggagcaguuuuuaaaagaaaucuuugcagauggcuaugauguuauguguucgguguuguaccaugaguaguauugacuucccuugagauaugauguacaaugugcuugugaaauugacuuacccucuucacuuaaguuaguucuggccugaccugaacucugacuuuuacugccauucacuuuauaaaauaaggguguguaacauaucaagauacauuuauuuuuaucuguuuuuuuuuuccuguuaaagacaauuauguagagugggcacguaaucccuccuuaguaguauuguguuuuguguaaaugugcuauugauauuaaguauuuacauguuccaaauauuuacagacucuaguugcaagguaaagggcagcuugugaucucaaaaaaauacauggugaaaugucauccaguuccaugaccuuauauuggcagcaguaggaaauuggcagaaguguuggguugugguaacggagugaugaauuuuuuuuuaauggccuugaguuugaucucugcaaaggauaggaaaccuuuaggaagacaagaaacugcaguuaauuuagaacugucacuguuucaaguuacacuuuaaaaccacagcuuuuaccaucauaacauggcucugguaauauguaggaagcuuuauaaaaguuuugguugauucagaaaaaggauccuguugcagagugagaggaagcauagggggaaacuccauuggaacagauuuucacacaacguuuuaaauugauauaaguuuaggcaguuguaguucauaacuuauguugcucauguugugcugugucaggaugggauaggaagcaagucccaugcuuagaggcaugggauguguuggaacgggauuuacacacacuggaggagcagggcaaguuggaauucuaagauccaugaacccccaacuguauuuccucccugcauauuuuaccaauauauuaaaaaacaauguaacuuuuaaaaggcaucauuccugagguuugucuuaauuucugauuaaguaaucagaauauuuucugcuauuuuugccaggaaucacaaagaugauuaaaggguuggaaaaaaagaucuaugauggaaaauuaaaggaacugggauuauugagccuggagaagagaagacugaggggcaaaccauugaugguuuucaaguauaugaaggguuggcacagagaggguggcgaccagcuguucuccauaugcacuaagaauagaacaagaggaaacuggcuuagacuagaguauaagggagcauuucuuggcaggggccauuguuagaauacuucauaaaaaaagaagugugaaaaucucaguaucucucucucuuucuaaaaaauuagauaaaaauuugucuauuuaagaugguuaaagauguucuuacccaaggaaaaguaacaaauuauagaauuucccaaaagauguuuugauccuacuaguaguaugcagugaaaaucuuuagaacuaaauaauuuggacaaggcuuaauuuaggcauuucccucuugaccuccuaauggagagggauugaaaggggaagagcccaccaaaugcugagcucacugaaauaucucucccuuauggcaauccuagcaguauuaaagaaaaaaggaaacuauuuauuccaaaugagaguaugauggacagauauuuuaguaucucaguaauguccuaguguggcggugguuuucaauguuucuucauguuaaagguauaagccuuucauuuguucaauggaugauguuucagauuuuuuuuuuuuuaagagauccuucaaggaacacaguucagagagauuuucaucgggugcauucucucugcuucgugugugacaaguuaucuuggcugcugagaaagagugcccugccccacaccggcagaccuuuccuucaccucaucaguaugauucaguuucucuuaucaauuggacucucccagguuccacagaacaguaauauuuuuugaacaauagguacaauagaaggucuucugucauuuaaccugguaaaggcagggcuggagggggaaaauaaaucauuaagccuuugaguaacggcagaauauauggcuguagauccauuuuuaaugguucauuuccuuuauggucauauaacugcacagcugaagaugaaaggggaaaauaaaugaaaauuuuacuuuucgaugccaaugauacauugcacuaaacugauggaagaaguuauccaaaguacuguauaacaucuuguuuauuauuuaauguuuucuaaaauaaaaaauguuagugguuuuccaaauggccuaauaaaaacaauuauuuguaaauaaaaacacuguuaguaauaccag

SEQ ID NO: 13847 - RNA, 1689 nt, Homo sapiens
aucuaguuauccagcuugguguugacuucaguguuaauaaauugaggguggaagaaacaagaauagacaggagcucuaagcuuacuggguaaagggggacagauuaaaagagacagcauuucccuuugaaaacucuugauauaaugggcuccaaccauauauuuuuuggaagagcuuugacauuuccccuuuccccucauacuuugacaagggaauucuuuuauuuucugccugagcucuuagagagauggcuaugcaagaaagcaacaaauggaauauauauggcauacgcuuuucacuuaaccugggacaagugacugaucaaacguucuaaaaaugagaauauggggugcuuuagguaugauuccaaccuaccaacaugguaauauagauagagaaguaaauauauuuaauagcaacagagaguaaaccuaaaaugcucacaaacuguuaagcauauauggaccaacagagagaucaagagcccaaaggaagcacaaauucaaaaccauugcuuucgugucaucuacaacauucaaaacacaagguuacauaaaacuaggggaaugacaaaaauuagcaaaggacacuaaucacaguaugauaggccauugaaauacuguaaaguuucaagcaucuuauuaugggaaaaauaucaaagaguugaaagguacagaaaugacaacaaaaugauaaauguuaucaauguuuauaacugaaaaaaacauagaaaaagagguuuuuuucauuagaaaggaagagauuagaagagagaauuauugagguaucuaaaacucugaugacuauugagaaaggagagacaggaaauggcucaaaagcaaaagagaacaugagcagaaagaaacaaaagacugcauuaaagggaauucagaagcaauguauuugcagaguguaauuacuauggucugagaaaaggcuacugauaucagaugggcaauauccaaauccugaguguauuuuuacaaugagucagaugaggguuuuguuuguuuguuuucauuugcuuuuuguuuuguuuauggcugugagaggugggaaugagggggacucgguggggaggguagugggucggaggugggagaggggauacucuauaaggcacagaaccuacuuacagggauugauucaucaggacgacauggcuccuuuccuuccugaaaugcgagcugcucucguucauuaaguuaacacacugaucuggcagagccacauccuggaauccuaaaaacaucagcuuccaucuaaacuuuucauuucuuauaugcuuaauuuggcuuagucagcuugauggcaaguuugcaauauuauaaauaugcauauggccugguaucugccacccaucugauccugacuuaguugccuauaggaaaaagcauaagccagauaggaugugccggugggcaaagcuccagguuuggaguucagguucagucuugauaaauaucagauaauacugacugcuuaucuaaacugcucagucccauaaagccugugaccuuucuucaaucaccugacuaggucuuguucgcucaggguagagcagaaauuuuaaaagcaacccacacaagccacaguuuuaccauaauuuugccuacuaauguuauaaaauauuuugacauucaaaugucucauccuucagggucaaaccaacacuuauuauucucuaug

SEQ ID NO: 13848 - RNA, 2401 nt, Homo sapiens
uuguuccccugacuugcugucagcugucacauuuuguaguucaccccuucugcaagacccuuuugauacuugugauuuguuaagaagcagaaaucagauaaccaaacuuguuagaauucaaugugaaguaagaauaaguagacucuggguagcugcugccucuaccauuaaaaauuuuuuaaaaagaagacuuuuucaauuaccacuuaauuugaacuugacuuaccuagacuacuauuagucgauauuaguuuaacagagggaaaauuguuaauaaaguagauguaauauguaaacacauacaucauuuccuuguucuggaucuaucaaugauuucauacuuugacuauaucuaaauuaucugcuuuucccagccuucaaaguggucuuuaauucaccccugcuuuccauggguuaaauuuccuacaaugcugagauauuuauauugguuuccuccuguccuacgaacuucguacugauuucugccacaauaaauuugauuagaugaaaaaaaaaaaagacuuuuuuuuuuuuuaagauaggguuucacuucuguugcccaggcuggagugcaguggcacaaucuuggcucacugcaaccuuggccuccucaacucaagagauucuugugccucagccucccgaguaacugggacuacuggugcgccacugugcccggcuaauuuuugcauuuuucuguagagaugagaucucaccacguugcccaagcugguaugguacuccugagaucaaguacuccacccaccucagccucccaaagugcugagauuacaggugugucgucacugcaccaagccaaugaggcacucauuucugaauaaaguacaagcauuaguaacaucuccccuggucucuccagauugguuaugcugccacaacugaauucuaaauggguuaaguauuauacaauuacuuaggcuucuuugguagguaucaaauaaaacauccaccuaaauucuuaagaaccuuguuaaauaguggcauuuacaaacucucuauacagauucugacagcacauuucuauuggaagacuauggaaucacaaugaggaagguaguacuauauagaucagcagcuggcuuaauuggcuuccuguaacuuacuuauuaacaaauuagguuacaaaauacaaagucaacuuaaugaaucaucguauuuggcauugaacucaaagcugaauugugugaauugugaggugcuuuccauaauucaacuugcuuaauuacccauaugaaugaaucauucauaccucaagccugcuaacacuuuuggauaccugauguuuauguaauagugauguucauuugcugaguaaggcaugaguaguuuccuagguaagcagaagcaguccucaaaacaaucaugugacgcaguaacaacagggcuguauuuugaaggcucuagaaaccgaagacauguauuucaagagccaaguuacuuuuuuuuuucuuuuaccacuuauccucaaguucuacaaguuacuuacacugcaucaauucaaauacauuugguuauuagaugucuauuuuuuaaagauggacaagauaaaauuguguaaauuuacaagaaguaaugcaaacugcuaauaaugcuuauuuaaaggaguuauuaaagcaacagcuuacuaccaacccuacgcuucugaaaaaugugcacaggugggaaaagauaugggcauagcucuuagcauauuuuaacaacugaaaauguggcagggaaaaagucuuuauucugagaguacaaccaucuuacuuuugggguauuaaaauuaccuuuuaugagauaauucauuuucaauguuauuugacaaaauucaaaguuggucauucauuuuagucuccucauuuuuaguaaauuugccuccuguaaaaucuaaguuaugggaaccacuagaacaugugugaaaacaaguugcugugagaugcagugauagauuuuacaaaaagaagagcauuucaugaacacagaucaggauauccaaaauuuuggugagguggauuuuuuccaaagucuggugaccaacuguggaaaaauaauugguuaaucugacagugaggccccuuaacaguguugaagaaaauguauccgaaaaagcacccagagucaaagaagugagagcaaugcuguauuuaucccccacugacaugugaggaaagaacaauuuuggacauacaccuuguaaaacuucucaaaaaccagacuacauuucuaacucuaaaauacaugcugcuggucaugaagauguuacgaucauauaauugaaccuacugacauuacauguaauaaauuaaaaacccaaguaccaugcuuaguguagugucugguacauacaagugcccaauaacaauuaguuuuauuucuagaaggauuaccucugucu

SEQ ID NO: 13849 - RNA, 4020 nt, Homo sapiens
caguaguauuuugccuuugaguaacuguccccagcuccagugcugcaggcacauuguuccagggccucuguggugcuccugaugccccucacccacugucgaagauccccggugggcgagggggcggcagggauccuucucucucagcucuaauauauaagguaaggaggacccugggauggaaggcugggguuggagcuuucucagacuccacugugcugcugcucaaggggaauaaucacuuucuuagucuucuggcucuuagccuaggccaguggggggacugugaaggacucuuucagcugaggcuguugcauggcuuauugggaauacuagaggagagauaucagcaccauuuguugccuuuuaaucugcuguaauugaggcccagaaguuaguuuagcuucucacuaagacugggauggaagguuagcaaggcagcugaauucugggcuuuugagauugugcccaagggagauaacacggacccugcaguccacuuggaaucagacuuuggcugacuggggcuccagccaaacccucauacauacccucauuuguuuuugguauuucccuuucugacagggaaggaaaagaacaugguguugggggaaagcgugggcuuucgagucagggagaccuggguuugaaucucaucucugccauucacugucuuuggagccuugggucaguugcuucauuauucucagacuuaaaguggaguuguuaauuaccaucucaagugcuugucaugaugauaaagguaauauaugggacagcacuuuguacuuggcaccuaguggacaauuuagguaaauauuucccuuucuguuuugcuagcuuuuaccaccaucaacuggucuuagugccuggugagugacagcuccuuuuagccaucaugaagcucugcguuuucagcauggccucuaucccacgcuacccugacacuggccuaaggggacucccagcaucgccuagauuagggaguggaugauauggccagaagcaguagugaccugguccucugcccugcuuuccuucccaggacgagaagcucacugugacccaggaccucccugugaaugauggaaaaccucacaucguccacuuccaguaugaggucaccgaggugaaggucucuucuugggaugcaguccuguccagccagagccuguuuguagaaaucccagauggauuauuagcugaugggagcaaagaaggguaaagagccaaaugcuggggagggaaaggaggucccauuccagagaagaguauauguuuacuguggguaacagaauuguaggggagucugugccuucucccuuagcucuagacuccccaagcagauaccguuuuguaacagguuauuuuuagccaguaagacaggccugcucuagguuauaauuaaagcagauuguuaucacauuaaccaaaugccugccgguuaaucgccccaugguucacucugacacuaaaucccccuguagcuacacaguacuguaguuuaaaaggcuaggaagcaaaaagaaguacuuaggcccaucaccaccuuccuagaccucccucccauucacaccccacccaggaagcucagagguaagugggauuucauuggauugggcaaagacccuccaagcagccaagauggguaagaaauguccugaggacagaguuccugaguggucccagccucuugagaaaauccuuuuaggcaguguuagagcccagagugucccucucaguggcaggugaucauaucagacuuggcaaucugugggacaccugaagaacuggguuuucuuucuaggccccagacucugucuuguggacagcauuaguuaagauggguaguguuacuuucagaucuccuauugcaggaagagaaaaguuaguaacauuuuucucaggcgcuguggcuuuuuuuuuuuuuuuuuccaaaauucaaggcucuuggggucuugacauaggaaucuuccuccuggagcuucugaauuuuuuuuuuuuuugagauggaggcucacucugucgcccaggcuggaguggaguggugcgaucucggcucacugcaagcuccgucucccagguucaugccauucuccugccucagccucccgaguagcugggacuacaggcgcccaccaccacgcccggcuaguuuuuuguauuuuuaguagagaugggguuucaccguguuagccaggauggucuugaucuccugaccucgugauccaccugccucggccucccaaagugcugggauuacaggugugagccacugugcccagcccagagcuucuguauuuauauugcugguuguaggccucagaaaagccuuuggguugguagggguggggguggggugugaaugggagggaggucuaggaagguggugaugggccuaaguacuucucuuugcuuccugcagauuguuagcacugcuagaguuugcugaagagaagaugaaagugaacuaugucuucaucugcuucaggaagggccgagaagacagaggugaggagucagaguggccugagccuuacagcccagacaguggggccugggggagagaagggagcaccuccaggaugaggugggacucuugaauuugccuuucaaacccugggaaaucauggcaggagggcaagugccugaagggcucguaaaagccuagugcuuauuuguuccaucuuuguuugggguuuugauuucagccuaccauuguguuucucaucagacuuuuuuacacucugucuucugcagcuccacuccugaagaccuucagcuucuugggcuuugagauuguacguccaggccaucccuguguccccucucggccagaugugauguucaugguuuauccccuggaccagaacuuguccgaugaggacuaauagucauagaggaugcuuuacccaagagccacagugggggaagaggggaaguuaggcagcccugggacagacgagagggcuccucgcugucuagggaaggacacugaggggcucagggugaggguugccuauuguguucucggaguugacucguugaaauuguuuuccauaaagaacaguauaaacauauuauucacauguaaucaccaauaguaaaugaagauguuuaugaacuggcauuagaagcuuucuaaacugcgcugugugauguguucuaucuagccuaggggaggacauugccuagagggggagggacugucuggguucaggggcauggccuggagggcuggugggcagcacugucaggcucagguuucccugcuguuggcuuucuguuuugguuauuaagacuuguguauuuucuuucuuugcuuccugucaccccaggggcuccugaguauaggcuuuucagucccugggcaguguccuugaguuguuuuuugacacucuuaccugggcuucucugugugcauuugcgucuggccuggaguaagcagguccgaccccuccuucuuuacagcuuaguguuauucuggcauuugguuaagcuggcuuaaucuguuuaauguuaucaguacauuuuaaauaggggcauugaaauuuacucccaccaccagggcuuuuuugggggaugccugggccuuuaaaacacuagccaaacucuaauuaauucucaaaucacugccaggaguucuugcuccuggcugcaggcccaggccccaaggucuccuucuuggggucacaaacagcaguaaggaagaggaauauauagcaacucagggccugggaauuguggggcaauccguucuuagggacuggauacuucuggcuggcugaguauaguacuagcugccuccccaccagguuccgaguagugucugagacucugcucugcagggccuaggguagcgcugggaguguagaaguggccugcccuuaacuguuuucacuaaacagcuuuuucuaaggggagagcaagggggagagaucuagauugggugagggggacggggaugucagggaggcaaguguguuguguuacugugucaauaaacugauuuaaaguugu

SEQ ID NO: 13850 - RNA, 1128 nt, Homo sapiens
uaguuguaaauuuauucauugcaaagagccuccauuaauuuuauguaauuugguacuucccaguaguugcuacuggagugguuuuguguaaugauguccucuggaggaacucuauugcauauauaaauuuuaaagggcgaaaagauccucagagaacucacaaucuuaacuguuguuuuguuccuguguguacucucacuuuuagaaaugcguucaucugcuguauuucugaaccuaaguaugugcagaacuauagcaauaaaauuauguacaaaccaguugaucuuguguuccaguaacuaucuaccucaccucccccccgcuccccccaaaaaaaaaccaaaaaaauuaaaaacuagucacuguaggcucuuuuuauuuuaaacccccuuaaucaaaugaugcuagauuauauuugcuuaagaucugccugaugucaguguacaguaaaauguguuuuacuguacccuuggugcacuacauuuuaacuguuguuguaucuaaagagugagaugccuuuucaugccuauggaaucccugauguaauugagaaccuaaaggaguaaugacuuugaugaggcaguuuuagccagugcugagcucucaacuuuuauuacugaauaucaauuuuguauacaaggcccauggcagucuuaauaugccuucauauuuuaucuugggugugacuggagaacaguugggaaagcagagguaaaccauuaaaaugaugaccauuuuuagcauuuuuacugucuacuugugaguuuguauuuagcuauuuucauauuuaccaucuacuugcuuuuguguggguguguguggauucuucuugcuuccaaauugugauaacuaaauuuccuaauuguccuuaggucuuguccuauacuuaaguggaauuguuuucuucuggaauucucuuucuucuguugguagacagaauuucaaaauucaguuucuuguuuguuggcauguuuguuugcuuucaauuagacaauucgauuuugagauaacuuuacugagaaagcaaaagggaguaaucaacagugacaucaaacuguuuuagugcuuuuggaauaagauuaaaccaaauguuuaaauuuuguugaaaagcagaauuuagugagacug

SEQ ID NO: 13851 - RNA, 408 nt, Homo sapiens
uuuuuuuuuuuuuuuuuuuugaacauaaacucaagauuuuauugucuucauaauaaaagaugacacuuagaacuggaucacuuggcccuuucucuucuuaucuccucccaguucaaaaugcuugcaucuuuuaauagccagcauucucuuagaucugcaguugggcucaacgcacucaagccuuagcacaaucuucuuuguaguuuuagccuuuuuccggaaaaucggcuuaguuugcccaccauagccacucugcuuccugucauaacgccgcuuucccugggcguacagagaauccuugcccuucuuguacugugucacuuuaugggguuggugcuugccacacuucuuacagaaaguccggcggguuuuagggacguuaaccaugcuugcgugagcgcuaucggc

SEQ ID NO: 13852 - RNA, 2580 nt, Homo sapiens
gcuaucucacuuuguugaucuacagauuugacaguucagucacaaagaaaugugcuuaguuauugcugcuagaugagauacucaaaacaaguuccuauuacaaccaagcaaauuuaauacacaacuaguuugggauaugaccuuuauugaacuuauccaccagaguggaaauaaugucuguacaaaaccaaauguuuguuacuauaacuucugcaucacaauuaaaauccaaacaguuuuuuaaaaacagucaacucaaucaaaacccacuacuucagaaucaauagcuucuuugaagccacaguaacacuuaaauaugguuaagacucgaaugcagaaauuugguugguuggaaagcuaauuaaacuuccaacuugcucaaauagaauuacaaaaaggcaaaauuguguuuuucacagagauacaguccacuggaaucaccaacacuggacagcuguuagaguauuuagaguccugagauaacaaggaauccaggcauccuuuagacagucuucuguuguccuuucuucccaaucagagauuuguggauguguggaaugacaccuaggagagugacaggaauuaauucuacuuaagauuuuuuaaaaaaucacaguauuugaaaccaagaaaguguauacuguucaacuugaaagguaucuuuaaaaacaugcagcucaaguaugaaguaaaaauucauugaguuauacauauaaaucaaauuucaugauacaaccauacuuccaucauugaaaauauacuuaaauuuccucuccuggaaaaacuaauuaaaagcagcaaaaaauuccuuccucugaagaaauuuuuuaaaauguuagaaguuaacauaccaccaccagcaauuguagccuugaugagagaauccaauucuucaucuccacgaauagcaaguugcaagugacgagggguaauacgcuuuaccuuuaagucuuuugaugcauuuccugccaguucaaguaccuaaaaggcagaaucugucaguugccuuccaacuuuccuuuggccaagauucagagaacagaauaaaacccucacaaacgcagaucuaccaacuggaaucguuccucacuaucugacuggcaagauauacagggggcacgcaauuuuaauuccaagagcagagaacucaagcucaguaggauccuuguugaacaccagcucccucuagcguucucuuaggccucucgccgcguucagggccugggaguuuucuugcaucacuuuccuccuucccucuugccgccuccccgccccccaaaccuucuccggauuauaggcguucacccauuuaccucugcggugagguacuccaggauggcugcgcuguacacagcggcagucgcgcccacacguccaugacuggucguccuagauuuuaggugucgaugaauacggcccacugggaacuuaaauuuuaagcauacacaaacauaaaugcacaaaaaugagaacuagagauggggaaauuauaugcgcgccaaagcaaggggcacgggcgcagcaacgcgucccgacaucgaaacacgugauuccucccccccauauuuaucguaugggcagcccaagucgcgacaccgcaucacccacgcauacacaaaacgcccaucgagagcgaugaauaacaaaaaaggaaaugcaaagaaaaacaucaugacucccagacugcacgaacaacuacugaccugcaagccggcucucugcgagcgggaaaccgccuuugucuuggccuuuccggaguccuuuccagccuuaccgccagccugcggcgcgcacacgcccgcgagcggaggaggaacggagaauauagaauuaccaaggcggcgcgcccaucccccaccgcggcgcgucccgccgcgagcgcguccccgcacccugccggggucuccggcccgcggcgcgccgcaggggcgaccccgcccguucgccccccgccgcgcgcucgccacggccgcgcgccuccgcccgccggcccccagcggcgcugcgcgcgccacccaaccgucgccgcccgccgcgagauccgaggcugcuccgcuagcagccgacaaaacaccuccccccacucuucuaaauccugucuccgcgcguucccaaccgucgccacuucacccccaucccucuguguaacggguuuuucucucgccggcaaaaacccgcggagucaucgagcgucucugcgaaguuuaccauuucgaauuccgcugaagcucaagcaagcaaggcagagaaaaggcuaaucggacccacggugagaucccaccaccuacuccuucgucgcaccgcgauucaaacugcgcugucucccgccuucccugcucccuuuauacugcagaauguucccucauccgggaacucggauugcucaucccaccaauggcugccacccgcccucgggacgcguccuugagacuucagccaaugagcaagcgaagaaaaggguggaggggcgggcgcuucuaaucucaagccgcgauuggggcguggggggagaggcgggggaaggcggagggaugggaacgggggagaagaagggcaccgcggcgggagggaagaaacaga

SEQ ID NO: 13853 - RNA, 19749 nt, Homo sapiens
uuacuuuggauuaauaauagaaucauuuuaaauuuugcaccaaaugacuacaaaguuaaaugucuaugucaaaagaaaauuuauugacuucauuauuagaauaugaagugguuuuuuuugcuuuaaaacuuuguuuaaaauaucuaaggaggccagguauuaacucugaaaaaacuguauaauuauuuauaaaacagaucccauaggagcaacugaacagcuguggaaagauuuggcacaucacuuugccagccugaauuuaaugaccuacaugugaagggcuacauauccaauuacuaauccucccucagcuacucuuugcccucauauggaggcagcugaaaaaagaugcccuacuaacagaucagaaguggauccagacuuuuuugccagugcucaguuaacaaagaucuuuuagguuugagaugaggaagaaacagaagagggacucacaacaguguuauagcugauacaguguuucaaguaaaauuuaagggcuuauggcaagagugacuuuaguuuuguaacuaaagucaaagaaauuucggcucuuuuagagaaucucaaauucuggauuuaauuuucuauucacugaagccuuuaaacauguucaaauaucuucaaggauaauuuacuucaaaauucuuucuauaugagaagccagucuucuauucaagaugcaaaccucauucuuaccuucaaauucugcaauaaucaccuauuagaaguagaggagaaaaaaacuaaauagaaaaugacaaucuacgggguuguauuucauuucucucucaguugacaugaucuauauauagcaaaagauuauauaaggucaaguauuauaaacaaugaaaugucaucugauguuuugcaaaacagcauaggaaaaauagcucaaggaaugaauaaagaguaaagcuauggcuguuuuacuucagccauaaaaaagccuuacagauucuaaauuuaaaugcauuuuauugugaaucugacucacuuuuugaauuuaauuuuccacuugaguuauguaaaaucaugugauaugguaauuuucuguauaaauuaaaaauaauauaggcaagagauguuuuucucucauuuucaacacagaaaaauuaggagccuuucuucguuguuuugcauuuuuaacagugggacuaucuuaauuccuucauccaauacucacaagaauauaugaaugaauacacgucugcagguacacacuuaauucuugaacgggaaaaaacagacaucacuguaacuaccucccacucccaaaacacuaacuccagaccccgccccgcauaaaccccuccccuuucuuccauugcggguucgaaauggccgcaguucgaugacguaagacgcaaccgccguagccuccacugcguaacuaccgccccugccucugggaauugaaguuucuguggaaggaagcgugagccguaaccaggccaacccagaaaggcuuucuuucugagauuucacuucccugucaacucuucagcucgguaaguguccuggcacugguuggcgcucccccgcacuaugguauucucuggacgcaaaggggcgcgugccaugcagcccccuacuagcaacaagggcuuccgggggagaggggagcagugguguggaagugguuuccugcggcgcucuugcugaaggaaaugacgucgaugacaggcgccccccgcggccuacccagcugcucccugguucgccagagacagcuuaaucccgucucugaaaugcguuugcuggcugggagccuagaagggauagugggcgaggcuccgccccgugguggggcgcuuuccgucggcguguguuuugggguugccaucggcccguaguaugugaaaagugaguuugcaaagaaucagugggaaaucuguacucuaaagggccggaaagcguguuauggcccugccacuucguggcuagagaccgugggcuuuaccucuuuaaagcugccuuaccucauuuuuccugcaaagggcugacgucgcugaacucucugaaauguagagagcccgaggggaaguugcugcaggugcugugagcugaggacaguuuuauaaagaucgaaguguuacuugauuucacugaaauacuuuaaauuugggaauuuuucuacagauaugaagaggauggcaacacauuacuugucacuuucugaaagaauuucaucugccccuuccauucccaacccucugcccaaaaggcuugacaacugaagugaacaaagggcuuuucgcuccuccacguuuaguccgcaugucuuuuaaaagggcauuccuggccgggcgcggugacucacgucuguaauccccgcacuucgggagggcaaggcggguggaucaccugaggucaggaguucgggaccagccugaccaacauggugaaaccccgucucuacugaaaauacaaaauuagccgggcgugguggcgcaugccaguaaucccagcuacugggggggcugaggcaggagaacuacuugaacccagaaggcggagguugcaaucagccgagauugcgccauugcacuccagccugggcaacaagagcgaaacuccgucucaaacaaacaagaaaggccgggcgcaguggcucaugccuguaaucccagcacuuugggaagccgaggcggguggaucacgaggucaagagauggagaccauccaggccaacguggugaaaccccgucucuacuaaaaauaacaaaaauuagcugggcgugguagcgcgcaccuguagucccagcuacucgggaggcugaggcaggagaaucgcuugaacccgggaggcagagguugcagugagccgagauugcgccacugcacuccagccugggcgaccuagcaagacucccucucaaaaaaaaaaaaaaaaaaaaaaaaaaaaggcauuccuuugcuaucgcugucaagucauuaauuccaaucugcauuauucccacauucguugagauuuuucugaaaaggagacugucauaaauuaacgacgauuauuuauuuuaucccaauccauaacuuaaugcaguuuuaaaaaacuuuuuuuuuucuuuuggugcucauugauguaggauguguccuugccuuacaaagugagauaguuuguaagcccacuuaauaaccuaugucugcgaaugaaccccacaaauuuuuaaaauuuuaugcaggaguaaaauuucacacacacacacacacacacacacauauauauauauauaauuuuuuuuuuuuuuuggagacggagucuuacucuguugcccuaguuggagugcagugcugcgaucauggcacacugcaaccucugccucccggguucaagcgauucuucugccucagccucccgaguagcuggaauuacaggcguccacuaccacgccuggcuaauuuuuguauuuuuaguagagacgagguaucgccauguuggucuugaacuccugaccucaggugauccgcccaccucagccucccaaaguguugggauuacaggcaugagccacugcgcccgaccucacacaaauauuuuuauaguuacuguaaaauacguucuugaacauuuguugaacuugguugaaugaaugaaaauguacugugagcaucacugcaugugagaaaggaaugaaaaacucugccauggaauuuuauaaauuauugcccaaacuaaaacaauuagaaagcaaguauaccuaauaaaaugcuguuuugcuuaacagguaaucugaacacgcuaguacauagugcaguguagauauacauuauacuuauuguauaguguagacagugcgaguugguagauaucuuuguaaaguauacuauacggaauaauuuauaagauaucagguuagcaucauuuuuguugcauuccauuugucucagugcaccuggcuuauuuaaagccuaaaaacuucacuuaguacagucguuuucuuaguuaggaauaguuuuuaaaaagaugaugaugaugaugaugaagauguugaccaucucaugaccuuuccuuguguuugagagauugaaacauuaauguacuaugacaggucauauuaaauuuaacuuaagacuucuuagauaggaaaggcauaugcucccccugguguacaugaccuguaaaacauuacauugcucuuuaaaaagucuucacguaggccgggccuggugauucacgccuguaaucccagcacuucaggaggccgaggcaggcggaucacgaugucaggaguucgagaccagccugaccaacguggcgaaaccccuucucuacuaaaaauacaaaaauuagccaggcgugguggcgcgcgcuuguaaucccaguuacucagaagguugaggcaguagaaucgccugaaccugggaggcggagguugcagugggcggagguugcagugaacggagaucgcgccacugcacuccagccugggugacagagcaagacucugucuccaaaaaaaaaaaaaaaaucuucacauagagcuaaucaacacaugccguuuuugaauaaaauagagaacuaacugaaaaugaugccacugauaaacagaaauguacucucuuggaauauuauuauuucaugaagagagcaauuuguuuccugugaauuuuaauugugcuuuuaaguuuccuccacucggugucguuuuggauaccugcauagcugaauuuuauuuaauguauuguguauugcaagaaaggaaaauaaaagugauccaggggaucaaaauacauauuuuuuaauuuuuuuccaucuagccuuuuuaggcuuauucaguuuccccaccuccaguuucuuaaauugaaugcuuaccuuacuuucuagauuuuuuuuaaaaaaauuaaugaaugcauucaaggcuauauguuuaucucuaauuaccuuuuuuuccuguaucucucuuauucuguuauccaagucuuuacugcuccuccauauuauuuuucuguucuauuugugucugcauccugagucagauugucuucuaagucaucaguuacuucuugggacuccagauaaucuggaguuugucucuucuauugaacuuuuuaugucuucauuuccuaguuuucacagauucuuuuucacugauucuguucuuuuucacugauucuuguuuuacuuuuuaguaaagccugcuuuuauaucacaacuuucugucuuguucuuauacuucuuauucccuuaugaccucucugaaauauuucagccaaauuuauuuuaaagucauuuugauugcccuauuuuuaauuuguaucaagugaauuuauuucuugguuauugauuucaguuuuaaaaaucaguucugucuuuuuguaguuucccucauucuacagcauuaaaaaagacuauagaaaagaugcuuuucaucucuuuuuaaaauuuuuuguuuuauuaaaaacaauauauuuucauuauauaacuuuagaaaaugcagaaaacuguggguaagaauuaaacguguguguguauaccuuuuuaaaaaaguuggucguaauguauauauuguuuucuuugauuuuguuuaauguauaaccguuuccccuuaucauuaaauauuuuuggauauauaaguuuuucuggcugcuuaauauuccuugcccauguuauagauuaaccguaauuguuuaguuuccuuucacugacauucaggagguuucuaacuuuucacuguuaaaaauaacacugcauugcauauacucuugugcacauuuuugugugcauuucugauuuauuuacagaaauuuaaggaaauacugagucaaagggugucuaaauagagauuuugaagcucuuaaaacauauauauguguugccuucuggaaaaauuguaccaugaccaccaguaguauaugaaacaccccauuucuuuagaccuuuacuagcauugcugaauauuuaauugauauuaaaugguauuuaaaugauauuuacaauuaaaugacauuuauuugucuaaaguuuuauuuauauuauuuuaugguuuaacuuuaaucauauugauuauuugaguuuuuuaacuuuuuugugcuuguaaauuaucuauucaugucaaaaguuguuuuucagaggcaccaaauaaugucaucugaaauguugccagcauuuauugaaacuucuaauguugacaaaaagcaaggcauaaaugaagaucaagaggagagccagaagccaagauuaggugaagggugugaaccaauaucuaaacgacaaaugaaaaaacuaauaaaacagaaacaaugggaagagcaacgggaacuccgcaaguauguguuucaaaauguauaugcucucuuccuauuuagagauaugcaauguuaaaccuugcauagcccuuuggcauauuaaauguaauuguguuacuuaaaauucaauuacuaauuuuagacaaaagcguaaagaaaaacgcaagagaagaaaauugaagcuaacaacguauauuguuagcuaacacugucaacuggcuguuaaaacuauuuuuuaaaauuguuuggguuucuuuuagcacuguugaugaucuugcacucaacacuuuuucuaaugcagaaccuuauuaugaguagcagcacaauuuuugaaacaacugacuuagauaagggauguaauuagugucugugugcuaguuauggaauaaaaacagccaacucagaaagaucaaguuuuggccugacauugauuuugccacaagaacuguugcagguuuuggugaaagcaguuuggcuaaauuugucguuguaauaaaugccaaaauuuauggagagaaaauaaacuguaguugguguaaauuagagaaaaaguauguaauuuuuuuaaugaacaauuuuauuuugcuuuuuucuauaccuuauaaauguggcuuaaaaaucauauagguaaauuaugaaaauaaaauucgucauaacucaaacucaguauuuauaagguuagggauaguaugauaccaauaacaaaugaaacuauucagauaguauaguuaggauuuagauagaaagcuuuagaucauuuuuggaagcucauuuccuuccuaucugaagcuuuuagauggguuguauaaaacugcuaauacuugaccauuuuugaauggucacagaagugacaauuucauaugauuuaaccugaugauuuuuaaaaggaauuguuuauuuagaagagucuuguaaauaacugaauacacaauaacaaaauguuauuucaauuacuaauuuuagacaaaagcgaaaagaaaaacgcaagaggaaaaaauuagagcgacaaugucaaauggaaccaaacucagauggacaugacagaaaacguguucgaagagauguuguucauagcacccuucgccuuauuauugacuguaguuuugaucacuugaugguauuaaagguaucaugaaucauugucagaaaaaucuuguaugugaauuaggucgaaucauuuuuguuuuaauaugcaauaucccuuuuauguaaauuuguguauugaaaugaaucuucaguuuuucaaacuuuccccuaaguuaaauuagcuagcaaauugcauugauauaauaaauauguguauuuauauauguguguaugugugugugucaguaugugugcagacaggaaagagagacaaacacacacuuuguagucuagaugacagaacuaaauuaacuacuuauugaucauaaagaucugugggguuuuaccaguguuguugguaaaacaugaaaauaguaauaguauggcucuaaaagucuuguuguugucucuuuagagaguagccguuuucaugaacuagcauuuuaaauaaauacaaaauaugaaauaaugggucacuuacagagcauuaacuuacaguaauuuugcuaguauguaaggaaaucaaauaacauuuaucagaaugcauuuguauuuaagaagaaaaauuguauguauauagucaucccuucugcuuauuccauuccuuuaagaucauagaauggccauagacaauuuuaauaacuuugcuuuaaaaauugaacucugugauaggacauuaagaaacuucauaagcagauucaacgauguuacgcagaaaaccgacgggcacugcauccugugcagguauguguaaagauuuuaaagcagacucuaguuuucuuuuaugucuuuuguggcaaaagacauagauaauuccuauagucuuugcaguagucuuacagguaaucuuguuuaaugccuaugugaaaaaaauuuuuuugacagaaaugaagcaaaauauuuuaaacaucuuuuaauauguuaucuuagacacacucuuuccaguaaucaucagucuuauacaaauuggccuuuucauugccuguaguugauaucuucauugugggacauacauauauuuuuauaccaguuuuucaguuuacaauuacuuccagugugggagagagauuggacagagaggcagaagcuguggcugccaccgcuugacauaugucgugguaucuguuguauagauuuugucuacuuaaagguuuuuaguuuucuuuugggucacugagaguuuugacaggucuuuuuuaagcugaggugagggagugauuugggagacuauuuggcuacuguuaagaauaacaucuuucuguuggaauucuaggugaccuaaaaauuaauacuggcucacugauguuaagaaccaggaacuauuaauauauuuugguuagauauuuuguuuuuaccaagugauaguaauuuuguauuuuuguuuuuuauacuuuuuguuuuauagucucauaucacacuucugugauaguccuuuuauccccauuuuuaucuguaguagaccccuucucacccuugauucaaacuuaaauaggugucaggguuuagaaucaaagaaaaauuaugaagacuuuguauuguuuuaaaaaaaagaggagugggaacuugacauggaagcagggaguuuguagacaagugaugauuaagguacaggcauguuauaacuacuugggaugaaaauguaaaugggauacugcagcuacuggguuaugaaacaugcacacaaaacguacuauuucuaccacaguuuauuguuugcucaaagcaugucacaaauuuuuuuucuagaugaaugagaauaaauauauuuuguguuucauugaucgucagauaaguagaugagagaaauaaaauauuagacuuaaauggucauuuguucucuuuuucuauacuuacaaaucuuuuaucaguuuuacuugacaagccacggaggccagcugaaaaagaacauggaugaaaaugacaaaggaugggucaacuggaagguaauuaaaacagauaaacucucacauaauuccaaguauuuuuauguuucuaaaggucuacauuuuguaccuaaauucuauauaaugcuacuuaauacaacaaucuccagaugcaaucucugaaccuaagucuaagauuacaaaucagagaugcugaagaagggagugagacaucugguagcuuguauuuguucucauuaaaucuucccuauuuuauggucaacuuuuaaaacguauuuuuaaaaagaaauaauuuuaagggccuuuauaucauuucucccuaacauacuagcuauacauuauauguuaccuauaaaaaugaagucacucuaaauuuuggaagugugccugcauucuguuucuucuuacucugugcuggccacuauccacauguggcuauugaacuugaaaugugacagucugaauugugaauugagaugugcuaugaaugugaaauacauacuggauuucaaagacucaguaccacaaaagagaaagaaugugaauaucuccuagguaauuuuuaaaauauuuauuauauguuuaaaugauaaacuuuuggguauacuguauuaauaaaauaaauuguuaaaauuaauuucaccuauuuucacuuuuuaaaauuuggauacuagaauauuuaaaauugccuauguggccucacaguuuuuucuauuggaccaaauuguucucagucauugguaaaggugacuaaauagauuggccuugguaccagucccugaggaacuugauccuauuuagggaaguacuggguuaucccuauaccuuuuuucuuucucaaagucaguucucucagugacacacuuucccuuucacacucacuaauuccauaacaaaggcauuuauuuuauuaauagccuaugauaugaaacauuuucaaaggcuuuuaaguuuuuaaguacaguauauuuaccaaauccuguauuugugcccauuuuuccaagaacuaguguaauaaauuaaaagaggcauguuuucaguuauuuugcgacuuguuaaauuuaucauuuauaccaucaccuuuccagagagacuugagauucauuggucucuaauuaaucagguuccucuuggggccuuaaauuuguaauauaacauuuuccagaaaacuggcuauuuauuaauuauacauuuuaggagagaguucuuuugccucauucuugguuucauuaaaaauuauggauaaaugucaucugagccuggugauacaucuuuuaugcagucaauguggcuuacaaaaucaugacugccagcuauuguucaauuuuguaccugugaccugacaauuuuggugaagaaguuuucaaaugugugucucuuuguagaaacagauacauggaauuaauuaaaucuauaaacuauuuccuuuucuuuuuuucuuucuuuuuuuuuuuuuuuuuuugaaacguagucgcuugcacugucacccaggcuggagugcaauggugcaaucucggcucacugcaaccucugccuccgggauucaaacaauucuccagccucagccucccgaguagcugggauuacaggagcccgccaccacacccagcuaauuuuuguauuuuuaguagagacaggguuucaccauguuggccaggcuggucucgaacuccugaccuugugauccaccugccucagccuuccaaagugcugggauuacaggcaugagccaccgcacguggccagcuauuucccuuucaugauucauguagauggagaggaaguaauuggagaaggcauucuuuggucauagaacaaugugagcaaauauguggcaguaaaaaugcguuuguuuuguuggaacagaaauaaaguuggaaaaguagauuacugccauauucaggaaagaguuuuuaaauuaaggauuucagauuuuaucccacagaaaaagauaaaacauugaaaguaguguuuuuagaaaaugagccugcuaucaguguguggaaguagguuggaggggucugaggccaacaaggaggaaauaaaauuaagaggcuauuuaaaugaucaaagugugagauauaagaaauugauguaguaaauucaaaauaaugcauuguaauuauauuauuucaaacuuuguuucauauauuuuugaauggauuuguuuugggaaaagagaauaaucauuuuuagccaacuuucauaaggucuuauuaauuaguaaccucuuucccuguugucuuaaaggauauccauaucaaaccagagcacuauagugaacucauaaagaaagaagaccugauuuaccuuacgucagauucaccuaauauacugaaggaauuagaugaaucaaaggccuaugugauuggaggauuaguagaucacaaccaucacaagguacuauuaaauuuuuauuuuugcuuuugcuuguucuuaaaauugauauaucaccauuuccugaaaguaacaauaauacuaaugauagcucaucuuuauugagugccuacuauaugucagucaccuucugagcuaagcaaaguauuucacauaaguuagcuugcuuaaucuucacucaacccagugagauuagugcuauuauuauuuacguuccacaaguaaggaauucauggcacagagaaauuaagucuaaaaucaacaguaguaggugacaaagcagcuauuugaaaccaggcugauugcucuggaguccacaugcuuaaaugcugucuaugcuuuacugauagaagauucugcugcuaaucaauugcuaagccauuggaacuuaaacuaguuuuuaaauauguuauuuucaugggauguuuuuucuauuaucuuucauuuguacuuuucucucuucccauccauaccuuuauuuggaugaaaaauuacagaaaugcacuuucuaaaagaaaaugucauuuuguacuucgccagcuacauugcagcaugcaaaauucuucguaucugcuuguccaguauguuaggucuguggcuauugagcacuugaaauguguacaguaugacugaagaacugaauuuuuuaaauuguaaucaauuuaaauuuaaguagucacacauggcuaccaauuggacaguugcagcucuauugcaucauagggaauuuuaucagaaugaucuuuuagccuuuuuguuuuuuucuuaguggaaaaauucuauuuuguuauuuauauagaaccacauuuuuucucauguuuauguuuuucugaacuaaaacaauuuuguuuucaaaagcaccugcuucaaucuauuauuauuugcugccucccccccccaccaaguaugcaaaccaucaguugacaaauugagcuuuucuuucuccuguacucuguuuuucgaccauuucaguucugguuggacauagguuucaaggauuuuaauuuugaagagagaugaaauucauauucugcauuuuuuuaauugacagggaaaaauaaaacuugucaguuauuuaaaauuucucaauucaaguuuucauuuaauuugucuuugucauuugugcaaaguaguguuacuaauugaaauuuaauuuuuuuuuacacuuacgggaagaaugauggugcuuccauaggaauucaguuuaaguucagucguauguugcuuaaugauggggauacauucuaagaauuacaucauuuagcgauaucaauauuauagaguguaguuacagaaaccuagaugguauagccuacuacacauaggcuguauggcauagccuauugcuccuaggcuacaaaccuauacagaguguuacuguacugaauaguguagacaauuguaacauaaagaucuuuguguuucuaaacauauuuaaacauagaugauauaaaagauuuuuaaaauacagguauacgugguauacauguauagggcacuuaccaugaguggugcuugcacaacugcaaguugcucuaggugagucaguaagugaguggcaaauuaaaugugaagaccuggauauuacuguacacugcuguagacuuuauaaauacuguacacuuaugcuauacuaaauuuauuuaaaauuuuuucuucaauaaugaauuaaccuuagcuuacuguaacuuuuuuacuuuauaaacuuaauuuuuuaaacuguuggacucuuuuguaauaacauuuagcuuaaaacguaaacacauuauacagcuguacaaaaauauuuucuucauauauccuuauuccauaggcuucuuucuauucuuaauuuuuuaacuuuuuaaaauuaaaaaaaaaauuuuccucuuuuuuuuucaacuuuuuaaacuuuuuuguuaaaaacuacuacacaaacacacacauuagccuaggccuacauagagucaggaucaucaaaaucacugucuucuaccucuacaucuuaguccacugaaaggucuuuagggguaaugacaugcauggagcugucaucuccugugauaacagugccuucuucuggaauaucuccugaaggaccugccugaggcuguuuuauauguaauuauuauuuuuuuuuuuaggaguaggaggaguacacucuaacgauaaaaaguauaguaaauacauaacagguaacauuuauuaucauuaucagguguuauguacuguacauaauuguaugugcuguacuuuuaugugaugagcagaagguuuguuucuuccagcaucaccacaaacacaugaguaaugcguugcaguaugauguuccaacagcuccaaagucacuaggugacaggaauguuuuagcuccauuauaauuuuaugggacuaccacuguauaugaaaucugucauugccugaaacuuuguuaugcagugcaggacuguauuuuaagcugagauaaaggcaggguagaauggggaaaagauauuugaguuaggagauaugugagccagauuuuucucgugauucugccacugaggagcuuuguaacucggcaggaaacauaaugucuuugguuuccucauuuguaacuugaggagcuuaaaacaaaugcucugcacauugacuauacuuauugucaagagaauguuuccaaaugagcaguaaaacacacacauaccccccauucagauaauauucucugaacuauaaauucucugaacuauaaaucuuaucuaaaaauuauuuauacuauuacagaaacuuuaaauaauuuaauguucuugucgaagucauagugucuuuguuuuagggacucacauauaaacaagcgucagauuauggaaucaaucaugcacagcucccacuuggaaauuuugugaagaugaauagucgaaaaguuuuggcaguuaaucaugguaagcuguaagggauaaacugaaaauauaccugagcgaacauugugagaaagaauauuacauuuaguauuugaacaaguagaaaguauuacaccuuccuggagacaaaauuguaaaaaguaauaauuuauaauuuguuuaacagaaauaauguguauuagaaaauuuugaaaauguacgaaaguauuaaaaaauuagcugugucuuacuacacagaaauacuugguguuaacuuuuugguguugaccucuaguucuuuuccuauguauauauauuauuauuuauuacauaauuggauuuucacuauauuacauacaauguugugaaucugggauauuuucucuccuuuauuacuuuauuuuuuaugucauugaaugauuguuaaugguggccaggcacaguggcuuacaccuguaauccuaauccuagcacuuugagagaccgaggcagacagauugcuuaagcccaggaguucgaacacagccugggcuacguggugaaacuucaucucuacaaaaaauacaaaaauuagcugggcaugauggugggugcuuguaguccuagcuauucaggagggugagaugggaggaucaccugagcucaggagguggaggcugccgugagccauguuugugccacugcacuccagcuuggguggcagagugagaccuugucucaaauaaauaaauuuaaaaaaugguuguuaauggcuauguaguccaucauuugaauauacaauuauuuaaccauucuacuaugguugaauuguguuuuuuuucuuuuugcuguugcaaauaacauugaaauagacauccuuguaccggucuuugccuggacuuugcuuuaaaaaaauuuuuaagccgaguuuuuagucaauacacaacuacuuauuaaacuuuuuaugcgcuacuuucuauauagcagguucuagggaguuauaaaaaugaaauuaucgauucaacaaaugaauugccucuaaaaccuuugauauauaguagaaauuacuuuuuccacaaaguaauucagguuagcccuucagcaguaugcugaugugagaguacccuggagacaauauugauacucuugacuacaaccaaugugaaaagaaaaacaaaagaaaaaaaagcagucaaggagauccuagugugaguggcucuuuacaggaaacaugaagaaaguuaagugaaugcuaacuagguuguuagcauguaaaggauaaagaugugaaggggcuaaaaaagaguaggagagaaacugaaaaggucuuuauugauuauaauugacaugggauacugguaaauuucugagugcuuaagaacugaacugagaaaaagcuagauaggagguaauagacuuaaguaccuuggggcaaauugggcuugacagacaauagaaagaagagcuaagaacaaaguaguuauuaggacaaacuagcacucuuaacacaaaggcaauguauuuuaaaagacauugugcagcauugugaugaacuuggcuaagaaauguacggaauaugucuuuauugcaguguuugaaauuauucuggaauaccuggaaacaagagacuggcaagaagcauuuuuuacuaucuugccccaacggaaaggagcuguucccacagacaaagccugugaaagugcuucucaugacaaucagucugucaggauggaggaagguggaucggacagugauuccagugaggaggaauauagcagaaaugaacuagauucaccacaugaagaaaagcaggauaaggaaaaucacacugaaucuacagugaacucucugccacacuaauguuaccugguuuccuuuuaguuuaaggaaaaauuaggagaaagugaggugcuauauagaauauugaaauuggaagaacauuuuauuuucucuuauuucuguugugauuuuuaaaaacuuuuuuuuggaccuaaauaauaauaaaaaaaaaagcccuuuaaacuuuguaaggaaauauuuuuugauuuugcguaagaagauuuaaauguguaugugauuuuuuuuguuuuuguuuuuaaagccucaguaguuucuagauaauuuuacuguauuaguauauuuucauuuucuuucauuuuauauucuuuagaaugugccuucugaccuuucaguuuuuuaauuuuauagucacaucaacaucuuuaugaucuauugccuauauaucugugagggcacauauucauaaauauacugucaaucuaucagcauuuguguaugguagguuacccucuauuugcagcuuuuauguuuaaauuaguuacuugaaagaauguaguaauuuuaggaagaaguaucaguuugauagacuuaauaauucauuucuuuuggacuauggagcgcauaucuguuccuucuuuaugaugccuuuuuaugguucugaaguaauuacugaagaguugagaaucucuuuaaugcauuuucuuaauucuuacaauggugauaaguuacuucaauuauaaaauugaauuuugcagacuaaauuauuuuauaaggcuguugcuauugaaagaucaauuuugucuuuaccugcauuuaaaauggaacagcucuuagcagcugugguuuuuuuuuccauauuuuuuuuaaauuuguuggcucuuaagaugaauaaaguuuauaggugcaucugccuccucuucucuaagaauaugcauacuaauguuuguuucuauaaaucaaauacacaugugauaauaugcauguaaauacauaacuauccucaucauguauggcucucaguucuuaauugaugauaacaugauugaauugccauauaucuguauuacuugugugaaugguuguguugaacacgcuaagaacaauuugaauuuuauuaaguacaaaaauccuuaacguuuguaugggaacauuggcaagaaagaauagugugaaagggaacuguuuuaguuuccuaucaguaauuguacaugcaguuaaauguuuaagguaaaaugauuggucucugucacagcuaaaagauuucaguagccuucauugaguuuggguaaaauaaguugcuguucuuuugucuucuuuuuaauauauaaaaguuauauuuaaaaaguauauaacauacuauauauguuacauacuaacauauauauacacaacagaaaguuuauuggauuuaguacugauauuuacugucuauuuuuguuacuuuguucuuaguaaucuauuauaguuaccuauuuuaagguaaggucuguaggcaagauauguaaguaaagacaagcccuacaauuuuaaaauaacaaagcuuaugucuuaaguuguauuuuuucaaagguucauguuuuucugaguaaaugugguuuauuagcaugaaauauuaugccuuuuacuuaaauuauuuuauguaaaauagggcacuguuuaauuaugaaagggggaaaaucauuccaaauaagaguuuaauuuuuauuaauuauaaaaaacucuguauuaguuuccuagaugugcuagaacaaauuaccacaaacuggguggcuuuaaacaacagaaauuuauucucuuaacaguuccagagacuaaauguccagacucacaaugucccagugccaugcuuccuccuuaggcccuaggaaagaauacuuccuagccucuuccuggcuuuuggugguugccagcaaucccugcuguuccuuagccuauaguggcuugacuccaaucucaguuuuguugucaaguggucuucuacccugucuucuauguuuguauccguguccaaacucuuuuucuagggagaccagcacuggauuagaguucaccaugauccaauaugaccucaucuugacuacauccgcaaagacccugucuccaaauaaggucacauuuacaggguaccauguguuaggauuugacauaucuuuugggggacacaauucuacccacuacaggcccauaucuuaucuaggauguugguggcaagaaggugaagauuacuaccucuuuugauauaacuaguuucugagguauuuaaaaauuugguuuuaaaaauauuaagcuuuuugcucauuugcauguauacuuuucucucaacauuguuuugguuuauuuagguuauuuguuaaaacuucaguaaauacuaaaguuacuuguauuagaacauaauaaaaguagagaauuaaacuaccuaaauaaaugcaucaaaaaauauaugucugcugaaauacagaauuuccucacauuuaauuucuuuaauaaccuacagugaucauaaagcaagcucauucuuaagagaagaaccauucuucauucugauucuccagaguuuggugcuguugacauuauagcauuugaaaaugcucagaauggaaaaaucaaaauugagaaaagaaaguaauucuacugaauaaacaucuuuugggagguaaaugaacaaugaugaaauccagcagugacuggcaauuauaaagcaaagggacauacuauuucacuuuauagacagaaaagguaacagaaaugauguagauaaaaggcaagaauuguccauagagcccugagaaaguauacagacaacagguguaaaaugagauaaagaaagaaaggagaaugguagagauuugaauuaagggcaguaaaggcauuuaguagucauuaaacuuugauuucaguuagcaugcagguauuuaucucuguuucccugucucauuaccagacaaauauaguagucaucuaauaaaugugaagaagagaagcagugacagaaucaaaaggugguaauauugacaaucaauggaaacaguagggaauuggacuaagcauaagccuugccacugccacuguugguguugagacuuuggaugaguuauucaaccuuuguuaggccucaguguuuuuauauguaaaauggaaauguuauuccauuuacucugucagggcuugagcaaacaauugucaagcaguagcuaacgauaaugcuuguauuggcuuucucauuucuugccuuauuucccuuguuucucagucuuuuugacauugccugcccuaaaaugguaauaauauauaggauuuugauucaggcuguacuuucugaggaacccaggcuuagauaagauuuuuaaaauguaaacuuucuaaauuaccaaaugaacacucacuaaacaaaacaaggaaauuacagaucauuuagugaaacauuuauaaaagcaacaaaaacaaugcuaacauaaaacacaaucacacgacaaaau

SEQ ID NO: 13854 - RNA, 52216 nt, Homo sapiens
aaaaaaaaagcagaagcacuugaucuuuaggaaggcacgcaguugcuuauuaugaaucauuucuagaguccgaugcauuuucaaagccgguuacagucauuacgaagcacacccuugugagguaaguguaucaucaccuuugguucauaaauaaaaaagcugagacgccgagcgauuaagucacucgccuaaggagaaugagucaacgucaagagucauaguugacccggccuaaagacuccagaccaucaguccagggcuuagucagcggggcccggaguggcuucccuggcuggcaucuggacuuaggcuauuuccgugcacguaaaagcggaauauuggaacgguugcacagaacuuccaaauaauuuuuaccgccacgcaagauuuagcccugaggucuuaaucucaggauuugggacaguaaaagcugucgucccucccccucguccagccgguggcaagcggguacugcgggcgguuccguccguccccuuucgcagaaauggcaacgaaugaccaccagcauuagcugagccaggggacgugggaggguugauugccuaaacgacucugcaucgccgccucuuuuugaaacuaagagaaaauggugggagaucaaaagaaaacuaaauaaacacacaggcaacuuguccugggaccucaacuaagcaaaugaagccuuauugugugugcugagccugcaguucccaaccuuccggggaagaugggaggacagggcgacaaagggcacaguaggcuugccuggcaguaagugugaccgcagcuauccaggcggaagagcagaggacugaaaccacccuccagcaagcgaguguccgccgcguugagaaccgcgcacccuacccaucggccacgugaccaguccuuuuuaaaaaaaauuucuuuaccuuaaaaaaaaaaaaaaaaaaaaggugggggagagacuccacuucccagaagccucucguuacucacgcagccgcagucuugcgcaggugccgccagggccaaacggacauauccgucacguggccagaagcuggccaauccgguuugaaucucauuuuuuuccucuuacccccccuucuggagcgguugugcgaucagaucgaucuaagauggcgacugucgaaccggugaguauugccuuuggcccccacccccacggguccccgcgcuccgucuuccuucugacugggggacuccgcgggacggcguucccggcgcgcacuguaccccuugccgccccuuccccuucauguuggaccugaccucccgcggacaaguggggacgucccggaggauggccgaggcggcguguagcgcacacuuucuggugggggcccgagaacugggggagcggugugggggaggggcggcguggcgccuccugcggaaccgcgaggugucuacaggguggaggguagcugggguucugggcuggguaugcgaggauggugucuucaugauaggaaggcgcagggccggcucccagcgaguacugggauccgcaggcagggugggcggcgagccggccuggagugagauggaggagggagcccuggagcagccuuucccucccugcagaaccccagcuccggggcucgggugcggggcgcgcgcacgucuuccuuagaccgguggacuggggagcuggugggcgaguguugccggaggguggguuaggcgggaguggugccgcggcacgcgcggaggagcuucgaccucgcuuaggggaguugagaggggcgagcgucuguuaauccagcgcgccggagaguugccgguguuugcgccaggggaagcgagaaaggucuggggugggaaggaacacucgugugucacggugaagcucuccaaguagaaugagggauggugguggugagaagggguaucacauuguccucgccccuccaugcuugggacugggcugucauggaggagggaagggggaggagcgaggccuacagaucgcuguagccggucggcuugccggccggaccugcugcauuucacacgcgcccgucuuccauucauucauccuuuccgcguagugcgcacgccucagagaaugcgaaugggucucaaucccucuguucuuccgagucuuuaucuccuggaagauuucugagacgcaguuuauuggaaauagaaacuuuuaaauuuacuuuuccauuugacuuuuuuuuucucuuuaucuaugcuacagacuuucauuucaauuuaggcaccauuuuaaacuuaacugaagcaagcuggucccaggguagguuuguaguuaaucuuuaagcagaggguauauuuuucauaauuuggguuugccaggacuggcucacugaaacuucugggcccuguugccuuuuuagaaacgacacagcuaagugaagauaucuugugugcauaaugggguuuauuagcaaucagaaaaccuuucacacucuggaaccagcucuagaccuugguugccagauacuuuuguguaucuuuucaugguagcuugugguuuugcuaaugguuuaccaguuugcuuugacuuuuaaagacuuuuuuuuuuuuuuuuuuuuuuuuuuuuuuuugagauggagucuugcuuugucgcccaggcuggagugcaguggcgugaucucggcucacugcaaccuccgccuccggguucaagcgauucuccugcuucagccucuugaguagcugggauuacaggugcgcacaaccgugccuggcuaauuuuuguauuuuuaguagagacgggguuccaccauguuggccaggcuggucugaaacuccugaccucaagugauccucccgccucagccucccaaagugcugggauuacaggcgugagccacagcacccggcacuuuuaaagacuuuuauaaaacuauuucaaaaacucuuauagacuacacaaaggcuuauuuuucauugcguugguguaaacuauccuuaccuugucaaaauucaaggcagcuucucugcuugcuuacuuguuuuuuuauuggcaccaguuuucauuuauguuccugggaauuaaauugacugaaaaacucauaaguuguugcuacaguuaacugacuuuaggacauuaauauuacauaacacuaaugaagaauaaguauguaaaauauacauuuuaaaccccuugacagguucugauguccacuuuugucuagaucuguuccuaccccacuacacuagugucaguaaaaagcauuacaucugguaauaggggcaaggcuacgagacuguaaacuauaaaacaauaaggaguucugugagguuucugucacauuuaggucccuugaguuuugcagaguuuaugcaguuuuguuucagcagcacagagcggaacugcaaagugaugaaggacuauauuuugaguuaguaaauauuaauagcuccugauauauccaggguguuguaccaaguguucuuuaggauacaaaguuauacaagaugugagucuuguugaauguaaacccuuaaggaacuuaauuccuagggaugugguuagugauacaguauuuguucugguacagacuuugggagauuuggauguuauguuuaaauuuggggaguaggggaaccuaaaaacaaagugugugaagcuggaaacuaaaguauuuugagaauauauguaaaauaguaucgaaguguuuaguuuuagugagaaaugaauuuuuuuuuuuucgauacugacuuucacucuuguugcccaggcuggagugcaauggcgcgaucuuggcucaccgcaaccuccgccuccuggguucaaucgauucuccugccucagccuuccgaguagcugggauuacaggcaugugccaccacgcccggcuaauuuuguacuuuuaguagagaugggguuucuccauguuggucaggcuggucuucaacucccgaccucaggugauccgcccgucuuggccucccaaaguggugggauuacaggcaugagccaccgcgccuggccugaaaauuuuuaguacuuuuaauauacccuugugcacaggcuaguuauguggaauuauuuuugacaguuuuaaauaguuggauuuuguguguaggggugcaggaucuugcucuguugcuggggcuggagugcaguggcgcgaucauagcucacugcagccucaaacuccugggcucaagagaugcuuccaucucagccucugguguagcaagcacuacaggagcaggccaccacgcccggauaauuuuuaaacuuuuuguagagauggaaucucgcgaugguuacccaggcuggucucaaacuccuggacucaagugguccucccaccuuggccucucaauauguuggguuacaggcgugagccaccgagccucgccuggauuuuuuuuugaagcaacugauuagaauuggauuguacuugagauaccccugcugaaggcugcaaaaaucauguuuuuucuuacuucagcuaguuugugagcuuccauaaugguuuucugcugugcauaaucauaaacacuuaaaaagagccaugggcuuuuccugcuuaucccaucaugcauagguaucuggaugauuuuugucuauggacauuacauaaaauaucauuuucaguuugauauuauugugugguuuucucuuuguaugaguugaguuacaugaagauguggcccacaaauauuaaauuuguugagaagcuugaaagggaaaauuaagggaaacauuuuaccucuuaacggauaauuuggcaaaaauuugaacguuagggcaaacgguacucugauguuauucuaucggcauuugaauuguggcugggucaaaauuagguuuaauauuagucugugaaaauggcaaggccaucuuaccuccaguaggucguguuucuuuguagcuuuaucuucauucuacaucguucauuauuagaauuaaaaaaauuuuuuuuugacuuguaguuccuuuugagguaagagauuaauuuugauuucuuuagcuuaacugaaaguguauaauuuuacuuguuuuuacauuguagcucuugaauuuuuugaaaccacgcuaauuucauaagugaaucaacuuggacaaucagcuaauuuaaugcuuccuuuuuuauacuuuggaaacaugcucuguacuacacagcuuauuaauaagaguaaauaagguuuauauacauauugacaaauauuuguuguacuauauaauucauauuaaugaacaauugaaugccaaccagacuaugcaaauuaguggacuuuuugcuuaaugaaagaacccacuauaucagaguuccucgauaauccacguaaauuuggcucugggguucauauuccagauuucuucaauuaaaagaaaaaaauauacuugcugagugcgguggcucacgccuguaaucucagcacuuugggaggccgaggcggguggggaucacuugaggucagguguucgagaccagccuggccaaaauggugaaacccugucucuacuaaaaauacaaaaauuagccaggccugguggcaggcgccuguaaucccagcuacuggggaggccaaggcaggagaaucgcuugaaccuggagguggagguugcagugaaccgagaugguaccacuguacuucagccugggcgacagagcaagacuccaucaaaaagaauaaaaaaaaaaacagaaacaaauuucacacuucauuuuauaaucugaguuaaugagcaugauuauuagacuuagagaaauucaauguagacacacaguuuauacacagaaguugcagagggauaauaugcaaaaugaauuauguaagcuuacucuaguuuggacagaaaacuguaggcaaaaaacauuuaaguaaaauauuguuuaauuuacauaaaguuaagaauaugggccgggugcgguggcucaugccuguaaucccagcacuuugggaggccgagguggguagaucaccaggucaguaguuugagaccagccugaucaacauggugaaaccccaccucuacuaaaaauacaaaacuuagcugggcguggugaugcgugcuuguaaucccaagguacucaggaggcugaggcaggagaagcucuugaaccugggaggcggagguuguagugagcugagauugugccacugcacuccaaccugggugacagagcgagacuccgucucaaaaaaaaaaaaaauaaacaaaagaaguuuccuuaaucuauuaguaccggugaguugcaccaucuuagucauagagacuuuuuugagaaguggaaaugagcauggguuauagucucaucuuaauaucugagugaucuugaagacugaaauuucuaagucagcugaaagucggaauaagauauauuacggugauuucaauuuuuaaaugcaguauucaaaggugacaguuugucaacuguaagggacuaaaguugacauuccaugaauguuuuauacucauguauauccaugcauuuacauacuauuuucccucuuuucuuggaaauucacauugcugcuuuuuaauuaucaauccuuagccauuagcaagaaaugcaaagccugugauucacaauccuaagauguucuucccacuccuaucccuaccauaaaaaucacuaguguuccuucaaaagucccuaaucaugucuccagaaaaagaaaggggcugggcuugguggcccacacauguaauccgaggcuuugggagacaaaggcaggaggaucacuugagcccggaguuugagaccagccuggccaacauggcgagacccugucucuccaaaaaauuaaaaaauuagcugaauaugguggugcacaccuguguccuagccucaggaggcugaaaugggaggauccccugagccugggaggucagagcugcagugagcugugaucacaccacugcauuccagccugggugacagaaagagacccuaucucaccaaaaaaaaaaagaaaaagaaaaugauuuugcgugugugugugugugucuaaaauacuaauagucauuucugggcacuucuggaaccugagaauguggucagaaauauaagggguuuuuuuuuuuuuguuuccccaguuggaacuuuugauacauuauuccauagaaacaguaggaaaaugggccgggcgugguggcucacgccuguaaucccgacacuuugggaggcugaggugggcggaucaccugaggucgggaguucgagaccagccugaccagcauggagaaacccugucucuacuuaacaaaauuacaaaauuagcuggguaugguggcacaugccuguaaccccagcuucuugggaggcugaggcagaagaaucguuugaaccugggagguggagguugcggugagccuaugucugccaucgcacuccagccugggcaacaagacugaaacuccuucucaaaaaaaaaaaaaaagaaaaaagaaaaaacaggaaaaugaaguuuagucacacuauauucaguaaauuuuuguggaaucauuacaaaucuaaccagcauuggauuuauagggauauggaauuaaggauauggauuuauaguuguaagcaacuaacuaaaaaaaccuuauaaacauaccuuguuuguaacagcuauuuuuaauguagaaagaucguuauuuguaauugcuacacauagcacuuauucuauguuaaguaccacacugaaugcuuuacauauauuaacucauuuauuucuuuuuuuuuuuuuuuugagacagcgucucacuguugucccagcuagaguacaguggcgcgaucucggcucacugcaaccuccgccuccuggguucaagugauucuccugcuucagccuccugaguagcugggacuacaggcacgugccaccacgcccggcuaauuuuuguauuuauaguagagaugggguuucaccauauuggccaggcuggucucgaacuccugaccucgugauccgcccaccucagccucccaaagugcugggauuacaggcgugagccaccgcgccaggcuaacucauuuaauucuuaacaguacagaugaaguaacauugugugacuaacuugcuccaaaaucacacagcuauuaaguggugggguggaguuuaaauuaaagcagccaaagugcagaguguauauucuuaaccguugcacucuuucaaguaggcauguaaugugcuuugcuugggugacuucagaaggggagauguguuuugauaagcuuacuauguguuuugcuacagcuauaaaauaaaacgugugggcauuuauuuuuaggcccuguuauauuacaauguuagauaacaaaaauauauaaucuugaggacuaaaccaagcaauuacaccaaucguguuuuaguaacuaauugagaacuuuguggauuucuaaagaaaguggauggacacuuaaccuucucccccuuucuaauuugauuucuggcauuugcuaguucguaugauuucccaguuaaaauauuuugcuagugaaaaaaguuuuaguacauuuuuaaaaguuugugaauuuuggauuuauucuagacuuaacuaccuuaguacuuuuaguaauuuuggugauaagucuggcaaaggguaaaacaguuguuuugaaaaaguuuaagcuaaaauguacacauacguguuucuugguguauuuuaagcuuguuacuacaaaaugcuauacagaaauuaguuguaauauuuuuuucugugcucugcucauuacugucauuguaaucucuacuaaaaauacaaaaauuagccaagcguggucacgggugccuguaguccuagcuacuugggagacugaagcaagagaauugcuucaaccugggagguggagguugcagugagccgagaugaugacauugcacuccauuacugucauuguaaugagcagagcacagaaaaaaauauuguaacuaauuuugauauauaugucuacauauauaugucaacauauuaguauugccgugaaacuucuuauggggcaguaagccuauguuggcacaaaaucuggucagaaguauuaacuaaggcaagaaaguuugauauuuuaauugauaugugaaauguauauuuuuucuuauaguucuuuuucugaugaauaaaugaauacuuuauaggugaggaauucauauuucaagugauuuuuaacuuucuaccacggucacauaguuccuuaaguguuacauacaaaguuuuggugccgcaaaaggaauagcacuugaauauaaaauuuuuuuuuaauuuuuagcaaggcaaguuauuuuuauagaacucauaauuaacauaagugagagagaacucaaaccugagugucaagcuuuauuacuaucuuguguaaaaagaggaacaaauucaaccaaaacuaaaguccauccuucaguaaaacuuguauguuaggguugauacugaugcguagguacacaaauaaguguaaaauucuaacugaaagaauaugccagaugguuuauggauggugggauuaggaggguuaaauuuuuuucauuugaacuuguauacuuuguuaccauguuguggauuguaaaaucuguuuuggauguugguuuauacaucaugguauuuagcuuuucuuuauuuuuuguuuuuuuucuuugacuuaguuacauacucaugguccaaaauagcaauuugguaaagccuauagccccuaucuuagaguguuuuaaaaugcaggccaggcacagugguucaugcuuguaaucccagcacuuugggaggcugagaugggcgaaucaccugagaucaggaguucgagaccagccuggccaaaauggugaaaccuuaucuuuacuaaaaauacaaaaauuagccgagcguguucaugggugccuguagucccagcuaaggcugaggcaagagaauugcuugaaccugggagguggagguugcagugagccgagauggugccauugcauccagccugggcaacaagagugaaacuccgucucaaaaaaaaaaaagaaaaaagaauguuuuaacauguauuacauaaaaugcauagguuuacaaaggaaaccaauuuauacugaaguacaacaaggauugaauuagcaugagucauauuaaggacauuaucuggcacaggcuaaguucugucuaauguggaaaaccuaucuccugccuaucuuccccaaccaccucauuccccuuuccaaauugcccaauuacaauuuuuugaggauucuacuagaaaaagucuguccaggagaacuuucugagauaauggaaaggguauuuuuuacuguccaauacaguagccacuggcuguacaugguaauugagcauuuggauauuguggcuugugcaaccaaggaaauaaauuuuaaacuuuauuuaauauuaauaauuaaccacauguagguaauggcuaccuaauugugcaguauggccucagaagcuagaaauucuggccgggcaugguggcucacgccuguaaucccagcacuuggggaggcuguggcagguggagcacuugaggucaggaguuggagaccagccuggccaacauggugaaaccccaucucuacuaaaaauacaaaaauuagcugggugugguggcacgugccuguagucccagcuacucgggaggcugagacaggagaaucacuugaaccugggaggcggagguugcagugagccaagacugcaccacugcacgccagccugggugauagagcaagacuccaucucaaaaaaaaaaaaaaaaaagaaaaagaaucuagaaauucuggugugugcaaauguauguauacauauuguauuuaguucaacuuuauaagguauaacuggauauguccaguuugguuagauacaugauucuauccuagaaaagcuugucgcucuguauuuuaaacuuugaaagauaguuauuuacucuuguauagaauuagaauuuuucuguggguuaauguuuuuuuuuguuuuuuuuuuuuuugcuagucuuuuuguuucuguuuuuguuuugagauggugucucacucuguugucaggcuggagugcaguggcacgaucucgggucacugcaacauccaccucccggguucaggugacuccugccucagccuccugaguagcugggacuacaggugugcgccaccacugccaacuaauuuuuguguuuuuaguagagacagcauuucaccacguuggcuaggauggucuugaucucuugaccucaugaucugccugccucagccucccaaagugcugggauuacaggcaugagccaccacacccaggcuuuuuacuaguuuuuuaaauguguguguaaauagacaguacuuuacaguguucaaaacucaaguuuuaugcaaaaguacacagucuccugaagcugaucccuauccaggcagaugaccuagaggcaaccagcauugucaguuguuuaacuuuuaauagagauuugugcauauacagcaaauauguauauuuauaaaaaguaaauaguagccagcuaugugcacuuuucuggcacauuguguuuuuucacuuaauaugucuuguagagcauuacauaucaacacauaaaguuuucacuucuuuuuucugaugguauauguuacacuauuugguuuuaacauaauuauuucuauauuaauauuuaggucauuuccaaccauuugcuauuucaaacauuacugggauaaauaaacuuuucccuguaucauuccauacacgagauaauauaucuauaaaguagauguuuugacaacggauugaaaaauuuuaaacccuguuggucagauaaaacacuuuuucaaauauaguugguuuucaggcugcaauuuuuuuuuuagugcuccucccuuuuucaaaauaaauguuuauauguaaaaacaaaguauaaaauagguauguacguuuucuuuuaucuuuaauuuuuuuuucuuucuuuuuuuuuuuuuuuccaagacggagcuuugcucuugccuaggcuggagugcagugacaaucucggcucacugcaaccuccgccucuuggguucaagcaauucuccugccucagccucccgaccagcuggauuacaggcguccaccaccacauccagcuaauuguuuguguuuuuaguagagacaggguuucaucauguuggccaggcuggucucaaacuccugaucuuagguaauccacccacuuuggccucccaaagugcugggauuacaggcgugagccaccacaccuggcaaaaaaaaauuuuuuugagacagggucucacuguugcccagacuggagugcagucucugcucacugcaaccuccgccucccacguucaagcgaucauccugccucaaccucccaaguagcuaggaauacaggugugcgccaccacgcccggcuaauuuuuguauuuuuaguaaaaacggaguuucauuauguuggccaggcuggucucaaacuccugggcucaagcaguccuacugccuuggccucccaaagugcugugauuacaggugugagccaucacgccuggccagguuuuagaguaguaaacugaagacacauguaccaugaccuaggacaccacagcagcauuucagcuuuuuuaauacucccgugaucacauucuuguaucuuuggccccuccuccaucuucuuuucugacuuuugagucaagcauucccuugcuuuuuguuuuuucuacauuaaccucccauguauguaucuuucagcuauguguuguuuaguuuugaaaaaacuaaaaagcuagauguuuaagggaaagaugguauugccacuauuggaugaaggcucauaaaaaugauaaucugaacacaguuuuugguuuauaguuuggcuucagcuuccuagaauuucuacuagagcccuuuuucgggaaaccagugggcaugaucauggacauguccugggaaacauaggauuuauaguuguuaucuggugaggcuguuuugugggccaggcaaagaaucuucaguaagagaguggucuuugggaauaugcugcucuguaucuuguuuuaagauuggauuaaagcugaacucuucugguguaaaguuaccuaauacaguuagcagggcauaaaggagagaagaggaacuucaugaacacauggucaagcagaauuaaguagagauaaaagucugggcuggacacuugagcauuuggguuuuuuuuguguguguguguguguguguguguguguguguguguguguguguguguguuuagaaaagguagaauaauaaaaauaggcauuuuaaucauagcagccauuaaaucacauugcuccagucacauucaccugaaucacauugcuccaaucuggacugcugcccuuuauauaugguaaacauuugucuucccuggaucuccuuuuaccauguuccugauucuuucauuugacuuuuguguuccacccuuccauuugcugugcccuuuaucuuccuguuauuugguuucuuaucucacguuggugggccagaucuccagcaguuuuuugagaaaaaguacauaguaaaaaaauuuuugaggccuugaauauuaagugucauaccuguaguuuggcuggacauagaauucuucaggauucugaagucaaguuucaugguggacuucuguuguagcugcugaugagucugaaauuauucugguagcuaaaaauuauuuuuuagugugaccuguugcucucucacccucacucccuauaauuuguagauucuuuuucuuguccuuauuucacaauaauauaccuuaguauaagucuguuuucauccauuguacuguguacucauugggcauuuuuaauauggccacucauguccaucacuucucauagguuuauugguaauucuccucuuuuuucucuuugaaacaguuacucagauauuagaucucuuggacuaguucucugggaaauuucauuuauuuuucaaccuucauuuuaaguuuccauucauuuugaauuuccagguauuuauuuucucccucccauccuccuucucuuccuuuuuuuuuuuuuuuuguccucugaauguucauuuuuauagcuuccuguaauuguuauauacaugcaaaaucuuaacuuauuccuuugaggaaguacguagacuuuuuuuuugagacagagccucacucuguugcccaggcuggagugcaguggcaccaucuuggcucacugcaaccucugucucuuagguucaagugauuaucccaccucagccucucgaguagcugggauuacaggugcccaccaccaugcccagcuaauuuuuauauuuuuaguagagacgaguuuucaccauguuggccaggcuggucucgaacuccugaccucaagugauccgcccgccucggccucccaaagugcugggauuacaggcaugagcagaagcaaaguuuuaagaaggaagagcaaaggugacuggggaacuuacuguaccaugaagaaaaguauuauuaaagauaacggccaggcgcaguggcucacgucuguaauccuagcacuuugggaggcugaggcagguggaucaccugaguucaggaguucgagaucagccuggccaacauggcgaaaccccaucucuacuaaaaauacaaaaaauuagcugggcaugguggcggguaccuauaaucccagcuacuugggagguugaggcaggagaauugcuugaaccugggaaguggagguugcagugagccaagaucacgccauugcacuucagccugggugacagagcaagacucugucucaaaaaaaaaaaaaguaauuuacaaaaauaugauauuggcuguuggcccaugaggggaugggcagauuauuggaauacacugagcaguccaggaguaguuucagauguuuauuugggcuuuaauauaacuuuguuauaauacauuuugaacauuuagaucauugugaaaaaauaaucuguaaucucaacaacuagguguucucugguaauauuuugguucacuuguuugugaacuucucuuuuuuuuuuuaaccauauccuucuucguaccuuuucuuuuucccuuuuaaauacuuaauuuucggccggguuugugugcguagcucaugccugaaaccugaagcacuuugggaggcugaggcaggugaauugcuuaagcccaggaguucaagaccagccuaggcaacaugaugaaacccugucucuacuaaaaauauuaauacaaaaaacuagcugggugugguggcaugugccuguagucccagcuacucagaaggcugaggcgggaggauugauugagcccuggaggucgagacuucagugagcugugauugugccacugcacuccagccugggcaucagagcgggacccugucucaaaaacuaacuacuuaauuuucuuagagcaguuuuagguucggagcaaaacugagcagaaaagacaguucccguaacuuacuccuugccccggugcagguacagcuuucccagugucaacauccuacaacagaauggcacauuuguuagaauugaugaaccuaaauugacguuauugucacccaaaguucauacuuuacauuaggguucacuccugauguuguacagucuguggguuuugucaaauguaaaaugacauguaucugcgguuauaauaucgugcagaauaauuuuacuaagcccuaaaaauccucuguucugcuuguuuauacccuccccaccaaccacugaucuuuuugucuuuuccagagugucacagaguuagaaucauacaguauguagccuuuucagcuuagcuucuuucacuuaguaauauacauuuaaguuccuucuacgucuuuuuauggcuugauaacucauuuuauuuuagcauucagcaauguuucauuuucuggaugcacuacaguuuauuuaggacuucuuaaaauaggucaaaagcaaaaaaaaaaagugcuuuuuuuuuuuuuuuuuuuuuuuuuuugagacggagucuggcucuguugccaggcuggagugcaguggcacggucucaggucacugcaaccugcaaccuccuccuccuggguucaagugauucuccugccucagccucccaaguagcugggauuacaggcaugcgccaccacgccuggcuaauuuuuguauuuuuaguagagacgagguuucaccauguuggccaggcuggucuuaaacuccugaccucgugauccgcccaccucggccucaaagugcugggauuacaggugugagccaccgugccuggccuuuuuuuuuuuuuaagugcucauuuuuauaugguucuguaaucugcuuuucuccacauuuguauuaguuuuaaaguaauuuuuacaaacauguuuagugcuuacaucauaaacgccgugguuuguuuaucuguuaccuuuugguuauaucuguugauagauguguugucucuuagaagucuaauuacuagguuaaagaauguagauguuuuuauuuuaauuuuauuauuuuucuauuuucccauuuaguuuuggcuuggaacucaguagauccuuuuacguuuggaagcuugauaguuuaacuuaaauuaaguaaaacuuaaacuaaguaaauagaagguuguauuccacucuguaauccugggaacauaugaaacugaugacuauaccugguuuuguaaauuuuuuuaagguauauauuucuucaaaauauuuucuuuugaaaggugauuuuaaaaccuugguacauaaaaaggcaggugugguggcucaugccuguaauccuagcaacuucgaaggcugaggcaggaggaucacuugaggccaagaguuugagaccaggcugagcaauauagugagaccugucucuaaaaauuagcugggcaugguggcucaugccuguagucccagcuauucaguaucgucucuugagccuaggaguuugaggcugcagugagcugugauugcaccccugcacuccagccuaaguaauagugauacccuccucugaaggcaagaaaagaagaaaaaaaaaauuuguuggauaagaaguuguuacagaaaacaaaaugaccuuauuaaagcuacaguuuacauugaaauuauaaccuuuaacuuuugaaaaugaacacauagaauuuuuuuuuuuuuugagauggagucuugcucuguugcccaggcuggaaugcagugacacuaccuuggcucacugcaaccucugccucccagguucaagcaauucuccugccucagccucccacguagcugggauuacaggcgcgugccacuacaccuggcuaauuuuuguauuuuuaguagagacgcgguuucaccauguuggaccaggcuggucucgaacaccugaccucaggugauccgccugccucggccucccaaaaugcugggauuacaggcgugagccaccacacccggcaaaacacauagaauuuuaacaguaacugcucauuuguuugaacugugacauguaaagauugauuuuuuuaaaaaacuagaauuuaguaucaugaaauuuuaguuauguuuucuaaguuuuaaaauguauaaacguuuaaauagcaguuaaauucuuuaaaagauuugccuuucaaauacuucuuauaaagcuuuaaggaauaauugaaauggaaauuaucauguuacugcagucaacaguuuugugcacugguuguaaugccauuuuaguguugauauauuuugaaucauuuuuuuacuuuugcauaauguucaacguauguaaauuuuucuuuucuuugugguuuuuuuuuugagauggagucuugcuuucgcuaugcuggagugcaguggugcgaucucagcucacugcaaucucugauucccugguucaagcgauucuccugccucagccuccuucguagcugggauuacaggcaugcaccaccacgcccagcuaauuuuuguauuuuuuaguagcggcuggguuucacuauguuggccaggauggucucaauuuccugaccucaugauccacccguguuggccucccaaaguguugggauuacaggcaugagccaccgugccuggccguauguaaauuuuucuuuuucuuuuucuucuuuuuuuuuuucgagacggaguuuugcucuuguuaucuaggcuggagugcaguggcgcgaucuuggcucacugcaguuucccucucccggguucaagugauucuccugcuucagccucccaaguaacugggauuacaggcaugcgccaccaugcccagcuaauuuuguguuuuugguagagaugggguuucaccauguuagucaugugggucuugaacuccugaccucgugauccgcccgccucgaccucccaaagugcugggauuauaugcgugagccacugugcccggccuguaaauuuuucuaguuauuuuaaauuaugaaucuucugguagccuuugguuuaaauaguagugacauuuaaauuuuaucauuagccuugucauccuagaucacacaucuguuauuucuugugucuguguuaucaccuccccaaacccagacugaauuugugauguuggcuuaagcuauauaauaugugcaaaguaauuugaucaguagguacauguuagugcucccuuaagaauguucuuuaaaaaaauuuauuuuaaaauguuaaaaggugaccacaagucuucuuuuuuuuuuuuuuuuuuuuuuuuugagacagaguuucgcucuuguugcccaggcuggagugcaguggcuugaucucagcucacugcaaccucugccucccggguucaagcgauucuccugccucagcuucccgaguagcugggauuacaggcguaugugccaccacgcccugcuaauuuuguauuuuuaguagagaugggauuucuccauguuggucaggcuggucucaaacucccaaccucagaugcuccacccgccucggccucccaaagugcugggauuacaggugugagccaguguucccagccuccuacaacucuuucuaguaguuaagaaugugcugggcgcgguggcucacaccuguaaucccagcacuuugggaggccgaggcgggugaaucacgaggucaggaguucaagaccagucuggccaagauggugaaaccccugucuguacuaaaaauacaaaaauuagccgggcgugguggcaggcgccuguaaucccagcuacuugggaggcugagguagagaacugcuugaacccaggagauggaaguugcagugagccgagaucgcgccacugcaauccagccugggcaacagggcaagacucugucucaaagggaaaaaaaaaaggauucauccaaguuuuaggccuggugcgguggcucaugccuguaauuccagcacuuuaggaggccaaggugggcggaucacuugaggucaggaggaguucaagaccagcugggccaaaguggugaaaccucgucucuacuuaaaauacaaauaauuagccaggugugguggugcaugccuguagucccagcuacucgugaagcugaggcaagagaacugcuugaacccaggagguggagguugcagugagccgagaucaugccacugcacuccagccuguguggcagagugagaaucugucucaaaaaaaaaaaaagaauccauccaaguuuuaaaacuguuuauuugaagaucagaaaugcaaguguagacuguugggauuuuuuuuaauuaauaaaauguguucaaguauagcuugcugaguauccagaaauguaaauauuuagcuauagcccaacaaacuuaaucagcucuauucacucaugaguuagugcuacuuauuuugaucaaguauuuagguuauuauuuaaauaaacagcuauugaauuuuuguaguauuuuuggacacugcacaauuuguacacaucaucacaacucuuuaguaauccaguuacuagugauuuuuuguuauuguuuaguugccauuuuauauuaauugaaaagcacuuuaagaaguacugucuuuugaaucaugauugauauaugaugucucagggacuuuuacaugaaaaaauuuuuuccaugugagcaguguuuuaauguugaaagauuuguauuuugcuaaaucuccauguguuuuuuauuucaacuuucucgguuaagggaggaguauaaaagucauaguuuugauccuuuauuacagauaaggaagacugcaaaauccacagccacacuuucaugagugaugccagauuagcugguauuccuuuacuguaaauagauguuugaaagcuaaaaaccaaaacaguuuaauagccugaggcaguuuuucaguguuuucaccaaauuuuuuauuucuuacaagacaggugguaagacuauauuuguucuuguguacuaguuaauuaauuauacuaauuuacauauuugagggugcugugaggaaaugcaugguuuguugaaaagaacugaggacugacagccgccuccuccaugauuacccuggcucucugucccacccuucucauggcgcuugggggaccauggcugauccuguccugagacaaauuaagacuccuguggugaagcaguuggucgagaaaaagugaugcaugaaaaagaagcaaaacaagaaggaaagaaaaaaaaugagagcugaagauggugaaaaugaugccauuaaaaagcaggcagaaagucugcgagaaucccaggugauaagccuuguuugccagcacagguuggaagcugcauauacuguucuuuggcagauuuuagaaagugaaaaggacuuggaagaagcugaggaauauaaagaacauuuaguacuggauucaguggaguuagaagccugaaacuuuuauguacaggguguuuuuugcauuaaaucaugggguccaguuuacauuucauuauuuuugaccacugcuguguguucaagugugagaacgugauucuuuuuaugugauuguguacauuucuuugccugauuuaauuugucaaaugaaugacaaaacugagaacuaacaguagauacuacaaggaacagaaacguaugaagucuguuuacauauuuguauuaaauaauguucucauuaaaguuauuuguacacauaaaagagguuuuuacuuacacuuaccuguauaugugagauauuugaccaauggguauuuaguguccugcugugcauaauaauacaaacucacuauauaguugcuuuuuuuccugguaguggguuuuuuugugugucugggaggaagggugagguguaccauucaugccuuuuuuacuaguuuauuggcagucacaugcauuggcaagaugagcaaagguguugagccugaggcuguagaacagagcacaguauauauuauagauuuauguugccuagaaagagaaucuuuguaaccauauaauuuauuauucaguccuggccaccuuugggagugagaguucuguuaacaauuauacugaaacaacaaacagguagaacuaggacaugugguguucuuagccguaaacccugguaguccuggauuuaaaugacauguuuacuuuuccaggacuucagauuugucugaagaguggagagaauaaugguuguuucacgggauuaugaagauugacuauauugagaugauuuauaguauguugagauaauauguaugaaaauaauguagcacauggccugguaguuacugcuuaguaaauguucccuaucaaguaaaaacucauaguuuggaugaggugugagcuuuucaaaaucauaaagcaccauccuuuucuguucuuacugugucuguccuucugcucauuauuucauaccuuuauuuaauauagugacuucaauuuacuagaauguuguauuaguaccuuguagaaauaauugcagcugucuuugccauauguagcauuuacauuucuaauauggacacagcugguuuuccaguucagcuacagaaagugaaggaagggguaauauaaggaagcacuacuggauaugagucaccaaucauguuguuauccauuauuuggugcuguagcauugaccgaacacguuuauauuuuugugucaucaggaagggggagaguguugguaucagaauuauuuaggugugguaacaguaaucuggguaauuauuucuaacuuaaucacgaguucuuucucuuuucauaucccuacuuacuguguguaugauuggggguggggugaagguggggaaggucugguguaaggaucugaggauagauagaaauuauugagccaggacaauaauuuagagagcauacccuagguaguuuagguuaccacuccuuguucagauauuacugggauaugaauguuagugauuuaucuucuauuguucuuaaaauuuuuuccucaucuuaaaauuuaaaggacuggaacuucuccagaguuugaagucuaguucaguaugccgcauuuacucagcucuuaccuuucuaaacucuuacauuaaugucaucucaaguacugauugcucaugguagccgacaguuauggaucacuucagugccaaacucuuggauuguugaugaaaacccacacggcacuuuuuacaagggaagaaacugauccuuacagggauuuuaaggacuuacccuagaucacuuaaaucccuaugguacucugaaaguuuucuccuaucauacucaucuuaagacuuaaaggacucaucaaguugggguuagagguggauccaggcugucuuguugagcuacccauuuugcaguauggcuccuagugcaucagggacugauaaaccugggauugcuuuuucuguuaugagaggaaaacuguaguagugaagucagagccugauauauacagacugucaguugcagcauuauuuggaagcacagaagaugguaugugaauaaaugugccugauauagaaugucuuucucccucuagcccccuuuuuugugccuuuuuugaugcuugauuucaauguccuuuaugcuguuccuugguaauagauaguugcagcucaaugcuauauuuuagccauucaugaggccaaagauaugaugccuucaguacagaaaaggggaaauaggguaucugggaguaccuuuaaaaguaggaaaaguagguuuccuuacuucaauuuacuuuaaaaugacuuuauauugcauuaaucauuauuguucugggaggaauaccuauaucuacauauaucagaaggaauuuaggaaggaggaaagugauaaauauaauuuaaaaaauuuuuuucuuucuaaaacaaaucauaugaaacaacucagcauaguggcuggucauauaguuugcucugaauaaauacuuggagaauggcaagccagguaaccauucacuuaacauuuuuagcuacuuuauaaaaagcaacccuuauuuugcauuucccauguaucagacaguuuaaaugcuuuuauuuuuuaauucauuuaauccccauugugauccuaggagauaaaugucacaaugcccauuuuaagaugaggaaacugaggccacggaaguuacuugcucugaauuuuacagcugugaauggcagagcugggauuccaacauggggaacauggcucuagagggugugaucagaagcagugcaucucauauucugaugacaaucugguuuguguuuguuuuuaaaguuucauuucauuuaauuuuuuagagacagagucuuacucugucacccaggcuggaaugcaguggugcuaucauagcucaccgcagccuuagaacuccuggacucaagugaugcuccuauuuuggccuccugggcucaagagauucuccugcuuuggccucccaagguguugggauuacagggaugagccaccaugccuggccuuuuuuuaaaaauuucuaauauaauacuuuuguaaaaugauaaagaugaagacaugcauacaauauguaagccugaauuugauuaguuucagcagauacaaaauugucaaauugcuacagauuuucaaaguguuuacuuugcauuucuauacuuaaccucacugucaaccauaaccaguuuguggaccagcaguaguagucuguggacuauacuuugaguuacugguucaaaccauuauuagugccaagagggacuacugauuauuccauacuucaaauaagguguugggugauuugucuuaaccuggaaaaaaauuuuuuggaaguuccugugaguaaguagauauuuguugaaugaagguaauggaggacacaaaugggguauucugaggggaaaggcucaucauuauuucuagaagugguuuauauguauauuuagguugagaguugcugagaaaucuugaauguucaaaacuauggaaaagcacaucaugguuuuggaauuuaagcaauguagacuugaacaugaugaggagaaccuaaaguuuagucagauuuauugaaaacaccacagaaugaugcuagaucugggaaauauuuaccucuauaauauuaggauuguccuguaagauuaauauuauaccugugcuaauuuuugcagaauguaguaaaaagcuaccugacauucuuugcagccaguuguuagacuuuucucacccuugcuugcuuuuuuucuucgcuuucaacuuucucuuguugcuaugacaguuuauucagcccuggguuugcuaaauuacaauacugaacauuuuuauuugaagcugauaaacucagcaaaucuuaaaccagguuuaauacuuugcucucaaauugguuaucuuuuucucuucccucacuugccauuuguauuuaaucucuuugaccuucuaguuaauggcuuucauugcccccaagaugaaagguacacuuuuagccugaccuuugaggccuuuaacagucucacuccaaccuaccauucuagcucuuugguuucaugaacccucucuuucagccacauuggucacuaccuggaugaacacagcaccaucccauggccucgcucuuacucccuauucuacccaccuaaaauucguuacacgaugcuuuuucaagggaagauugccuauuuuaggguaaaaauguguuugacuacuuugagauuagccauaaucugcuaaauuagccuuuacuuuuuuguccaaguaguuuauaaaccuagaaauacuggucauuuaauuuuuuuuccuuuuuuuuuuuuuuaaauucccugauagaaccugagaucggucauuuaggauguaauuuccagugaaauuugcucauugagagaacacuagccuaagagaguagagagaggaauaugguaggauuuugcaguagaguuuuguuuuuaaacugaauguaaacuuaaaacuauuuagugucuauaggaagcaaucuuaaaaauaagguuagauaccuuaaaauagaacuuguuucuugaaauauuuuuuaguucccauauagaucauacgaaaagaugacugucuaugcccaauaaaaauuuuuaugguauuucacaucauucguuuuaaaaucuaguauguuuaaaagugaagacuaaagauuuuaaauuaguauacuuacugauucauacauacacacauauuuaaaaauguguagcuccuuuuuuaaguuguuggaaaaguacaaaaucauguguccuuuuuuguuuuguuuugagacugaguuuugcucuugucgcccaggcuggagaacaguggcacgaucugugcucacugcaaucucugccuccuggguucaagcaauucucuugccuuagccuccccaguagcugggauuacaggcgcgugcuaccacgcccagcuaauuuuugcauuuuuaguagagaugggguuucaccaugucggccaggcuggucuugaacuccugagcucagguggugcacuugccuugaccucccaaagugcugggauuacaggcgugagccaccaugcccggccgauuauguguucuugauaugaagacuauaguaaucaguuacuuacagugggacuuuuauuuuaauucaaaauaacacuuuaaaauucuaggaacugaauauguuuuuccugagugauaacuugcuuuuaauuccuguauguccaaagacuugagagagagagagaaagaggauuguuucuuuuucuuucuuccccuuucuucacugggucucacuugcugaggcuguuuucgaacuccuggacucaagcaguccucucgccuuggccucucaaagugcugcaauuacagacauaagucccugcacccguucugcuuacguuucacaaauacugggcaguugcaaguuuuggcuuagcuguucuucucuguuaggccaaccagaguuacgcucugaaagugccaguuuaggaguuagccaaaaaccugugagggauuuuuacauauauugaggagcccacuucucaucuacagcaguuuuucucugguacccugucccccaaagccuaccugccugccagucucucauuguuuucaucgagacucccacugucugccuggaaacccaucauuaauuuuaagcuagugggauaggaaaugucauucaguaauuaucuguuugaacacuuaaauuuacugguaaguaaauguugauaaaaauguuugguuuuaaggcauuacuuacuguaugucaauuuucaggccuuaaucauucuguguaaacauuuaaauuuauucaguuaaguaaucaaguuaauaaguuccuguuggguuaaguacugugauuauugaguaaaaucaagacauggucuccguucugggugacuuuauaggcuaauagaaauucuuguacaugucauauguugauaagaaaaaacauaucccuugggaggccaaggugggaggauugcuugagcucaggaguuugagaccagccuggccaacauggugagaccuugucucuacuaaaaauaaaaaagaauuagccagguaucauggugccuaucuguagucccaguuaccguggaagcugaggcaagaagauugcuugagccagggagauugaggcugcagugagcuaugagugagaccccaucucuaagaaaaauaaaauacaaaaaaaaaaaaaacccauauucuuucaaauaaauauuuaccaccuuucugcucugcauucuuuuagacaauaaauauuugacuuacauaucuuguuauguuaacauagaucucuguuguuugcugcuucagucugauauccaaacacuuguugcauugcccuuuuuuugguaucagucuuuguccuagugccuuucuuuggcucucuucuuuuguugacaacaauuuaugauaguaugaagagcuacauggaagaauguggugaacaccuauuuuaaauuacugcccccagacuacuuuucuuucugauauuuuuagaugacaguguuaauuuugucuagccuaaaagaagauuuaaguucaagccaauguccaucuuguuagguuccauugaaaauauuaaguugccgaacuuuuagguuacgauaggguaaacaguaugccaugaagguaagaccugcgcaucauuggcuugaucacuuuacaaagcuuuuuugucaucauaauguuguuuuguuuuguuuuguuuguuuuugagacagggucuugccguguugcccaggcuggucucaaacuccugggcucaagcaauccuccuauuaauccuccuauuaaucucccgaguagcugggauuguagagacgcaccacagugcccagugauacaguuguuauacucuugaaacuuuaguuuccauccuguauccuuccugauacccccuucaguaccauaugcaguaucuuaauaugaugguauguuaagaaagauagaagauuuucccaacuuuguugcauagucugugacagucuuccugcuauuuaaaaaaaaaagugcaaguggaaggauaacuauaaauacuguuauauuuucaaauuugagaaaccguuugcucuuugcucuuaaugaagagauaugagaauagagaaugguucuuuagaguuuggucuguggucuguuuuaugaagcaaucugcuuuaauuccuucuucuuaaaaaauacuacuagugccgggugugguggcucacgccuguaaucccagcacuuugggaggccaaggcaggugaaucacaaggucaggaguucaagaccagccugaccaacggggugaaaccccgucucuacuaaaaauacaaaaauuagccaggcaugguggcacacaucuguaaucccagcuacuuaggaggcugaggcaggagaacugcuugaaccugggaggaggaggagguugcagugagccaagaucgcacgacugcacuccagccugggcaacagagagagacucugucucaaaaaaaaaaaauuaucagcauaucaguucagguuuaguuagaauauugcugucauagauguguuaagacauuuaaaauaauguuuuauauuauuuuccacuaggaaaccaccccuacuccuaaucccccgacuacagaagaggagaaaacggaaucuaaucaggagguugcuaacccagaacacuauauuaaacauccccuacagaacagguaagcuuucuaacaccuagguuuucugaguuaggccacaagguaaauugugaauggggcaaguuugaagggaaaguuagauuaugagacuaguuuuagauaugcuaagguugaggguucuauuuucacuuggaugacccaugaccagcagacaguuuuaugugugagucuugaguucaaaaggagcuaugugagagauuaguuugaaaaguauuggucauaauggaagccacauuaguaaauaaguucccuuaaggagaagugaacuugacucaggacaaagaccggggauacuagcaucauauaggaggcuuuuguugaagaagaaugccuaugaaggauggacauacaaagacagugguggucgcccaacgcgguggcucacgccuguaaacccagcacuucaggaggcggaggcggaggcggaggcgggcggaucaccugaggucaggaguuugagaccaaccuggccaacauggugaaaccccgucucuacuaaaaaauacaaaaauuagcuggguaugguggcagacgccuguaaucccagcugcucgggaggcugaggugagauaauugcuugaacccaggaggugcagguugcagugaacugagaucgcgccauugccugccagccugggcaacaagagcgaaacuccaucucaaaaaaaaaaaaaagagacagugguggucauggaaaccaagaaggugguuuauucuaagauagggugguuuacagcacaugugcuaaaaaggucaaaugaagcaagaugucaaaauauccauuggauugaacacuuuuaaaaaaguccgugcugacuugggaaaaaguuuuuuaguaagguuccauagaguaguuccauaaaacauggaaaaagagauuagggcaguuugaagagugaauaggagauauacagauguauagaguaagaacaggugacuugaaguuggacugagaaugagaaacgagagccagggaauguggaguuugaagguugguugguuuguaagugagagacuagaaaaggggacagauuaaaauuaguuaaguuuucauaguuaauaguguaacaggaaauugaguauuaguucauuauauggcuuuucccaacucuucccacuccuuuccaguagguuuguuuuuauuuauuuucugggguauaugagaauuaacuugaguucacugaaugcugauggugggaagaaaauggcaguucagaaacauuguaacaaucuagaggaaaguaaauuggaauuaacuucugagguucuugaaguauuucaguucauuucuugucuuuuuuuguuuuuauuuacuuuuuuuagggcagaccauucacucucuacuuaaaagaguccacaagucuauuuauaauuguuucauuuauuaaaauuuuuuuaugaucucaauuuuuuuaaauguuuccuuuauucaucauggaagaccuacugaaauaaauaguucaaauaugcuguaugcaguuuucucauaggagacccuuugguucaguauauccuccagugaggaacaaaucaguuuuuuagacaauggagauucucagcuagugggacaucagaggucaaacagucuauaaaggauaaaauccuuccucagggaagcaauguaccacauguauuagguugaacaauucguuagaggcagucuuauauaguuuaaccuaauaguagcaccaaaacccacauuuuuuuuucauuuuuuucagugauaugaaacaaacuguauaucuucuagcugucugugaaccuaguucuuggugucacuuuuauuguggggagaaguaaacaaggcauauaucccucacagcuugaauggagucuaagaagggauucuuaaguguccucaucaguuuaaaaaaaaaaaaaaaguuuaaaucuuaaaaugaagucucuggggacuucaguuucucuauaaauucuacuuuuuguguaaaauagcaaguaucauuuggaaaaauacuauguuuuauggcuccaauuuuggcaguuuucucauuauuuacuucuugcauuuuacuuucuucacuccccagaguagucaauguuaaauuugguuuguauuccagaaguauuaaaugcacauauguauacuuuuuaauacauacgucuauacaguugacuuuucuguuuguaugugcauauuuuaccucauuguuuuaaaccaccgucuugcauuauauugauauaccaccauauauuuuauuagguuuacauuaauggcuguauagauuuuucuuuuuacacacagugcuguaauuuacauccuuacauaauugugcacuugugugaauauauaggguaaaauuucagaucuccuagaacaaagauuacccuuuaacaaccuuugcgcagauacugccacauuauucuguuuuauuggcuuagacuuaacaguuugagaguuccugguuucuauauccuugcuaacucaugugauuagucuuuuaaguuguugccaaucagauuggucccagucugauuugggaaaacaauuucaguauuuucaauuugcauuuuaaaauugaaguuucaaaauauuuucauauugaugauuugugguuuuuaucugaggacagauuauucaguucuucuauuuuuuuucuuuuggauuaucuuuuuuuuccccuacuuucaagcuaacaaguuauggaauaucuuuucaaguuuauuuccaagcauuuuauauuagagugcuaacucacccaaggcagggaaguuggaggaguauuaagucagaaagaaacagguuauccauaucauuugucuucuaacauugucuguggaauuguaugguuuuuuuuuuuuuagaggucuuuaauuuucauguaggcaaauacugcuuuuccucagugguuucuggguuucauaucaauuuuaggaaaacuuuaccacacaguuaagcuuuuuuuuuuaaacuuuuuaauaguugcauaguagucacuugcguggauguaugauauuuuauuuaaaucagcaguacucaaguauuuggucucacaauuccuuuacacucuuaaaaauuauuggugacucuacagagcuuuauguggauuuuuaucuauuguuauuuacuauauuuuuacaguaaauaaugcuaagauguuauuuuauuuuucacauuuaaaaauguauaauuucaccugaaaaacuugagaaauguaaaauuauucguuuagaaaaucuaucacauguuaaccuaagugacauuuuguaaugaaaauaauuauuugaaauaaaaaauauauaaugggaagaacagcauuuuugccaucuguuuuuuuuuuuuucggagucucgcccugucgcccaggcuggaccuccaccucccggguucaagcgauucuucugccucagccucccuaguagccggaaccacaggugugugccaccaugcccggcuaauuuuuguaguuucuaauagagacgggguuucaccauguuggccaggcugaucuugaacuccugaccucaugauccacccaccucggccucgcaaagugcugggauuacaggcaugagccaccgcaccuggccgcauuuuugccgucuuagaagucaacuggauuuucauagcuguuucugccuucagucuauggaguuaagauguuucauuggaaguauaagaagacaauacagccucacacagguauuugguuggaaaagggagaauaguuuuuaaaagccuuuaaaaauaauuguugauaugcuccuuugauacacuacuagguuucuuuuuuccccccccuuuuucguaggacacaugcucaaagagauacuagguuucuuagaggcuaguugcaauguggaaucugaaaccauauccaagaauuuuuuucuacuuuguuacauuaaaauccauuggucugucagugucuugcaucuggaauggaucucuuaccuguguaagauuuuuaacaucauacacugcuuauuuggaaaauaaugguucagugaguuaugcagaucuuccaauguugacacauuuucuuauauaguaucaaacaauaauaauucauuaauauuaccucuaaacucauuaagcgucuuugauuuuuaggaaguugucaggcuuacaguggcagaugaaaucuuucuaaaauucugauuuuucuacugaaagcuuaaauuuuaagcaacaaucuuaaguucagacaauugccuaaauauuguauuuuguuuuacaguaguggaagugguuuuugugcagauuaugaaaaauauggaaauagaaugaaauuuaaugaaacugguaauguuuauugccucaucaaagucauuccuuuuuuuuuguucucaagacggaguuucacuuuguugccuaggcuggagugcaauggugcgaucuuggcucacugcaaccuccgccuccuggguucauucucaugcgucugccucccaaguagcugggauugcaggcaccugccaccaugcccaucuaauuuuuguauuuuuaguagagacaggguuucaccaugauggccaagcuggucuugaacuccugaccucaggugauccacccaccucagccucccaaagugcuagaauuacaggugugagccaccaugccuggcccaaaggcauucuuauaugaaacucacauuauuaguacugugagaguugguaguaauaaauguacagugacuacucguauaguuuugugucacugucuugguucuugcuaaggcaccagcagauuuaacuacuguugcuuuugcaccguuagugcaaaugugaauacugaaaagcaaagugccuucuuagcauuauuaugaaaauggaucuuagggccuccugccugucugcagaccacauuuugagaacugcugauuuaaauaauuccuuguugauaagcacuuaagauguuuucaaauuuuccaaaacuaaaaacgucauuuguuuguuuuugaagacagggucucacucugucacccaggcugggguggcguguaaucucggcucacugcagccuucaccuuccguacccaagccaucuuuccaccccagcuggggccccacaggcaugcaccaccaccauuuuaguauuuuuuguagaguuggaguuuugcuauuucccaggcuggccuugaacucguagacucaagcaauucauccaccucggccucgcaaaauacugggauuacaggcaugaaccaacaugccuggcuuuuuuuuuuuuuuuuuuuuuuuuuuuuuggaagagacauggucccauucugucgcccagacuggggagcaguggcaugauaauagcucacugcagccucaaauuucugggcucaaaugaccuucccacaucagcuuucuaaguagcuagguccacaggugugcaccaccauggcuagcuaagguguuuuuuuuuuuuuuuuuuuuuuuugagagaugcggggucuugcuauguugcucaggcuguucucaaacuccugaccucaagcaguccuuuccccuuccccuuccauucccugucccuguccccaucccugucccauuccuugacagggucuugcucuaucacucacguuggcgugcaguggcaugaucauagcucacugcaaccucgaacucuuuggcucaagcaauccuccugccuuggccuccagaguggcagggacuauagacacaugccaucaugccuagcuuauuuuauuuuauuuuauuuuauuuuauuggagauggagccucgcucugucaccaggcuggagugcaguggugcgaucucggcucacugcaaccuccgccucccagguucaagcgauucuccugccucagccuccugaguagcugggacuacaggcgcgugccaccacgccuagccaauuuuuguauuuuuaguagagacgggguuucaccguguuggccaggauggucucgaucucuugaccucaugauccacccaccuuggccucccaaagugcugggauuacgggcgugagccacugcgcccagcccaugccuggcuaauuuuuuaaaugucuaguagagaugaggucucacuuuguuguccaggcuagucuugagcuccugggcucaagugauccuccugccucagccuccuaaaaugcuguuauuacugguaugauccaccuuuccuggccccauagaucuuuauguguuuaaauggcugggugcagagguuuuuguuuugaaaaaagauugaauuauuuuuaaaaauccagcauguauacuugaccucguuggugguuuucuugccuuuucuucuucuuuuuuauugauaaugggguggcaguugcugacaaauuaucaaguacauguugaaaugcaucucauuuuucugucuaggugaaguuaccaagcauuaauuauaggauuaugaaauauauauucaauuuggaaggcucuucagacaacauucguguugaugagaaaaugaaauuucccuuugacugcccuuugguauuguaauucagagaauauucaguuuaauucuucuaaaggagaaucaucuugggauaauaacauuuaaguguaacuuuaauguuccacgaguuuaucuucaaggcauuagagaaaauauuauacaggcguaccucauuuuacugugcuucacaaaucaugccuuuucuauaaauugaagguuuguggaaauccugugucaagcaguucuguugaugccauguuuccaauggcaugugcucacuuggugucucugugucacauuucgguaauucucacgauauuucaaacuuuuauuguaucuguuaugaucugugaucagugaucuuugauguugcuauuauaauuguuuuggggugccaugaacauuggcgauauaagauggcaaacuuaauugauaaauguuguauguguucugacugcuccacugacuggccauucccaucuucuuguccuugggccugccuauucccugagacacaacaauguugaaauuaagccaauuaauagcccuacaguggccucuacauguuauagugaaaggaagaguugcaugucucucacuuuaaaucaaaagcuugaaaugauuacgcuuacgaggaagacaugucaaaagccaacacaggccaaaagcuaggucuguuguaccaaauaaguuagccagguugugaaagcaaaggaaaaauucuugaaggagaucgaaaguccuccuccagcaaacacaugaaugauaagaaaacaaaacagccuuauugcugauauagaguaaguucaaguggucuggguaguaaauaaaaccagcuacaacauucccuuaugacaaagccuaauccauagcaaggcccuaacucuguucaguguuaugaaggcugagagagguggggaugcugcagaauaaaaguugaaagcuggcagaggucaguuauaagguauaaggaaagucacccccauaaaaguacaaggugaagcagcaagggcugauauagaaauugcagcaaaaucuccagaucuagcugagguaauugaugaaggaaguuuacacuaaaaacagauuuucaguguaaacgaaacagccuucuacuggaagaagaugccaucuucuaggacuuugcuaguuagagagaagucauugccuagcuucaaagcuacaaaggacaggcugacucuuguuaggggaucuugcagccaaugacuuuaaguugaagccagugcucauuugccauucccaaaaucuuaagaauccugaagaaugaugcuaaauccacucugcccaugcucuagaaauggagcaacaaagccuggaugacagugcaucgauuuauagcaugguuuacugaauacuuuaagccuacuguugaaaccuacugcccagaaaaaaaguuuccuuucaaaauaucacugcuccuugaugaugcgccuagucgcccaagagcucugacagagaugaauuguuuucaugccucuuaacacaguguacuuucugcagcguauggagcagcaaagaggaauuuugacuuucaagccuuauuauuuauuaauaagaacuauauuucaugaggcuaaaugcuguagauagugauuccuuugauggaucuggacaaaguaaauggaaaaccuuccgaaaggauugagcauucuggaugucauuaagaacauucaugauucaugggaggucagaauaucaacaugaacaagaguuaggaagaauuugauuccaacccguauugaugacuuugaagcguucaagacuuuaguggaagaaguaacugcagaugugcagagagcaagagaccaacaguaagaaauggagccugaagauguuacugaauuguugcagucucaugagaaaacuugaauggauaagguguugcuucuuaugggugagcagaaaaaaagguuucuugagauggaaucuauuccuggugaagaugcugugaacauuguugaagugacaacaaaggauuugaauauuacauaaaccaaauugauaaagcaacugcaggguuugggaggauugacuccaauuuugaaagaaauucuacuauguaaaaugcuuacaaacagcauugcaugcuacagagaaaucuuuugugaaaugaagagucaaucagugugacagacuucguuguugucuuaagaaauugccacagccaccccaaucuucagcaaccacuacucugaucagucagcagcaaacaagggaagacccuccaucagcaagauuaccacucuuuguaggcucagaugaucguuagcauuuuuagcaauagaauuuuuaauuaagguauguacauuuuuuuuuagauguaaugcuauuucagacauaauguagacuacaguauaguguaaacguaacuuuuacaugcaccgggaaaccaaaaaauuugugugacucuccuuaaagauaguuccuuuauugugauacucacuuuauuaugaugaucuggaacuggacucacaauauauccaagguaugccucuauauauaauauguuagguauauauaagcuauuauguauuauguaggaauaaaacuauuuuaagagaaguauauacagauauauuaaaacugguauacauuauuucagaacauaucuaugcagcauuacucaaucuuuauuauuuucccaguuagguauuugauuaaauauagaaucacauuuaauaguuuccccacuccuggcacucucauuucuucuuggcuaauuuguuccucugagaaauaucagccaaccuguuucucgccuucuuuuuuuuuuuuuuuuuuugagacagaguuucccucuguugcccuggcuggagugcuguggcacaaucucggcucacagcaaccuccaccacuuggauucaagugauucucgugcuucagcuucccgaguagcuguaauuacaggcacauaccaccaggccuggcuaaauuuuuuuguauuuuuaguagaaaccagguuucaccauguuggccaggcuggucucgaacuccugaccucacgugauccgcccaccucagccucccaaaguguugagauuacaggcuugagccaccgcgccuggccccuugucuuauuuuauaguuuaagugucugcuguguuuuuuuuguuuuuuuuuuuuguuuguuuuuuuguuuuuugagauggaauuucgcucuuguugcccaggcuggagugcaguggcgugaucucagcucaccguagccuccugcuucagccucccaaguagcugggaauacaggcaugcaccaccaugccuggcuaguuuuguauuuuuccuagagacggaguuucuccauguugaucaggcuggucucgaauucccaaccucaggugauccgcccaccucagccucccagagugcugggauuacaggcgugaaccaccgcgcccagcucugcuguguuuuucuuaaauaacugugcuugcuuaucucugucagagcacuuagcacacuguaguugucucucugcgucauuucugugaauuccguugagugaugaguuucagugugucuugggucucuagguauagcagggaaucuguuauguaguagacauaacauacauaucuuuuaaaugaaagaaauggagaacucucauuauuugccacuguaauaacaacuagcauuuugcuuuuuucccuaaauuuuugugguaaacauaaacauuuacaguauuaacuauuuuuaaguguacaguuaauguuaaguacuuucugcaaccaauuauugugcaacuaaucuccagaacucuuguucaucuuccaaaacucuguaaacucuauaacccuaaacucccuucucuuuggcuaguggcaaucaccauucuuuuuguuucuaugaauuugacuucuuauaccucauauaaguggaaucauacaguauuugucuuuuuuggaggggggcuggcuuauucacuuaauguccuuagcuuccccucauguuuuaugaaguguuagaauuuccuucaucagggcuuuuuaguauuccauuguguguauauauacauuuuucauucaucuguugauggacagguggguugcuucuaccuuuugacuuuugugaauaauguugcuuuuaacauggguaugcagcuaccauuuuuugacacugauuuuuuauuuuuagaugggcacucugguuuuuuaaaaaugauaaaagcaaaacuuggcaagcaaaccugcggcugaucuccaaguuugauacuguugaagacuuuugggcguaaguaaccauuuguuuuaguauguuuguuguuuuauucguuguguaguuuuuuuauuuuuaagucgaauucacaaaaugaagugugaguuaaacaguuaaugaauguucaucuauuuuuuuaucuccucacaaaaguuugaauuggugauuaugcuuuauuaguuuuacagagcuucaaucuugucaucccccagccccaauuauuguuucuuguccugagauauccuuagcucaagaauccauuauugcccuuagaacuuuugacagcuaguuggaacuuguuccacuccugguugccaagauacauuugccucauaacuggguauugcagugcguuguuggguccucauuucugcaaacuguuuucagugcaauaucuggaauuuccuguaccagagauuuuaagauaucaaaggcugaaguguucagaauucacgguuugucaaggcaaugccaguaucuaucaugauacuuuauucauuucauuauacuuugaucaaccucaagaagaauaguugaaauauuuuugaaauuuuguuucuguauagcagaaaguuaagaauugggaucaucaacuuuugcaugaccuuaaaacaaaauuuaaggcugggcucagugacucaugccuguaauacuaauacuuugggaugcugaggcaggaagaucacuugcagccaggaguucaagaccaaccuggucaacaugagucccuguuucucuauaaaauaaauaaaaauuguaaagucuauuucaagaaguuuugauaauugauucucuuaaaaacaaaguuaauccagugugucuaauuuacuuggagaaugacuagggagguacuauuugagaccaugaaaggcaaaacucuuuaauaagcacuuuaaauuaccuagcaguuaucuaaauauucuaacuuguacaucuuuuuuuaggaucauauacaugcugaauuagugaugcuacucuuauguuuuaauguaacccccucaagauauucugcucauacaaagaaauagauugugguauaaaauuuauacauauguauguacaucuucaacagcagaaacaauauuuuucuguauauuuccagugcuuggcuucuaauagauauuuuguauucauuuguguugcugaaaaaagcaaagcauacgauuaaaaccauaaacuuugagaguauuugagaacauucauuugagaguaaacuuugagaguauuuauuuuuuauuaaaagcauugacacuuaauaauaacuacauuuaaggccuaauaauuuauaggucuaguuuucuaguuaaacuaggauuauuauucuuugcccaucaucaaaacaucaaguaguuuuucuucucuaguuuuguuuauucaggacucuuaaauaacuccagucuucugcaccccccaaaaaaaagcuuuucauucuccuacagagaaaaaggaagccuugagccaccuuccccaaucagauuugcauuuaucuaguuuguuuggcuuuuaccaguuuacauaauucuaccuucuaauuagaacaguucuccaugcuucaguuacauguagucaaugucauuacauaguagguuuuuauaccauaacuuagagauaugaaggauuuuucaguuuucuauaaaugugugggccacuuccuaauuucuguuuuuuucuagcaaauuuauugcagauaaccauugaguccuuuuguauuuauccagacugcauagucuuaggauucuguuuagaugugccauuauaaauucucaugauggacuuacuugagagaccuuugagcaccacagaagagaaaggaggcagcaaaagggaaaaaguauuuuauugaaggucauucccacaauauccauucauuuuaugacauuaguagcgcuaauuuuauagucacuuaguaucccgucuuuuuuuguugccuaguggaggcugucauugaugauguaguugggaguuaccauuagguagugacucagcaaaccuuauguggucuuagguugucucaccuaaacuauauuuguguguuauacuauggaauuugauuuaaagaugccaacuucuuucuuaaaucuuuuuuuuuuuuuugagauggagucuagcucugucaccaggcugaagugcaauggggugaucucggcucacugcaaccuccgccuccuggguucaagcgauuuuccugccucagccucccuaguagcugggauuacaggcgcaugccaccacgcccggcuaauuuuuguauuuuuaguagagacaggguuucaucauguuggucaggcuggucucgaacuccugaccucaugauccaccugccucggccucccaaagugcugggauuacaggcgugagccacugcacccggcccuuaaaucuuuaccugaaauauuccuagaugggguuaacauagcaccaggagaaccagacuaaggauaguagaaucauccauggucuguagacacagcuaagaucauuauuucugccaucuaauauuggagacaagcaaaagauucuuaagaguugccaauuuuuaaaucaauuuugcuguaaaagacuacaggagaucaaaugaucuaagccuccuaccuucaggcaagcaacuaagucaucgcaaauguuauucuguuauuuugauacuugggaaauaguuuagaaauacagacugcaggguuccaucuuauauuuaggugauuauaaucccaagauguagggcuuguaacuauauuuauuuauuuauuuuucuaaaaucaguuuuaaaaugauuauuauguugacuaaccagugacaguuugugguguuugggaaccguugaucuauucuacucuuggauaccuucaaggauaaugacuguuucagucaugcaauccugauggucaggaaguucaucguuucugguuuuuguuuuuguuuuuguuuuuguuuuuuuauguuugugaaaaaaacuguguauuaacuucagaaauuauuucaucuacuuaaagccaccuuauaccucucuucucaguuucuuauauauauacauauguaugcacugaguuaacuaacauaaaauauauuuuugucagagcagucacuagaaguuuuuuugaaaauuauaccugucaucugaaguugauuauuuaacugcuuuuaagaucuguuuuguccauuuuagaaauugacuccuuagaaacaaguaaacaugaacuuuuaucuguuuauuuucaucauauguucuaaauguauauauauguaagcaccuaaacucuauauuacauauucuguguuuuuaauuguuauuuucuuuuaccuagucuguacaaccauauccaguugucuaguaauuuaaugccuggcugugacuacucacuuuuuaagguaugcuuaauuggugauuuuauauauuuauuauaggacugggccauuugguauucauuaagaaaucuuaccauaaacuuaggaauauuugauagugugaugaauaggcugauaauuuaauuggcuguaguaugcuuuaguaucaauauaucuuauucuauuuguuuauaaaaauugagagagaguuacucugugggcacauacugagauugauuuugaugagagcuuugauuauccagucuacuccuuccuuuauauauuugagcagacugaguuuaucaagcauucuuaaccuuaggagcauggguccuuggaauacuuauuauugggcuuugucaguugguagagggacgggacauucauuaacugaaauugcauaguuuuugcauguauuuucuagcuguagaaauguacagagcuucuaaaauauguuugcuucucagaaaguuuaagaaccuucaaauuaagugaaacccaagauuugauagcuaauaagugacaaagccaggacucuaauucugcaaugucaugccucuggcuuuaagucuuaugugcuguuuaaaaacuacaucaauggcaguuuuaugggcaauaaaguaagaaguugacaguguuguugcuuaacuguuucuaaugauuaucucucaaagucaagguaacaauguuguguaauacuguugucuucuaacccuguaggaugguauugagccuaugugggaagaugagaaaaacaaacggggaggacgauggcuaauuacauugaacaaacagcagagacgaagugaccucgaucgcuuuuggcuagagacaguaagguuuuaaaaguauaaagcaguuuuagagguaguuuuggaauacugauacuuaagauauguuauguuuuacauuuguuacuuaauuuaagagaaggaugcccaacacuagaaaaucagggucaguaauuauuuuuguucugucauaugacuccuguuuauaguacagugaaacauccuaccacauuauaagucagauauuuuaagugauuggcaguugacucucaccacaguaagcucacuguggucauuucauuaaccucaaaauuauagaaccuuacauuuuguaugauugaaguuuuugcaacccucuuacagcauugcuauauguauacuaaacuuuuaaauacuuauauuuuuagagcgagggucuugcucuguugcccaggcuggagugcggauauuuauuuauauggcucauuucagccucacccucuggguucaagugauccucccacuucagccucuuaaguagcugggacuacaggugcaugccaccaugcccagcuaauuuucuaauuuuuuuccagagaugggaucuugcuauguugcccagguuggucucaaacuucuggccucaagugauccucccacuucagccucccaaagugcuggaauuacaggugugagucacugugccugucccacuaaacuuuuuagauuagugaagcaaauaauaaaauuguuguguacuaccauuugaccuacauguugugauauuaacuggaacuucuggcuuuacaagacaaauuaaauaugagauaauaagcauuuucuguagacagagguuccaaaccccaagcuuauaggagcgggguuuguagucucuuuuguaucccuagcacuugaaaccgugccugguuuauaguuagcacuuguuaaguuaaucacuuuaaauguuugaauaagugacuauuuugcuuuuuuuuagagacagggucuuguucugucgcccaggcuagagugcaguggggccaucauagcucacuguagccuccuggguucaagcaaucauccugccuuagccucucaaguagcugggacuacaggugcaugccagcacagccagcuaaugaaugaaugacuuuuuaagaagaaaauucuguuuuugagggggaagaucaugagcaaauaccauuuuugaauuccacauuaaaaagucaggacauuuccauuuugcaguuaaaaaaaaucuucuggagauggaugguaguagggaugguuguacaacaauguugaauguacuuaacaccacugaacuguacacuuaaaggugguuaaaaugguaaauuuuauguuauuuguauuuuaccacaauuaagaaaucuguuagggcugggcucacaccugugaucucaacacuucaggaggcugaggcaggcauuucacuuaaacucaggaguucaagaccaguuugggcaacauggcaaaacccugucucuacaaaaaauacaaaaauuaacuggguauggugacaugucccuguauguaugcccaccuacucaggaggcugagguggaaggaucauuugagcccaggagguugaggcugcagugagcugugaugaucccacugcacuccagccagggugacagagcaagacccugucucaaacaacaacaacaacaaaaaaccagaccauuaacaaauauucauaaaaaauaagaacaagaggagauuaaccaugaauagcuauuuuuauuauucuauuaauauuuguuugcucauaaauauaagcagcagcagagcaaaugaauauuaauaaaaucagcuuuuaugucugccaugacauuaacugccaaauuugcugaaaaaggcugauuugauaguaaauaaaugaaugaguauuuaaaagucaggacagaucaauauaugcaaauaaaauuuacacauuuaaaaaauuaacucuugauuuaaaaacugccuuuaguuucuaugcaaauacagaagagacauuugcaguguaaugagcuuguuuauaaucuauuaaauguaauuugggauuuuuuuuuaagcuucugugccuuauuggagaaucuuuugaugacuacagugaugauguauguggcgcuguuguuaauguuagagcuaaaggugauaagauagcaauauggacuacugaaugugaaaacagagaagcuguuacacauauaggguaaguuuugcucuuugccuacuuauuuuacaguauuaagaugaguaaaaccagaaguuauuuuauuuguagcuuuagaaauacuucaguuuguagauccuguuuuccuuguauuguuuucgugaacacuuuuauaauuuugaacggcucaauuggugcgcaacgucuuguuuuuuuggguuuuuucacagcuauuuauuuauuuauuuauuuagagauagagucucacucuguuguccaggcuauauauaguacaguggcaugaucuaggcucacugcaaccuccgccucccggguucaggagauuguuaugucucagccucccgaguagcugggaauacaggcgcaugccaccaugcuuggguaauuuuuauauuuuuaguagagaccagguuuugccacguuggccaggcuggucuuuuaacuuuuggucucaagugauccguccaccucagccucccaaagugcuaucauuacaggcaugagccacugcgccuggccuuuuucauauguuuuuuauuucuguaaaauugcuuuuucuuagcagugaaguauauaaccacuagagcacucuccuuuggcauguagcauuuuuuauucauucacaaaugagaauguauuauuuccuacuuugaaagugcuguuuggaaaaaaguacuacuuugaaaagagcuaauguaugcucauaauaauaauucagugauuauuggcaaauaguauaugugcauuuaaagcauguguguuuacuacguauaauuuucauuaaaauuuauauaacauaucuugguuuuuguuccauguuuaaaacccacauauguaggguuuuauuaaaccuuuuuuuguaaauuuuauucuuugcaaaaguggcuuuuuuuuuuuuuuugagacagggucucacuguguuauucaggcaagagugcaguggugcagucauggcucacuucagccucaaccuccugggcucaggugauacuccuaccucagccacccaauuagcugcaacuacagguguguaugaccacaccuggcuauuuucuuguauuuuuuguagagaagagguuuugccauguugcccagacuggucaugaacuccuggacuugaucaagccaccucagccuuucaaagugcugagauuacaggcgugagccaccaugcuaaaccagcugacauuuuuuuucuaagauuucuuuuuaccucaauuauauuaguaauauuugacaccaggcgcaguggcucacaccuguaaucgcagcacuuugggaggcugaggcagguggaucacaaggucaggagauugagaccauccuggccaacacggugaaaccccgucucuacuaaaaauacaaaaaaaacaauuagcugggcgugguggcgggcgccuguaguuccagcuacuugggagacugaggcaggagaauggcaugaacccgggaggcggagcuugcagugagccaagauugggccacugcgcuccagccugggagacagagcgagacugucucacaaaaaaaaaaaaaaaaaaaaaaauuugacuuacaauuuuauguuaaaauuaagugcuggucagucaguggucaaaauguuugguuugccccuuugugauuuuucaaauauuauuaauuuuucuuuuuaaaauuaauuaauuuuuugagacagagucacacucuguugcccaggcuggggugcaguagcgcgaugucagcucacugcaaccuccaccucuuggguucaagugauucucuugccucagccuccugaauagcugggaccacaggccugaaccacugcaguaguuuuuguagagacaggguuucgccauguuggccaggcuggugucaaacuccuagccucaagucauccaccugccucagccucccaaagugcugggauuucaggcgugauccauugcucucagccauguaaauuuuuaugugaacauaauuuauuucuggaucaaaagguauagggauuuucuacauuucaugcuauaugggguuccauaagagaaaagaguugauuugucaucauauuuuaauguuucuuccagcaucaaaaccuaauuuuggaggauuuacuuuuuuuuuuuuuaaaugaguuaaauuaagaauuuuuuuccuacggaaguuuuguauuuuugucaauauuaaauguuuuugaguguauauuaagacuucagauuuucaaacgaagauuuucuuuuuuaaccuuccaauuugcaugacucaauggucuugcuuuuugacauuuuuaauaauuaaguauaauugaaaggaaugcauugcauuauaaugcaaauuugauaauuaacacuuuaguuaccauaaaauuacuuuuuaauaccuuauuuuagggggaagguaguaaaucuucuggaagguauaaaaaaaaccuauccuaguaucauguuggaggauuuaacuccauuaauaucuuuauuccuuuauuuuuauuugauuuuugcuuauuuuugaauuuuuacuauuuuuuuccuaaagauucuuuuuucuuuuuuuuuuuuuuuuuugagacggagucuugcucugucacccaggcuggagugcaguggcacagucucacucaagcucacugcaagcucugccucccagguucacgccauucuccugccucagccucccgaguugcugggacuacaggcaccugccaccacacccggcuaauuuuuuguauuuuuaguagaggcgggguuucaccauguuagccaggauggucucgaucuccugaccucgugauccgcccgccucggccucccaaagugcugggauuacaggcgugagccaccgcgcccagccaaagauucaaauuuuuaagaugaccuaugaagcucucugugaucuuccucugaaaccuugucagcuuuaucucauguucacuuuacuuacaagccauagccacacagccuaauuuuuauuucucagcuuucaaaugugcucauucucuuaacauuauccuuuugaccucgugauauuuaaaggggaagacuucucuaauguuguagaugagauuagaaucuccuuguuauacaguaucacagcccuuauguuuacucuuuggcacucaugacaagugccauuuuauucuugcaauagagucaugucuuacuugaaaauuagguuguaaaguuaguauguaaagcagaaauuacauucucccucgaaguguuucauucacucccucgaaguguuuaaucucccucaaaguguuuaguuuuuguuugugcagucuuauaacagguaugguuaauauaauuuguguaguaauauacaauauuugcuaggguucagacgugaaauguaacauuuuagaucaaagaaugaaacauguuuguuuuacagauuucuguuuuuaaguaugcaugugauacaggucugucauguauuugugauuauuugauuauguuuucucuacuagacuauaaaugcagucagcucagggacuguccuuacuuuguucacuguugauuuaguaauaauuauaguaucauaauaaauaacaauauaauaauauaguaaugcuccuguaauuuaguaauaacauaccugacucgcucucaaauauuuuaaaaguaauuaaccaagaauaucgcaaaaaugaagaguaaauugugcugaaaggaaaaggguguauaauuaauuuccuauuuuauucucaagucuauguuuuuuaauauaaagacuaauaacccuaaauuuuuaaauguauuucuugugaguaaaaguuaaugacuacuuuuuucuucuucuuuuuuuuuuucuucuaggaggguauacaaggaaagguuaggacuuccuccaaagauagugauugguuaucagucccacgcagacacagcuacuaagagcggcuccaccacuaaaaauagguuuguuguuuaagaagacaccuucugaguauucucauaggagacugcgucaagcaaucgagauuugggagcugaaccaaagccucuucaaaaagcagaguggacugcauuuaaauuugauuuccaucuuaauguuacucagauauaagagaagucucauucgccuuugucuuguacuucuguguucauuuuuuuuuuuuuuuuuggcuagaguuuccacuaucccaaucaaagaauuacaguacacauccccagaauccauaaauguguuccuggcccacucuguaauaguucaguagaauuaccauuaauuacauacagauuuuaccuauccacaauagucagaaaacaacuuggcauuucuauacuuuacaggaaaaaaaauucuguuguuccauuuuaugcagaagcauauuuugcugguuugaaagauuaugaugcauacaguuuucuagcaauuuucuuuguuucuuuuuacagcauugucuuugcuguacucuugcugauggcugcuagauuuuaauuuauuuguuucccuacuugauaauauuagugauucugauuucaguuuuucauuuguuuugcuuuuguuuuuuuccucauguaacauuggugaaggauccaggaauaugacacaaagguggaauaaacauuaauuuugugcauucuuugguaauuuuuuuuguuuuuuguaacuacaaagcuuugcuacaaauuuaugcauuucauucaaaucagugaucuauguuugugugauuuccuaaacauaauuguggauuauaaaaaauguaacaucauaauuacauuccuaacuagaauuaguaugucuguuuuuguaucuuuaugcuguauuuuaacacuuuguauuacuuagguuauuuugcuuugguuaaaaauggcucaaguagaaaagcagucccauucauauuaagacaguguacaaaacuguaaauaaaauguguacagugaauugucuuuuagacaacuagauuuguccuuuuauuucuccaucuuuauagaaggaauuuguacuucuuauugcaaggcagucucuauauuaugucuucuuuuguggugucuuccaugugaacagcauaaguuuggagcacuaguuugauuauuauguuuauuacaauuuuuaauaaauugaauagguaguaucauauauauggaauuaaauugauguggcuaucuuuguuuuuuuauaaaguaaggcacagucauucagucuuagguaaauaauguacucucuuaauauguuaauacucaugagaauugggaucugaugcaucaccauuugauugguagcaacagugguuguaaaacuugguugcugaauugaguuguuucuauguuaagugucaaaaugauaguguagggaaaguacaggugguggggacauaugcauuaagaaucuuguuaguguugcaaucuaaauagaauggaauaaacagguguuaagacauauuuauagugguaaauuguuguaguaugguauucuguaaacuugaaaacuugaucuacucuuuguagguaucauuugaaagcaaacuugaaaauguuuuguacauaguacauacuuguauaguccugugagaugaaguauggcuaucagaccaaaggauaagccaaacuguagguagcagaauggaaauuauuauuuugagaggaaaauuugucuuugaauggugauuaugacuuaaucauuuuaaaacugauaaacuugacaaaaacccuguaugaaauaaacaugaaauuaauagcacugauuucauuguaaaauuuuaaagcaguuuaaaggguaccacagguuaucacaguacucucaaugccacaaacaccucuuguucaguauucuagaaauacugaaucagaauucuguguuuauuauaaucucagcauacuguacauaauaucugcuaguuaaacuuggguaauugguuaaggugacuuacugucuaugucaauauguauaguuuugaguacuucaagaguuuacuuaaaagugaugauguuacugguauguuggcagugggugggacugaaguaguguaucuauuauaaauugaucuauuuucuuaauucuaagaugaaguccaauuuuaagcaucagcuuuuaggugcaaaggaggaauuaacacauuaaauguauacaguucuaaauuuuugaaauaacugauguguagcauuugauuauugguauuaccauuuuagaaucaugauguuauuuuaaaccuuuuuccuggggacaagaaaggauaauaaauuacgcugaaucacuuuuggcaguugccacuuaaauaguacagugacuugcaacuuuuauaacuuuaucagcaucuucucuaaauacaaaauuaggcuauauguuauuuuccaacuuacuguuuucucucuguuuagcaggauauuauaaauagauuaaauagauauauuuucuuuuuuuuuuuuuuuuuuugagacggagucucgcuuugucucccaggcuggagugcaguggcgugaucucccaguagcugggacuacaagcaccugccaccaugcccggcuaauuuuuuuuguauuuuuaguagagacgggguuucacuguguuagccaagauggucucaaucuccugacuuugugaucugccugcuucugccucccaaagugcugggauuacaggugugagccaccguacccagcccaaauagauguauuuucauaauagagaauugaaauaggcuuuaaugggugaauagcaguuuauuguaggcaugugacauuucauuuaaugaauuuaaaguuuauuaucccaauucuacagaaggauuuaaugcauacuaugcaauuaaauaauuauaacacuacauaguaauaauuuaugugccaggcaguaguucagucacuuuacaugcuuauuaaccugcagaauaaucuuuugagauguaggugcuguuacugagaauuuaacuuuugcuuguaaauugcaaaggguggauuugaauucuggaaauuugguuccagagacaauaauuacauaa

SEQ ID NO: 13855 - RNA, 1350 nt, Homo sapiens
cuaucggcucccuuaaaucuucacucccuuucucaucuagccuugacuucauugucuaucacuucagacaaguugcuuuugcugccuugaauuauuugcaccauuguucuaucucagcugaucaaaaagaaagaacucaacccugggguuggagcuccaugccuguaccugggcuguacauugcacaguugggcagguucuagcaaccaugaauucacgucacugacacgaacuagacauaagucuauguuccccuaccuuuuaccacagcagcaauuccuaccauucuccuauauuuauguuuuguuuugagauggagucucacucuaucgccaaggcugggaggcagugccguaaucucagcucaccgcaaccucugccccccagguucaagcaauucucaugccucagccauccaaguagcuaggauuacaagugugcgccaccacaccuagcuaauuuuuguauuuuuaguagagacagguuucaccauguuggccagccuggucucaaacuccuggccucaagugauccgcccgccucagccucccaaagugcuggaauuauaggcaugagccaccgcacccagcugauucuccuauuuuuaauaacaaaaauaugcuaccuccauucucaccucaaagccuaccacaguagcaugauuaaaucauagcaaauaacuucaaccccacuucugugaaaaauauaaugaaaaaacaagcuaccaaaccagcacuuccaacuaggaucguaccaauaagccugugacuugucugcaucaucauccauccuuccuucccuccaguuauaauggucauucauccuuugacuuguccaaggccgacagguuagggguggcaguagaguaaggaggacuugguuaaaaauuaccaggcccagccaucuagaaggaagcucaggaccccaagagccaacaauucuguagcaacagaaaucccauggcaaauguuuagccuguccacccuugcugggaacuugacaaaauuuucagcagaauuuaaagcagcuuuuugcagcccuggacuugucuaaugcuacuuccacugccugugcucuggaucuuauuuccucacacacucucagaauuggcucagucuaugcucuuggaccuucaaucucuacugguucccuucuucagaagugggauauguucaaaucucucccaucuuagaaaauucuuucacugauugagucuaucuacuaaccugcuaugucuuccuauucagggcaaaauucuuucuaucuuuccucucucuccuccuccucccucccuuccuucuuuccuuuguuccuaucuucuuuacuucuucccugucugccucccuccuu

SEQ ID NO: 13856 - RNA, 1350 nt, Homo sapiens
aaggagggaggcagacagggaagaaguaaagaagauaggaacaaaggaaagaaggaagggagggaggaggaggagagagaggaaagauagaaagaauuuugcccugaauaggaagacauagcagguuaguagauagacucaaucagugaaagaauuuucuaagaugggagagauuugaacauaucccacuucugaagaagggaaccaguagagauugaagguccaagagcauagacugagccaauucugagagugugugaggaaauaagauccagagcacaggcaguggaaguagcauuagacaaguccagggcugcaaaaagcugcuuuaaauucugcugaaaauuuugucaaguucccagcaaggguggacaggcuaaacauuugccaugggauuucuguugcuacagaauuguuggcucuugggguccugagcuuccuucuagauggcugggccugguaauuuuuaaccaaguccuccuuacucuacugccaccccuaaccugucggccuuggacaagucaaaggaugaaugaccauuauaacuggagggaaggaaggauggaugaugaugcagacaagucacaggcuuauugguacgauccuaguuggaagugcugguuugguagcuuguuuuuucauuauauuuuucacagaagugggguugaaguuauuugcuaugauuuaaucaugcuacugugguaggcuuugaggugagaauggagguagcauauuuuuguuauuaaaaauaggagaaucagcugggugcgguggcucaugccuauaauuccagcacuuugggaggcugaggcgggcggaucacuugaggccaggaguuugagaccaggcuggccaacauggugaaaccugucucuacuaaaaauacaaaaauuagcuaggugugguggcgcacacuuguaauccuagcuacuuggauggcugaggcaugagaauugcuugaaccuggggggcagagguugcggugagcugagauuacggcacugccucccagccuuggcgauagagugagacuccaucucaaaacaaaacauaaauauaggagaaugguaggaauugcugcugugguaaaagguaggggaacauagacuuaugucuaguucgugucagugacgugaauucaugguugcuagaaccugcccaacugugcaauguacagcccagguacaggcauggagcuccaaccccaggguugaguucuuucuuuuugaucagcugagauagaacaauggugcaaauaauucaaggcagcaaaagcaacuugucugaagugauagacaaugaagucaaggcuagaugagaaagggagugaagauuuaagggagccgauag

SEQ ID NO: 13857 - RNA, 1513 nt, Homo sapiens
ugggcauuuggcuccagcgggucugcacucaacccgcuuccuauaugauccuuuucuugacuaugaauuaaguguugucacaagcuaucuugacauacaauaugccaucuuaaaggccuaaaguaugggcuauauauuaugguuuggaacacauauuugccuugagguuugcuguauuguuugcaauuaguauugaggagaagguauauuuaggaauuaaaaauauucccuauuaaguauaugggcuuucaggcacaauauuuucaauucugauguagacgucauuuucucuguacguuggaggaaaguucaccacgucauaacaugucagccgaucguaagucaaaaaucauuuccaugaauauaccuguuacaaugugagcacugcacaagguacaauuucaaaaaaauaagaauuucccuuugacaaauauuuguuccugcccuauugaaauuuaacgacugauaaggcaugucacauaaaaaccaaaggaacaaagacaaccagagagugggggaaaacauaccuauacauaccacaaguauauaugccacaaguguaguccauuagcgcauccuguccuaaauaucuuucaauccauuuucuuaggcagcccuugcccuuugcuuccccaguccugacucagauccuuaacacuugcuucuacagcacugcaguagccuucuacuuaguuucucuuccuccaguauugucccuucuuuuccguuuuauacaccuucuccagaugaccuugcugaagcagaaagcugacacuaucacgguucugcuuagaacccugaacugacccuuugccagcauacaauaaagcucaaacucuuuagggugacaugcaaugcccuccucaaaauccccugccuacuuuucuagccucugcuucccugaugcacuguguccuucaagccuugcuuuuucgaguauauggaaugccuuuucuggucuugucugcuggggaaaacccagugaauucuuucagacugaauuuaaccaucgccucauuggagaauccuccuuugacuucuugccuuuagucagaaacaauucucucaccucugugcccccauaacacuuuauucagaccuuauagcucuucucaugauguuugauaauucccuggcuacaugucaaucuuccccaccagagggagggcucuguaagguaaagcuuguugucuucaucuuucuauguguagcaucuaaugcagugccuggcacagaaaaggaguucaauaaaugauuauagauugacuaaugaaugggugaaugaaugauggaacaaauccuauugcuugaguaaaggguaaacuuuggaaguuuucuguauucuuuaaugaacuaacugaaguauugguucaauugguguaaaaacuauaacauggacuagauagcagcaaguguggguucucauccccagugucacuaauuagcccuguggccugggacagaucacuuaaccucuugaugccucaguauuguccuccagaagauuaggaca

SEQ ID NO: 13858 - RNA, 1166 nt, Homo sapiens
aauagauuaucucuacuuuaucaaugaggaaaaugaaguugagagaguauaaaugaccugcccaaagccuguuggcuuguaaguagaaaucaggucuucuaacuuggaguuuucuucucuuugaauuguucuagggacagcaagaguuuucuuucaucuccgaacaacugacugggggugccugcuuggagaguuguguugggaaggguuguaagaccacauccaaaaagaaagaggguuuugguugauuaacaaguucgugggcgugagggagggcagcaguguacuuuuccucaugacuguaguaugccaugaggcaggucuuucuggauuaucuugacugugggagggaugguguaauaguuaucuacuacugaguaacaaauuuagcagcuuaagaaaaacagguauuuacuaucucacagucucugugggauguggaaauagagacauggauuagcugagugcuucugucucaaaauugguuaugugguggcaaucaauuuggggcuggggcugcguccuuuucuguauccucagcugggggaaggaucugcuuccaugcccacuugugugguuauuggugggauucuguuccucauggacagaggguucuguuccucuaggacaaagggccuccguguuucauuggcuguuccuuagguucuugccaccugggccucaucaugggacaacuuaccccguggcagcugcuuuccuugaugugagccagcaggucagagaaggcauccagaagagaagccacagccuuucugcagcccaaccucagaagggccaucccaucacuuguacgguauucuacccccaacaagcaacagaugaaaaaaacaugcaguuacuucuucuguuaccauuucugucauugucauuguuggcuauuuugcuucaaaaauugugauuuaucuucuugaagcucagucucuuucugugcauucagcaauaguaugagggccugccucguguccccuuuccaugucaggggcuuaagcauggaauaaugguauuauugcuuauuauaauuaguaauuuuaguuaauaauaaccaauaauuuagaaaagagugccacagggcagugagugccugugguguuggcacguucccucucacuccuguccaaucccuuucacaucacaugugugucugu

SEQ ID NO: 13859 - RNA, 1503 nt, Homo sapiens
cuaccucugcuuucccaccgcccgcagcugaagcacaucccgcagcccggcgcggacuccgaucgccgcaguugcccucgggcgccaugucgcagaacggagcgcccgggaugcaggaggagagccugcagggcuccuggguagaauugcacuuuagcaauaaugggaaagggggcaguguuccagccucgguuucuauuuauaauggugacauggaaaaaauacugcuggacgcacagcaugagucuggacggaguagcuccaagaguucucacugugacagcccaccucgcucacagacaccacaagauaccaacagagcuucugaaacagauacccauagcauuggagagaaaaacagcucacagucugaggaagaugauauugagagaaggaaggaaguugaaagcaucuugaagaaaaacucagauuggauauggguuggucaagucggccggaaaauauuccccccaaggaguuccucuuuaaacacccgaagcgcacggccacccucagcaugaggaacacgagcgucaugaagaaagggggcauauucucugcagaauuucugaaaguuuucuuuccaucucugcugcucucucauuugcuggccaucggauuggggaucuauauuggaaggcgucugacaaccuccaccagcaccuuuugaugaagaacuggagucugacuugguucguuaguggauuacuucugagcuugcaacauagcucacugaagagcuguuagauccugggguggccacgucacuuguguuuauuuguucuguaaaugcugcguuccuaauuaaguaaaauaaaagaauagacacuaaaaucauguugaucuauaauucuaccuaugggaucaauaagcaugucagacugauuaaugucuacuguaaaaaauuugguaguaaauuuucauuugauauuagauauaaauaucugaauauaaauaauuuuaauauacuagucaugguguauuguauuuuaaaaauuaucugcaaccuuaauucaguugaaguacuuuauauuucaaaagaaugaauaacauugauaauaaaaucgcuacuuuaagggguuuguccaaaauaaauauuguggccuuauauaucacacuauuguagaaagcauuauuuaauuuaaauggaugcagguugucuacuaaagaaagauuauacauaacuaugcuaauuguucauaaucaacagaaaccaagauagagcuacaaacucagccguacaguucguacacuaaacucuuguugcuuuugcauuauaaggaauuaagucuccgauuauuaggugaucacccuggaugaucaguuuugugcugaaggcaccugcucaguaucuuuucgucuuuaucacucugcauuggugaauucaauccucuccuuugugcucaacuuuugugugcuuuuaaaaucagcuuuauucuaagcaaaucugugucuacuuuaaaaaacuggaaauggaaaaaaaaauaaaucuuugccaaaucc

SEQ ID NO: 13860 - RNA, 447 nt, Homo sapiens
ugacauucuauaauuaauaaccuggcuuuuucauuaucaggcaauuccccagaguaaucagaguacuuucgguucugaaaucauauuacuaacagauggggaagauuaucaaauaagcuuaugcuuuggagagguaaaacaaaguggcacagucauccacaccauugcucuggggccgucugcugacgaagaacuggagacccugucaaauaugacagguaaaccuuuggcauauaguuugaauaaaaaauaaauuucuagucucucccauuccagggguucuuucucuauaaaucugcucaaaauuuucauauccuaaaaauuaaucuuugucccuucuucauccuucagauuaaguucuuuucccuuucuuccacuucauacaccaguuuuuuucuaauguuauuuaacauuugcugucuucauuccccgcccaguuucugccaa

SEQ ID NO: 13861 - RNA, 56645 nt, Homo sapiens
uagcuuuacggcgauucgagcagucgcgucaagcaggcuauuccggguuuguggcugcuuggcuccacacgugggccgccguagguauuccgaccgguaauuccuccuauuggugugcagcagccacauugaaggauagaguggcagcagaggccaaggaucgugaguugauggaguuugcugcugaaaaugaagggaagucugggggaggucuccacagcguagcugagggggugcggcuaaguccagagccuggcagggagggaguaagggacuuagcaggggcggaggaguucggcggcggagaggaggggacagggcugacagggauaaaggagauaggggauggagaggaaggaaguggacaaaggccagaggaaauaccgauggaccuaacgguagugaagcaggaaauuauagacuggccagguacagaaggcagguuggcuggccaguggguagaacaggagguggaggauaggccugaggugaaggaugagaacgcaggcguauuggaggugaagcaggagacggauaguaguuuagugguaaaagaagcgaaggugggugaaccagagguaaaggaagagaagguaaaggaagagguaauggacuggucagaagugaaggaagagaaggauaacuuggagauaaaacaggaggagaaguuuguuggucaaugcauaaaagaggaauugaugcauggagaguguguaaaagaagagaaggauuuccugaagaaagaaaucguggaugauacaaaggugaaagaagagccuccgauaaaucacccggugggcugcaagcggaaacuggccaugucaagguagggcaugggggauuccauuuaggggaauaaagcuguggaguccucaugucuagagugaaggaaaccacacuaucaggagaagguggaauaaugaaaaaugagcacaaguuuggguuucuggagucagacggcguucgcggggguggguugggaaguggaggguguuguacaugacaacacaacaaauucagugaaaauacaugaaauuaguaguguccaauggguaauggucaaguuaggaaaguggaaauucuggggaccaaaagaucaguuggaacuggaucuggcuugacuuaauaugcucuuuacucgguauuccuuugagagagaauagagaugagaaagucuaauaaaacuaacaaugacaaaguagauuaaguuaaaacuaggcaaaaauacacuugaccucaauuaucaagcuucuucaugggugcugugaauauuuauugcuuuugauugaauuuccuuaguguguggaucaugugacaaaggaaauaagaguagucagauucuugagaauauucccgucuagaacacagugggcuaaauagaaguaacuguaguuugguugucaguaucccaggagcauagaagagcaguugaggacagaugauggguuacauggcauuucuagauuauuucgaugcucauucuagauuaggcguggaguucaggaaaaagggugcuacuacuacucucuaaauuucacuuggccuuauauucuuugucuggugugugcuuuaaaaauaucuaaacauagcucaugaauuggacuucuggauacacacacauacaaucauuaccacauuuccaggaaucacaaguuaaaauaucagugaauaaucucauucccugauuauaguagaaaaagaagucaaaagcgagauggguuuuaaaaauuuuaauacauuuuccugaguuacauaucacuaacaacauuggaaauguaguuguuuugggaagguuucauagagaagaauuuucaaaugauguucaacagcuaucaaauauuuuaucaguuacuugucacugaguuuauaaauugauugggaauucuaaguuuauaaauaaauacaauuaauauuugauaauuuaauguuacaugugggcuuuuguaggugugagacuugugguacagaagaagcaaaguacagauguccacguuguaugcgauauuccugcagguauacauguaacuuccuaccuuuuaaccuguaucuguaccuuucuuacccuaaaauauaaaaguacuuccccuuugucuuuucaguuugcccuguguaaagaaacacaaagcagaacugacauguaauggaguucgagauaaaacugcauacauuucaauacaacaguuuacugaaaugaaucuccuaagugguaagccacuuuaugcauagcaaauugaggcuuccuggccauugguauaugucacuuguuuauucuucuguuuugaaauuuuuagauuaucgauuuuuggaagauguggcaagaacagcggaccauauuucuagagaugcuuuuuugaagagaccaauaagcaauaaauauguaagauuuuuuccuaauuucuuccaguuagaaguccuucaaaucaauuagauucuuuuuuuuuuuuuaacuuaccaaauauauuaaguggcuaccaugauguagagcuauucugauuacuuaaggauauggcugugacccaaacaaaguccguccccucguggaguuguauuuagugggagauauaggagauaaguagaggaacaaauguaauuucagauagaguuaaguucauauagaaaauaaagaaggcucaagagauuaaagagagaaugaaaauggucuuuguuggggagagauugucaggguacuauuuucgauacaguggucaggagaagcuucucaaagagaugauguguaagcagugaucugagugcugagaaagaggcugucaugugaacauuuggaggcagauuaucccagguagggacaaaaguaaaaggaaagaccugagucagaaacaaggaugucugguuugaggaauuaaaagauuugcaagguaacugaagcauagugagugaggaggagaguauugaaaaugaaguuagagaaacuggugaggaguugggugcaguggcucaugccuguaauccaaacacuuugggaggcugaggccagagcauuccuugagcucaggaguucaagaccagccugggcaacauggugaaaacccgucucuauaaaacaauacaaaaauuagccaggcgugguggcgugccccuguacucccagcaacuugagaagcugaggugggaggaucaccagagcccaggaaggucaaggcugcagugagccaugauugcgccacuacacuccagccugggcaacagagugagacucugucucaaaagaaaaaagaaaagaaacuggugaggguuucuaauucuaagugcaaauggaaaccauggaaggguuuugaacauaaauuugccuuuugaaaaaccacucuugcacuuugugaacuuuagcggggcaagaauggaagauuggaagcagggagaccaauuaugcagcucuucccaugauccuugugagauaauaguggcuuggguguacuguuugaauuauugggaagggauuagauugcgauuuugaaggaagagcuaacaagacuugcuauucuaauacacuuaauuuucauacucuugcauuccuuuuuuaauuccuuaaauacuaugcaaaauuaaagcuuacauauuuggaauauuuggcaacugguguuguagaaauuuguuuauggugugauuaaaucguauccuggaauuguguucauuuuaguauuggaguugcagaauuuuaauaccuuuuaaacaccuuauuuuauugguauuauugguacagacauaauuacauuacacauaucugaaagaaaauuauucauauagcaacucuuauuuuuccucaaacuuaauuaggcauaauuaaaauucuacuuaaagauaaauuacuuuacaauuuuuuuuuaaauugugaaauauagcaaguauauuuucuaaacaucacaaaauggaaauacacaguauaaugaauaauuauaaaaugaauauucauuuaacuaccaccccaaucuagaauuagaacauuacuggcuucccagaaguuccaugccacccuuuuaugcccuucccugaucuuuucucauuucuuuauauuuuuuucuaucuuaggacuguaccacaauuuguuuacgcauuuuuuuaauggauuuuggauuuucuguaagaauaaaaaacaguuuagaaacaaugccacuacuuuugucuaugaauuauaguaugugugugaacauguguuucuaggguuuauaccugggaauagaauugcuuuguugugugguaugcauaucuucaauuugccuagauguuaccaaaacauuuuccaaagugauuguacuaguuuacacucucaccaauaguguaugaauguaccuauugucauauucucgccaauacuuaguuugguaagacuuuaaaaauuuuugucaaucuguuggcuuuguaauuuuauugugguuuuaaaugugcaguucuuuaauuccugaugagauugaaccaccuuucaaauacuuuauuggccauuuggauuuccucuuuuaugcagugccuguucaagucuuuugcucaucuuuucauuggucagcuuuauuuuucuuacugguuugugagaauucuugguauuucuuggaugcuagugcaaguugguuguauguuauaaauaccuucuucuagucuuugucuugucuuuucauuuuauagugucuuguggugaauggauguucuuaguuuuaauguagucaaauuuaucauuuguuuccuuuauaguuaguagguuuauauguuuauaaagaaauccaucucuaccuugaaguuaggaaguuauucuuuuauaguuauugccuaaaagcuuuauacuguuguguuuuacacuuaugucuuuaacuggaauugauuuuugguaucauauacagaggaguucccauuuaauuuuucauauagauaauccacuuuucccagcaccauuuauuggaaaguucauccuuucccuauugcucuguaggaccaccuuugucauauaucagcaucccuauaugcuugggucauuuuguggccuugucuuuuccauucuguuggccuacugguauauccugcaccaauacuaugcucucugaauuauugugguuuuuuacugaaacuuguuaucugauuaaguccucccacuuuuuuucuagaguauggcuauucagugcuguuuucaaggcaaaauaauugcaaaucuaagcaagggaugguccauagccauaacugcuaauggauuuuuuuucuuuuuuccucuguuucaguguaaccauacaaguuuccuagcuugcucuaaaaguagagauuguuucugguucacccuuauccugaagguauauuaggaggguuggucacugcuauuagaauuauuauaauuaucacuaccauuacugaaacuaaaguccucuaaauuauaaaauuacauguaauuucuuaaaacaguuuccuacuuagccaaugauagcugacccauccuuuccuuggcuuauggacuugauucugacuguuuacauugcaaauucuagaucccuauucacuuaacaaaaaacuugcguuuauauuuugccucuuauuugagugaucuuucuucuuccuugacuuaauaaaaaucugguauuacuuccuucauaacucuggaauugcccaguuuagcuuaaucaacccagguggucaauguaauaacacaugucagagccagaauguucucauaucccauuuugugcuucccacaacagugguuacuuuaagcuaggccuuguacuaggcaaugccuuggcucuucccuugagugagcugucuaguaauaaaaucagugauauauauauacagcuaacugguaaaaccaucgguaaaagaaaucaagaauuguguagguagcccccgugauugccaaaugaccuguguuuuuguuuguuuaaucuccauuaaauucuucuuuggcucacagaacauaugguuagaaacacaagcucuggaauuagacagaccaggguuugaauacagguucuaucucucugggauagcuguaugauguugggaucucacuaauuuuuauugcuaaaauggagaugauaguaccuauucucauaguaucauggugaagauuacaugagauuacugcuuagagcuguuguaacacuuagguucucaguaaaucuuaacuauuauugaacauuguuuuacucacuuuuuaaauuuaaggaauuuaaaaauuaauuugucuguuugguuuuuguuguuagauguacuuuaugaaaaaucgugcccggaggcaagguauuaacuuaaaacuucuacccaauggauucaccaagaggaaggagaauucaaccuuuuuugauaagaaguaaguuucuaacuuuuuaguauaucagguauucugauuugaucaggaucauucuuuaagguuugguugcuauagagcauugcuaccccaagugugguucuguaaacuguuuguuauugguccaugacaagauaacuguaguaauuguaugucauguaacucuaauaaaaauuuggguuugcagugugugcgugugugugugugugugugugugucuucauaucauuugagaagcuucucaaacauuaaugugcauaccagucaccuaggcaucuuguuaaguaugcuuguugugauuuuucaguaggccuggguuggaguuugauauugggcauuucuaacaagcuccucaaugaugcucauuguuugagaaacauauuuugaguagcagcgcccuggaacacucucauacauuagaaauaaacuguuucuuugagaacuaagauaccaagaaaguauuucaggggcuuccaggacaaaacgaguaaaaacaggacgccuguacuguuuuaaucaaggcagcucugcuuuuauuuucuuucuccacuggguuuccaaauaagauuucaauuaaaagcugucaauguagaagaaggggacuuugaacucuugaguacagauaauauaacagagauuaguuugcugcugucugaaaauguuggguugaaaaggccccaagaguacagaagagaacaggaucccaaaguucuuuaaguagccaacuaaauuaucagauaauaccuuucagaagucaagauuuuggauuuagaauuuuuaaaaacuugagggagucccucccuuuucagccucuuaguaacuguggggccuugaacaaaucaacuuccuuucucugggccccaguuguaugauguggggaguugacccggguaaacuacggagccuuuccaguuguacucuuccaaaaauugaaaagacaaagccaucagaauuaucauuauucuagugaagcuucuaucuuuucaaagcuguuaucauaauuagaagaugacguuuuccauuuauuuuauauaagacauaaacauuuguaaaaaugguuuuucguuuuuccugguugucuucgaaaaguaaaguaaugcugaagcagguggaucccuugaggccaggaguuugagaccagccugggcaacauggugaaaccucgucucuacuaaaaauacaaaaauuagccaggugcaguggcacccaccugugaucccagcuacucaggaggcugaagugggagcaucccuugagcacaggaggcggagguugcagugagccaagauugcaccacugcacuccagucugggugacagaaugagacccugucucaaaaaaaaaguaaaguaaugucuugcauuuaucaaaugugagaugauucuuuugugcguuuugaaacuggcauauuuagaaauugacauaauuugaaguuuaugguaacugguuagaaguuuaugguaacugguuagugcuuucucaaauacaaaauguguuccuguuuuaugaaagaaacuauucagaaugauuguaaucagagauuaguucucaguaaugaaaagcagauggccucaaguauaacauuuuugugucuguagguacaugaauguaugcgggaaguuuuuaccgagaauauuacacucaguauauuuuccagguuuaauauauuuuugguuguuuugaaacuccccgggucucugaaauggcaaaucagauucuucuugcauaagucuuuugcucauaaauuuauagagauuugugaucaguuuucuuacauuuuuaguguuucccaggaggagauuagcaacauaguauguacuaauaggcuuuagaauccauuucuuagucuuuuaccgucugcaaaauggagcucaugauagcuaccuuguagaguuguggccuuuuaguguauuaauucacauaggcaguaacuggcaugugggaaggaaucaguuuauaguagcuauuguaaaaauaauacaucuguaucauuaaaaaguuuaaaggaaaaauaucaccuauaauuccacuaucuagaguugaccacuaauaaaauuucguaacauuuccuucuaaucauguuuucuccuuuuuucaucuaauaaaguaaaacauaauauaaaauacuuaaaacuauauaaagugacaugacucugcucaaguuaaacauuaauuuuuuaugaauaaaugcaccuccuuuuuuccugcagcuagauuuuccauuuagcaauacauugugaaccucuuuucuuguuaaugcaaaucugccucauucuuuuuaaauaggguauuccaccuuugacuauaucucauuucauuuaauuauuccgauauucaugaacauuuauuuuaugucuuguuuuuaauuauuauacauaacacgguauuaaacagccuugaacaaauuguuuugugugcuuaccugacuuuuuuuuguaggaucaauuccuagaaagcggaauuacuggauuagagaguacaauguauuuaaacuuuugagaaaaacucuacauugucuccauaaaacauuaccacuuuguacuuucaucaagaaaguaugagugccuauuuuaguuauaccuuaacuuuuguugaauauuaccaaauuuuuuugugggcagcuuuauuagagagguugagcucuuggauuuuuaauuucuuguuaagacauugccagauguccacugcaggaggcagaaucacccccauuugaaaagcacugauuuacauaaauacagaagauguacuuauugaauguauaguucuaaucuuuucuugguccagauaauuaacauaauguagacagaaucaggauucugguguuuuauacuucaccuuuaagaggaaaaaauagacauuuaagaguuacuuuguuugagauauuugugucuuaucagcuguucauaugaaaaugagcaagguuuuagaugauugcaaugguauuugcuggaaagagggaagaaggggaaaugaaauuuuuucaaagaauucuguucagcucccaugcccccaguauucuaagagacuaguuuucaauacuuuuuucuauuaacuuuucaaaaguugguuauagcuuugacucugauaaauguaaauuuucauguugucucuacuauuugauuauacauuaggugaccuugggcaaaaucugacuuaccagguuauugagaggauuaaaugaaauuuuaauaccaacuaaaguaguaccuggcacauacuaaauaauauacagugacaaugaaaauuuacauucccuucacugaaauccuuaggaauaugccacauuuacuguauauuccauucaccccucauaggucugggauagcacuguguaaucaaacaguacuauuugugcagugaaaccuauaaauguuuaccuuauaauggguaaauaaugacuauagauuuauucaguuagguuuugcugcugaaggaguuaaaaaucuuucaguuuuggagauuuuggaauuguugauaugagaaguuggucuuguccuaagauuauuaauacucccuagguauuaaauugauugcuuguuuaagcaacuugaguugcaauauagucaaaaucucaaguugaugucgcuuaaaauuuacauguuuucacuuuugaggaaucugaaugaagaaucuuuuguacuguuuuuguaacuuuucuauaaagucuacauuuauuuuuuuuaaaaaaaguuuuaaauguaaaagcccguauaugaagugugaugaaugugccauuguaccugaauuacucuguagaccuaucagaaggugauuguagcagcugacugggauagguucauucuaauccagacacccuuuauggcaggcauuuucacugacucuccuaaaauuauaugugaaauuaugugaugugugaauuuuucuaagaauaaguacugcaauuuucacugaauagucaaagugaggugaagucugugaagucaaaaauagaugcaaugaggaugaauuuuagaggacuauuuuagaggaauuugcaggaguaccacaguggauagcuguaaucaauaaaguucaguucagggaggcuuauguaaguugagcccaagcaagguugacauucucuguuaaaaauagagaagcuugauaaggaaauguuggcucuccuccuuauuuuggaguagaucccaagcuacuuuaaaauaguggcuuuuucagagguaauuccuuuaccucaccucuuuguagggucuauagcuuuauguucacuuucacccaguacuaaucaaaucuguugaaagaaauaugaaagaccuauaugaagaaaauguaaauucuccugaaugacuuaaaagauuugaauaaauggaaaaaagugccauauucuuaaaaagcucaauauuguuucuuaagugaucuuuuaagucugaugcaauccuagucagaauaucaaugggauuuuguuuguuguuauuuauuaauaagacaguucauaaauaacugaaguuuauuuugaagaauaacauggcagaggugccuggaaaaaucugaaaaaagaaugaugaggcuggauucauuaaaauuuaugaaauuauaguaguuuuaugguguuggccuagaaaucuguaacuagaucauagaaaauaaauaguauauuugguuugcugguauaugaucaagguaacauuucaaauuaguacaaauaauugcuuauucaauaaauagaguugaaacagcuugccauuugagaggaaaugcugaaucuuuuacuaaauaacauccagguggaucaaaaucuuaaaaugaaauaaaaauacuggaauauuuucauaauuugaagagaagaaacaucccauccagaagccaaaaggaaaauaauaacuaaauuugcauggcaaaaaagaccauaauaaagugaaaagacuggaccaaaaaagucuuuaacauauaugacacagagugcuuaugcauuauuaagaaaaaaagacuagcaacuaauuaggaaaggggcagaggauaagaauagaugguuggccgggcacgguggcucacgccuguaaucccagcacucugggaggcugaggcagguggaucacgaggucaggagauccagaccauccuggcuaacauagugaaaccccgucucuacuaaaaaaaaaaaaaaauacgaaaaauuagcugggcgugguggcgggcgccuguagucccagcuacucgggaggcugaggcaggagaauggcgugaaccugggaggcggagcuugcagugagccgagauugcgccacugcacuccagcacuccagccagggagacagagccagacucugucuccaaaaaaaaaaaaaaaaagaauagauggucauagaaagauauguguacauacaugguauuuagcugauaaacauuauaauaauaucuaauauaaugaaaguauggauuaaccaggccauuuuccucuuccauuguugauaguuaaauugguacagucauuuuuagaaggcaauuugguaauguuucucagaauguuauauauuuuauuguauaaaauguauauuacaucuuaaaauguuauaaguaaguacucaaggaauuuagccuacaaacguauuuguagaugaucuauagucaggagauauauguacacauauaucuauugcaguauuguuuuuaguaguguaaaaacuggcaccaaccuaaaguauccuucaguauggacugaguuaaguaaaugauggcaccuucauaccauggaauuccaugcagccauuaagcaaaaacaauuagacguagaaguauugucauggaauacuauccaugacauguucagugaaaaaaaagaauuggaguuuaaaacaauugucugaaagauuaggaagcucacuuuaaauugguguuucuaaagcaagaugccaucuccacagaaaauuuaaaaauuagcuaggugugauggugaaugccaugauugcaccguuacauuccagccugggcgacagagugagacccugucucuaaaaaaaaaaaaaaaaugcaguuaauaaauuagcgauuauuuggaucugaaucccuuugggaaucagcuuaaauaugaguucuauuugauauauacuuugugucuguuagauaagaaaaacuucacagaugaaccaugcuguuuuuuguuuguuuugagacagaaucuugcucugucacccaggcuggagugcaguggcacgaucucagcuuacugcaaucucugccucccggguucacaccauucuccugccucagucucccgaguagcuggaacuacaggcacaugccaccacaccuggcuaauuuuuuguauuuuuaguagagacaggguuucacccuguuagccaggauggucuggaucuccugaccuugugauccgcccgccucggccucccaaaguguugggauuaaaggcgugagccaccgcgcccggccugaaccauguuguuuuguccccucugguaguagaguuuggacugaagcuguuaauguugauuaaggacaugcuaagaaauagcucuuagaaucuugcugaacuuucuuuaagggcauuacauguuacucuaaccaguggucuccaaguauauaaccaugggagaaaugucucuuugaucucuguuucuuuuaaucaauuauuuguuuuuuucugaagcugaacaaaauauaguggcuucaaaugccagcucugauguuuacuaguuuuguggcuuuaacucuauaucucauuuuccucaucaguaaaauggacaaaaguauaaucuacccacauauauaccaguauuuuuguuccuuuuuaaacauuuuuucagaccuuuuuaggaucauuuuguucuccuuuuuaagauuucuuuagugacagucucauaaaaauaugcuuuuucaguuuuugucuuaaaauaucuuuauuucaucuuuuuuuuuggagacagggucuccaucugucacccaggcuggagugcaguggugcaaucucagucuucucucugcaaccuccaucuucuggguucaagcaauucucuugccucagccuccccaguagcugggacuguaggugccugccaccaugccagcuaauuuuuuuguguuuuaguagagaggaaguuuugccauguugcccaguguggucuugaucuccugagcucaggcaguccacccaccucagccucccaaagugcugggauuacagaugugcgccacugugcccaucuuauuuucauuuuuuaauggaaauacaguacauaccaaaaaagcacacaaaucauuaauguaccaagaucaaaaacauuaccagcaccccagaagucuuuacugcccccuaugggaauaccuaccaccuccucccaaguuuccuauuuccccuaacuuugaauuuuauagauuaguuuuaccuauuuaaaguuuuuucccauauuuuauuaugaaaaauuugaggccagccgugguggcucaugccuguaaacccagcacuuugagaggccaaggcgggcggaucacgaggucaggagauugagaccauccuggcuaacauggugaaaccccgucucuacuaaaaauacaaaaauuagcugagcguggaggcgugcgccuguaaucccagcuacgcgggaggcugaggcaggagaauggugugaaccugggaggcggagcuugcagugagccaagauugugcaacugcacuccaaccugggugacagagcgagacuccgucucaaaaaaaaaaagaaaaacgaaaaauuugaaacauaaaguugaaaauuuugcagugaaugcuuauauauccaucaccuaaauucugucaucaauauuuuacaauaauugcuuuaucagauauuuauccauccauuaacccauuuuauuuuuggugcauuucagauuaaaugcaggcaucccucuacugggcccugaauacuuaagcaucguuaacuagaguuccguaguuugcauuuuugucuguugauguaaaauuuacacguaaugaaaugcacaaaucuuaaguauguacauuugcugaguuuugacaaauacaugcaccuguauaauccagugccugugaauaaauagaacauuaccaucaccccagaaagacuuuucuugucauuuccucucuuccuuagagacagccuguccuuuuuucccccuguacauuucuuuugccuguuuuaaaauuucauauauagucagacagcucacucuuacuuuuguuuuuuguuuaucuguuuuuuacuuuuuaaaaaauagagucagcaucuugcuguguugcccaggcuagucuugaacuccuggccucaagcaguccucccaccucggcuucccaaaguacugggauuacaggcaucagcccccacgcccagccccuuuugaaugauaguuuagcuucauaugaaauaucuuaaguugacauuuauuuuagaacucaguuaauuuauauauuccguugacuucucacuucuuuugccacuauugagaacaguguuguuuuauacauagucuuccuucuuuucucuucugauugcuuugaaaauauucaauauugucuuuggaguucugcaguuucuaugauguguguugcagugcuauuucuuuuuauuuuuauuccuugagauuuguucugcugucuaaauaugacaauucuggaaaaguaguaaguuaucuuaauuucuuugucuuugcuacauuccaaguaacuuguucagcuauauuguccaagucacuuucccuccucaguugucuaauuaaucauauuuuuagucuaugcacuguuuguuuuuuaguuuauuuuucccuggaaccucuguuucuuucccaaaucuuucucaucuuuuagacagaauuguauuacuuacucacucacguuguaagcuuccuuuuuuucuucaguaauuuagaacacuucucaucuguguaaauaaucccaguaucugaaguuguguaagucugguacugcugucugcuuggacucuuuuguguggacuaaccacccauuuccucagaaauggacccaauuuuugaccuucuuauccccacauuugucuccaaaugauauuggcccucaguucuuaacaauccaguucuucugcuuaccauucuucuaccacuaacagcuuagaacugaaaguccuuaacuuuucaauuuauucuuuugaacuaggguucuuuagcucuguguuugugugucugucuuuuacuuacaguaugaagauaauagaggugcgccuauuacuaaacaacuuaauauuuaagagcuucaaucuguuuuagaagcaagccacuaggugucccucuuguaaagaaauaacaaagcuuuuaugaauucaaaaaauuacuuuuuguucuuuggauaaaauuacaucauccuuauuauauugcaguaauauaccuauuuaccccuguauuaaugucaguagcacuuuuuuccuuaaacaguuaugugguaauguacuucuaaaagcacaggacuuuuuuuuuuuuuuuaacaugguauccuauaaauauaaguaguauagguuuguacuuugcugcaaauuggcuuuagaaaagaguaaaggaaaaugaaaugauggguuuagcaguuguggucaugaggagacaaguggauuuugcugugagcuuugggggauuauauaauaggugcccaguacagacuugucaacugauugacagcucugugguuucucugccauaauagcuuugauaugguuugauggaagaauuucagaacaacagcaaggauuuagaaaaauaguguggaagaauagaauccuaaugguuccccaauugggccucuacuuacugcagccaugcagacagugguaagggaguucuugugacacagcaucacagaggguguaacuuuccacagcaauaauuagccagcauucauagaaauguaaagccaaacacucgaucaucuugagguucccgaacugauucaguuaaggaagccuuuucccagucaccaaguccauccuuugugauaugccucuaaaaugugucccuuucuuacugccuccuugaccgcagcauuuaucagcuguaguguccuaugcaggcccuucuuaccucacucuggacuguugaagaaccccaucugccucccggguucaagcgauucuccugccucagccuccugagaagcugggauuauaggugcgcgccaccaaacuuggcuaauuuuuguauuuuuacuagaggcaggguuucaccguguuggccaggcuggucuugaacuccugaccucagguaauccacccgcuuuggccuccuaaagugcugggauuacaggcaugaaccaccauacccggcguugagacagagucuuacucugucacccaggcuguaguuaguggcgugaucuuagcgcucugcaaucuccgccucuuggguucaaaugauucuugugcguccgccucucagggagcugagacuacaggcuugcaccaccacgcucugcuaauuuauauauuuuuaguagagcugggauuucaccguguuggccaggcuccuggccucaggugauccgccugccucggccucccaaagugcugggauuacaggcgugagccaguguacccagccuaucuguuagauacaccucucuaaaacuuguucucaccauaauggucagcuacuuagaauccuuuaagcuucugugcccacaaaagucauuagcucagagauaucucaauuggccagaggcagcauugccaguagaugaaauuugucaucucauuuuugagucuuguacugucuguacuccauuccguagccugagguuaacuccuucuuaucccccucucauuugaaguugcuacuucccagacaguuggaaauauaauucauuucaaguauuccucauuaaacaaaacagaguaagucaucuucguuguauuugcuuuuuaaaggaggaaucacaauauaguuaauauuucuugaauguuuauuuuuuauuaaacauaacaaauuuuauuuaaucuuugagaggaaguuuucuuggcaaguuacuuauuucccugugccuauugccuuaucuguaagauggagacaguaauaguaccaguuuuaugacuagugguuuucaguuuauagugcaugccagaauuaacugugaggcaauuucaaaaugcagaauagauacccgggcuugaccagcagaacuuguuuuuuugagauggagucucggucugucacccaggcuggagugcaguggcacgaucucggcucacugcacccuccaccuccuggguucaagugauucuucugccucagccuccugaguagcuaggauuacaggcaagccccaccacgccuggcuaauuuuuguauuuuuaguagagaugggguuucaccauguuggccaggcuggucucgacuuccugaccucaagugauccgcucgccucagccucccaaagugcugggauuacaggugugagcuaccccgcccagccaaggacaucuuuacuucuaaaaagcaccagaugauucugauguuuaccucuaccugaaaaccacugaucugugugccuauaagucaaugaccuuauucucaauuaguucagucagugggcagacaagacugcaaacucuuaaaacauaguauaguuaguguugugauggaguacucaugggguaugguagcacagaggaggacucccugccccagccuuucgagggaaguguuacucacugagagcagggaacaggaaagacuuccuagagaagauagaauuugagcauguuuuuaaggaugagaaauaguuuuuauuucuagguuuuuaucuagacagagggaaagaugguucugguggugagaauaucagaagcaaaagcauaguguagcaaaguuagcacaauguaaguaauuuggugugccuaaaaaccaguggggguuuggugagcgauaggagaugaggcuggagagaggcccacucugccaugccagggaguuuagguagagucauacuuugagcaggaaaucuuccuguucguacgagugauccauaucugaauguggaucuuuauagucucucuccaccuuauuuccuaauguauucaacuaaauguucccaggcuggucaccauucuaaauccuagaaugucuuuuuauuccauauauucuagccaucugugagaguacacaugauagcuuaucuucuccauuaugucucuuuuaccuagguuccuauaguacauauuuucuccgcaguuaauaugaaacagaugcuagcauuuagugcugguauucauuuuugguaugcauauaucuggucuccuuucuacuuucuaguguuucuuaguaggggcucuauuggcauuuuugaaugggacaguuuuuuuguuuuguggggcuuucccauacauuguaggaauuucccauuccuugcccccuaccuacuaaauccucaagugcucccuagucuuggaacaaccaaaacugcccagccauuuccaacuguccccauacucccagcccucccaguugagaacugcuuaaguacucaaguauucaucaauuuuuggaaguaaaaagguucuuuuucauuucauuuccgucuucaccugcuauauccauuuucuuaauauacuuucuacuaaagccaauaccacauaguuaaccuuuuuccuauuauuuucaugcaguagugguacuaauuuuuaaaaggacaaaaauauauaacuauuacuucccaaaguauuuacauaaugaugugagacauaaaauuaugguuuucauucucccaaauucuagucauuuaaucuauaccaaauaauuaaacagauucuuuguauucauacuuccaaaaaacacuuaucaugguacuaauccuaauaaaauagauuauuuuuauaaggaaugauuccauuuauuuuugagagacuucagauuuucaccuuggaauacauuuuaaaagauuaaaugccugugaaugaaggauuauguagguauuuuauagauuuuguauuuuucuugaagaguucaaaauuuguuauauuuucuuucagcuuuaaauuaagauuuuauagcugacaguagaacaaauuuuuuuccugaaauuucaucagguauuauucgcugcuuccagaugucauacaaguugacaauuuuagugucucuucuuuuucuauugcuuauaaaugaaagagaaacauagcagaaauguuuguaucaaucccuuguaucaguuagguugcuuuauaguugcaugaaauagaauacucaguuuaaacagauuugagcuauauacagaggacauuuugacucucauaacugaauguucagagguagauggacuucaauuacagcaacuugguuauaucaucaaggacccauuuuuuuuucugauucuuuauuguguccuuuaugguguccauguaauccucauagucauaggauauugcugguaacaguuuggguuauaguaaauauccagacagagugcuucucucccaacauuacuaaacagaaaaccugaacuucaccaugauuaggcugccuacguaaucugcccagucuggagccauuguguccaggaaaguauguugauuuucuuaagucauaauguacaccccuagaggguaggcauagaguucauucauuaagguaugguuauggauuacgaaggaugguggugagagguagggaacgauugcgaaguaaauagucaaaaugucuacuauaccuuuuaaaaaugauuuuaaaauauggaggcagauauuuaaaauaaaaaguaacugagauacacuugaauucgcaguacagaaaaauacauaguuuauuuuugaacuuucaauucuagaaagcucguaauaauauagcagaucagaguauggacucuagaguuaagaggaagcacugccugggcucaaaucccagcagcucugcuacuuuccagcugaauaaugaccuuggaggagugacuuucuuuucucuaccuuaguguuuucaucuguaaaaugaaauaauaauauuuuaccucauagaauuauaaggauuaaaggaguuaauacauacauuuagaaccaugccugacauuaaaagcuuuuaaaacaaacuauuguuauuuacuauugcuacuugcugugcucucugguaaaacaguuuacugguaguuuuuuauaaccuguagacauuucuuuuuuuuuuuuuuuugagacggagucucacuuugucaccaggcuggagugcaauggcacgaucucggcucacugcaaccucugucuccgggguucaagcaguucuucugccucagccucccgaguagcugggacuacaggcgcacgccaccauacccagcuaauuuuuguauuuuugauagagacaggguuucaccauguuggccaggauggaaccuguagacauuucuaauguaauuagugauacaguauucugaaaacagacauguggaaugucuagcuuuagcuuaccucauggagucaccuguguuuaaaaaucagaaguaaaaauuuuaagcauauuugaauugacaugauaugucaaugugauucucaaaaguaguuggaaauacuucucuuaauaacuauaaacaagggcuaaaaaguuaauguccugaauauacuauggaaacacuuauuaggagaguuaaguaguaggaugaugaaucucccuguaagcccuucaauucacuguuuuuuaaaaccuuuguuaauggugcauuaauuacaagauagaauccauacugcuuagcagagcauucagggcccuuuauaaucugguauuaaugugucuaguuucaucucuagccacuaaacacuaaguuuaaugugaauagaguuugcuuaugaaaucacggcaaaauacucuguuuaaagacacugucgguauuugauaguaacauuuuugaguacuggguucuaaauuguuuuuuuuuuuuguuuuuuuuuuguuuuuugagauagucuucucacucuugucacccaggcuagagugccguggcacaaucucaguucacuacagccuccaccuccuggauucaagugauucuucugccgcagccugcugaguagcuaggacuacaguugagcgccaccaauccuggcaauuuuuuuuuguuuuuuguauuuuuaguagaggugggguuucacuauguuguccaggcuugucucgaacuccugaccucaagugauccacccaucucggccucccaaagugcugggauuacaggaaugagccaccaugcccggccucuaaacucuugauauauuauuuauucauuuaauugugauagaaauaccguuguuaucccuguuuuacuaugagaagccugagguacagagagauugucucuugcugaagaacauguuaagaaauaaauuauuaaaaugggauucaaacgcaaaguccacuuaaccucucccccauccuaccucuggaccuuauaguauauugagccuucuugcuauguacagugucaauaaagaacaggaagcuuucauaugaaaauugugaaauggagggaaaaaugcagugcccaacauuggugauugacuugcugcccuaaaaagaaguccguguuggacucaucuccuuguuggucucuuuguccuuaaugucuagugagcucucguuaguguucuuuggguauauguugguuaaucaguguuggagugggaugagaauuggugauuaaaaaaaaaagaacagaaauauucaagcuucuuuaaacuuuguauuagaaaucuucauucuuugaguuuagccuccguuuguaacucuuaguuguggcacauuucuuaggaagauagccuugagaccaucaaaaugaugagauagguaacccucguucugguucaguacuaguuucuaagauaaaaaagagaaauauauauuuuuuuucucaaagggggcaaaagagaauucuuaaaugaauacuucuaauagugaaauauguuuaaguuuaaaaagaauguuaagggugggugcgguggcucacaccuguaauuccagcacuuugggaggccgaggcgggcguaucauaaggucaggagauugagaccauccuggcuaacauagugaaaccccgucucuacuaaaaauacaaagaauuaaucaggugugguggcgggcaccuguagucccaacuacuagagaggcugagacaggagaauggugugaacccaggagguggagcuugcagugagcugagaucgcaccacugcacuccagccugggcgacagagcgagacuccaucucaagaaaaaaaagaaaaaaaaaaaaagaauguuaaaauuauuccuguucuuucuaucacugccauccuguaugcgcccaugaaugcaucuuugacuuuacugauuaugaaaaguaacaaaucagccagguacgguggcucacaccuguaaucucagcacuuugggaggcuaagguaggagggucacuugagcucaggaguuggagaccagccugggcaacauagcaagagcuugucucuacuaaaauucaaaaauacagccagcugugguagcuacuugcaggggcugaggcgagaggaucacuugagcccagaaagucagggcugcagcaaacccuuuuuggccacugcacuccagcccaggcgacagagugagaccuugucucaaaaaaggaaaaaaaagcccacaaaucauuauguggaagauuuauuuaauaauacagacauauucguagguaaaaauuaagucaaguccuuuuauaaugucaagaaauaaucauagcuaaaaguuugggguauggccuucauacuugccaauauauguauaaaccuguguuuuaaauauaaaggcuaucauucaacaugcacauuuuucuacaucaguacauaaaguucugccucaucuuuuaugacuacuuaaaauucauuauguagauguaccaugauuuauuuaaucaacuuucugaugauguacauuuagguuguuucuaauuuuuuucuauuauauaaaguggugcaguggacauuuuauauauauaucauuacuugaccaauuauuuccuugggauacauuuccaggaauaaaacuauugaggcaaaaauauacaguuuuucaauuacaaauuuuuauuuauagcuuuuaugaaauugaacuaccaguagcuugcaccaauuuauauuccugucagcaaugaaguugccacacuuuugccacacuuccuuaguauuucuaauuuaaaaaacauuucuacaaaccugaaaaggaaaaauauuuuauuuauauauacauuucuuugguuauuaaugaauuugaacaucuuauugugacauuagagcagugccauuuaaaaggaccuaaugacuuuugauuugcaucuuuuuccuugggauugugguaguauuccccauacgaaaauuugcaauuugaaguuaugaagucaaaagaauaauuuagauuaugguuauagaaccucuuuccuuaaauguguguguucauccacauacuuucuugaaacugugggagagaaugaucccuuuucuuucuauuuuuguaaacaaaugggccacggagagacugauccuuaacaguuucuaguaagcaaguguugguaaauaagugcucuguauuaacucacugaaaaugaguauaaaauauuuauuuuccucauuuaauacaagugccaucuaaguauuuuucaacuuuuuuuuuauuauugccucccaaggagcuuucugccgugauauuuugauaccauagauacacuguauaucuguugcauacaguagcccuuuguagggccacaagcauuaaaauagcaagauuuuguuggcccuucagagaaccaguuuuugcccucuuuggggccaugcugcccucauugagaaugcauguguguauugauauuuagaggaggagagggaaacagcuuugcuaugcaugaauaguuacuuggguuucauaggacucagaagagguuaguguuucuguugcuuugucagauuguccagaagggaacauaaggauuaaguugccacaauuacuccaccagucuuaucacccaacucuaaacaugguaucuuggagucccuaaguuaccuagaauauacuagguauaguaauaccauuuuugagaacguugauaugccaaggguauagugacauuauuguaguugaaggcauuuuguugaauuuagggaacaguagcucuaaugcauuaggaguaauuguaaauguucaaaccuuuauccuugugguucucaaacagugaugauucugcuuccaggggacauuugcaauuucugggagcauuuuugguggccacaacuggguguaugaguguuccuaguggaacacucaucuagaggguggaguccuaggaugcugcuaaacguccugcagugcaaaggaccaaguccuuugcaaagaauuaucuaguccaaaauaucagcacugcugagauugagaaacccugcucugucuuagugauuguacuucuuggaaucuagcuuuagaaaguaauccaaguaauguugcuaggauuuugauguauguauauuuuuuuaagugggacauauauuuguauauauaauuauaaaaaaaugagaaacaagcuuaauucuuucagucuuaagaagaacacaugucaggacuuacaguaauuucagcaauacugaagaauuggaaaccauuuuagagaaaauuaacucacccauuucagcaauuuuuuuuuuuuuuuucugugacggaaucuugcucugucgcccaggcuggaaugcaguggcucaaucucagcucacugcaagcuccgccucccggguucaagcaaugugauucuccugccucggccucccgaguagcugggacuacaggcacaugccaccacaccugacuaauuuuuuguguuuuuaguagagacgggguuucaccaugugagccaggauggucucgaucuccugaccucaugaucugcccaccuuggccucccaaagugcugggauuagaggcgugagccaccuugccuggccuagcaauuuuuucuuuuuuuugaaacagggucucauugugucacccaggugaagugcagugacgcagucgcaguucacugcagccuuaaucuccugggcucaggugauucucccacuucaaccuccagaguagcugggacuauaggcauacgccaccaugccuggcucauuuuuguauuuuuuguagagaugggguaucaucauguugccuaggcugaucucaaacuccugggcucaaacgaugcgcccaccuuggccucccaaauugcugggauuauacaggcuuuagccacugcgcccauccccagcaguucuuuauacaacacccuucaacuucuguuugcccaccuuggguuaaaguacauauaaagaaucaucuacuguuaucaauagcccuuuauuucuuagaagaaauaaaaguaccucaaaaauacggcaauuuguaaaugaguuaaaucugaauaugggugcauugaguguucuuuacauuauucuguuuuucuuuguuuuugaaauauuggaagaucacauuuuaaaaguuaguguacuuuucagauuuguucaugugugagcugaggccaaauauagaaauauuuuuaucaauaauuuggcaauguauagcaaugaaugacuuuguuauaaguagagcuaguuaacuacaacaaauaaaaugauuuccgagggcuuuucucucuguguuuggaauguuaagugcuuucugaauguauucaggguguauuaaauguuaaaaggcgaaugguuuuugaaauuacucaagcaagaauuggggugauugaguaugguuuacaauuccauaagauggcaaguugguaauccuuuuuuucccuaaguuaaccugaaaaaacauacauuuaggaagaaacuauauuaugcauuaagaugaacaaaaugaggccgggugcgguggcucaugccuguaaucccagcacuuugggaggccgagccagguggaucacgaggucaggagaucgagaccauccuggcgaacguagugaaacccugugucuacuaaaaauaccaaaaaaaaaaaaaaaaaauuagccgggcgugguggcgagcaccuguagucccagcuauucaggagagaggcaggagaauggugugaauccgggaggcggagcuugcagugaaccgagaucaugccacugcacucuagccugggcaacagagcgaaacuccgucucaaaaaaaaaaaaaaagaugaacaaaaucuguuuauuucuuauuaaaaaaaaaaagucagccuugugauaaugcuauuaugguauuccuauuucacagauaaugaauauugcaaaauguuuuauuuuggaagaauuauuuauuuaaaacuaguaacuguugcuuuugcauucaaauuuuuaaauguuuuuuccucugagauuuuagacaucuguccuuuagauuaguaaaggguacuuuucaacuuuguucucaauaaaauuauguucuuugucuucugacagaaauucuacuaaaucauauagauguuuggugaaagauagauuguauuaaaagaaaauuauuuuagauuuugggguccuacugcuaugggauagauuuuaaggagauaucgguagucauuaacuugcucuaauggauuguuagaaauuucuucuaaguaaggaaaacauuguguaaaaucaucauguagugaagacauuuaaauuucuguauuggauucaauauuuugagcauuagaauuuuuaaagaaggaaucaugucaaugucucuaaauuuagauauauuaaauauagucauuuuucuaaaaucagacauuuagugaguuauugcuguugaugcuaugucaaaccaaaguuuagaccugaaagcaaaaagacuguagcucaaagugcauucugcuuagcaaccagcuuguugucuccuguuuugcuacugaaugcacguacucaugccucagaaguguaucuccagccagcuggacucaaccggacaauacuucauucaccuaauuuccagacuagucaagcaaagacaucagcucauuguauuuagucaugaggaaauuuauuuguaaacuucaaauaguagcacacugcucccaaaagccccugaacuaugagaaauugcuuucugauucagaaaugugaaguccuuggaauuuagaacugcuucccuuuuuuuucuuucuuaauaacccuugcaagagaaauuagcucuuaauagaaaauauauguuaaagucuaagaauaauuuuggaauuaucuuaaagugaaaauuuagaaaguucaauuugcauccagacuuuuauuaucuaccuugauucucacaugauuauuuucucucuuagaaaacaacaguuuuguuggcaugugaagcuccaguuuccucaaagucaagcugaguacauagaaaaaagguaucacugcuaucuuucaaucacugauuuguuuuaauuugaaggcuguguauuuaaaauaaacuguuaacuuaaugucaguaguagaauggauaacuaaauugugguguauuuauacaaugaaaugcuaaacaucacuaaaaaugaacuacagcuaugcacaucaacauggaugaaucucagaaauaauauaagaaaagcaaguuaaggaagaauguagagaacaugauuguaaauaugggggaaaaaagccagaaaacuaaauaguguacuuuugggaauaccuacaaaggugauagaacuaacucuaagggaaauuauuaacauagaaauccugaugaugguuucuuuagcagcaaagcaaguauugaggagagggauccgaggagaauuagacggcugaaaguuuccuauuucuucagcugggugguuguuaaggaagugaaaaaugacccaaaauucuaccaugcaaagauuacuacuauuaacauuauaguguaucacucagaaaauacauuauuuuagaaguauauauguguacucauuggaauuaauuugcauaaaguuuuuguguuacuguuucauauuaaaacuuguucuuuucuuuuucuuuauuuuuggaggggagugggggcaggaucuugcucuguugcccacgcuggagugcaguggugcggaccuccgcucacugcagcuucaaccuccugggcucaggugauccuccuaccucagccuccaaguaggugggacuaaaggcucaggccaucacgcccagcuaaucuuguuuaguuuuguagaggcaaggccucacuauguugcccaggcaggucucaaacuccuggccucaagcaauccuccccucucugccucccaaaaugucggaauuacaagugugagccaccgcauccagccuauaaacauuuucaagugucauuuaaacauuuuaauguuggccagaugcagcggcucacaccuauaaucccagcacuuugggaggucgaggcggauggauugccuuuggccaggaguuagagaccagcuuggccaacauggugaaaccccgucucuacuaaaaauacaaaaauuagcugggggaaguggcgcaccccuguaaucacagcuacuugggaagcugaggcaugagaauagcuuaaaugcaggaggcggagguugcagugagccaagaucaugccacugcacuccagccugggcgacagagcaagacucugucucaacaacaacaacaaaaaaauuaaaaaaaaaaaaaaaaaacauuuuaauguuugugaacuauuucauuccuugauuuaggaaaauuuuaaaguugcucuuuaaguaguauauuuagcauauuccuauauuauacauaaauauccucucuuuguaguugucaaagggauuuuagugaagaacuuuguuauuuggaguugcauacaaggaaaagacuuauuuuacaucuagggguauguagccaauaguauauaugaauauguauaaaugguugaggaaaguuacuguuuuaaaacagugucuuaauuuuguuuauacagcuuuauagauaaguuuaaaacagcgugcauauauggaagaaaguuggaaaacuuaaaauguuuuguuuccaaggaaauuacuaucaauuuuuuaacuuggucuuauaaauuagaaugaguaaauuugaacaugcacugaaaucugaaaccuuuuuucagauuuauuauuucugcuaguuucaaauauauuuuauccugaccucgucuuuucauguuugaguacagguguguguuaagaggcuucauauuuuuauaauugauuuauacagaacuucucaaaauguuguuuuuuaagaccuuaaguguguccaagaacucuuuuugagcuuuuuccuaaguaauuuuugcuuaaaaugauauuuuauuuugccaagaguaauauaaaaggucuuuguucaguuauuuaaaccaaaaaagccacaauauuuaauaauucaaaauuaacaccuuuaguagaaaauuauaaauacuaauauagcuuguuuuuuuuucuuuguuguaaagaguaccagaugauaaaacuauuaaugaaauccuaaaaccuuacauugauccugaaaagucugauccuguaauucgucaaagguaugcuucaaaaauauuguaacuuucugaaauaauuaaaaauguugauguacuuauuagggucauccaugacuauuagaaugugauguguaguacaauuuacuuucuaucacauuuucuugguguuuacugaaggucugucuguagaaauagcugacauucauuguuuccuauguuccagacacucuucaaagcagacaguaauaaauguguuaauucauuuaauccucacaauaacucugaaaaguagauuauuauuauacccauuuuacagauggagaaacugagccuugaagugguuaaguaauauccuauagcuaguaaacagggaagcuaggauucacacccaggcagucuggagucaaagucuuuacucuuaacccuuaaacuaaacuaccuuugagguugaacgaaaaacucugaaaaugaaaaguuuccaaguaacuuaaagacaggaaauccuguuucagccaagucuucuuagaacuaaguaaaguacacucugccuccuguccagaaauacagcauggacaaaagugguuaacauaacauaguggaaagauucagucauggauaucuggguuaaaauagcuguuucugucccuuauuagcugugugauuaagagcaaguuacuuaauuuccaggccuuauuuuuucucaucagugaaauaagaaugauaacacuuccuagauaggguuguuacaaagcuuaaaagaaauagcauauaugaaauuccuaguacaggaccuagcauauaguagacacuacucgaaaacggagauuguuauuagagugugaguuauuagugcuccugggcagaaacccgguugacuuuauuuucaccagaugguacuugcuugggaugugaaugagugcuugguuugguuccagaauaaccugguauuuaaaauuuagacuggguggauucuaaaaugucuaauccaguucuaauugaaucucauucuuuugcuuuugauaaaaggucaugcccagacugaaccagacccaugucacauaucaagcagucuuuaaaauagcuaugauaguugaguuucuuuccuuauaacugguaaccuaguuauuaucauuagucauauauuugccaguaagacaaaaugucacugaauaggauacauuuuuguaaaauuauauagccagauuaauuuauugaaacagguguuuuaaaauuuaagauguuuaauugaacaaaggaaaaaaauuauuuucuuuucagauuucugguuagaaaacaucuuuaucuccuuuucuaugcuuaaauacaugaacuuuuaaguauuauuagguacaaaugcuuagucuccauaagacuaucuugaaauauauuaaaaaucagcuuuuccuucaauaugauguuuuuauuucagguugaaagccuacauucgcucucagacugggguucagauuuuaaugaagauugaauauaugcagcaaaauuuaguaagguaaaauugcuccccuccccauuucuuuaaauauuuuuuaguucuguaauauaauuaaguagcuugauuagcucaaguuauuaaacuaauuaucuagcuaugaacaugacuuuuacuuuucaacuuucaagucaaauucaaaauaaucagacuuauaggauaaauuggguugaaaaaucacccugguuagaauauuuuauuuuccgucaacugauauaggggaaauagaauauuuuaaaauauaagcauucuuuuauuuguucuauugugguuuacuucacugagcuuuacagguauugcauucuuuacaaauugaagguuugugguaacugcauugagcaagucuaucugcaccaguuuuccaacagcacauguucaguucaagucuaugugucacaguuugguauuucuugcaauauuucaaacuuuuucguuagcacuauaucuguuauggugaccugugauacaguaguaacacuuuaauguuacuucuguaauugcuuugggugcaccacaauauaagguggcagccuuaaauguguguguucugacugcucuaccaaccacucauucacccaucucucucacucuccucaggccucccuauuccuugagacacaauaauauugaaauuaggccaauuaauaaccacacaauggccugugaguguucaagugaaaggaagagucacaucucucacuuuaaaucaaaaguggaaugauuaagcuuagugaggaaggcauguugaaagccgagauaggcugaaagcuaggccucuccugcuaguuagucaagucgugauugcaaaggaaaaauucuugaaggaaauuaaaagugcuacuccagugaacacaagaaugauaaaaaaguaaaacagucuuuuuuuuuuuuuuuuuuuugagacggaguuucacucuuguuguccaagcuggagugcaauggcgugaucucgguucaccgcaaccuccgccucccagguucaagcgauucuucugccucagucucuugaguagcugggauuacaggcaugugccaccacgcccggcuaauuuuguauuuuuaguagagacgggguuucuccauguuggucaggcuggucucaaacucccgaccucaggugaucugccugccucagccucccaaagugcugggauuacaggcgugagccaccgcgcccggccaguaaaacagucuuauugcugauagggagaaaguuuuaguggucuggauagaagaucaaaccagcccgaacauucccuuaagccaaagccuaauccagagcuaggcccuaacucucaacucuaugaaggcugagagaggugagggagcugcagaagaaaaguuugaagcuagcagagguugguucaugggguuuaaggaaagaagccaucucuauaaccuguggguuauguguggggugaagcagcaaauggugauguagaagccacagcagguuauccagaagaucuagcuaagauaacugaugaagguggcuacacuaaacagauuuuucaauguagacaaaauagccuuguauugaaagaagauggcauguaggacuuagcuagagaggggaaguaaaugccugccauaaaagcuucaagggauggacugacccucuuguuaggggcuaaugcagcuggggacuuaaaguugaagccagugaucauuuaccauuccagagauccuagggcccuuaagaauuaugcuaaaucuauucugccugugcucuguaaauggaacaacaaagccuggaugacagcacaucuguuuauggcaugguuuacugaauauuuuaagucuacugcucagaaaaaaaaguuuguuuucaaaacauugcugcuuauugacaacuucgauccucuuugggacucuaaagaaggaaaguuauaacauuagagugaggaccuuaaaggaaaaugaagcacaggggaguugaaugccuagagcuaggucaugugaguuucauuuaagcauacuucuuugacguauuuuuuguuuagauuuaucccauuuggcucuuuguuaaaauaagucuuaauguuuugacuuguagcuuucugaguuguggucucuggguauccugauuccuuucuaugcaauggcaugagagcaguuuccuuaacugcucccuuuggggacauaacaucuuacgggcauuacugcagcucuucucaaaaacccugguaugcuaggacaaagagauuuccauccacuucggcucuucauggacuuacaguacacauuuccaacuuaaaaaauaacuguucucugggcccaagcaguguguccuauacuauaaauuuuaaaauacucaguauccccuguuuaucuuuuauuaccaagaauucugauuuccuugaauuuuggaagaagaggcuauuuugucagagucaaguuugacuggcuuaggugaguggacacauuagcccucagagauauucucuuaguaggcuugugagacuaaagccauggucucauggcuuaaaacaugaguaacauuuaaaugaacuaauuagauaaaauauggcacauggcaagaaaggaacugaauuuagaagaugaaacagauaauaaaagaauuauguaaugauugacuagagguaaauuccaaggaaacaauguaaauuauuuuguuuaaacaugaauuacguggaauugauuuuaggauuuuacuaaacaaaacugaccuuuuuaaucgccaaagugaagggaauaguagauuaauaaaguaaaaaguaagugguguugacuauaaggaauaccuagaauagacugauuugauacuaaaccugagccuagcugggugccuguggcucaugccuguaaucccagcacuuugggaggaugaggcaggcagauugcuugagcucaggaguuugagacaagccugagaaacauagcaggaccucgucuccgaaaaaaaaaagaaaaagauaaaccugagccagucugaggaacaugaaaguacuuucacucuaccuuaucuguggagaaagcuuaucuuccaaauucccccauuuuugcuauugacucgaacuaaguaauauaugaaaauacuaucaaagcaaaggaagggggaaaagguuaugucccagguccaauuuaaaaauugccauucuguuuagccuugaguagugauggcaucauuugacagcaauaauaaugucagaaauuccuguugagguagcuuucuucuugaaguuggaccuaaauuggcauagggcaucuuuauauuucugauuauuaggucagccacaaagcauaguuaugcuaauuucuaaagaaccucaauuuuauaaguauuuuguagucauaaguaaugaaguuagauaguauagagauauauuuaggcguagauuuuuauuuuuuaucagauuuuuaaaacauaauguucucuguaacauacucaugaauggacuaagaugagcauuuacauuugauugguacauccuuaaaggaaaguacauuacaguuacauccuuaaaggaaaguacauucagagaacaucuaaggaaaauuauuauagguuauaaauguuaagcucuaauuuaagauaagcauucuaaauagaaccauuuuauuaauuuccugaaaagugcuuagaaaucagaaacauguaguuucuuuguggcuguuuaauucuacauuuacagcauuacaguaacuucagaguaaagucuuuuuaccaaauacuugauguugccaguuuccauugguuuuacuuuccauucuuggaagguauauagcaauugucucaugauauagauauaccuggucagcuagagcaugcuuaaguuuuuuccagguuuuagcuuugccauacaugacuuauuuuuuaaauugcgauccuagaauguaugucuaaucuaaggaauucgcuacugaucuguuugggaguuuucuuuccagaauacauagggucugaauuuaucucuuagaaaagcuauuauagcuuuuuaaauaaauucacuuauucauucagcaaacagugaguaugccaaagucuagaugcuguucuagacauugaggcuauggcaguaaagaagaguguuccugccccuguggagaagaucauucauguaagaugcuuguguuaguaaagccauucuugcccuuugccgccuuauuucuuaccaacuuucuauucucagaaaguaaaugagugguuuuggacuagaaaagccuauguugcuaaaugucaggcacuaucagagggcagcuguuguauuacugcccacuuaaguuacuacugacugaagaauuuauaaaacaaccaacuuugucuauucaaguacaguuuuccaaaucuauuaaauuuuaagccuggauuuuacuuuuauggaauuauuuaccagaaagaaauuuagauacauuuuguuuuuuauguuuacuuugcugcuuugauacuuguaaaucuucgugguuuuuuuuuuuuuugugauuuaagcaguuauaggaugauccuuuccaaauuuauucaaaaaaaaccauuaaguacauuuaaucuucuaggcauauaaauaaaaauuggaguuuauacaagaaugaauaaaauacaguucuguuguaguaaggaaaacagacacacuguauauaucauaagaaaccuaugucuaagucuuaaaagugauguggaagguagcagguauccucaugucaucagaaggcuuuguuguggaagugauguuugauuuuuauuaaaggugaauggccuaugacuaggagaggguacagagggccuuaagaagugcaagggcaugguaugucauaaacaaggcaaguaagugauuugaggagguuggaguguauagauguaugcagagcaguauuuuuuaaacuuuuuuuuaaaaguuaagguugaagaguuaguucaagacccaauacuaacgcugucuggaucuggucuccuuggcaguagaaaacuguaaaaaucuagcaaaaaaaaagcaguaagacuuggugaucaaguuggcuauagggagcaauaaauaggaaucaaaggugacuacaguuucuggcaugauugcuguuuacagagagauaaaaguaaggucuggagaggcuaagagcauguugaguuucauguagggguggcaucauuuucaggaacacuacuuuugaaaagaaugaccuuacucuacuaauuauuaggauaucuucagagugaaacuguauacuaguaaaaaauaguaauauuauccuuccagaauacauaaucuguguaguauaccuuacuuuacuuuaugaggcucuagacuagacuuuuuagaccaaaaguuucaccauuacaaauaguacauuuauuauaauaaauaaaaguuuauuguaacugcuuccuaagccuaaaccaaaucaugagaacuuccagaauaaccuuuuugcucuuaugcaaaaauguacaucagagauuugcuguaaagucaaaauuguguuuuuaauuugauacauaccuuggaaaguuacuaagccuguuuucccaucuaaaagugggaaucagaacagaaaugauacugcaucguuguaaagauuaauuugaguuaauauuugucagcuacugaauacagugccuggcacccagaaaaucacuccuguguauuauucaaguauuuugaguuucaacuagaacaucaugcugaaaugauucaaugaacguaagagguguuuaaguuccacaugucugguaguaguuaacuguaucguguauuacuuuuuuuguuuauuuguuuaacagcuucuuuugaccaaauucauuuugaaaaaaaaaaauuuuuuuuuuaagagacagggucuuacuguguugcccaggcuggaaugcaguagcacaagcauagccucacugcagccuugaacgccugaggucaagaaaucuuccugcuucagccuccugcauagcugaggcccuaggcaugcaucagccauauaauuucuuauacuucugggauauacuucaaauguaauauuagcuauacauucccaacaggccacucaccacuaaacacaagggagcagauaaccaguuguguuuguuaacauuucuuuugacauaauuggauauuggaagaauaugagagauuucaggaacuuaagauauugucaacuuauuucuguagaaauuacucccaaaucuagauauaguuuuaaccuuucucccaaccuccaaaucuugguuuccagcuaucuucauuuacacaucucauuaaaucuuaagcucaacaugucuagauuucauuacacugcaucuauuucuuccugauguguguguuucgaauuuaauggacugacuguuccuggcaucgaguaagcagucaacaaauguugguacgcauuuucuauuacuggcacuguuguucuaguaagccaggcguaagaccuugcagcucagcaucuucaacuacuucuugacuucuaccuugccaccuuaccuuguguaauugacauccacaaugagucuuccauuuguccuuucuucuccauuccuuuuauguagacuauuaguuaccagugucugcaacagaguucauuuccuucccccaaacuggauauaauuucuguaucuuuagaaccuuaaaaguguuuugcauuucucauagguuucuauaaauuugacuuauuuuaucccaauaaaacuuaaaucacaugaugauuaacucucuuuugaagacagugguugccguaggcaucuucauuuuuauauuuccugcagaguuguguuagugacuuuuccacaguaaguguucagucuuaauuuuuuaaucagugugcuaauucauuaaaauauauauauguguguauauauauguauauaugccugcuguaugcuagguauugaugccacguuaauacccuuaagcagggcuugggcaacuuuuccuuuaaauggccagauaguaaauauuuuccagcuuugugggccauuuagucauaauuagucaauucuaccauuguagcacguaagcaacuauagaccacuuaaacgaauggacaugacuagaauaugguccaguaaaacuuuauuuacaaaaacagauagugggcuggauuuggccuccuggcuguaguuugccgauuccugcucuaaaggguuuuuuuuauugguuuacaugauaucuguauaucauguaaacaguugggggcuucaauucucaaugaagagagagagagaagauuguaacaagggccuaguauaauuuaaaaguuacuucagaaaguguaguaccugcucagggucaggcuuuuugauacaugaaccugaccuaaaguaucaguuaagauugaucaggucuguauuuuucauuuauucaguuaauuuucauugagccccuuccaugugcuagcccagugcuaauaccuagggauauauagacaucuacaagacuagcccucaaagagcuaggugggaagaaugauaugugauaaauaccgcaaaagauagauacuuaaaauacaaggcauaaaaggugcccaguggagggcaugggcaucuuugcauggacacuccagacuuaaucauuucuugauggaaagauaaaccauugccuucacuuugcuuccagaauuuuucuuguaaagccaagaauuuagauuuaaacccaagcccagguuaaaguauuaccuaagcuuugauuucauggauaucacaaaaauuuuuacuguucaugcgcauauuauccuguuguacuugcacagagccuauuaguuguuuccuccugugcugguuuuaguuaauaauuuuggaaugcuuuuuguuugaaaagcaaccagcaaaaguaugagcuauuucucuuggaugauuuuauuuccaugcugagaggauguuuuuaaauuuuaaaaacuaaggcuauuuuaccuuccuuggaacuuuauggaucuuuaaucuaaaauauuuuaaaaucguuuucagugaagugaagagguaaaaugcuuuuuccuaucuccuuuuugagaaauugauuuuaccuguguaaaggccucaggugagccccaccugaccucuuuuggcuugcacccacucacuagcaagaaaagacccccuuucacuacuggccaguuauucuuccuuccuguaaaccucuccccaguggaacauguaaccuguauuucuuuucagaacaaugcuucucagauuucaguauccauaauaauagucuagggcaguuguugaaaauguugauuuccaaaccacucucuuaggguucugguuuaguaaaucuuacauaggacccagaaaccuacauuuuuuuuuuuuacaaucucugucucccaagggugaccaugauauaaguuuuuccugggaccacacuuugagaaacacuggccagguugguaaacucuuugaggacauuuuugguucccacacaaugucuaacaugugacaaguuuuugguagauauauucaguugaguuguugaaguuguauaaagaaacaugucaauugauauuagaauggauuuuuuuaaaaucacauuuuaccuccuuaaagauuagucugugcucuuugccuaauugaacuagaaauggaaaauuagaugacuuuguuuuagacuuacagugaauaauugaaaaauauacuuugaagauacucuaaauaggaaauuuauaagauguguguuaaaaguuagaacuuaaaaauuauuuugagaauagugcagaauuaaguauauacuggagaacacugaagaaauuccagaauuucuaagaacaguauuaacuauuuucagaugucuuuucuuauguaaacagccagagacauuucugccuaagauccccugaaaauaacuguugaagaauuagugaagaauaagagcuugcucucuagaugggauuacguaaacuuccucuuguuuuccuuuugaaauuugauucuguuaauggauaccaaguugauaaaugggggaaaaucauuuaaucuaagaaucaauagugaacaaccaugccuuuaauagaagaugccaucaucagugcucguccaucauguugagauguuuuucaaaaauaacuuaauuuguuuguaauauauuugugauguuuugaucaauuugauguuaauaauaguuaaaauuauucaguucagaagaaauuuuauuauuuaaaacguaaaggucauagguaaugaaauuaaauuuuacuuuacauuacauuuuuguugcagagaaggucagguauaaacauacuacuugguauaaaauucugcaagagaaucggaauggaaaaacagaacaaguaagauuucuaacuuagaaagcagagcauauauauauauauauauauauauuuuuuuuuuuuuuugaaagagagagugagugaaugagucucacucuguugcccaggcuagagugcagucgcgcaauuucagcucauugcaaccucuggcuuuuggauucaagcaauucucgugccucagccucccaaguagcugggaucacaggcacacacuaccacaccuggcuaauuuuuguauuuuuguagagagacaggguuuugccauaguggccaggcuggucucaaacugcuggccucaagugaucugccugccucagccucccaaagugcugggauuacaggugugagccaccacacauggccauuauucuuuuuuuuuuuuuuuaauggaugauauugauguuaaauuaccaugauauuuacagucuagugaauuuccuuaagggugauauauuucaucuuaaaacaucaauauucacaauacaccauaaauuauguucuuugcaucuacuuaaacuuguaggaugucaauuuaagaauguacaaaaguaucauuguuuuucacaauuauuuuagguuauguuuaagcaaaacaaugugaaggcccugaauaaguuuucccaaacacacacaagaauuguuuccugcaagaguuauuuaaaaucaagguuaaaucugggggcuaauauguaucuuuauggaauauaguaaguaugaaugacauacuuuuauugagugccuuacuauuauuuagguacucugguaagcacuucguacauauuguaauuguauuauuauuaaauggauagcccgucuacagcuguaugaccacuaaacgguagaaccuagauccaaaccuaggucugccugcacucaaagccuuaguauguucuuugcaauauaguauaugccucucagcaccauaaauaaucauaaugcauguucucagauuaugugaaacccaaccacaguucuuuguuauaccuuuuugggauuguuguuuauuuuucaaaguaaucauggucaagaugaguauguguucagaauggcauuaacuuuugaccacguuuuggauauagauucuaaaagaaagcgagaauaaaacaaagaacaaaggaagcaucauuuaaggauuauagcaauucuguauucuauuacagaacaaaggaaucaucauuuaaggauuagaaaauguuagaguuaaccugaagaauguccacacacagaaagggaauaugucaagugguuugcuaaacuuuuuuuaucaucucaaagaugauacucuuccagugauggaaugggcuucauaugugguauucuuguuaaagcaguuuuaugauaagaauuguuaacuuagcuuuaagaaagcugaagcucagcuaguuggcacaguucggugaguguuuaccggacagauauaagcucaacuauugaggucucgguagcuuucaaccugagaagguuaguuugagagccuguauuugaagugauccaaagugaugugauggucaaauucuuggcagauuguaagccuacaauuucuauagugauaaucuuacuucaaauauauucuauucugauucuugguuaaggaaauuaugugaaauauaaaaugugaguuuucucuaaaaacaagugauauuuuagcguaauguuaaucuacuaaacuuaccuauccuuguuauguuauagaauauuuugugaccaauuuaaauguuaggcaccaaaacugugaauucuauguguauuccaauacccauucucugcucaguacuuuaaacauauccgcucucuacccaguuccauagaccuagcucucuccuccuaucuuuaccuuacacauauacuuucuuccuggaaagucuguccuuucaccucuaguaaauuccuuauaguacaccauuguauucccagugccaagaacagugucuggaacaugguagacucucaguaaauauuuguugaaugaggaaugaaugaacaagcacacaguugagugaaagaaaucacaaaauuggcuuuauagucccaacucuccauuuucuugagagacccugaguaagauacuuaacuucucagggcuucaguauacuuaacuggaagacaaaaaagacuggguuguaaguuccugccaacucuaaaauaauaccauucuauaauguaguuaauucauggacuguugaaccucuaagcaaaaguuucucugaggaaccuaaucauauuuugcaagguaauauacauccuaauaaagacugaagauguaagagucuguacugaugagacacuugcauucaguuuuagcuucaaaggaaauguauguuuuguuagcaagauuaagacuaaagauuaagauuuaaaaucccuacauuaauuagaggggaaaaaagugcauggaggagaaagaauuuuaagaaacaaauaauuaacaauacuguauuguauacuugaaauuugcuaagaggguacauuuuaaguguucuuaucacaagaaaaaagaaaaaaaugcuauguaaggugauggauauguuaauuagcuugauuaugauauuauuucacaacauauacauacaucagaauaucaacuugaggccggcacaguggcucacaccuguuguaaucccaacacuuugggaggcugaggcaggaggaucauuugagcccaggaguuugagaccagccugggcaacauagggagacccugucucuacaaaaaaaaauaaaaaucaaauuguauaccuuaaauaauauauauaauuccuauuugucaauuauaccucaauaaaauugagcaaaaaaagaauaugaaccaauuaaggagagguguuagcuaggguuaggaacugaauuaccuagauagugaagacccugugcagccugcaagaacaaaggacauuuggauguugguacugaacaagagagguuugggaggcugaggcaggcagaucaccugaggucaggaguuugagaccagccuggccaacauagugaaaccugucucuacuaaacauacaaacauuagccgaguguggcagcauacaccuauagucccagcuacucgggaggcugaggcaggagaaucgcuugaacccgagaagcagagauugcagugagcugagaucgugccucuggacucuagccugggugacagagcgagacugugucucaaaacaaaacaaaacaacaacagaacgagagagaauauuuacugaggaucuacuuagcuuuacuuuuuuuuuuuaacuuuuagguucagggguacguguacagauuuguaauauggguaaaaucaugucacaaggguuuguuguacagauuauuucgucacgcagguacuaaaccuaguacccaguaguuauucuuucugcuccuuucccuccucccacccuccaccuucaccuaguuccuaguucuuuguguccaugaguucucaucauuuagcucccacuuauaagugagaacauguggcauuugguuuucuguccugcauuaguuugcuaaggauaaugcaugaagauucaggagaauggcaagccccaauccaaggaaacuaagaaucacaauaaaacaguacaggagcugacagacaaaauagccaauguaaaaaugaaccuaacagaucugacaaagcugaaaaauacacuucaagaauuucacagugcaaucacuguauuaacagcagacuagaccaagcugaggaaagaaucucagaaauugaagauggguucucugaaauaaagcagacaaaaauaaagaaaaaugaaugaaaggaaugaacaaaaccucugagaaauaugggauuauguaaagaggccaaaucuacgaaucauuggcaucccugaaggggauggggagaaagcaaacaacuuggaaaacacauuuuaagauaucguccaugaaaacuuccccauccuugcuagauagguuaacagucaaauucaggaaauacagagaccccugcaauauucuccacaagaagaucaucccuaagauacauaaucgucagauuuuccaaggucgaaaugaaagaaagaaugaaaugaaaagcagcuagagagaaggggcaggucaccuacagaguggcuacagagacggaucaccuacaccgggcuaacagcagaaacucuuuacaagccagagaguuugggggccuauauucaacauuguuaaagaaaaaaaucuucaaccaggaauuucauuuccagcuaaacuaaguuucuuaagcaaaggagaaauaagauucuuuucagauaagcgaauguugagggaguuuuuuaccaccagaccugccuuacaagagaucuugaaaagaguacuaacuauagaaaggaaaaaccauuacuagccagugucacuuuacauuucuaucaugauacuugugccaaugaaugcaauagcuguuugucugccuccccccauaaagugcaagguuuauuucuaugaacuuccauuaccuagcagacuaccugugcauaguagacacuaaguaaauauuugagcaaucaauugaagaauaaaugccaggcuaaugcuuauaacauuuucacaugcauuaauucuaauaaaguauguacuaugucuucucuacuuuaccugauuaggaaucguaggcucugaaaaauugacuuacccaaagaaacuaaguuuguacaguuuauaaggcuaagauuuggacucagaccuguuugucaagaguucaguucaugcuuuuucuacuaacuagucucugucucugucauaaaucauaaauauaauuccugauaaguaugucauuuccuugcuaggagugccaaauuacuuuuggaguauaaaaucuuauuacugaugcuagcuuagcaaguuacacuuuggaaacauuuucaccuguuauaguccuuacaaacuaacccaugaguagguaucuuuccuaccauuauauugaugggcaaaacugagucuccuuguggaguuauagcucauaaggaccagugauaagacuggaacucaagccuuguggauuuaaaaguaauugaauuuaccagcgaaaaucagaaaagauuucaaagaaauaauaucuagaacaagucagagccuuguaagccccucuuuaaaacagguuuuaaaauauauaguuggccauuuuauuuaaccacauccauaguuuaaauaucaugguuagaauaggauaauuuaccaaaugcaguucugaacuggugagcuuucugaauuaagacauaugucuguacuacacaauucaugaucuacucuccaugucaagcagguaucguccucauuuauguggauauauaaaaaucccaaaacaaagugcaucaaaccacuaacuuaacuacugugauuuuuaaaauaugaaaacuaagagagauugggugagaaaaagauuaacuauggcaaaauccuuuucuauaugacuugaacauuaggaguugcaaaaauuguuacacagaaguauuauuuggagaaauuuuaaauaauaccuuuuaaaguuuaaauaaaagaagaauuaaaacuuuuuuggaauaauuuaguugaacuuuuaaucuagaaaccuagauugagaaauaaauacaacugugaaaaaauauaguuaaguaucaaaaauuguagaaauuuagagcugaagggaucuuagugaucaccuaauucaaugaucuuauuuuaguggaaaaauacuguggccuagggccugcuacuagauugcuaaauuuggagaaauucaaacuuaguuuugguauuuuuuagcagguggaaggggcgaugauccauggagugucagugaucagaugggacauaaagugguuugugauuucguuucuuuaaaaacuugucuuuugugguuaugaggagguuuuuuuuuuuuuuuuaaagcacacuaauuugcuaauaaaguacagagaaagaaguucaagagcuuggccuguuucuuugaaaguuagugacagagucaagauuaaaagcacacccuugauuaucaugacaacuuuuauuuauauaugucacuguaacaccuguuuggcccacugagccguucugcccucauaaugcgcccaugaggcugcccagagcagggucagccagugaaccugugagggugagcaagugaaauaacaagaggaaaugucuaagaagggucccagagggcaagagaaaagacaaauguuaguaucuuaauuccuccaaaccuaaguaguuugucuuaugguagcagagacauuauauuaauggaaauaccagaguuugugaaaauuucaaaaagauaaagcugucccuuaggauucaguagcuuaauggcuugcaaaggagcuaaaccuaaguguuuuaggcagugcaaagcugggcucuuaaaacuugcuucaagauaguggaaacagaaacauucaaaguaccuuuaucuucuuggaaguaaaugugacaauaaaauaaugauuugaaggucauacagaaaguuguaaggcuacauuuaaaaugcaaaaugcacauaaaggcaguauguucacugcuaaugaaauccagugacuuuguccugaacuagaguuucuauaggaaaguguuguuauuuuugguaaauaaaaauauaaaacaaacacaugugcuuagggcuuaaauaaaugagugagcaguuucuguguuuuaucauuuagcccucacaguaacucucugaagugauacugucauuauccccauuuucaagcauggaaacugaggauuaaauaacuuaaguaacuuguccaggaucacagaccagugaaugauggagccggaacuuuaacucagcguuaaacuccaaacccaaacaaccaguaaaaguuauugcuucauuuaacuaaauuccaaguccauaaaauauuaaccccauaugugucugauaggcuuucuuuaugaacaguuuacaaaauuuacuuuuaaauuacugauaaauauuaaugguagauuaagaguaaccacuuguaguagaaaaaucuaagaaauucagaauuucagcuaaaagauuauuuagugaaaucugaacgcuucauuuaacagguuggaaagcuguggcccagaagcuuacugacacucaauagcguauugcugauuagaaguuugcaacauuuuaggcuaaacacuaaauaaaauccacugauucuaaucaaaaccacacaacauaccagauuuucauugcauaaaauauuuuuaaaauaauuuaucaguugacaagccucuuauaaaucuuugcauccuuagugcuuuuuaagugccugcuuagcauguaaaacaggaaccaaguuuuuuuaaguauaaucauuacaguuucaggauccaaguaaguguaaucauuacaguuucaggauccaaauaaguguaaucauuacaguuucaggauccaaauaaguguaaucauuacaguuuuaggauccaaagcauguuuaacuuguugcauaguaauuuuuauguaccucugaacauuccucugcuaggaacauauuuuauaucagcaauaauuuuaggcucugauucucauguggccuuugaagaacucuuuuuguugcuucuugguuucagcuuuggaaaucuagagaaacccaauuaagauuuaauauuacaaaaagaaaucagauaccuaaaacauuaaauaugcacugaaaauuauuuaccaaaaacugaaacaaguaaaaaacauucccuuauuugaaaaaugccuuucauuagaagccuuaugauuuagcuaaaaugcacagaagauaaguuauugccaagugcuuguaggaugccacuugaaaaguuccuguuugagaguccaggucuuauuuccucccaagaaaaauuuaguuaucaccauuuuauauuuuacuuuguaaguuaaucuuuuacuuggguaucugauauaaucucauuuuucuuuuuuauauaauugcuacuaacuuugaaaaaaacacugcuuauuucaaagagaaauaauguuuaaaagaugugaagcauuuaauccuugaaugcuggaaacacuuuuaaaguauuguaaguacaucuguauuacauuacacacagggaaaagaauguaugaauucuaugaucugugggcacuaagguggcugguuuagaaaaacaguauuuugcauuucaaguuucuuuucaacauaaagaauauucugcaauuuuaaaaagaauaauuccaggcugggguguguggucagggaagcauaaguaaaguuuugguuuuacaguuguucucuaacuuuaguaagcuuggcucugcauuuuguuaagcacuuuuauauuuuuccugauuugaaaacgauugcgugagacaaacucagaacauggagaaaucacuacaucacauuucuuaaugaguguccugcaugucuuacucagcuaugauuauggugcagauaauuuuuuacuaauuaagaaauaccaaaguuugugaaugauuuacucuuaaaauuacagcaaauuuaaauguaucccaaugauaaccucacucuugaucacuuguguuccagugugcuuuuuugagcaggagauaaaaggauggaguuacagccauuaggcuggaucucaugagauauguguuuugcaugugaauaucaccugucauugguagagaugaauaaaaaugcuggagaacuucugcacuagacugguugacauguucucagcuuuuucuucuuugacaugaaaugacauuaacaugccaacauauucucauauguacccgcuagugagcuagcuagaauuccaccccuuucacucccaccccagaaagcaagcaagaaugaauguucuggggaugcauuuucagccaccucagacuuauuuuuuuaaaguaaugauuugagaauuucaugcuuuaaugaccauuagcaucuaauuaccugugacacauuuggcagcuaugucacgauaaacucuguauuucuuaaauuuuacauggcaauauaaauuucuggaaaccaguuauaauuagaauaauugacuuuuuuccaaaagccaauuuuguaaccaguuauuuuauugccauguuacuagaaauugucauaaggugauugguugucuuuaaggcucaaaauaaauauauuugaggaauucaaauaguuagcucaucauucuuuuauucaagaaaaauaacaacauaaauauuauuauuauuuuauuuuuuuauuuuuuugaggcagaguuucacucuucuugcccaggcuggagugcaguggcacgaucuuggcuuacugcagccuccgccuccuggauucaagcgauucucccaccucagccucccgaguagcugugauuacaggcaugugccaccaugccgagcuaauuuuguauuuuuaguagagauggggauucuccauguuggucacgcuggucucaaacucccaaccucaggugauccacccaccuugaccucccaaagugcugggauuacaggugugagccaccgugcccggccaacauaaauauuauauaagagucuuuaacuauuucuugguaugaaaauugauaacuuguaggcuggucaugguggcucacgccuguaaucccagcacuuugggaggccaaggcaggcagauuacgaggucaggagaucgagaccauccuagcuaacacugugaaaccccgucucuacuaaaaauacaaaaaaaauuagccaggcaugguggcacgcaccuauagucccagcuacuugggaggcugaggcaggagaaucgcuugagccugggagauggagguugcagugagccgagauugugccacugcacuccagccugggcaacaaagcgagacuccauaucaaaaaaagaaaaagaaaauuaguaacuuguuuuagagcuuuccuaaugucagaauauuugauuuuuuuuuauuuaguuuuagaaccucuauaauaauagcucuuguaccugccuuucuuagaagguauuaaacuuacuaugcuauaaggaaguaacuacugaauugucaucaccuuuaaaaaauuuuuaauguaaaauacucucauauauuuaucuauuaguaauuuugaauauuaagaguguuuccugguuuuuuguuuuuuuuuauuaauaagauauuaugaacuagauccuuauaaaagucuccuagacaauuugaggaacaaagugaucauugaguauccaacauuacaugugguauugaaaggauccaauaaugacaugaaaguucuucaccaagguaaguguaaauuuguuucuguaaugcuuagaauagcuuuagagaaaccaaagcaaaauauguccacccuuauuucuuuauauguguuuucccacuauauuuacacacuuacaggaucuacuguauagcuaguuaaugugaagaaccagguaaaugcaaugcugcuacucuucuguuucuaagagcguauaaucuuauaaaaccaauuuuaagugaauaaaucaaauugaauggcuauaaaaggacuuuuuuuuagcaugggguucuauguauuuuuuugucuuuuuuuaagcuaauagucuuuaaguaacuguccaugaucacguacauuuacuccauaguuaagacuuuagacauuucuaaaaugagggauuacaaaacauuuuuaguugacaaugaaaauguugaaugguuaaaaaaaaaaaaaaaaagccuaguauccuaccuuauagaaggagaaaauguugcaaggaacauuauauuuaaaaauuuggcagcauuuagaauaaguuaaugccauugccuuuacccuuuaucuccuuuucuaaacccacugguuuuauuuucucugauuuuguuucucugauuuugugauauagggaaguacuagaacuggaaaaaauguacauaaaaguuuaguacauaaaaugacucaucuauauuuguaacuacugauuaaaguaaacuaacugugcuucugaaugcaagauuuuagaggaugaguaaaauuuagucacuaccuuuaagaagugaggaagauuacccaccuuaauccaaaacuauuacauagcacuuucaacgaaaagaauuacagauacaggccagguuuuguuguaacaaacuccagaggagcauagaaucuuugucuuggauugauacuauuuuuuaaguaguauuugaaauggguaguuuaaguuuuauuguuauaccagcauuacaggcuguaagaugcaguaaccuauauuguaagguauucucuguugugcguaguguuuuuucuuugcaaaaauuaauagaaaaaaauuguuuuccaaaguggccaaaauuguaucagugcuacaacuugaaaccagauuuuaguuagcaaacaugauguuucuaauaauaaauuaugggccucuaaaucuuauuuuuauucuugacauuaauauuuuucacaauuugagaauuuuuuucucagaauaaauuaggaauuuuaguuuuaaauggccaguuucacuuuguuuaagcuuuguauuauguugcuuuuuucuuaauaaauucacagugcucucucaaauguugguuuugggaaaaguuguuuaguaauguagguuaguagcuagggcaaacaucuucuguauaaauaaacagcacacacagcucuccuuucaccuuguuuaggaauguacauucaaguaaggcuuccuguaaugaagcaauaagaaaagacuacuuuacuagcguacugggagccuuauugaguaaaauuugcuauuuuucugguggauauaugauguuugacuuauuuacaggaacacaaaugacucaugcuuuuaguacagaggauuauuuagaacuguguuagcaaagaacuaaaaguaucugacaggauuuuaaaaccauaccaguuuugucacaucguaaguacacacaccuuaaaaguaaugcccaggucuuccuguacaugcauuucuuucuguaaguacuucaaggugucuguuucuuuauacauucucacagcaucagauauuuugcagggugauaccuugaugagggaaggggauuauguaagaagagggcauuuucuuuggaaagccuugaaauuccuucccucucuggagguaaaaaaguuggauuuugauccugaguuuauaguacaaguugucucuuuccuaauuuggggguacauguguuucuggucugggauucaguaguucccacaccugaugguuguucuaauauuuguuaugauuguagauugccauaauuauuugagucugccuauauuaaucagcaguagccaagauuuuguuuguuuguugcuuuucaguaauggaaaagguuaacuggaaaagauagagcuauuuagauacuccacuagauuggagaugcuaagugcugauuaccuaccuuauaucaguccagugggaagugcucagaaugguguaacuugcuucacaggcuguuauuagacuagcagauuuagaugagggagaaaagcaugcugcauuucaaucuaaggaaaaaagaauggaacccuauucaaagaagaaaacugggcaccuucaauaggcaaagaaaggggaaaaugucccauacugcuaaaaaucuuuauuaauuuagaaaugucagcaaaauaaacuuuuugauguucuaguguaacucaagauuagaaaaugccucagccuuuagagaaggaauccaacccaaaauugauuacuggaauuagugaaaauaccuggcauagcagcuacucauauaucagucucuuauugggccaguaaaucuuucauccauucucccucgcucaccuuuccucauucuuccuuacuucucuuuucuuucuuuuccuuuugcagggagagagaggaggauuuuuggcacuggaacacgcauguaaaacuuauuauacaauagaugcuaaaauagaguuuaccugaaguacagagacagccagagaaggaaaaaaacuuuuaauaucauggaggcacuggauggacugcuaaaguucauaaaauuucacaaagauugggaugauaucuuggauggaacuuauuucagugccuuacucuuagaaagggcucaguaaacaccauugugguugcugguacaaucugaagucuagguacaacagcaaaccccagggaacuugucaguuggaauaugaggcaguuccaggugugugcuucuagcaucagcuuuuauaagcuguggucccuugagcauuugcucugccucucugagcuuuauuuuucuuaucuacucaguggagauaacagcuauaagccucaaaauaaccuauauuuuagcaugacaauuuuuaaagaguuacuaccuauuauuuccuuuuagcuucacaagaccaugaaauagaacacuuacuccgguucccauuuugcagauuuagggaaaaaacacuaaaaggcagaaugauuugcaguuacauugauucagcaaacauacucuaaauugugaggauagauacagagaagaaaggucgaguuucuguccuccaggaacucucaguuuagugagugagucauaguuagucuugcuugcucuaagcaagacaggggugucagaggagcuccauuucuauucuucuuuccugugaaaggaaggagauggcgauuagcuagucuucugucacuccacauucacucaacauauacugacccucaauuaaguuuaaaaaaaaaucauggaaaaaauuuauucuaaccacaaguggcuggccaggauaauagugaucuauucaguggcaugaauauggaucauaaccacauugugaagugaccauuccuaagucuuccacagagucaggaaggauguuaccucacaaaauauaauugccacuuucagacaucauuucucuauuuauuguggccagaauuguauauccuagcugccugggacaugacgcgguuugugugucccugugagcagugcuuuugcuguacaucagaaggagggagagaagagggacagagcaaccuaaacagaaaaauauaaacacuugacuguauguuuacuuauuuuuuucuagugaagagugaaucuaccaagaacguuggcaaugaaaauugagcauuuuuucuggaagaagaaagugaaaacuuccagacaacugcagcagacucugcauugaugggcuguuggcugauugggguauugucaaugggugauuggaauuuuuucuuuguaugaaaaauaagcuuaacucuuuuaaaaaauguauuuuauaaccucuugaauuaauugacuuguaagacccauuuauucauauuaagaacucuccuuugcacuugaucagcauaguacuuauuaggcccuggcuuuuuaauaugcuuaauugcuuaauuccauaaacugaaaacuuuuuuuuucuuuuuucuuucuuuuuuugagauggggucuuggagugcaagugguaugagcauagcuuccucaaauuccugggcucgaaugguccucucacugcagccucccaacaggcugguaccaccacacucagcuaaguuuuuuguuguuguuuuuuuuugguagagacaggguugcgcucuuucgcccaggcuggucucaaauuuguggccucaagcaauccuuccaccucagacuccaaagcauugggauuacaggcaucagccaccacaccuggccuugaacauuuuuuauuuguuaauuucaugcgugacgaaacccaaggaucacccaugucaaccacaaaguuggcauucccuuuaguagaaccucacuaaacggaaaggcuguacaacgcaccgucuagccacaggagaacuaaucuucuaucaguugcccuuucuucuuuggaguuuuuauguaacuuacccuugugagacaaguuuucuacuugagaaacuccuaguacaaugucuuauacuagaagccuggauaaauacuauuaacuacuguuucuuauauucacuucagaaaaucaguggcuccacauuguuugagccauuagugauaacaaauuuggaucuacuuacucaagucuuaugaauucugugccuuucaucacauuccuagcccacucucaucauuacugcagaaggguguugugaugaccaguuuuauacuguguuuugauaugucuagcaauaacuuaaagaaaaaaaaaccugggaaaucuucaacauguuauuggaacauauauguauguauuaauguauauacauggcuuaacuuauacguuauggcagcucuguauacaguuugaucucauguacugaaaaaaaauucuuaauuuuauuggaguuuauaccacugugaaacugcaauaugacuguaagagaguaaaaagauuguuacaucuauauuguauguguguacuuaaugguuaaaaagcaaugauaaaacuggacauuaaugaaauugauuuuuaguuacaguuggaauaaguuuuuuaccaaaaagaaaccagagacguuaguuaaggagacuuaaaaagaucugaaauaugaaaagagaaugagaagaugagcagaagauaaauuugugggacacaaguauaacuugggguagaaacuggagaagagaaucgaaaaacaauaaugccagaaggacccuugguaugaaaguacuaauggaaugugauucauagaaaguucauagaaagugaguccuugcaacuugagaaacauacauacauauauauuuauaaucucuaaagcaacaucaggaaucuucuaauauaugauaaagaauuuguguagaauuacguuguucacaguauuauuggagagacaaauaagauuucaaggaauucauuuauaaucaaaagugaaaugugucuucuugaaaccagcaagaaauagaugaauugagugaaacguguuguuauuaggagaagugggauaacguauacaaaaagaacuugcgaucugaauaugaucugaauaugaggguggauaggaauuuuuugacagugaaaucuguuaugauguagucucauuuccaagaaaagucuugaguuccauccccccuucugaauuuaaauugaaaccuggacagaaaacaaacuauccuguaguuuccacugcucaggaggaaaaaaagaaaucuauauuaucuaaugcaucuuugccaucuuuauuuucuagaauucuauuagacuuuucaauuauaggcuauuaggaaagaauauaacucuuagaauuccccuaaauauaauuaucaacucauuugauuaauaugcauauuuuuucccguaagauuuacaauacacguguguuuuagugaauuaccaauggcuuggagagaaugaaauuggaauaacuaacugaaaacccuagauguuuguagcauugagacc

SEQ ID NO: 13862 - RNA, 2955 nt, Homo sapiens
cagauauuagguaaauauuucuuuauuaaaugguuaauuccauaaauaaaaucuuuucacugaauauaaaauuaaaaucauuuacaaauuauuccaguauuacauuuccccucccuccccaaaagcuacauuuugauaaauaaaacauucagucuuaaaacaccugauuucuguuugcaguuuagagugcagauagcugccucucacagacacucauggagugucccccuucaggaagggauggaaugcccucccauuuacuuuugucaaaggacgaauaaaagcuuuaaacuguccaacuaaucuuauuaucucuuuuacgacuguagaaccccaaaaggaaaaaagccuagagaaaauaugcuuagcaaauaauuuacaaacagaaaacagaaagucaucaacuccacaagcuccaaaaugaagcaguaacaugugcuccaauacuaugaagcaaaguauucuccaaucguggcugcauuaguguccauccgcaccagcacccuuggcaguuucgaaauaccuuaaugcuccucaagaaugagcaaggcuuccuuucuacaaugagucccaucacccacaccacccccgcccauuuucuccaugauucugauucugacacucuucucccuuguuugucuaggugugcccuggaaacccagguagcauuuagucccuaaauuugugaaugucauugaacagccuguagaagggaaacgcugcuucauuggcaugcgggcaguuguaguugcauuugcaggacuggaucaucaugacguucuuggaaaaugucuccccaucuucgcagcggaaccgcaucuucacaguccuggucagcuggggcgugcagcaucggccguccacgcaggaaccgcaguacuugggccgguauuucuucacacucaaacauccagcguaaguaaaccugacugguucgggggauuucuuggucuugcugcauuucuugcccuucuguaagagaaaggagagaaggaaaguuaggggugauauuucucuuucuucaaaaagauguucacaucccacccaccugccaggcaacagucuacacgucccugaaggaacuuacuuucaggcugcuguacacuggcuguccacaaggccgcaccucacaaauccggguuucuuucacaaggcggcacucaggguugucauugguaacucguguggagauaccaguuccacaggucuuugagcacugggaccaugaaguuguuugaacaauacauuucuggccuuguaaaggguuguauaggaugcgaggcuccauuccaaaaacuagagacauauaagagggaagacuucucagaggcauaccgacacaaacaggcucaagcacucauuucuacaaagauuuagaccagaaaugcaucucaguacagugucugaagugcucagucuccacuuaccagggagccgcuucagugagcugccuuuuccaacugcaaucaauucauuguuucucgucaacuccaccucggaggcaucgaaucccagcuccuugccaaggaggccguccugguccuccaugggguccuugauacuauccucgucacagacccacuccucgcagcacugcccgguaacuuugaccagccgaggguugggacagcccaaguuggggagagauaguucuuggggacacagaggaaugcagcccacggcgccaucaauacaugugcacugauguuuacaguugggcuggaaacuuuccccguuuugguagauucuggaguuauauucacagggucugcccucugacugagcugcaaagaucaccaaaagagaaagguagaaggggauaaaguuaagauuccaaaccaccgccugaaacucauacauauuuucugcuguuaaauucaauuuaugguaaaguucccuacaauuccccggagacuccagaccagaacaauaaguuagucaggaaucacuuuuccguaugcgcuuucguugggcccagacacacugaauugcauuccagacugcugaaaucaugugccuuucugccaagcuaccaacaacaaagcaucaccauacauggucucagaauuacuaaacuucuggacuauggggacuaguauuuuuuuuaaaggggccaaaccacaagcaucuuaccucugcagauccccuucagagcgguggagcuggcgccgaaguugcauuccagccccuugguguggucgcagggcugcguuuugcugcaguccucguugagcugcuuggcgcagaccuuacagcagccgcagccgucccggaccagcccgacucccggcgcgcacuugggcgccuccagggggcaguggcaggcagcggggcagguggagagcgccuggaagggggagaagauacgcgugagacucggcgcggugcgcaggaggggcgccgcggcugccgcagugagggacgggggucuccgacccuaucgacggggagccucugaucucguccagcccggccaccucggaaggcugcucccaccaagaggucccgacacgucuucggggggagggggagagugcuuaaagaaacggcuacccgcaaacgaucgcgaacuuuuuaacuuuuccugccgugggcaaucugggaccaggggaaggggcuggagagcggacggggaauagguggcaaaaggagaguccaacucaccagccuggucaaguggagaagggugacgacuaaggcgagcgcccuggcgaugcgggagcucauuguggcgcgcaggaguagcccggggcgagcgcggcgacgaagacgccaacaagcuggugugcagcggacaggccgugcgcagcggggucgggguggcggcgcggugggcccggugggcagggaggcgagggcugggcggcgggcgggcgucuuucgcucgaggucccggcggagaaggcgcggagggcgcgggcgcugcucgggggcgcucucgcucgcggucugccc

SEQ ID NO: 13863 - RNA, 2955 nt, Homo sapiens
gggcagaccgcgagcgagagcgcccccgagcagcgcccgcgcccuccgcgccuucuccgccgggaccucgagcgaaagacgcccgcccgccgcccagcccucgccucccugcccaccgggcccaccgcgccgccaccccgaccccgcugcgcacggccuguccgcugcacaccagcuuguuggcgucuucgucgccgcgcucgccccgggcuacuccugcgcgccacaaugagcucccgcaucgccagggcgcucgccuuagucgucacccuucuccacuugaccaggcuggugaguuggacucuccuuuugccaccuauuccccguccgcucuccagccccuuccccuggucccagauugcccacggcaggaaaaguuaaaaaguucgcgaucguuugcggguagccguuucuuuaagcacucucccccuccccccgaagacgugucgggaccucuuggugggagcagccuuccgagguggccgggcuggacgagaucagaggcuccccgucgauagggucggagacccccgucccucacugcggcagccgcggcgccccuccugcgcaccgcgccgagucucacgcguaucuucucccccuuccaggcgcucuccaccugccccgcugccugccacugcccccuggaggcgcccaagugcgcgccgggagucgggcugguccgggacggcugcggcugcuguaaggucugcgccaagcagcucaacgaggacugcagcaaaacgcagcccugcgaccacaccaaggggcuggaaugcaacuucggcgccagcuccaccgcucugaaggggaucugcagagguaagaugcuugugguuuggccccuuuaaaaaaaauacuaguccccauaguccagaaguuuaguaauucugagaccauguauggugaugcuuuguuguugguagcuuggcagaaaggcacaugauuucagcagucuggaaugcaauucagugugucugggcccaacgaaagcgcauacggaaaagugauuccugacuaacuuauuguucuggucuggagucuccggggaauuguagggaacuuuaccauaaauugaauuuaacagcagaaaauauguaugaguuucaggcggugguuuggaaucuuaacuuuauccccuucuaccuuucucuuuuggugaucuuugcagcucagucagagggcagacccugugaauauaacuccagaaucuaccaaaacggggaaaguuuccagcccaacuguaaacaucagugcacauguauugauggcgccgugggcugcauuccucuguguccccaagaacuaucucuccccaacuugggcugucccaacccucggcuggucaaaguuaccgggcagugcugcgaggagugggucugugacgaggauaguaucaaggaccccauggaggaccaggacggccuccuuggcaaggagcugggauucgaugccuccgagguggaguugacgagaaacaaugaauugauugcaguuggaaaaggcagcucacugaagcggcucccugguaaguggagacugagcacuucagacacuguacugagaugcauuucuggucuaaaucuuuguagaaaugagugcuugagccuguuugugucgguaugccucugagaagucuucccucuuauaugucucuaguuuuuggaauggagccucgcauccuauacaacccuuuacaaggccagaaauguauuguucaaacaacuucauggucccagugcucaaagaccuguggaacugguaucuccacacgaguuaccaaugacaacccugagugccgccuugugaaagaaacccggauuugugaggugcggccuuguggacagccaguguacagcagccugaaaguaaguuccuucagggacguguagacuguugccuggcaggugggugggaugugaacaucuuuuugaagaaagagaaauaucaccccuaacuuuccuucucuccuuucucuuacagaagggcaagaaaugcagcaagaccaagaaaucccccgaaccagucagguuuacuuacgcuggauguuugagugugaagaaauaccggcccaaguacugcgguuccugcguggacggccgaugcugcacgccccagcugaccaggacugugaagaugcgguuccgcugcgaagauggggagacauuuuccaagaacgucaugaugauccaguccugcaaaugcaacuacaacugcccgcaugccaaugaagcagcguuucccuucuacaggcuguucaaugacauucacaaauuuagggacuaaaugcuaccuggguuuccagggcacaccuagacaaacaagggagaagagugucagaaucagaaucauggagaaaaugggcggggguggugugggugaugggacucauuguagaaaggaagccuugcucauucuugaggagcauuaagguauuucgaaacugccaagggugcuggugcggauggacacuaaugcagccacgauuggagaauacuuugcuucauaguauuggagcacauguuacugcuucauuuuggagcuuguggaguugaugacuuucuguuuucuguuuguaaauuauuugcuaagcauauuuucucuaggcuuuuuuccuuuugggguucuacagucguaaaagagauaauaagauuaguuggacaguuuaaagcuuuuauucguccuuugacaaaaguaaaugggagggcauuccaucccuuccugaagggggacacuccaugagugucugugagaggcagcuaucugcacucuaaacugcaaacagaaaucagguguuuuaagacugaauguuuuauuuaucaaaauguagcuuuuggggagggaggggaaauguaauacuggaauaauuuguaaaugauuuuaauuuuauauucagugaaaagauuuuauuuauggaauuaaccauuuaauaaagaaauauuuaccuaauaucug

SEQ ID NO: 13864 - RNA, 8079 nt, Homo sapiens
cgguuuccgguuuccggcuuccggcggagugcuggguugucgcucgcagccgucauggcagcggaggagaaggacccucugagcuauuuugcggcauacgggagcagcagcucaggcuccucggacgaggaggauaacaucgagccggaggagacgagucgcagaaccccggauccggcgaagucggcgggcggcuguaggaacaaggcggagaagcggcucccgggaccugacgagcuguuuaggagcgugacucgcccggccuuucucuacaauccgcucaacaaacagauagacugggagaggcacgucgucaaggcgccugaggaggugagguccccgaccccguuucucggucucggccccggccugcgcccccuuucuccugagcccccugcuggggaccugcuguccauccccccacacgcagucacccccgcgggaugccgcaccacccccucccaccucaagcccugggaaaccuggcccccucuccccgccugguggguguuagaccggacccgcagccccgccccuugugaggagacccaaaccuccgcgcucggugccccgaccccgcgcggcgaggacuaacaguggugacucccccgccccccccgcugcagcuucucccugagaccccuucccuuugacgccgaagugccugcggugcugccuccaagacagugucugcugcagccuccugaaggggucagccuuggcguaguaucucugagacuggauucuucuuugguaacuaaaaguuauuagcuuuauucauauagggaacccuuuggcuuuucacuuaacaguauugugauuuugauggaaaaaugugucuuucaaccuuaaagaaaaaaaaagucagccugaacgauaagcgaacggcagggaguugcaugugcccacguccaucguaggaaccucgguucgucacagugcuucuuaaugugcuugcuuaacagccuccaaaggaauucaaaauauggaagucaaauuauguaccaccuccugagaccuacaccacugagaagaagccuccgccuccagagcuugacauggcaauaaaauggucuaacauauaugaggacaauggugaugaugcuccacagaaugcuaagaaagcuaggcuucuaccagaaggggaggagacguuggaaucagguaaggaaagucagaauccgaugguggucuauuuugauccccgugaugggcuuaaaaagaaugagauauuuaaugaaugaaaauuaaaucuagcgaauugacaaacuaauuugauggucuuuggauacuuacugcucugcuuuugagaaagaucauacauauuuggcuuuaacaugaagucucugauagcucagcuaguaguaguugcuguauuuuagugaaagaucauaaauuauucaggcuuuaaaguaaaauaucugauaucucauccaguggucagauuuaugaugcauuauuagaacaacacaaaucaauucaugguuucuugugacuguagcuacaaaguacugaaggcuuaauuuucuuuuuuuucuucuuuuucuuuuuuuuuuucuuuuuuuuugagacagcauuucgcucuuguugcccaggcuggagugcaauggcgccaucucagcucacugcgaaccuccaccucccagguucaagcgauuauccugccucagccuccaaguagcugggauuacaggcgccugccaccacgccgggcuaguuuuguuuuuuuuguuuuuuuuguuuuuguagaggugggguuucaccauguuggucaggcuggucuugaacuccugaccucaggugauccaccugccucggccucccaaaguguugggauuuacaggcgugagccaccgcucccggccgaaggcuucauuuucuauuaaagcaguugugcuucagagcuaaaauuaguaugacaaaaugaauuuaacugagcauuacuacauaguaauaggaagauaaugacugaguuguuuuacuuuaguucauaauagcauaauuucgucucuuacuuggacugucacaguaaucuuugccuacacauucuuauccaaucuguaccauccuucacugcagcuaguguugaguuucuaaaagucguaucugauuauauaacuugccugcuuaaaacccuucaacgggauaaagucaaggccuuguauuaauaggcccuuucucccuguccacagucauuuuuaauggccccuuucuagcacuugaagaucuugaaauccagaacugaauuguaugguucccugccuuucaguauacguugcaccuuauucuuuaguguucuuucuuaucucuggcuaguaaacuaauucauccuucaaaauccaaaucaaaagaagaaaucucagguaucaccucuaauaauuauuugcuccuuuguaccuuguuuaugcuaaugcuguugauugcccucaucacuuguaugugauuuuuuuaaaagucugucugcuuuaugaugaguuccucaaacagcaggauuugaaguguuuguaucgaguacauuguaaguauucaguaauuguugaauugaacuaauguuuuggaccauuauuuuuaagaaaguaugccauuuuuguuaaacagauuucugaucuucccacaauacaagggcuacuuagcccguuuuuaacagucaugcagggagugauguuuuguuuuaagagaaaggagaacugauuggcaguucuuucuuuaauuuugauucuaccuagcuuuuccauuacuuuugcugacuucuaauauguauuagucacuaaugaaggagcaucuucaguaaguagcaucuuuuugcagaccuuaaaugauguaaacauuuauaauaucucauauuguacaaucuuuuuguuuucuuuucuuuuuuuuuuuuuuuuuuuugaggcggagucucggucagucgcccaggcuggagugcaguggcgccaucucggcucacugcaagcuccgccucccggguucacgccauucucccgccucagccucccaagcagcugggacugcaggugccugccaucacacccagcuaauuuuuuguauuuuuaguagagacgggguuucaccguguuagccaggauggucuggaucuccugaccucgugaucugcccgccuuggccucccaaagugcugggauuacaggcgugagccaccgugcccggccauuccuuuucauaauuaguaaaaauauauuugcuuaaauaaucuuuauuacaacaccuugugaaauaagauagagaaauguggaaaugauagcuuacauaacuuguccaaggucacaaacuagaaaaugccaaauucuaaaauaggcacuuucacacaguuuucuaauuuauuacuccgagcaaccugauacagaagugcuacaugacucauuauuacuguuuuacagaugauaaaacaaucugagauuagggacuuuacccaaauucauucacgcagcuaaagaagagacagaguaguaggcauucaaauccagaccuuuaaauagaaauuaugccuuauuaaacugggauuuggucuccugaugaauagccauuucucaacagugagauauagcuauucuucuguagggcgaauggcaguaaagauacuaggguugauacucaaacuagauuuccauaggcuggugcucucacaucuuuguaguuauauggaaaaaaccaggauuauacaccagggcaagcaagcaagaaagaauuaucuuuuucuagcuuagcuuuugaguuaaguuagaaggaguuccaaauauguggcagguaacacugcuauucacauagauaauuucugucuuuuugaucacaugaugguccuuuauuggaaaacaaauacaggcaaaaucaaauaacagacccauuuuuuagaagugauuuucagauuccuauaaaaucaauuaugucauaauuuuuuagccuuucuuuuucauucauaaaauauauaucagaaacucuacacucuuacccagauuuuagauuagcaagugacuuuuuuauuuugcuuccccauucugcccuuuggccuuuuauugccgguuaacgucuuccaguuacuuuagaggaagggcugggaaagguucagaacucaucauugggucuugcugcuuaucagcccuucggguuuuuuuuuuuuuuugagauggagucucgcucugucgcccaggcuggagugcaguggugugaucucggcucacugcaaccuccgccucccggguucaagcgauucuccugccucagccugccaaguagcugggacuacaggcacacgccaccacgcccagcuaauuuuuguauuuuuaguggagaugggguuucagcauguuggccaggguggucucgaucuccugaccucgugauccgcccgcuucagccucccaaagugcugggauuacaggugugagccaccgcacccugccacuucugguuuuagugguuguaaaauguagguaagcaaagcuuaguuauuaguuguagcuuuauugacauguauaauaauuaauuguaaaagcauaauuaauauagugauuuuuaguuuacacuuuuuagaauuuagaaaguuugucuauugauaaguuaaacuuacuugagugauuugaguuccauaauaaaaaaauuguuuccuuaccaguacaucuauacuauaugagaccgaguaaaaaagcucaguaaaauugauaaaugaacauugcucagauuuuuuccuacucuaguuuauaaagcaaugccuugucaugacacuagauggcauagcacuucugcucaaaucacugauagccaguuacuuuuuaacuucaguaguuugugguuuuguuauucaguuaauuuacuuguaauaaguggcaaauuaaaagcaaaaauaucucaguaucaucuaaauguaugcuaaugcauagugaauauuauaguaaacuuaguacuuuccauuuuuauauuaucacuacugaaaaucucaaaagaggagcuuagugauaauuaacucguuaaaaagcaaaaggugccgggugcgguggcucacgccuguaaucccagcacuuugggaggccgagguggguggaucacgaggucaggagauagagaccauccugguuaacaccgugaaaccccgucucuacuaaaaauacaaaaaauuagcugggugugauggcaggcaccuguagucccagcugcuugggaggcugaggcaggagaauggcgugaaccugggagguggagauuacaaugagcugagauggugccacugcacuccauccugggcaacagagcaagacuccaucucaaaaaaaaaaaaaagcaaaacguuuggcuuguuuuggugguauaccauguuauuugguuuguggagccaguguuuuuguaugaacaugaugaacuacugauuaaaacuuugauuuguaaauuccuggggugaguugaucugaauuguauuuuauuccacugccuacauaaauccauagugcucugugaagcauaugaauaacaucaccgugcugugcuugaaggggagugaagaugaaugguauugauuguuaucugcaucaauaaaugagauauucugauuaugguacagucagcagaagggaauugaaggcuuaagauuuuaauauuuccuucaaggaauuuaugauuugaugucaguaguuccucacauuuuuuaauaaugaaggcuccuuucaauaucaagauauuuuauagaucuccacaugauaaccuguugaacuuuuugaguaucuguugaucaagaaaauaaagucaaaagcuacaauuaauuaguaaugugcucaaaauaaauuuguauuuuauaaaucauaacaucuuuuccauguuacucugucuauauggaguucuuaauaccacacauuugcuuagggagauggaauuagcaacuagucugugcuacccuguauuuuuuuuuuaaccauguaguuggauuuuuuaaaauacaauaaaagaguucacuuuuccagguuugacaacauuuuuaugaauuggaaauuuucuguggcuacagauacuauuaacauuuuggaaagguguaaagaacauuguuuuaauguaaggcucuucucuaaccucccuccccucuccaaauucuccauaauaugaaguaggaagauauguauuuuucuguugccauuaaaauguucuggccaucgugggaguggggauggggagggcggggaugggaauuagaacuuacuagaauaaaauuccaaauagagguuuggggaaaccuacuugugagugcuuuuuaaccucaaaauaaggauuugggguggguggagaaggugauggggcagaagaaguuguuuuuggaggagagaaagcagauugaaaggaaaaggacagcugauagccacuuaaauaaugucaucguuagagugauaccuauuuuuuguaaaaagaaaacaauaugcuccauucuuacaaagcauugauuguauuuuaauauauacaauguaaauacuaucaugcagugguguccaagggagagaauacagucaugaguucuuaguuucuguuauugguugggccaauaaagccccuucaucauccuucuuuucugcuuaucacuagagacagaaacuaaaaaccauggcuucaggcugcuaaaagccuaaaacaaaacagaacaacaacaacaaauaaggcagguuggacaagcuugcugaguauuugggagccuuuuucaaaagucugauuugggggaaguaaagucacuuauuuuaagcuaccuuaguauagcaccuaaagaguuacuuugugaauuuuguauggcugcaauugaaaaaaaaaauugcucacuuucacuugcauuuaaaaaucagagcucuaaaaguuaauucuuguuuuuuauugggaaacucugagagaaacauuaauugaugaggguaauaauuuugguauaaagccagugaaauuuuaaugcuuaacauguuggguuuuuuaaaauuacugauugaaacucuuccuuuucuauuuaaagaugaugaaaaagaugagcauacuucuaaaaagcgcaaaguagagccaggagaaccagcaaagaagaaaaaguagaaacaaaugaccagaauuucuguacugcuaaacuuguugaaauguuucuuuggacagauuaaguugauauuguggguuauuaugccacaucuccaugaaaaugcauacguuaaugaacuaauaaguauugccucaagaacuuuccacuauagaauucuuuuuuuauuuaaaacauguauguauuuaaaacucaacuggugacuugugauugugaaauugauaacacuuggaugcauucuugcucucacagaauuggugacaugcuuugagaguuuugucacauguugacaugccaauguucuuauaaaccuuuuauaaaggaauauauuuuuaaaguaaauauauuguaauguacugugaacuuguagggugcuuuucaacagucuuuguacaguguaaauagaucauggaaauaaaauuacuuauucaauauuacuauuacuguauaacauuaacauuugaauguuugucugugacaaguacccuauuugucgugugacauuuuaaguuguaauaagaaguauuaccauuuaaagagugccuccuguguuccaggugcuuugugcauauauuuucucugauccuuaaacaaccuagcgcaagguauuauuaguauucucauuuuauaauaaagagugcuugaguagcuugucugauguuacacagcuagugagugguucauuuggaauuuaacuugggacacuugaaccucaaaaucaucacauuaaaccaccuguccaccagucaaaauuuagucaucuuucaggaaugacaucaauugucaucucuuccagguacuuuuuucuguuguaccuggagauccguuaguagagaucuuuuccucuccugauuggaugacuguacuugucaucugugcuuuaugguuauucauuaauuucuuuauuaaauuguaaguuuacaggacauucaguuaaauuugaauuucagauaaauaauguuuuaguauauuuaauauucaggacauauacaaaaaauguguuuaucugaaauucaaauuua

SEQ ID NO: 13865 - RNA, 1100 nt, Homo sapiens
aagggcagauuuuauuucauugcaaacaaaagaggcauucaggcuccagggcacucuccucccuggcagcauccucccaggccuggugagagcgcucccugcagacccucagggcaggccacacugccucucagaugaaggagaggaagauggauggaccgccacgggcaagccuucucugugggaacauaaagcccagcaucugcuuggggcagaagccccggggugccccaugagaaagccgucagggcccuuggugugcagucaggcaagcugaugggcugggcagccgcugccaguuagggaacacagaaugcuccuucacaguacagcgaguccaucugggcaggagcccuccacagccggccucucugggaaugugucuuugccauuuggaaggccaagagccaucaucguucauucagacgccuccugugaggccaaggaggcugguccauuguuccugccuccccauucccucuguccucccacccacagccuggggugcaccucuccuccucacagcugcugccugugaguugugcaaggcagaccucuuagaagucucgcuuggaacugccuagaaggagauaggcauguuuuaaugggaauguaggcauuugguguguuuacugauguuuccuggacaaucucuugucaaagguugagccuuucugugucucagaaagggaaaaacacauguguggguuuacacauugcugagagagcaggcagaaagcugcugccagaccaucaguuucauccucaucaucggaaaguaucuucuaagcaccugauugcccaucacaccaaauaaagaggaagucuugugugggaggccacugaauuggaagggaggagguguggauuccuaucccugcucugcuucuaagcagcucugugccuuuucacucggcauggcuucccuugcuccaauuccacagugcuaucccagauacagcccuuccccucugcauuccccagccccugcccacagcagacauggcuaaucaaucauguucccauggcgccuuacagcauggccucagagacauuaacacagagcucccgacagccacugcucacugauuugaagggcc

SEQ ID NO: 13866 - RNA, 1100 nt, Homo sapiens
ggcccuucaaaucagugagcaguggcugucgggagcucuguguuaaugucucugaggccaugcuguaaggcgccaugggaacaugauugauuagccaugucugcugugggcaggggcuggggaaugcagaggggaagggcuguaucugggauagcacuguggaauuggagcaagggaagccaugccgagugaaaaggcacagagcugcuuagaagcagagcagggauaggaauccacaccuccucccuuccaauucaguggccucccacacaagacuuccucuuuauuuggugugaugggcaaucaggugcuuagaagauacuuuccgaugaugaggaugaaacugauggucuggcagcagcuuucugccugcucucucagcaauguguaaacccacacauguguuuuucccuuucugagacacagaaaggcucaaccuuugacaagagauuguccaggaaacaucaguaaacacaccaaaugccuacauucccauuaaaacaugccuaucuccuucuaggcaguuccaagcgagacuucuaagaggucugccuugcacaacucacaggcagcagcugugaggaggagaggugcaccccaggcugugggugggaggacagagggaauggggaggcaggaacaauggaccagccuccuuggccucacaggaggcgucugaaugaacgaugauggcucuuggccuuccaaauggcaaagacacauucccagagaggccggcuguggagggcuccugcccagauggacucgcuguacugugaaggagcauucuguguucccuaacuggcagcggcugcccagcccaucagcuugccugacugcacaccaagggcccugacggcuuucucauggggcaccccggggcuucugccccaagcagaugcugggcuuuauguucccacagagaaggcuugcccguggcgguccauccaucuuccucuccuucaucugagaggcaguguggccugcccugagggucugcagggagcgcucucaccaggccugggaggaugcugccagggaggagagugcccuggagccugaaugccucuuuuguuugcaaugaaauaaaaucugcccuu

SEQ ID NO: 13867 - RNA, 8172 nt, Homo sapiens
agagggcuggcaaggcgcgcaugcgcaccgaggguggagccgcugagcacagaaccggaaacuuagagacaaaguucggagccccgcccccgccgcgcgccgcugaguugucuggccccgccgacccacggcccacgacccaccgacccacgaaucggcccggccgucgcgugcaccaugucuggcuccuccagcgucgccgcuaugaagaaagugguucaacagcuccggcuggaggccggacucaaccgcguaaaagugagcgggggcgggcggccgaggcgggaggaaggcggcggcggcgggugggauccggcggcccagcuggcgggggcgggcgggacacgcgccggcccucgcuuccccuggagaggacgcgcgcucagcggcggcgaucggggagcggccagcuuuagagcaggcgccgcgugggucuacgcuguguuuuagggggacgauuaguucgcccuuccgccccaggacuuuccgaggcgggcuggccccuggguugaaccguggccgacauuccgguccuccuccgucucuaccucccuuggcagccuucucggcuggucucaccaacagcugcgccuccgcgcgcuguccgcacccuuccuuucccacuuugccagccuccuguuucucaucggacaggguauuuuccgacuuuugauucagagcagacuuuucucccauuugaucuuucccaaaccuacuuccuuuaguauuaaauucuuaccuucaacuucucuuguccguugaacacauacuuuuaagcgaauuauugcauaacuuaaacuguggauugaauaagcauuuuucgaaacgauccuggaguguaaaguuccggucagugccccguacaaccucgaacaaagcgugcauuucauaccuauggcacaguuugcucauauuugaccuuggggauaucgacugguccgcaugccggagaaaaugauuauuguggguaauuauuggucuuauuuuggcgucugguuaguauuggccuugucuugggguacuuugggagaaaaagccuuuugucuguguugauagaauaacuugacauucaagugcuguucuaaguauuuccugauuuuuacaguccuaaauggauuggcuucuuucugguacaauaggucaggcuacaugugaaacacuucugcaguuaaaaaaagaaacaagaauguaaaucaugugcccuguuaaaagcagccaguuccuaagaugauuugauuuuauacucaucaggcuagucuuuauuacuugccgaaauguuuugugaacugagagggucucuaagcuuucuuaacuagaagugucagagaccuagcuuacucaguuguggucaccucagaagggaagggaaauucucauucgucuuggugcaggauccuccugagagagagucucccauuuaguuuuguuaacuagaaaugucagggaccuagcuuacucaguuguggucaacucagaagggaagggaauucucauucgucuuggugugggaucccccucacguccaguccuugaaaugcuguagaccucacugcaguuuggaauccauuucucuacucucccaauucuuaccucaucacagugguuucuagucagucuuggcuggauuuggcucugaaacucgaaaucauuuauuucguaaccauuaaaugucauucaggugugccuuuaucauagauaggauggaccaagaaaaaaaaaugggggugggauagugaaagcaauaaauuguacaucuuuagucuccaaagaaaaugacaugagguucucaggcuaaaauacuccaagagcuuuacuuugaaaacccuagcugcugcuccccuaauuccccaaaacugauccuaccuaaaucuucaguagacuucugguucuggucgggaucauuaaaggcaccagacaugauuugguuuuggaguuauugccugauguuaaggcuguagcaagaaggggagcauccccuuuuguacuuuuuaaugagcuuuucuuuagacauguugcuaaaugugguuuaacguuguguaucuguuuuaucaaugacugggcuaggugauuuuuuugugagauuuuuaaacuagcacaaucuuacuuuuaaccuuuaugugugaguacaauugauagaacuuaccauaagugcuugacaaacugucauagguaggucaggacauuuuugagagugagaaggggcacuaauaggccaggauuacaggguuucaaccuccuggauggugauuguuacagugccuuaggggcuagcagcuuguuccaguuuuagagucuuugucucagcuuuccucacuguuuggaaugcuguuucucacugaugguuauuuggcuggaucucuugucauugagaucucagcuucaaugucaccucagacaccuucccuuaggugggcacccagucaccaucuaaaagauuauucauuuuacuacagagcaccuugucugucauuuucucugaacuguuagcuccauaacaacagggcucuggcuguucuuauguauucuuagugccuguaaguauaugcggcacauaguggugcuugaaaauugugaaagcgaguuacauuggaccccaccuacacuuuaaacagaaaauuaacagguacucuuuaugcuuccugcugguuaauaugaaugaaaacacuaaacacuauuacaauauuuggugaaaaaugacaccauuguuccccuacuuuagcuacacuucuuuuggaaggcgggggaugaggggguguagucauuuguaaaaauacuucuuuuacauaggagcuaauaaaccuauggaacucauuacucuggacugcuguauaagcaaaacacacaaauagauucgauaagcguuuagauucaucuuaggaugaagaauuauuagguuggagguacagcuguaaucugcagggguucuugguauagagagcauuugugaugcuauuaauucccugaggccacauauccagcuggauggacuggacaccugcucccagccuccuugcggauaaagacugagaauaaaauaaaugaguauuucucccacuuuuuaaaucucaguucaagacuucagauauuagaugcauuuggggcauguuuuagucauucauguuccacgucugaacggguccguuaauguuauuaaacuagacagugacagauuucugcccagugucacgugacugaaaggcugcuagcaaacuucaauuuaacaguuuuucugagcagccugccuuuaagaaacuauugccuuaaauaugauuuaaguguuaauauacauauacagagccacccaaacaggacuuaaggaacuucaauggcuuuaugguuauuuuguuuauauccuacaucaccuuagcagaauauauagaaauaguagaugucuaagugaaugaaugcaugccucuuuuaauuuguuuuaguuuaaaugcaagacaguauaagggucugauaaauuugaggaucaguauacugaaugcauucuuaguguuggcuuuucuaaauuaugugcuaguuaucccacauuauguucauucacaguagcauuuuuccaguaauacugcuuucaagacaaaguaauaguuugcuagaauguuauugcuuuuuguuuaacccuuaauguuuuuaauaagauguuaaguacccucagguuugcacuugaacagccuauuauuaauaagcaagaugugcuacgcuuugcaaaaaucaacauaauucuacuguuuguacucagucaucugaugcuucuaguaaccaagcaaaagaaaacauacuuaauuaaaucagucuuauuugcaagcacuaguuuuaaguauuaagagcucacuaggcugggcgugguggcucacaccuguaaucucagcacuuugggaggccgaggugggcggaucacgaggucaagagagagagaccauccuggccaacacggugaaaccccgucucuacuaaaaauagaaaaacuagcugggcguggugacgugcgccuguagucccagcuacucaggaggcugaggcaggagaaucgcuugaaccgaggcggagguugcagugagccgagaucgcaccacuguacuccagccuggcaacagagugagacuccgucucaaaaaaaaaaaaaaaaaaaaaaagagcucacuauuugacuuaagucuucaauuauuauauaguaucuucuuuugaagcaagagaaguacuguuuuauuguaaguacaauauuuccaaagauugagaaaaccuucauuaaaauguucucaccaucuggcacuucccccccucuuuguuauguauagguuucccaggcagcugcagacuugaaacaguucugucugcagaaugcucaacaugacccucugcugacuggaguaucuucaaguacaaaucccuucagaccccagaaagucuguuccuuuuuguaguaaaaugaaucuuucaaagguaaguuuccuuaaauuuaaaacaaaaacccacacuguaggaauaacuagucuucucuuucuuugcagcacuuaaaagaucaucccaugcccuuuccuuuggcccuccauuuccaguauuuuucuguuuugcaaggaaagugaggauucaugaaacuugcugacuuaguagccaugaaggcuaaucguuucuauuuuaccauaaagaagguuaaguagaggauuuaauaaccauaaagaggguauaggagaguuacuacaaaaucccacugccguaacaagccauguguuacuuuuuagagcauuggccuaauggaguccccaaguacuaguuuuguuuuuguguaccuggcaaauauuuagacaguuuuuaaaaaaucugcaauguuuauggggauaacuuaaaguacuaccaacugauuuggauuaacucuugauguuauugcucuaacugaacccagcuguagagcaguauagcaaagauugggaauuggaaaugcaagagaaagucagauguaauugaguaagccagugugguagaggcguuuggacugagguagaacagacuuuauauuuuguucucauuuguuagauuaaagauaaaacaugaaggaaaugcaguauauaaguucuugguggcaaacagacaguggacugaauuucagagaauuaaaaacuaaagacccuguuggcuuuauuaaagcaugcuucaguacauuaauuugugccuuccagaucaaaugucauguguacaaaauguauguuaaucuaagagaugugaccaaaaacguuuuggaucauuuaaaauguaacugaagggugcugccuuuuauaaauucuuaguacuuuaguuagggaauguacucauuaguauugaccuaugagaagcaaacuuaaacuaauaguacuuuuuuaaaaaagauuuuguauauggcacacaccccuuacuaacuuucugacuucuccaaaguccaggaagcugcuuccuaaaauaccuuguuacauaguugugcccuccuuaauuaagcuuccuagaccugggaguguccaggaagucuguauaaguacauguuuccaguaaauacaaugauugguuaagauguuuaaguuuuuugaaauaccagggggaaaaaaagcccuuugaaaacaggugucaugugcacaaaaaugcacaugaagaaguaauucacuuucauauuuaacaguuuauuauaauauccuuuguuucugguacuauucauuuaauucuucaugguaguuuuuggaaguuucauauuuuuaugguuuauuaaugauuguuuuuuuaaccucaguucuuguauucacuuuacagugguuuauuuucauuugaauaaaauacugggcagcuguuaauaguuuuacuucauaggaaucuacagauaaguguuuaaaugaauugcucaaguuuaaaaauauggcuggggguaagaacccagaagguaaaauaaugucuauuaaucccagcaguauaagaaaacagcuuuguggauauuaagauuugcagcaguuugggcuaggagaauaauaauugggcaucaaagcauugcuucucaagcuugaauauaugcaaaucacuuuguuaaaaugcaaauucuaauucagaaggucugaggugagucccuagaacuugcauuucuuacaacugcccaccuacacugaugcugacaguacuggaccuacacugaguggcaugaauguaaagaaucuacauuggaguuauguauauaaauacaguuuuaucacuggagugcaguggcgcagucucggcucacugcaaccucugccuccaagguucaagugcuccugccucagcuuccugaguagcugggauuacaggugcacaccaccacgcccggcuacuuuuuguauuuuugguagagacagcguuucucgaacgccugaccucaggugaucugcccaccucagccucccaaaaugcugagauuacaggcgugagccaccgugcccggcccuguauuuccuuuuaagaggaaauuuuacuauuuuuuuugagauuccagcuuuugaaauuuuuccucuuuuacacaaaacaaaauagaauaacacaggauuaaaaacuguuaaucaguagaacauguaugcacaaaaaaaugcagauaagacgacaggcuuauugacaguauucgccguuuuucauucugccuuuuuuaaaugaauuuauuucauuaaauacucuuuguaaacaagauauuuaaugguuguacuaaacuaugauggaauuauacuucacugaauauuuaaguuuccaaaauuugagguuacagugaggugaagauuuuggugaacaucuauauauacuuaguaccucuauuaaguuucuagaaguaaaaaggagugaacguuuaacauuuuuacaacguuguacuugauauccccugccaauauaauacuuuggccuuccacuagaaacaugagaauguuuuuuccuugaguccuaacaaaccuuagucuuuucugucacuauuuuaggugagauuaaacauuuuucacagcauucuguuuaugccuuuucaacauuuuugucacagacuaucucagauuaacacuuuuguaccuuuccauaucaauaacuaauccuaaaguuaguaugcucauguuuuaauuuuuuaguacacuguuuuucaauuuaauguuuucauuuuuuaaaucuuuuaguuuauacucuauuaaacugaaauauuaugguuugaaaacauaacuuauuuuuuaaggcauaacuuauaauagcuuuguauuccaucauauguagaaaccuucguuuauccauucuccuacggaguuauauuuaggcuguuucaguucuuugcuguuaaaauacuaauacagucaguauccuuguacauguuucucuaugucuggguuuaucuagguaacuagaagugugguugcauccuuuacuucacuagauacugccaaacugcccugcuaaauauagucuugcucauuuuucuaaggauguuuggauuuuugauuuaagagaguuuuauuaaccuuuuuuauuauauacagaauguauuuuggcaguaaucuuagcaaguuaaucuguaagucuguuuauaaaacaggaaugacuuauacaucagagugguugugaaaauuaagggaaagauuuuacuguuacuggaccauaggcauuucccauccugcuucuuuuaaguuauucaugaaaaaaauuaaaaacuauguucuuugauacuuuacccuaacucaccuuuuuuuuuuuuuccccaucuuagguuucccaaaccacuccuuaugauccagugaauauucaagagagcuacauuugaagccuguacaaaagcuuaucccuguaacacaugugccauaauauacaaacuucuacuuucgucaguccuuaacaucuaccucucugaauuuucaugaauuucuauuucacaaggguaauuguuuuauauacacuggcagcagcauacaauaaaacuuaguaugaaacuuuuauuuugcauuauuauugguauuaaauacaugguauauuaaucuguucugaacaccugaagggguuaaguuuguacaguuuuuuccaccuacucuucucacaugacuuuaugccauacaucuggcaagacugcuagggaauuaaagguaaacugugaaccuuuauucuuuuaaggucaggaggaggcuguuaaguucuacggguuuccauccaugaguuacuuauagg

SEQ ID NO: 13868 - RNA, 18609 nt, Homo sapiens
aggcuauuuccguuuccguacggaagcaaaggagccaagaccauggcgaaagccggggauaagagcagcagcagcgggaagaaaagucuaaaacggaaagccgcugccgaagaacuucaggaggcugcaggcgcuggggauggggcgacggaaaacgggguccaacccccgaaagcggcugccuuuccgccaggcuuuagcauuucggagauuaaaaacaaacagcggcgacacuuaauguucacgcgguggaaacagcagcagcggaagguacgcgagaggcgggggcugccgggcgcuugcgcguuguuccugacgcuuagggcggucgcggggcgcacaucugugguugucugcuggucucaaaaguguucucuguggcuccgugggaaggguggcgucgcggcccacguguucugguccccucgcccuaguuuggagacucuagguucagccuuuugccugagcgucaagguggaagauuaucuugauaggcucuuuccugggacgcuagauucacaaggaaagcuguaaggccaguuggcuuaguagugaaaacuacgcccuccuggcccagaaggcaaaagucucagcccuuugguccgucuagguagcguugguuaauuugcagaaucugaaauggaggcaauacguaauaaauccaaaauacugcuucucugauuccugcaggagcuccuuaccgaaauuaguacuguaaaguuucugguaauuguauuuguucuuuucagcuuuauccuuauacguuucugguagguaaacaaacugaaacguaaagagguuuaaacgacuugucaaggucgcagugcucauuucugguuaaauugcaauuggaagaaaacguuugcuuauucuugcacaucguagaaguucacacaauauuauuauuaugugucugccuccucuuacuggcccuucugaggcccgggacugguucuuacucauguucagugucaaggugcuguuucaauacauacaaggggcguuuaacucauucugguaugcacguauuggggagggauguccuggaagacuuauuggagcuaugauuucuaaucugaaaccugguggauugaggaucaguaggugcuggggaaaaaagaauauuuuuuauuuugucaagcauucuaucuagaaaucuccagaagaauauauagauugacaauacaaauacagauaaucuuaagccaccuugcaagcucuuacuaaauuuuagaaguauauuuugauuauaaaauaugugaauaacuggugaugguuuuauggaaaacaaccugaaaacucagcucccauuccuauuuuuagugcuuuucaagagaagcaagcagcauaaccauggucgucuuuaggaugccaccaguuaggcaaaacaaaacacaguggaaaccaucacauacuuuaauuaauuugaggcuuuauggaaaaagguuaagcuacucaaauuuuaaauguucaaacuugccaguuuagauuuuuuuaaaggagcaggucuuuguuaaagaaaucuuauugauuggccagcucauuuggcuuacaguaauuuagguagaaaacuccacguccagaugcuuauuucaauagauuacaaagaccgcccaguucgaguauucauagcauuaguaauuuguaguuucaguauguguuugugauauaacugguuguuucucaguauuguucucuuuuuuuuuaacccuuuaggaaaaguuggcagcuaagaaaaaacuuaaaaaagaaagagaggcucuuggcgauaagguaaauaaaauuuuuagcuguuugcuuucuaucuuauauuagggaaucccuccugauauuuaaguugaauuacuuucuuuuaaaauuuauuauuacguauuucagauguaugaagaaauacaaaaguaauauaauaaaccucuuuguaucauuuacccagcuuaagaaauaaugcauuagcaaagaauguuggaagccccucgucugcuucauaauugcuuuucccuccgaagauaaccacucgugaaauuuuugauuauuuuuuccaugcacuucuuuuaccuuuacuguguauguuuguguaccuauacgguaacacaguggugguauuuugcauauaacuuuguguuucagaggucaacaccucucccugacuuugggaauggggaagcucccccagguuaggccuggagcuuggcucuugucaugugaagcaaagauuuuuggucaggcaaggcuggggaaaggcaggacagauccucuucuggaguagggugauaaggguguguuaagcuuuagagcugguacagaggauaugaaccugugaaaagugagaauggggagugggaggacggugaggauuauggcagagaaaagagcagauaaugcaucaagaaagaauuuggcuguauuugugguacucauaagaagugaaaucuuuauugaaaaaauuuuuuaaacuacuaaaugcucauacauuauugcauagcuaaguuauuuuuauuuucaguguauuuauaguuacuccuagguugugauuuauuuuugcaaaauuuugaaaacauucaugucuccgccucccauucaaguaaguuaccaaauaaggguguuugaggaagggaaaaaaauguaaagacaguauacaaacuaaacacucuacuauuucauacauucuuugaauaguauuagguuaaaccauagaaaauugucaauaguagacuguuuugaccugcaguauccuaguaugucaagcauguuagucucuuuuuaauucuuuuguaaucagucuauuacagcaaauuaauguuaugaucaccauuugaaaacaccaccauucuuguuuuuugagaugaaagauaacuucuuaaaauugccuccuuuaaaaaaugcuuaaaauguaauauuuguuucauagaguaauaaaugcuaguuucaguuuguauuuucuucauagcucugcuaguguacauauauuuugaauuaguuuuaauguacucuuacaauucuguguucuacuucuuagcaauucauuuacaccauuucuuggucuaagcugaguaugcaugauugcugauccuaacaguauuccauaauguugauguacuguaguauguuuagucauuaccuuguugaacauuugcccuguuugcuguuuauuugcauuauaaauagggauacuauguauuucuucguucaaauuucucccccauuuacauuccugaacauaaauaccccaaaguaaaauuacuaggucaauggauaacaacuagacuuuuguuaaauauuucugaguagcuuccugaaaguauuggaacaaagucauguacggaugucgcuuuguuauuuuuuucuuuuauuuuucuccuguuugauguguuucccccuaguagauaacuaucuugaucucuauuucuucuccuuguuacuucugcacaguuuuaagccuuuucauucaguguuggccauucuucuaguaugugugugucucugcccagauuguuuaaaaaaaaaaaaaagccucuuauucaauauuguuauuagaauugauguagcaauagaaguggauugauaugaggaacagauugaguuugggguuauuuguagcuuucuguuauuuuucuccaacaguaauauaauuaauguaaaauccuucuaaaauguaaucccuucucuuuuacuuaggcuccaccaaagccuguacccaagaccauugacaaccagcgaguguaugaugaaaccacaguagacccuaaugaugaagagguaauguuagaagucuuaaauuaguuugaaugaucacauauaauugauaaauuauauguuuuuuuguugauauuuaaagugcuggcuggccaaguugcauaauggacugauucagcuaaaauguuggcauauuaucuuauuauuuggugaagacuauuucauaauugaauuucccaauaaugcuauagaaaaauucuauaaaaauucuagguaaacuuuuacauuugucauauaaucccugaaugguauuuuggaggguuuuguuuuuguuuuuguuuuugauuuuguugagacagagucuugcucugucgcccaugcuggagugcaguggugugaucucggcucacugcacccucugccucccagguucaagcaauucuucugccucagccuccugaguagaugggauuacaggcaccugccaccacgccuggcuaauuuuuguauuuuuaguagagaugggguuucaccacguuggccaggcuggucucgaacuccugaucacaggugauccgcccgcuuuggccuccaaaagugcugggauuacaggcaugagccacugcgccuggccuggugguuuuaaaagaauuccuuguacuaucgacuuuuguaguauuuguuagacauuuugauaccuaagaauaacauuugaugcuauuuuuuguauucucauaaaucuuaguuucaagauaaucuuucacuuugcauauucuccuuagauaguuggcaacagugcagaaaaagaagcaagauuuuaaaacuauauuuuuaaaaguuuuguaaaggaaauuugguuucgaaugucuguuugcuuugaaacagugcugcuaucaacauucuuucucauaucuccugguauagucauacacugauuucugucauucuuucagcaaauguuuauggauuugccugcaucguauugggaucuguuuuagggauuugagauccaucaguacacagaauagucacacacauacacauacacacacacaacuucuacccacccagagcuuacauucuaggaagggagacaaacaguaaacauaaugaaauaaauaaguuagacauauguuagccagugauagcuuacuaaaggaaaauaggauaaaggagauucaggacuaccuggaguagagaggguuugcaauuuuauguaaguaagguguuuguguguguaugcauuuuaauuuauuuugacauuauuucagacuuaauagaaaaguaggaauuuguacauacccuucacccagacuuccuaaauauucccucuuaaauaagaguaaguggcagacauggcgccccuuuauuccuauauaucucauuuuguuuuuuaugagcacaguuagcaaaaucagacauugauauugguauucaauauuaucuguucuauagaucuuacucagaugucacuagcuguuccaauaauguccuuuuuagcaaaaaaaaaaaagucccaggucauacauuccauuguaauuacucuuuaacuuccuuaaauuuagaacaauuccucagucauuugcuuuuugugacauugagauuuuuugaauaguauagaccagauauucuauagaauguaccuuaauaugaguucgccugggguuuccucugauuauauucaguuuauguacuuuugacagaaauacagguugagugucccuugccugaaaugcuugggaccagaagucuuuuuuuuuuuuuuuucuccgagguggagacuugcucuguuacccaggcuggagugcaguggcaugaucucggcucacugcaaccucugccucccagguucaagcgauucuccugccucagccucccaaguagcuaggauuacaggcacccagcuaauuuuuguauuuuuaguagagacaggguuucaccauguuggccagguuggucucaaacuccugaacucaugauccaccugccucagccuccuaaagugcugggauuacgggcgugagccaccgcacuuagccagaccagaagucuuuuuggauuccgggcuuuggaauauuugugauagauaaugagguaucuugaugauuggacccaagucugaacacagcauuuauuuauguuucauauacaucuuauacacauagccuaaagguaacuuuuuuauuuuuggagauggagucucgcucuguugcccaggcuggagugcaguggcacaaucucugcucacugcaaccuccacuucccugguucaagcaauucugcugccucuggaauagcugggacuacaggcucacacugccacacccagcuaauuuuuuguauuuuaguagagaugggguuucaccauguugcccaggcuggucuugaaccccugagcucaggcgauccucccaccuuggccucccaaaguguuaggauuacaggcaugagccaccccaccuggcguaaagguaacuuuuauacaauauuuuuaaugauuuugugcaugacacaaacuuuugacugugaccccaucacaugaggugagguguggaauuccccacuuguggcgccauguuggugcuuuaucaaaaaguuuugaauuugggaauauuucagguuuuggguguuuuuggauuagggaggcuaaccugugccaugaauauuauguuaaguccuuuuucaguacuucuuaccaagagucaccugauaauuuucucauacugguuauguuuaccuugaucacuugguuaagguggugccugccagguuucuccacucugaauuuacuguuuuucccuuuguaugauaauuaguaaguauuuggggaggagauaacuugaauguuacuccucaacuuaacacucauuguaaaucauuuuuuccaguuugauaagugagaaauuguauaucacuguaguuuuaauuugcaguucucauuuugaaugagguugaacaucuuuucauauuuuuuuccccuugauugauugauugugucucuugcccauuugucuacuggguagugauuuuauauaggaaagucaggguaggcuuuauugagaaauugaccuuuuagcaaagacuugaaggaugugaggaaauuagccaucuuugggcaaaaagagccccagaaugagagaacacccagugcacaagcuccaaggcaggaguguaucgaauaugcuuuuuaagaauaacaaggaggccauugugacugaaaucaagcaagggagagaauuguagaagagguccuaggaaaguaugaugaagaagaaagaccagaucagugacuuuguuggccgguaugaggacuuugguuuuauacuuagugaaaugaagagccacuggguggguuagaauagaagaaugacguggccgggcacaguagcucacgccuguaaucccagcacuuugggaggccgagacggguggaucacgaaguuaggagauugagaccauccuggcuaacguggugaaaccccaucucuacuaaaaauacaaaaaaauuagccaggugugguggcgggcaccuguagucccagcuacucgggaggcugaagcaggagaauggcgugaacccgggaggcggagcuugcagugagccgagaucgcgccacugcacuccagcaugggcgacagagcgagacuccgucucaaaaaaaaaaaaaaaaaaaaaagaauaggaaaaugaugugaucagacuuaauuuuuagaaguaguuggcugcuuuacugagaauguagcuggagagguaaguagagaaaggaagcuacuaaacaaauccaggaaagaaaugaugggcuuucaucaugaccugggccaggguaguuacaaugaaaguggugagaauugaucugauucuaaauauuuuuuccccuggguauauuuugaaaucagagcugcuucaauuuccugacaaauuggaugcagaauaugagauaaauagaggauucagagaugguauuaagguuuuagacugagcaaauuagaaggaugaaauggucauugacuagauguggaagacugagugaaggagauuuaaggggaaaucaagaguucaguuuugcauauauuauguuugagaugacucaagaguuuuuagaagagaugucaagcagguaguugggaugugagcuuggaauucaggaaagaggucuugagauaaauuuggggguaacaggcauaucaaggguguguguacauaaagguuucccuagaauguuuaccuacaguaggauaauuuugagucauggaauguguaaauguuuaacuuuacauaauuguaccaaaauauuuuucaaaguagugguuguaucauuuuauacuuuugugguacaagaguaguguuccugcucauccacauucuaaccaacucaugguauguucagacuaaugauaaaaggcugucucauugugguuugaauuuguauuuccuuguuuucuaauguugagcaucauuuaauauaaguuguuuucuuuagagauaagccaguucaugucuuuugcccaguuuucuaucauguaguauauuuuacgcauuuguggaacuucucuauauaauuuggauaccaauucuucauacauauuaaagaaaucuuccaauucaugaauucucuuuuuauuuucuauggugucuuuugaggaccaggaccagaaguucuugauguaguugaguuuuugaaaaauuagcacuuaaagcuuuuuauguaauauuuaagaaacuuuucucuuuccugugaucauaaguucuucuuuccuucuaaaauaauuaaagaguugccucucguauuuauuugcuugauugucaggaauuguuuucuguuuggugugagaauggaaaccaguuacuuuccuuccugucuccccaaccuguccuuuugcauauauauauuuugaauuaguuuuaauguacucuuacaauucuguguucuacuucuuaacaguucauuuauauauaaccaguuuauccaguacugguuauauauaaccaguaguuauauuuuuggaguagugcagccuuuccccacaaugaauuguaaugccaugauauauaucaaauaucuauauaugcuuggucuuuuucugggcuauuugcuucgucaguuugucacugcaucauuaguuaauuauuuagcuucauaauaaggcuucauaucuauaagggcaaaaugcuucuuucacuccugccccuaaauccccucucuucagauguguuuuggcuuuuccuaggccuuugcuccuccauauaaauuauaaauggcacuaaaucagaucaauuuggggauacguauguauguauauaauauauauuuacuuaggucuccuuuaaauagugaaauguauuucauguauuucguaauucucuucauggaaguugacacauaaaucuugcuagagcuauuccuggauaucuuacaguuuuuguugguguaaacugcaugucuuugaaaauuguuuuguuagccaauuuauaaaaaugcaauggauuuuugaauagugauguucuaaccaguagccuaccuaaauucauuucuaauuuguugggauaucguuuucauuuuucuguuuagauaaccauuucugcaaaugacaguuuucuuauuuugacccauuuuucucccauuuuugugccuucuagaacuucuagccuaaugucaaauaaauagaaaaaucaacagugccaucuuugccacguuccugauuuucaaaagaauacuuccaaugagucaacauuaauauuugugucacuagagauagauuauuaugaguuaaggguuaaguaaauuuuacuuauucuuaugauuuuguuuuguuuuguuugucaugaaugaauguagaauguuauuagauguuuucuuugcaaauauugaggugauuauguggcuuuucucuuacugcauuaaacaucauaaccaaauuggauuuauuaauucuuugcuuagaauuaauuauaucuguguucaugagugagacuacaguaauguccacuuuucguuccuaauauuauuuuauuuuggcuuuuucucuuuuuuaaaucaguuuuuaccaagauaucuauucucuuagucuuuucugaguacuuucuucuuugauccuguugaaucuuuguuuucuaauucauuuauaucuccuuuuaucuuuauuauuuucuucugcuuccuuugaguuuauucuguauuuauugauuugcucaauauauauuuuuucuaauaugagcagguauagccauaaaacucuuucagacuaccacuuuugguauauuccacaaauuuuaaaagguacuacuuucauuaauguuuaaaucugagugucucucaauggaagauuugucuucucguaauuucauuaguuuuuuuugguucuuuuuuuguuuguuuguuuuguuuuuuuugugguuauuguuuuuacuaaccaaguugaugagggaaaugaaaguaguucaagaguaaacacaucucaguuucugcccugaagugauuucugacaauuuuauucaguuuuguacuuguauuuuacacaggagaaauccacucauccauucucuucacguguccauuaaugucaguccuuccuagucugucuuuaaagccccuaucagcuagauacucaguguccaacaguccugcugaugcuacuuuuagaauucuggcccaguagaguauuucuuugauguaaaauuauuccucuucucuguucucaggucgcuuaugaugaagcuacagaugaauuugcuucuuacuucaacaaacagacuucucccaagauucucaucacaacaucagauagaccucaugggguaaacacauugauuaauuuaguucuugaauucuuaauuuucuuauuacuucuauuuaaaguacucuguucagaagaguuaaaccauuaguuaauugccuuaaagaaugccugugacuaaguaaauaaaacguagcucugguaauaugauguagguuuacuaaacaugauucuucaagauaggauuucucaaccucaacauuguuaacauuuuagcuggagaauucuuuguuauggugagcuauccuguucauuacaggauguuuagcagcuucccuggccucuaugcuuuaggugccaguagcaaccacacaccacuaccacuaccaucagucauaaccaucaaaaaugucuccagacauugccaaauguguccucugauggagcagaaucgccccuaauugagaaccacugcuuuaggaugaucagccuuugauaaaagaggacacacuguucgaguuucaugcuuuccucaauguugcuuucuauuaaucauaauaauuauuauuucuuuccuuaugaauauguaccacauaagauuuuuauucuuuuuugaaaacuauucaaaauuuuuguuauuuuguuuugcagagaacaguacgacucugugaacagcucuccacaguuauaccaaacucacauguuuauuacagaagaggacuggcucugaaaaaaauuauuccacagugcaucgcaagagauuucacagaccugauuguuauuaaugaagaucguaaaaccccaaguauccuuuuuuuuuuuaaggagguuuuccuguccucucccucaccccccuuaaaaauauauuuaaaagaauaaggaaauauugccuauaacuuucagaaaauaauuuuuuuaucagaaaauuguaucucuuuccaagagucuauaaacugauuuuuccuuuguauucaccaaacauuuaucaggcacaugcuacagccaagagauuguuguaacucuuaguaaaagaugcagagcuaaaacaagagacaaccaggaaauucauagguggaguaaauggauauguaaacugacaaaauauaguguggaugguacaauuaaauagagaaaugcaggauauaguggggacccugugacugguacaaagucugcccugggaggaaagacuucccauagaaagagaugcugaagcuggaucuagauggaugagggugaaggaggggaauaaggcagagaaaagcgcucagugcagagggacuaccauuuggaaagagaggaaggaaagggcugaccuaguuggggaucugcauaugguuuguuguggcuagauuuuacauugccagaggugguaucacaggauuaaguuuuugagguagagacuugggcccauguuauguguguguuccagucuaaaacuuuuucugugagucucagaccugagaugaaugugucaccugaacccaagguauuucuuccuguugagauaagagauuugauaaaggauaucuagguuuguuauuauuguugcuguuuuauuuauuuauuuauugaaugauggcuaugaguucaguaaccuuaaagaugaccaauugaaugagucaucuuuaugauuuuuaauuucauuaaaauaaaauuauaaagaauuuacaaaauagggacaagacuuucugugcugccagaauaacauuuuauuucuaauaucagugaacacucuauuagugguuuaaaaggcuguuuuuaaaaaaucuaacuuuuaugacuuuaauuguuaucaauauaacuuacuuuauccacuuguacuaguagcuuuccagaaacuacuauaacaagcuuuguaauguguuuuguuggccauauuauaauuuggcuuaacuggauuaauguaccaaaauaucuaaaaucucuugaauacuuaacuacuccagaaaaaaauuauuuuuaagguaguugcugccucuuuuucuuuuuuuaaacugccuccacaaaguggcaaggucuguuuuccucuuuuuauuuuuggcaguuaaaaaacaacugucaucacuuugaggccacuaguaacucugcuaagaagcaggcauucaucaauucaauaaauguucuaucccuguuuuauccaggguguuuuauauagucacacaaauuucacuuauaccaucuauugccuuuaaaaaguuuacauuuucuggccggaugcgguggcucacaccuguagucccagcacuuugggaggccuaggccagcagauugcuugaggucaggaguuugagaccagccuagccaacacagcaaaaucccaucucuacuaaaaauacaaaaauuaguugggcguguuggugcaugccuguaaucccaccuacuugggaggcugaugcacuagaauuacuugaacccgggaggcaaagguugccaugagcagagauggugccacugcacuccagccugggugacagggcaagacucugucaaaaaaaaaaaaauggugauuauccuagagacuuagcauggguucaggaauaaaaaucacaacuccuaauggugacacauggggggaaaguugaaaaaacaggauuuagccugugggaaaguagauucuaggaacauggcgucuuucuaaagaccauuggaggggcuacuguguggaagaguagugcugaauggugaaaguuaaagggauauacuuuuuugacuuauucuaaaauagaauuucaucagcugucuaaacuguagaaaccuaguaguggcuuugagucagggcagcugugauaucaaauacagauuccauuauuuucuaguuuugugauuuuagucacguuucuuagccacucaauuuccucguuuuuuaaaugugggaaauaauaccuaucuuuagaguucccacaaagaucacauuaaauguauuauguuuauaaagcauagugucuggcacaugguaggcauuuuaguaaacgugguauagugagaagcauguaaacuuuaucuguacagaccuacauccucuauucauuauuucuaaauggggaacuacuguuauuugagguaggguaauuauuugugcuacacucuuggcagcuuccaagaugguuugcauuccuggccuuuggauucuaaaugccaguaacaccucagucauacugacaaacaaaaugccucuguacauuuccaaaugugagcagcugucagcagggggcuuaagcuaggugcagucccaccgugguugagaucugcaguugccuuagucugauuuacuuaggcuaauuuacuugacccucuucagccucuuuuccucauuacugaaauaggcaugaugacuccuguuuuaugugauuuguguuagggauuagcaguaauguaaauaaagccucuugcacaaugcagguacaugggaaaagaaguuauuuagaaacugguaaguuuggguuuuguacuuggcuuuugacacagaccacaauuuagugggaauguucuagaaaggauuuaagccuugauuugggcguuggaagaaaugacuuuuauaucuccuagaccccuuaauaaauacuuuuggcuguauuucaugaaguuuagccuguggugaaucuuuuaaaaugauagaauucaaacguuugcugauaaucugaugcaugguaggcacuacuaucaaaaaaaaaaaaaaaaaaaagaucugccugcagucccagcacuuugggaggcuaaggcagguggaucgcuugagaccagccugggcaacauggcaaaacccuuucucuacaaaaauuagcugggcaugaugccuguagucccauuuacuugggagguugaggugggaggauugcuugagcccgagagguugaggcugcagugacccauggucgugccauugcacuucagccugggcugcugagugagaccgucucaaaaaaaaaaaacaaaagaaaaaaauucccaucccuaccuaaguuuuaacagauuaguugggaagaaagguguuuuccuaacucaaaaagugaugagugcugugguagcagaacugagaagauuuagaucuuaauucugacuacauaaaaaggugacauuugaaguagaccauaauagaugaguaaaacguugcagguauucaaaauagcagaagcaaaaaaugcaugcuaggauucacauauauaguacauaagacugugaguaccuaccaguuaggaaacaggcuugaugugggcauaggguaaauagguugaaaagguaauuuguggccacauuaugagucugauacuaaugucuuuuuucuguagaugagucugugaugagaguaguaugaaauuagcuacagcugucaagacugugaagguaucuaguuuguuuuucacuuagcaugugagaaacuaugguacagauauaaugaaacagcugagucccauagcugguuacuuauagaaccaaggccuaaguccagacuugauuuuacaaucugcauuaggagauguacuugagauggugagaaaaaggucagaccaaccacaauacuaccuuaauaaucuagguggaaaaucuugaggaccucacuaagacaguaaggguaaagaggaugcuaagugagaacuucugaagguaaaagcaguuaagauuuggugggagagggagaagcugaagauaccauagcuucuaaucuggaggaaugaguguugaugccauuguaaaaagauggcaacaucugcuuugaaagauacauauuaaaugcagauagacuugaaaccaucugauucuggccuauuuaaguuguugaaucagaugaaauguguuugaaaauuucuccuaaacuagaaaagcauaauacaaagugaaagcccuguccauugucauuaauaugccugcuuguaaugccauuaagcaauagccaagaauuacucaugaaaaguaaagguguuucaagugaaggucagauugugccacaaacuugaagaauauuauauagguagcaaccuuaguuugcagcacccaggacuucuagaguccuugggcugcuaguccugcugguuguagguaggugaucucacauuucauuuguaguuuagcaugucuagcauaauucucaguucaugggaaaugacagucagugaauggcuauuaauugguuuguugauuauaauuugggguacaguaauccuaaguaaggggugaucucuugcaaaauacuaauaaccuuaauuucauagaggaaaguuuaggagucuggucucaugggauguuauucaaaguugacagcauaucgugaccauacaaauguauaaaagugacauuuugggguuauacaucuuuagaacguggagguaaacucauacucuauuugcaguguuacaugauuauagaaucacauccuauuuuacuccuaagaguaguggucaauuaaauagcuuuuuuucaccuacuuuaguuuaggguaccuuaagauacccuauugagcgugauuaacuauuauauuguaaaaagagaaaaaaaggacuacucuagguuagucuauauucuugaaagauuuugacugauuuugagcuuuugauaugguaggaaaaugucacuucagaggaauauguacaucugccuauucacuuggguacagauuuuaggggccuuuggauguagaggaccaguuauuuaaacaauuagauuuagauuacagaguucaauguguuuuucuuaacuuuuaugaacagauggacuuauuuugagucacuugccaaauggcccaacugcucauuuuaaaaugagcaguguucgucuucguaaagaaauuaagguaaguuuuauacauuucuuugauuggcauugaucucuucacaauauuuauuugaucaauagaugcuguaucuuauagcucuaauuuauuuuaauaauggcauuuguucuccugauuagagcaguuuuuaaucuaucaauucucuugggagacugugguuaaguuacagccggcaggcaauagucuucauuacuaugaagcacguugauuuucuaauaggauuuuuuuguuguugcauucagugcauauuaaaauaauuuuagauacaucuuauuucauggguuugauaagccaucugugguaguuugucacuaaaaaauacauuuugcaaauuugucauguaaauuuugauacuugaaauugcauugggacguauugccaauuagcuuagcccauugugauauuuauuuuucauuauuuuucuagagaagaggcaaggaccccacagaacacauaccugaaauaauucugaauaauuuuacaacacggcugggucauucaauuggacguauguuugcaucucucuuuccucauaauccucaauuuaucggaaggcagguugccacauuccacaaucaacgggauuacauauucuucagauuucacaggugaggaagguaaacucauugaacuuugauuucaauuaugaaauauauuuucaacaugaacuaauuuuccaacauauuguagcaaguaucauacaagauaaaaugaauuaucuuuugaacccugucauaauguuaaacaauagcucauucagacuaauuuaacucuuuuugucuuugaagauacauauucaggagugaaaagaaagugggaauucaggaacuuggaccacguuuuaccuuaaaauuaaggucucuucagaaaggaaccuuugauucuaaauauggagaguaugaauggguccauaagguaugugcuuauuguuuaaaaagacuaagucauuuuuaaaguaugggauaagagggugggaggagagagagcaucaggaauagcuaauggaugcugggcuuaauaccuaggugaugaaaugaucugugcagcaaaccacuauagcacguuuaccuauguaacaaaccuguacauccugcacauauacccuugaacuaaaaaaaaaaaaaaaaaagauacaauaucugggucuggugauuaaccuuggcucaucugaaguauaaacauuagugguucucaaagcgagaccagcaccauuaccuaggaaccuauuaggaaugaaaauucuuuggcccacagaccuacucgaucagcaauuuagggggugggacccagcagcaaucugcuuauaagccuguguuauaugugacucuacuacauguuucuugagaacuauugauaaguuuucuuagaaguuuggagaucaucaucuuaaaucauaaaugaaaacuuuuuuguuguuguuguuuuguuuuuuuugagaugagucucagcuuuguugcccaggcuggagugcaggggcgccaucucgacucacugcaaccuccaccucccggguucaagcuauucuccugccucagccucccgaguagcugggauuacaagugugcaccaccacaccggcuaaucuuuucuauuuuuaguagagaagggguuuccccguguuagccaggauggucuugaucuccugaccucaugaucugccugccucagccucccaaagugcugggauuacaggugugagccaccgugcauggccuaaaacauccuuuucuaucuaguauaagcaguacuucacuuaguaacauuuuacuuuaaaaucacacacacacaguaacugccaacaucuuuuauauuagaccgaagacugacuauucggggucucgcacaaacccgguuuuucagcacuaguguuacuuaugaagaucuagggacguuaacuuuuacugucuuaccugaauuguuaauuauauuuuuguuuuguuuucuuccuccacucccuugcuuuccacuuucagccccgggaaauggauacaaguagaagaaaauuccauuuauaaaguacugagagaaugauauuggauuuugcugaacaggccuaucuugaacuuugguaaauuauuuuugacagaauacucuuuucaaaauggcauuugcugauuucauaaaccuuucacgucuggacgaauuaccaaaugccaugaauugccacuguguguuuauguagaaaauacaaauaaaaguuauuuugauggcuuagguuuccuuaaacuuaguucucuuguuuuuggguaacugugaauaauuaaguuggaaucaagauucagauuaacuuuccuauuugcauagaacacaugagaggaauaaaaugguugguaaauauuggcuaacccuugauuuuuauaccagauuaaccuuggauucccagugucuggcac

SEQ ID NO: 13869 - RNA, 160520 nt, Homo sapiens
auacagucgggccagggccuggccugggcgcgcggcugcccgggggcgcgcagagagggcggaccgcgcgaagggggagugucugcccgccgccgccacugcugcugccaccgccgucgccgccgccgccgccgccgccgcugcugcugccggugcuaaggaguucgcuggagcccuuuccucagacccggcccggucuucgcgcccggacuccuggcgccagcgcuaggcgcacucaccgcucugacgggugcagacgcgggaguugucccagacuguggaguggcgggcacggccccagccccccuucccuucccugaccccuucuugccaucgccccagacauggggaacgcggcgaccgccaagaaaggcagcgagguggagagcggugaguugaaggccgggucuggguauccgcugggcgggccggcgcggggcaccgagcgcccuccgggucgcagcuucugaggccgcgggcacgggccaggccuagcagcggccgccgggagucguucuggggggccgggagaccagcugccuuucuccuccauuccgaccccccagcuccgcguugagagcugaacgcgaagggccggauguggggauccugggaagagcguucccugggauucccuuucucacucuagcgaggaggacuugcacacguucuggaacacuuccccaaauaugguccgaggaaagaagucccuagugccaucccaccccugcuuuccccccucgccgacucuuugggagcuacagguagugcuguggguaagguuggcucuucucccuccaucacuuggguccgacccaaccuuaucacaaggcgggggcugcuagucuggcucuacgcaagugaggcuaauccugaguggacaacccugccuuagagauccuucaucucuucagauuaggaauggaaaacauaaugagacccaacagcaacuuuauccauuagagaaaaaagccaggcagguuugccuuuucucuagacauucaaggaucugcuaccaaugccuguaaaacuuaaaggucauucggaguugaagugcuuccagaacacgguuaauuucuucugagagcggaaggugcggguacuccacacuuuacaucaaacaguaaaaaaucaugaaaauggaauuucuguauggcgauaaggugugugugugucuguguguuugugugugcauguauacacaugcauauauauguguguauauaugugucagaaugguugugaaauaaaaguugguuugccuuuguaaaguucauauauuuuuauaauucagaauguccaaauaacagaugguauuuguuauaucaccaggagugaaugacauguuagcacuuaaagugggccuggugauuuuaguuuguguaaauauuacuuguaauguuuucaugguuguaacauaagaauuaggcuaauuuuauaacuuugcaugaagaaaauagcuuuuuucuguauuaauaaaguagaauucauuuagaaggauuuagucauucauuuuguuuaacauaaauauaucagauuaugugguuuauguuucaucaguaagguuuugguauucauuuucaggagcuucagaaaaguuugaugagcuauuauauaagccaagaacacacagcauguuauacggagauuuaaagaagccaauguagagguagaauguauguuauuuuauuauuauuuuuugagauggaguuucguucuugucgcccaggcuggagugcaauggugcaaucuuggcucacugcaaccucugccucccagguucaagggauucuccugccucagccuccugaguagcugggauuacaggugcccaccaccacacccggcuaauuuuuguauuuuuaguagagacagaguuucaccauguuggucaggcuggucucgaacuccugaccucagguaauccacccaccucggccucccaaagugcugggauuacaggcgugagcuaccgugcgugaccuauguugucuuuuuaaaauugcacaaauauaguaacuaacugugcaggaaguauaaagaaugcaaaaaguauaaagaauuauuuuuaccugauauguugucauuuuuuguguuaauuuaaagcucuauuaacuuaaaacaugcuaauuguguuacaaaagagugugcuuggagaaugauuauauuaguaguuuucauuagcaagugcugaccuguauaauguuuauauuuuggauaaugauaauagacucuucugugaccuguauauuuuuuauuaaguuaccaaaacaauucucccuuaguauuaauuugcaacucauagcugugaaauaaccuuggaauauuuacugaaaacagaauggaaacuuuaaauguuuaucugaacauauuuaaauuauuucuauggauaaauucuuuucuauguuuuaaguguuaaugacaaucuaguucuuaaguauguuagucagcuuuuuguguaacuuuauuuauggaaacugaaggucauuauaguaguuuaaaaagcuguugugaagugaccaaaaaaaauagcauguuaugugucauagggaaaauuauuugaaaugucacguguugauuaauguuuguaauuucauuuggagcaguguuaucagguauauguugcuguucuguagugaacaaagaaauuguauuuuaaacuuaaugaaagaacucaucauuacguaccuaaauguucuguguauuuuuuaaagaauuauucuugaaaauuuguuuuucaaaacuuuuagaaauauaugauguuagagaucagccuguacaaucauucccuuucaaagauccugaccuccgaagaagcuggaguugagaucauacuguuaguaauaacagaguaaggaauagagucugaugccuggacuccauucagcaucaauaaauaaucaguuaauauguuuauuuucaaaauauucaccaaauguuuuaguuucaauuaaagacuauaaguaaaagcugaaaaauguuacugucuaaugggaaagaaaauauguauauauaagaguuaccugaaaggcaaaaauacaagugcuaacauuauggaaaguggaauuagaacucugaaaauugcuguaugaaaauguuugauuugaaaaguugauuaaaaauaucaagucaguuaagauuucagguucaguuagcaccaagcuucagaaaggcaggugauuccagagcuuauuucuaaaaauauuccagaagaaugaaguuaggcauaaagauaauuuagaagggucuugguuaacuuuaacuaucuggugccuguauuguacucuacugaaccuuuucccucuauuagaauuaacauuuucugggguaagaccuaaaagcuaggugagauuccaucuucaucuccacagguuuuggagauaacauuaacuuagguaccuguuguucugcuguagugaauuaggaaauuguauugauguaucucaaaacuuaaugaaagaauaacugguacuauuacauaccuaacugcucuguguguguuuuuaaaauuacucuugaagauauauuccuuuuaaaauuugggcguaguuauuuaaacgucagcuaauacagagaaacauaaacuuuuagaaauaugauaaaauucucagagaaguuuuaaacucuugucaguuaaguuuguuuuacuuauccagucucuuccuuuuacaccagccccagucaccaacacaccaaaaaaacacgcuacuucuuuuaaccugggagggguuuuuauuuauuucauuuuaaaaaaauacuauaccuccagguugccuauggggcuuuguguuauacauucauugcaaaaauguugaggcccaugggugaaaaguguugguagagguuugaauguagauucuuucaugacugcaagucguaaaguuaccaugugaccuaguguucgcauaugaucuuugaauguuuuccagaguaucucucuguccuguggauuugaaagucaguaggaauuaaucaaagaaagccaccaguagacuagguucaacaaaaaugcaaguuucuuaacaacuaacauuuuuugaggacuaauacgugccagguucucuaaugcuuuccguguauaaacuuuuacuuacucuuuuaaacuguaaagcacuugaguuauuccuucauuuauggaugaggaaaugaaggcucagagagccuaagugacuugcuuaagguugcauagcuaguaagucaagaagcaacauuuaaguugaggcaacuguaaccucagaaccugaaauucuaaccacuuugcugaacagccucuguauccaauagaauagccgaugcuaagacacacagaauagcuuagacaauuauagcacauuucaguuuucaaacaugacuuuauuugguauauuaaaaucuuaagugaaaaagauuauuuuuuucuuguaccauucucuggauuuuuaucaucauuaucuuuucagauucaauauaguagaauuucaaauuaaaccacauaaaacuaauuuuauguacuuaaagccuuaauuacuacaguacuuauauuuauuuuuucccauuuguaaauguauacuuuucccuucuugcccaauaguugauaaaaaaaauuauuauuugaacuuguauuaccauuuuaaaaguauuggcaaauucucauuucaccaugauuagaguagcgcuguccagucaaacauucugugauaauggaagugaucuccaccuaugcuguccacuguaguagcuacuagccacaugucuguugagcacuggaaaugugacuaguaccacugagaaacugaaucuuuaacuuacauguggcuaauuaguguuugguauauuggacaacacagguuuagaacauaguuguuuuugcauuuaauagaaaugccaacccaucuuucugucaucuugguuauuuguggauccuuacaagugaguguagaugaacggaaugcuggauuuauuuuuucucauuuaagaauuaacuuauuuccucagaauaagcauuuauaaacuuagugagcaaauuauuauaguucaauaauuuguguuuaauuuauuaacuacaaaguuaaauuauuuuuggggcuguacuagaaauaaaauuuugugauuuuuaguaaucucagugaauaucuucuauugaaaaauuucuguagauuuaaaugcaauauagugauuucuuauaccuuacuuaggucuuuacaccuuucaauuaucaaaggaaaaucaguagcagauauuuguuccaauucuguagaaugcagagguacuggggaagucuuucuuggguguaagacaaaaaaaucaaagcaaucaguuaugcaauuuugaugauaaauacauaugaucucaucgaguuccaugauucugugauucuguuugugcagauuguguacuguaucaaauuaucucauguucaggaaccauuuuucuuauucuccuccucuuauucuccucaguguccuucacuuaggcuguagacagauuguugcuuuuucauugccagcagcaggauaauuagaggcaugaaagccagcuuagaaaaguaagccauggcugagugacagaagcagcacgugagaagguccuagauaagccaggauagcuauuaagauccugucagauaauuaauaguugaccauaauucauuuugacauuccauuaaauuaauuuuuaaaaauuaguacaacuuaugaaguucuauaucuaggugauaaauguuuguauacgugggugaucaaauuuccucagauuaauaaauccuaaauucuuagugaauaacauuguguuaaauagaaaagugugaaauuuaugaaagguaaauaugcuuaggucacuaucauuuuggguauuuaaucuuacuuuuaaauguauuccuucaagaauguccuguauaguucuuuguucauugcuucauucauuccuuuauucaguacacauaauugagcuccuaaaaugugacagacucuacacaagacuaugggaauaaagauugaauaggacagaguaccugcucagggugcccauauuccagaagggggaagauagacaugucagcaaacacaugaaaccugccacaaauccuuucauuaaaguucagcuggggaaccaagggaaagaauggucauuuccacugggauggggaggaagagguucaaaaaggacuucaaagaggaguugaaccaugacuugagcauugaaaaugauaaauguucaucagauggauuauaggaggaaggguguucugaguagaccgagcauugauaagugaagaugcagaggagugaaaccauguaacauauucaggauaaggaaguaaguugcccauuaugauuaaaugauggaaugugggguuggugauaggaagaggggacauuguauaaugauagaugaaacugaagaaauggacagagggccacauaauggagagaguuugaauuuuaucuuuuagacacuagggagccaucgugcacuuggaaauaagagagaaacaugauacaauuuggguuuaaaagagguuacuuugguggugaugugaagauaaaucauuauggagcaaguggaauagaggcaagaucaauuauaagacuccuaugauaauuugggugagggauuuugagggucugaaccaaggugguagagguugggauggagaaaaggaucugaaaugggagaaauuugaaaaauugagcagaauguauuguacugauugcaugugggaaaugaggaaaaggaggauuggggaugacacguuaaguuuaagcuucaaugccaugguagauggguuguaacgccaguaauagagucaggaaaugaauacagagggcaggaguacauuggggguugggguggggacuuacugaacucgggauacccguggcauuucugauaaaugauagcugauugguuauuguauguguggauugucuuuuaucucccagccaugggggaaaaugcccuuggauggucaagggaccuuuucuacauuuuauccucauuuuacucuuuucaaagacaacuguuuagaaacuauggaaacuauaacaucuggcauaacuuacauaaguuaagaauucuauauacuaaaaguuuagccuuuuuguuuugaaaagaggaaagccaaaguacugaugagaacaauguaacuuuuaaggaaacaaaguaauuuaaaaucauaaaauauuacuuuuauaauuuaagugugcauccucuaagcuauucgguuuuguaguuauacaggauaguggaaagaacauguaaaauauagcaccaacaucuauuauguacugaguaaaugucaguuuuauuccccuggaguccuuuaacauagauguuuaaaaguucagauguaauuuaguaguaaaaucauaaacuugagaguaagaaaaaucuaaauugucuuuuuucuaauacauucuaauaucucacuuuggacaaauguuuuaaaaucuccaagugacgguauaaaaucaagagggauggauuggauaaugacacugugaucucuucuuccagcuuuauaauccaaugcuucuauuauauuuauuaaaagaaaaaauacacaggaagcagcaagaugagggaauaaaucauaaaaagugcucacaaaaugugugggcagagaaguggcaaaugauccucaauugagcaaauaaauauaugguaauguauuuagggaaaacuuuugaucuacauuuaaggaaugauaguaaaggacaggagugcccuugucaggcagggagggcugggcugugcaucccucugcuugcgcugcagggaaaugucucagugacuuuuccugaggagguuccuggccucagucgucuccaggaagcccucucaggaucgguggccaccucucacuucuggagcccugcagaccccacagugcaguccugguggccuggcuguaacacccaacucagcccagaccauauacaccaccagcaucuccucaaugaccauuaauauccaggauggaccugacuuucaagaccaacagugagacgccagugcuuguggauuuccacgcacagugguguggacccugcaagauccuggggcugagguuagagaagaugguggucaagcagcauaggaaagugcugauggccaagguguauauugaugaccacacagaccucgccauugaguaugagguguugguggugcccacugugcuggccaugaagaauggggaugugguggacaaguuugugggcaucaaagaugaggaucagcuggaggccuuccugaagaagcugauuggcugacaagcaaggacaaguccugguucccuugcccccaugggaccccaguagaacuuggcccuuccugcugccucccuccugucuggccccuggggcccaggcuccagccaugagugcuucugagcuggcggacugcccaggggccaucagaagauggugcugcugcugauccggggacugccuucuucccucccacaugccuuucguccccucccucuagggccuguggcaguucucucaagaugcauagagagagcccaggccagcccacagcacuccuggucaggcagccacaccuugguccucaucucuggucccuuccgaucugaagccucgugccuggcucuucugccaccugcauuucucuuucuugcugcuguuuuguaaaaagaaaaagaaaaaagaagcccaaacuagugagaauaauuuauaacucucucgguuuuuguaggucuguaauaaagaacuuagucaucccaccuccuacugugaagagcagacccugggucccacacucaaauccccuguaguugcccauccucaccccucagggagcccccucccagcuagccucccgggcagggggcacagaaaaugaguggugggcuggggagcccuggagagccuugacucuguaaggcucgaggcaccuccuuugccccuuaacuggccuguugguccucugagcagggggcuuaacugugaacaaaucagacaauaaagcaagggucugcaccuaaaaagacaaauuuaugaaucacuguacugaucuuugaagauauuuucauguucuacuacaaguaaaggagccaucaaaauguucgccaucagggcagagucuuggaaauaaaacaugaaacauucuauucuuaugugaaaccauuaaugugcuauguguaguugugguguuuuguguauagcagaaccagagaaaguuuagaucagggcagcuaacaggaguaagagcaugggaagucuauucugugugaauaaacuguauauauacauauuucauuuaaucuagaaaaauuaaaguuacaugauuaaaguguauaaaaucaaguggcauagacagaaaaucugggauugcucaccuaaacuugaaacacuagaacucauggacuauucuuccaaacuuauaaaagcuagcuguagaacaaguaaaaugaauuaucguaaaaccuugauauagacugggcuuagacaauaaauguauuuaacugauuagucauuuauguuuaaaggugaaacauguguuuacaaauucagguaguauuuuuagcaauuucaaaagcuagauaaugcuuuuuuacucuuuaaaauaauuuuuuauuuuuauuuauuuauuuugaaacagaguuuuacuguguugcccaggcuggacucaaacuccugggcucaggcaguccugcguagcugggacugcagguguguaccaucgaggcuuguuuuuuuacucuugauagguuuuauaaucucucuagcccccagcacuuuccaaaagaaucaucaguauuuauaagauaagucuucuucuugcuaauacuaagguuuacuacuauuaugcaaauaaauuguuuccccgauauggugguauagcuuaaauugcuuuuaguggauuucuuuauuuuaauuggcuauaauuaauuuauucauuuaguucauuuuuauucccuagccagugaaauagggaguaaagaguugucuucauguagcuuauagucugguaaaagauuuagacaaguaaaagcacaauuaugagaauguuguaggaaguggauuauaggacguguuuuuuuguaaugugaauuagauucaguaaugcuauguaucuaugcagaaaauuuuccgaaucaaauucgggauucuuauaaguuaaauugauacacuagcauaauugguauuaguucugccuucgaaaauccaauguagaugccauauuuuuuaucuggccugauguaacaagguauaaagucccaggcucuauggccauaguuuaauguuauauucacuguugucuucuauucauauguuaacuuuucagggacaucugaaacuuguuuuguuguaagauaacuguggaaucuaaaccuuuaggucucugacaagccuguuuucucgaucuggacuuuguccuuagaaaauuaaagagacuauucuugugaucauauuaguuuagaguccuguuuaguaaaaugaauauuccauuucuauacuguauucuucuuaaguagaugaccauauagcaucagcaggccauuguuauaugugagccacaaacuugagagaacauguugguauagauauuacuucuuuuacaggggcuagcucuacugguaacuuagcucuuucaaucuuagcucagcucccucugaguaggagccaugacagguuaaacuguggaagaauaugagccucacuuuaggcuguagucuuuaggucaugaauaagccauaguucaauucauagaaugacaggcaaaacauucacuuauuugucuuucauucauucuuaaucaguacuuauugagcgccuacuuuaaaccaggcacuaugcuagucuguagaugcaaauaaaaauaagacuugguuccuguccuuaaauugggagacagauacagauauuuauaguaaggcauacaaugauacauaggugccugagauuaauacuagggugaaaauguagcauaggaguuuauagaggaguaguauagaauuucugagaucaucuugggaaauagacugaaacugacugaaauggaaacuuccuuugaguccauuuuggaaauauuuacaucuauaauuguagcacuuguacuacauugcuuuuucaacucuuauacccacuacagugugaucuggcaaagcagugucuauguuguuuaguguuuuaaucucuggaauguggcacaguucuuggcucaugucaugguggaagcuaaaaucauggauaguuaaauggaucaaaaauucaaaccuccuguagaagcguacauccuccucccuuuccuccauuggcaggaacuuugucaguaauguauugacuauuuggggauaauaguugauuaaugugauaagaggguaccucuuuccccccuuuuuaugguauauaguaacuucuuugacauuuacauaucaaaauuauaucacaguugguauggggagauuggucucaggcagguaggaagaagacacuggacuaggaaaaacuagaguauuaugcucccaaccuuuugaaaaauuuguuauucaaggcauguaucauucaacugugccacuguguuucucauccuuguugcugucauuuaccagucucuugcuuacuucuuauucaucaaauauuuuggcaucuggcccacaauguuucucuauacucuaagcucugcauucauccuggaugguuucaaauucuauguuaaugacucaucuaucaucacugcaccucuguucuuugaccauguuaucuccuauuccccuuuuguucauucagaugucuagucuugccaaagaccuuguaauauucauuaacugcucaagaaucaccaaugugugugauucuuugaucacaauuuccucuccuuuuugcuugcuuuuuaaauauucccauuaugaucauucuucaucagaaccucucauccauuuauccaucaguccucucacuuucauuuuuucuucuuaaccauucuagauuacuuggucccaaaauuccuuugcacaucugccucuuuaucaaaucucucuaacaaaaauguaacucaugauaaacucagcuaugugcuuucucagugcuuucagucaagagcuaagcacugcuagagaaagcugcacagaagaacacuagaaauuuacuaucaucaaccucaaaugagcugucaacaugacuuuacaguuuuaccacauuucucugaucaacucugucucucauucuucacaaguucuauuucauuucucucucuuuauaccucugacuucuccauuaucucucucauucuaagucaugauauuaugucauauuuuacaaggaaaauaaaagcuaucagacaggaaccccuuuaacuucuuccuauuaaauguucacaccuacuguauuuuaacuugaccaucuuauucuguuauaauagaggaguugucuguuauauuuaucuauuguuccaucaugcaggacuccuaaauuuagcagcuuaaagagugacaacauuuauuuuacuuaugaaaguaaguaauuugggcagagcucagcuaugcacucuauaugacaucagcuaucuuagcucugcuaauaaaucacugcuaugguuuauggggacuagaaacacaugaagccuugcucauuuacauguuucccuguugaugcuggcuguacagguaauuugaaccuuaccugggacugucagcugaagcaccuacacaugaccucuacauguggcuugggccccauaucauguggcuaaguuccaagaaggagggagagagccagguauaagcuguaucaccuuuuaugaccuagccuccaaagucaagcagugucacuucagcugcauucuguuuguuaagugagucacuuaaaugagucuguaucaagggaaguugaauuagauucugcacuuugauggaaggaguuagaaaaauuuggggacauguagaaaucacauuguacaucuuucucugcaagcccaaucacuccacuauuacuuuggaucccaaccccuccugcuuucccaggagucuuuguauucuuaucuuuuauauguauaauaauaugucuucucauuuauuuaaaaaacguguaccccuuuucccuucacuuucaguuuucucuuugacccuacuuucucuuucccuuucucaucgcucaccuacuaaagugaacuggccugugauuuacaguaugugugaucaaaucaguugacuuuggugcccaggcagguaauuuuaaugugucuuggguaaaaccugagacgagaagaaagaagaaagagaaaaauguucuuuuucugcucuugcuguauuauaguuacuuacaaucagguuacagagaacuuaaucagcuuuuagaauauaacauguuugaauguuguggucugcauauuaauauuuaaguauuaacuugaaguuauaugaaguauguaacaacauaaaaaaugucaaacuggguuacaugcacaaccugguuuaauauauaagaaccuaauuucuaaauaccuuuagaaucuuugaccuaacaauuucuugguucuuuaugauuagauuuaacuuucuuguuuuuuugguuuuuguuguuguuguuguuuugagacagggucuugcuguguugcccaggcuggagugcaguggugugaucaugagucccugcaacugcugccuccugaucucaggugaucccucccgccuuagccuccugaguagcugggacuacaggugugugccgcccugccuggcuaauuuucguauuuuugguagagaugggguuuugccauguugcccggccuggucuugaacuccuggguucaagcgauccacccaccucagccuuccaaagugcugggauuacaggcguaagccaccacaaccuucuuguucuauuacucacacaaguuuagcaugagaaauaaacacguuaaugacuucuuaucuuuaaucuuuauuguacucaggggcaucagugacccaaaaaucuucaaauguuuuuucgcagugauaucuguaacaauaacagugggagccauaguggagguagagugggcagaaggaaacuuuuuugguuuuuguuaugauugguuuuugucguaaucuacuuuauaauauucuguguaguagaauugagaaacuauguuacaguaguacuauuuucaaguaaaaauuuaauugaaguauaccauacauuucaaaaguauucaaauccuaauuuauaggcuaaugaauuugauaaagugaacacccaugugaauuuucacccauaccaagaaauagaauauuacugaaaccccagaaacuucccuccugccuguacccaaucauugcuagauuuaaaauguggaauacugcaucauguuuuccuuugugacugccuucuuucacuuauguauuugugacacuuauccauguuuuugucauagcagugauuuauuaauuuucacagauauauaucauuguauaaguauagcaaaacauauuuuuucuaugguugauguaaauuuggguuguuuccaguuuggagcucuuauaaauaaugcuuugaacacacuuguacaugauuuuugguaaauauauguauguuuuggugaauauguauuugaugaauauguguuauguauacacucauacauacaugcauauauacaugcauaugugucuuugugugugcgugagagagaaugauguugaauuaauugcuggauuucugggucacagaucaugugguucugguaaauaccaccaaauaaauuuucagauugguugaaccuguuucuaaccagcagugcuuaggguuuuagucgcuccacauccuucccaaacuugauguuuuucauauuucuaauuauaccuauucugguaaacauuuccugguuauaauuuguacaucccuuaugacugauaguguugaucacuuuuucauguugguauuggucauuuggauauccucuuuuuauaaaauguuuuuuuuuuuuucagguauuuccccaucccuuuuuuugugguauucuguuguauuuuucaaaaaaauugauuuguagaguuauuuaacauggguacaggauuuuccccccagacguauguacuacaaaugucuucuuccguuucauagcuugccuuuucacuuucuuaacgaugucuccuucauacuguuuaauaauuuucaaacguacaaauaauuuacaaaucauuuccuuuaugauuuguguuuuguuuggccuuccucggucuucuuuaagaaguucucacuacccuagggucauagauauuuuccuauguuagguuuagaagcuuucuuuugccuuucauauuuagaacuacagucugucuggaaucaagugugugcaucucucucucucucucucucucuguguaugcgcuucuguguguguguggugagguaggagucauuuguuaauaucaguauuuauuugacacaucaccauuuaaaaggaaaaagaaauugucccuuccccaaagcacuguaaugacaucuuuguuaucaaaggcugaauauaucugguuuccuucuuuucuguuccauugguuuugucuauuuuagugucaguacaaaacugcaugaauucauauaacuuuauaauagaagucaucauaaucaguaguauaaauccuaaaacuucauauuuuacaaaaauuuugaauauucuuuauuuuuaaaucagcuugucaauuuucacauacauaauuauauacacgaaccuuauaggaaucuugagauugcauugaauauauaguaguuugagaagaauuuucaucuuuaugauauugaauuuuuaaguccauuuauuuagaucuacuuuaacuucuuuuaguaaucuuuguaauauucuguaacuucuuuuaguagugcuuuguaauaugcuguuuaaauuuuaaauauaauuuuaaaaauuacauuuauucuuaguuucacaugcuuuuuuguuacuauaaaggguaucagugucaaaguuuuaucuucuaauuuuucauugugaguauauaagcauaggguuagaaauuuuaugcugaccuaucuagugaucuugcuaauuuuauuaacuguaaguuauuuauagauacauuuagauuuuacauauacacaaaucacuuuuuugcuuaauuuugacaguguaaguuuuuuccuuuuaguccuuauacauuuuuuuugccuuauugcacugauuaggacuugcaauacaguaguacauagaaaucaugauaacagccacacuugucauauuccuggugucacuggaaagcuuucaauauuuuggaaccaggcagaaaauuuuuaagauauccuguuaucuguuuaaggaagguuucuucuauuccugguuugcuaauuauuuuuccuuugagaauggguauuuaauuuuaucaaauguuauuucugcgucugugaguuuugaaucuuaaauuaauauugcauaccuggaauaaacccauucugguugcaauauauuguccauuucauauccuuuuuuaauguaauagugaauuugguuugcuaaaaugucucaguguguuuucuuuuuaucauuauuccauuguuuuuucuuugacuaauggcuacauugguuaguuuucaaauauuuggggguuuuuagcuuaguuucacuguguucagagaacauguuuggaaugauuucaguucuuugaaguuuguugauacuugccuuaugggucaccuuuauagccauauacaguagucauuuguaaauguuccaaugacuuuugaagagacugucuauucugcuuucguugccuacauguacucucucucacacacacauacacauacacacacuaagacaauuaauucacacugaauucaagguauucuguaucauguuauauuucuuuagagaggacuuauuuuacuucuggugugauucaauauuauuuuuacuaauugcagucaugugguauguaacaacauuucagucaaaaacauacugaauauacaaucaugguuccaaaaauuauacuacuucauuuuuaauguacuuuuuauauguuuagauacacaaauaccauuguauuacaacugccuacagaauucaguuaguaacaugcaguauaggauuguagccuaggagcaauaggcuauccauauagcuuagauauguaguaagcuauacgaucuagguuuauguaagugcacucuaugauguucguacagugacgagauugccuaaugacacauuucucagaauguaucccuggcauuaagugacacaugacuguauuuaacacuccaucaugcauuauuauuauuguucagggcccucaauauuuauauuuaucccauauuugcuguuuuuuuuuuuuuugcgcuuauuccuucaugcauucucuggucuaaguuacuugugccauaaauaagucuuguguaaagguguccuagugaugaauuaugucaguuuuuauuuaucuggauuuguguauuuuuuaccuucacuuuuucaggauauauuuuauaaguauggaauuuuagguugagaauuacuuucuuugaacacuuugaagauguuucaucauguuuuguuuuccauuguuuuguugagaaaucagcuguuagucucaguguugcuuuaugaagguaguauaucuuuuuuuuucuuugguugcuuugagauuuucucuuugccuuugguuuucagcaguuucacaauaugccuaggugauuuuauucccccuacuuucuguuugcaacuuuuuagaaucauggcucaaaauguuucauuuauuuaagacaguuuucaauaagcauaucuuaauauguugccucuaucccgucuuuucuuuccuauucuucugagauaccaauuacauguauauguaaaauuucugauauauaauuucaauuauuauauuuuuaaucucuagauuuuccaguugauuuuugaguuucuacuuguaaauuuuucuacucauuuauauuuuuguacaaauuaaucauagcuauauuaaaguucaugucugaauuuacaauuuuuauuaccaguguguuuuucuaugguauguuuguucucuuauuuuugguuauuuggucuuaucuuuuggcaugccuaggaaucuuuaauugaauguauuuuguaucauguuauauuucuuaagagaggacuuauuuuggcugaugguuagaguugggucagauuguguugauccaucaacaauuaagaugacuuguuggcuguucucagucuuugugaggcuuggucuauuuccuauucuuacuccuaucgauggagccuuucagugguuuugacugaaggccuggugguguuuaucagggcccuaccucaugcuagcccugaacuucaauuuuucuuuccucacugugagauuacugaaauauuugcuuaguuuucuaaucuccuaaaaaggugcuucucacuaucuguucuuuagugucaugccuuagguaucuuaaacaucugaaugcuucaagaagaaaaaguaguacagaauguugggauuuuuauuucugguuucuuggcccuaaagucucugaauuccauuuuuuucccuugucagccaaguguaauguugaauauuugagccuuagcuuuuugcauguccuuucuaccaauugaggaaaugcccugagggcaaaagcuguaaagaaucuugaucucuaaucauuucccaucuuuucaggaccuugguguuccucaaaaccugcugacuccuuugcuaauacuuucaaacaacucuuaccccauuucuaccaauauuuauguuauuuuaacaagaguuuuuuuuauauaucacuuuauugaagcagaaaucccuugauaguauuuuuucuuuuuguaaaucugugcaaugaaucauaguauaaagugugcacauuuuuaagcuuauagauugaagaggguuuacaaaugaauuccucauauaaucgugacuagaucaauauaugcaaauuaacagcauucuagaagguucccuugucccuccagagucaauaagcaugcuucccucagauguaaccacuauucuuauuucugucaccauauauuaguuucgccuguuuuugagcuuuacuuaaguagaauaacaauuauacuguuuuauaucugggauuuuaauuucaacauuguuugcaaaauuuaguccuguugcugaagguaggguucuuuacuuuuuguuaauguauaguguuccauggugugaauacacaauuuauuuuuucuuucuacauuugaugguaauuggguuguuuuccaguuugggacuauuaugacuagaacuucugugaacauuguugaccauuuuugugcauuuucauacacaccuauacucauuucuguuagguauauaccuauaaauggaauacugucauaaaguauauguaucuguagauacauuaguagauaguaucuacauuaguagauacuaucaaacuguuuucgaaagagguuauaccaauuugcacucacaguagcaguguaggagaguuuccauugccccacaucuucaccauccuugguauugacagguauuguuuuguuuuagccauuuugguguguguauuaauaaggguucuccagagaaacagaaccaauaggagggguguguguggggagaaagauuauuucuauaauaaaucuccucuuacauacauauauacuuauuauggaaauugacucaugauuauggaggcugauaagucauauaaucaaguuggggaaccaggaaaccuggugcuguaacuuagucuaaguccaaagaccugaggaaaggggagagaaaaugguuuaaguccugggcugagucugaagaccaaagaaccaggagcacugacguccaauagcaggagaagguagauauuccagucuuaaaagaaaagaaaaaacaaaaacaaaaacaaaacgugcgaauuugcccuuucuccaccuuuuuguuauauucaggcccucaauacauuggauaaugcucauccacauuauuaaggucggucuucuuuauucagccugcugauucaaaugcuaaucucuuacagaaacauucucacaaacacgcccagaaauaauguuuaccagcuaucugggcaucccuuagucuagucaaguugacacauaaaauuaaccaccauaguggguguauaucaggauauaauuaugcuuuuaauuuuuguuucccugaugauuaaucauguugaacacguuuuuauaugcuuauuggguuauucagauauccuuuuuuagauguaaugccuauuaccuuaaauuaaaucuuuugccuauuuuucuacugggaaaagaaaauaggaguuauuauuuugcagaaauguuauacguacgcauaguuuaugaauauaaauaaaaauauuuucuccaagucuauggguugcauuuuauucucuuaguuauauauuuugaugaacacagcuuuuaaucucaauauacugagaguacuaacuuuuuacauagcccauuuuguuucccuuuuaacaaaucuuugccuacuccaaguucaugaagauaguuucuuuuguucuucuaaaagaccuauuaucuuugucacauuuaggucugcuugcaugucucagagcaguagaaagcaauauuaucaguugugaggaagaauuaugggaaaaguguuggaaguuugguaaagaggagaagguauaaaagucaucuagaagagugggagauuggauggacuaggggaguacaauaugauugccagauaacaguaaauauacucuugagguuucugguuaugaacuucaaaucauaaaaaguuaagaguaguuuguuuuucuccagucuuacccagcugcacaagugcaggcacaguguagguauagagauuucaccaggguucugguuuugccaagcaaguauagacaaaacgagagagaggcaaguggcugaaaauguaugcuggaagugauuauaaugcucggcuuuggaauuugugcauuuuaaggaggaaaaaagauaauauuugggguaucaaggauccugaaaaggauuagagauccugguaagguuuaaagauuguugaaguugagaucuuaaaagagagugagcuaaaaagauagaacaugguuagagagaaaggguagaaugaaaugggcuaaggguaugaucuuuggagucaauggcuaagacaggguagggugggaauguacauauuaaaugaauuuagauauuguauuagaaagguuagaggauauacauauucgaugaauguguauaucuucaauuaacuacaaauaauccaauuuuauuuguaguguuaaguauaguaagaaauauaaguacaauaccuguuuaaaaauuuuacaaaauauuuuagcaaaguacuuuuuaaaacuuuaauuuuuaacuuaauguaauuuucagguaaaaggauaauauauucagugcauuuuaauggcaugaguuuuuaauuaauguuguauagucgaagacauaguaguauguuaguuuauauauuuucuagaauaacauauuucaguuuaaauauguauuuauuuuugaauuuaaaauauucauguuugaaugguuaaaugagaauguacccuuauuucuguggaaauauagcuuuuauuaacagcaaauauaaauauaucuaauugagaaaguaauugaauuguuccccccccuuuuuuaauuaaaugaauauccuuugagaauuuaggagcuagcuacuuaggggaccagaagcuacuuaccugggcacuuaauauuauuaaccugguauauggaucacauugacauccagaaaguaaaaaauauucucaaagaagcaauaauagacauaacagaggauuuguaucauaauucacgcaguuacuuucagauuuuucucuuuugcaaaauagaaauaguuucuaguugugagguuuagaaauccuauguaauguauuacucuugguaccgagaagaugcucaauaaauaguagcuauuguuuuuaagggaaauccuuaagcauggucuauauagauuaggcucauuuuaacaaguuauuugaauugucagucuguggacaacuagaaacaacaaauucauccacugggaguaauuuuauauuagauuguagggaacuuuauauuuguccauuuucacacugcuguaaagauacgagacuggguaauuaauaaaggaaagagguuuuauugacucacaguuccacauggccagagaggccucaggaaacuuacauucaugguagaagggaaagcagacaucuucuucacaaggugacaggagagagugugagcacaugaaggaagaacugucaaacacuuauaaaacugucagaucucgugagaacucagucacuguuaugagaacagcauggggaaaaccucucccaugauccaaucacuucccacugggucccucccucaacacguggggauuauggcaauacaauucaagacaagauuugaguggggacacagccagaccauaucaaauauauuuauauucauauccucaggaucaucaagaauaaaaagauauaaaagugaauggggacauuuuagaaaguuauucaccaaaacuuuaauaauuauaaaaaguggcuuuuaucucagaauaacccuauguaguaagaauacugaggcuuagagaagauaagaucacacauuuaauggcagaauuuugaaugaugcaaacuccaucagucugauucuaggcccucugcucauaagcaccauauuauaccauuucccuaacacagugaggaaaauuuucuuuuaaaaauuauguacuuaaaacucaucaaaucugaaggaccuuagaagaucuaucuaccuaccuaucaaguuuguagaguauuacauagcuuuuucuaugugucaggcacuguuaucaauccuauaacaacucauuuaaucuuuacaacucuuugaggugggaaccaugauuguucuuauuuuauacaagagguaacugaggcauagauuaaguaacuuguccaaagccacacaguuaaaaaguaggcaagcuaggacuugaacccaaacagugacucuagaguguuguuaaccgugccauauugacugccuuucuaaaaauuugugaaguuuuuacuucauuuaguuuucuccuuauuauaaucuuuucaaugauaagaaacucauuacgcuguaaggcuaugugccagucagaguuacaccagagaaacagaaccaguaggauauaucggaagagauauauugcaagaaauugacuuauugauugugguggcuggcuagguaagucuaaaaucuauagggcaaucugcaaugaagggcaagcuggaccucucaaucacaggcugaagcuguacuuuacaggcugaguuucuucuucugggaagcuucaguucugcucuuaagggcuuucaacugauugagucagauccacccaaauuaucuaugguaaucuccuuuacuugaaguaaacugacuguggacuuuagucacaucuacaaaauaccuucacagcaacaccuagaucaguguugaauaacuaacgacuauacccuagccaaguugacacauaaaaauguccuguaggcauauuuuuuccuuaagcccugacagguuuggggguuggugguucauuuucccaagccagaaauggaacuuccuacuuucuuuuuaacuuacauuuauuacucauucuuaucaccuccucaucucccauuaccacagccaaaaaagauuucagguguuuuucaauagaaggcauauauaaccuuuaaagcaaaauuauaaauacaagagccuugaaaucaaaggcaagaagaugguugaaccaauaaaccgauguugaagcuaguuacuguauuugagcauaaaauuuagcacuacauggugaggauacaguauaaagccacuuuccuagugccaaauuguaacaggaauuuaaucuaucuaaauacagggagcagugauuuacauaauaaaugagauaauuauuauuuaauaaagauuuagagaauucucuagauuccuguguucaagaaggagggccucaaagcugccugcaguuauauuuuuaugauaauuauuuauuacuaucucaugacuuaaaaauuuucuuaacaaguaaaauaacuaccuuuuaaaaaauacuguaagacccuuugcuaugaccucagauaauuuaaagugaugucucacagaccuuuauuuagacugaaaggcuuauaaaaauuuugugugugccuguaaucccagcacuuugggaggccgaggugggcagaucacgaggucaggaguucaagaccagccuggccaauguggugaaaccccaucucuacuaaaaaaaaaaaaaaauacaaaacuacaaaaauuagcugggcgugguguugggcaccuguagucccagcugcuugggaggcuaagguaggagaaucgcuugaaucugggaggcggagguuguagucaaccgagauugcgccacugcacuccagccuaggcgacagagcgagacuccaucucaaaaaaaauaaaaaaugaaaacaaaaaugcaaaaagagaaucuuguguguggcucacguuacucuaaauuagacaguugggguuuuuagaaaucuuaaggacuugucccauagcagucuuaugugaggcccaagguagagaaagcccucuccaaagggaauguggauguggcuuuuugucucuuggaauauauuagaauuugauaauaugagaaacccacagaguuuuaaaagaaauuguauuaauguugauugaaagggucagagauaauuaauaaggaaaaaaguguacgggcccucaccuacuguggaaaggaagcaggcugaaaagcuacucaccucuucacauaggccauuucaugugaaagaaugauugagagagggcagccaagaagccagagaguacagcuaagagacaaggagaacuacucucaggacuaaucaaggaaugagugacaugugcccaacuggacuuuagaauugcuauugaugagggaguguuuauaccucuuguuuucccucuuuuugaaugggaguauccauugcaauuucuauuccuaucucaccaucguguauugggcagauaacuugucucuuuaguucacaagucuuuagauuaagagaaacuaaguaugaggaguugcacucaggaaacuggaucugagaggccucaucuauaccugcauuugauuuagauuacauccuggaccuuaggauaaggcuucuuggggucuuggaaggaguaaaguauauuuugaaaauggaggaguauucugugacaaagugaagauggcuacaaauucuuaaccacccuuuucaucuagaagcauagcauauuucuucauuccacugaaucugggcuggguuucucauugcuuuaaccaguauaauaugguggaugugaugcuagauccguuacaggguugaggcucuguccucuuuuaagcgaacugcuaugcaagaagucugacuauucugagaccaacaugcuguucaaagcccaacuagccacuuagagagaaagagacagagagauggggugugggggugggggguagagaaagaaagagagagauugguagcacuagauaaggugaauuauuucaugggccuuuuagucagcccagccuucagcugaagacagaugagagagugacucagcaaacagugugaagugagccagcagaccuaugaccucauuugggcuguuccagcuucucgcagcuguugagccacccagcuuagaccccagacauugugguauagagaugaacaguuccuacuguguguugcccaaauucuugacccagaaaauugugagcaaaauauggugauuguuugaaaacuaaguuuguuacauaacacagauaacugaaacacaaguagaaaaauucuaucaccugcccaaccucacagagccaguaagaacuaguguucuccccuucccuuuuauuuuuaguugacacauaauaauuguacauauuuauaggauacagaguaauauuuugauacauauguaauguguaaugaucaaaucaggguaauuaguauuuccuuaccauaaacauuuaucauuucuuuguguuaggaacauuuaaauccucucuuguacuugaaaauguacaguaaauuauuguaaauuauagucaccauacagugcuauggagcacuagaccuuacuuuuccuaucuagcugugauuuuuuaucaguuaaccucucucuaaucuguaguaacccacaauuaucuaauucucuucccaacuuuuaauaaccacaauucuccuaucuacuuguaugagcuccacuuuuaaaagcucccucauaugggugagaacauaugguauuuuucuuucuguaccugacugauuucacuuaacauaacauccucuaggcucauccauguugccacaaauaacaggauuucauucuuuguuaugucuaaauaguaggucauuguuuauauacauauauauacacuuucuuuuucuguuaaucuguugauagauguuuagguugauuccauaucuugauuauugugaauagugcugcaauaaacauggggugcagaugucucuucaauauacugauuuccuuccguuugcauuaauagccagcauugggauugcuggauuauaucuucuauuuuuaguuuuuugaggaagcuuccauacuguuccauaauggcuguacuaauuuacauucucacuaaaaguauaugagaguucccuuucucugcauccaaaaagacuauugucuuuuuaacaauagucauucaaaccgaggugagauggcuuucauuugcaucucccucaugauuagugauguugagcauuuuuucauauaccuguggccauuuguauguagaaccaaugcuuuuaaucacaugucaaacugccuaugucccaguccuuuccagagagcccucuggaacccuuuuucuauuguaaacaaauuuauuuaaaccuacagguuuuccauggaauagaaguuuauuccucaguaccuugcaucuacuaguugggcaguuauggugagcauaucuuuuugacuuaauucuagaguaauuauauaauuggagauaaagcugggaaccauucuuuacuuaaaaagucucaagugggacucuccuuggaguguucucuaaaaacaaaacaaaaaaaaucguuuucuuaaaggcauuuaguuagcagagcacagcugacugaaaauuucuuaaauacaauucaggauaguuuguauaaauaaccaaaagguaaauaaccaauguaguccucaugagacauuaaaauuuuuuuucaacugaaucucucacugcacuguuaauuggaagucuucuuucuugaccauucucuagaacagaauacaacugcggucacuccucucuucuggauguuuuuuucuggaccauccaauucauuuccacccccuuguuauggagagaaacuuuccucuuucauggaaaagucauucugacaucgaggcaccacgacuuuugaccuagaguaagcauaucaaacuauuuuucucaacucaauaauuuacagaaaaauauuaagaaggugaaaauuuuccauucaucauuaccuacauguaagaaaaaaagaaaagaagaaaaaucuaccagaauccuagcauuuacagauaaccacuguuagcauuuauuuauuuauuuauuuauuuauuuauuuauuuauuuauuuauuuacugagacagggucuccuucugucacccaggcuggagugcagugguacgaucacagcucacugcaaccuccaccucccggauucaagugauucuccugccucagccucuugaguagcugggauuacaggugcacgccaccacagcccagcuaauuuuuguucuuuuuaggagagaugggauuuugacguauuggucaggcugaucucgaacuccugaccucaggagauccaccugccugggccucccaaagugcugggauuauagguguaagccacuacacccagcuuguuagcauuuuuugaauacuguuggcuuucuauauccacagauucaaacaaucaaggauucaaccagccaugaaucaaaaauguugaaucaacaaaacaauaauaaaaaauaaaguagaaauaauaauaacuauuuacauuacaguauaauagguauuauaaguaaucuagagauuauuuaaaguauacaggaagaugugcauaggcuauauacaaauacuaugccauuugacauaagggacuugagcauucauguauuuugauauccagaggcgcccuggaaccaaucucccauggauaccaaggggugauuguauauccuguuuaaaaguauaugggugaguuuccuccuagucaacauaguguuggaaguccuggccagaacaaucaggcaagagaaagauaaaaggcauucaaauaggaagaggggaagucacauuaucccuguuugcagaugacaugauucuauaucuagaaaacuccauagucugcccagaagcucccugaucugauacacaacuucaacgaaguuucaggauacaaauaaauauacaaaagucaguagcauugcuauacacuaacagcacccaagcugagagccgaaucaggaauauaaucucauucccaauucccacaaaaaagguuaaaauagcuaggaauacagcuaaccaaggucaaagagcucuacaaugaaaauuacagaacacugcugaaagaaaucagagaugacacagacaaguggaagagcacuccaugcucuuagauaggaagaaucaauaugguuaaaauggccauacugccuaaagcaauuuacagauucaaugcuauuucuaucaaacuaccaauuacauucuucacagaacuagaaaauacuauucuaccauucauaugaaaccaaaaaagagcccaaauagccaaggcaauccuaagcaaaaagaacaaagcuggaagaaucacauugccugacuucaaacuguacuauaaggcuacaguaaccaaaacagcauaguacugguauaaaaacagacacauggaccaauggaacagaauagagagcccagaaaugaagccacacacccaggaggagggagagguucagaagagaaagauaaaaaggaaaacaaaugaacaaacaaaaaaaccaaaccuguugaguaguaugcuuaguaccugggugacaaaauaaucuguacaccacacccccaagucacaaguuuaccuauauaacaaaccuacagauaugcccccgaaccuaaaauaaaaguuaaaauauauuuuaaaacauauauaaaauggauauaugugucaguuuuaaccaacugauguuugacaaggcugauuaaacaagcaauggagaaaggacucccuguucaauaaaugguucugggauaauuggcuagcuguaugcagaagacugaaacuggaccccuuccuuauaccauaugcaaaaaucaacccaaaaugaauuaaagaccuaaauggagaaccuaaaacuguaaagcccauggaagauaaccuaggaaauaccauuuuggacauaagaacgggcaaaaauuucauaacgaaaauggcacaagcaauuucaacaauagcaaaaguugacagaugggaccuguuuaaagagcuuuugcauagcaaaagaaacuaucaacagaauaaacaaacaaccuacaaaaauauuuucaaacuaugcaucugacuaauguauaguuagucugggucuaauauccagaaucuacagggaacuuaaacaaauguacaaacaaaaagcaaacagcccuauuaaaaugugcacaauggacaugagcagacacuuuucaaaagaagacauacaugcggccaacaaacaugaaaaaaaugcucaauaugacuaaucauuagagaaaugcaaaucaaaaccacaagauaccaucucacaccagucagaauggcuauuauuaaagaguaaaaaaauaacaugcugacaagcuugcagagaaaagggagcacuuacacagcugguggaguguaaauuaguucaaccauuguggaaagcaguguggaaauuccucaaagaucuaaaaacagaccuaccauuggacccagcaaucccaccagguauauauccugaggaauagaaaucauucuaccauaaagacacauucacuuguuuauucauugcagcacuauucacaauagcacagacauggagucaaccuaaauguccaucaaugguagacuggauaaagaaaauguacauauacaccauggaauacuaugcagucaugaaaaagagugagauccuguccuuugcgggaacauggguggaacuggaggccauuaacucuaguaaacuaacaaaggagcagaaaaccaacuaucacauguucucacuuauaagugggagcuaaauaaugaaaacacauggacagaaagaugggaacaauagacacuaggauauacuugaggguggaaggcgggaggagggacagguucagaagaaaaagaagaaaagaaaaagaaaaacuauuggguauaccugggugaugaaaaaaucuguaugccaaaccccugagucacaaguuucccuauauaaccaacuugcacauguaccccugaaccuaaaauaaaaauuaaaauacuaaaaaaaagugaguuuuaacaaauugagauuauaauaauaauauagugcuuauuguauaccagacaccauuauaagugcuuuaaucuguuuauuuaauccacccgaagacccuccaauaaggaguguacuuuuauuaaccucauuugcagaugagaaacugaugcccauaguuguuaaguaaugugcccaagaucacauaacugggauucacauucagauagucuugauuuaagaaccugcccuaguaaccauuauucuaaccugcuauccauauuauauauucugacaaaauuugcuuuuuucauuuuugaauuuuucuuugcauuuggauaaucuucuguaaggaauuugucguacagucaguauguuaaauguauuaaaaaauaaguguauggaacuaauuuuuuauuuccccaauucaaggguaaccauucucucuacuuugacaggauugauuacauuugccucuuuuauaaauguaaucacacaacauguacucaauaaguacucuuuugucccugguuucuuuuugccugacaauuuguuugugggauucauuccucuuguuagguauaguuggaaauuguucauuuucuuugcuguauaauguuccauugugugaauaugucacaguuuaaauguucuacuauugaugggaugugauguuuccuuuuugggccuacuguaaauaaugcuacuauaaacauuccaguacacacauuuuggcgaacauauguaugcauuucuauugaguauauauaucuaggaguaggcauucagcuuuaguagauacugucaaauauuuuucuaaaaugguuguaugaauuugcacuacuagcauugcaugaggguucucauuauuucacauucucaucaacuuuugguuuuuccuuucacuuuugcuuuagccauucugaugaauguuagaguagcauuuuuaugacuauauaguguucuauuauaugcauauguacugucuuuuauagacgggagucccuauuguugugcauuuagauuguuuccaaucuuucuuugaaaaaauacaaacaguauuuacacuaauagguuuguagacguacuuuaagucuugugauagauguucccauacacgauugaaaaauaacaaguguguuucccugaaacauuaugaaaaugaguuacaauuuuugcaacuucauccaguuacuaagcaaaagauagccucucauauuuuuacuuuaaauuuuuuuuauuuccagagaaaguugagcauuauguuuauugcuaauuuuuauauugguaauuuguauauauuuaauaaaucaccuagucucauuuuaugcucauauuucuauugaaguauaugugaauaucuuagacccuuuuauuaacccuuuucugauuauauauguuauaaacuuuccuuauuugucuuucaauuuuauaaaaaauuaacuuuuuauauagucaaguauauguuuuauggcuuuugccuuugguaucaugcuuuaaaaggccuacucauacuuucagcuuuuucauucugcucuguucuuccccaaagugcauguguauguguaugugugcauauauacauguaugucuauucagauuuucccauaaaaacaugauacagauagcccuccauauccuuggauucaaacaaccaagagaauucaaccagccauguaucaaaaauauuaaaacaacaaaacaguaaaagauaacaauacaacaauaugaaauaauacaaauaaaaaacaauacaguauaacaacuauuuacauagcauuuacaguguauuagguauuauaaauaaucuagagaugauuuaaaguauaugggaagaugugcauaggcuauaugugugacaguguauguauguuuacauauauauauauguaaguauauauauauacuugaguuuuucccauaauguucaauuuccucuggaaagaaaauguaaacuugcuuccucuaugcuguaucaucaucuuauucucaaauucccuucaaaaccaaacuuuuuaauuaguaggguaacacacugcuuccauuuucuuacuuuguguuuacgccucaaauccucugaggcugauaucuauuccuuccugccguggcaaaagucaucaauaauuuguugugaguuuuuucccuuacucuauaguagaguuucccuaaucuauaguguuuuccccaagugacuuauucacuaauuacuucauguucugucaguuccaauuacuuucuaucuuugugacaacauauaucucuucugugcucugaguguaauuuuugcuggauaugaacccugcaaagucaaauuggggaaauuaucguuuccugaaucugcacuuccuauuuuggugaaaaugaugcaccucuuuagucauauaagccagaauuuugggugucaucuuagauucuuuaauuuuccuugucuucuaccucuccuuguugacugagucuuaggaauuugucccuucauuucuaauuucacugauucuagcuuaguucaggucuuuaucacccuuuuugaggauaucuacaacaguuucuuagccauucucccugccuucaauuucccuagucgaucuuccaaaucuaaucuaacucccugcuuaaaauuaucuuuauggugcuccauugcauauaagauaaaaucuauucuuagccugacauauaagaugauuuggccccuuuaucuuguuucauuuuuucccuaucacuucuuaaaguacuuuuuaaggcacaauaagacuuuguuauuacuaugauugcaccaacauugcuacugacuucaacacccaaaauuuuuguauacagaagcgugccccaaacacaaaaugagucuuucuguacugcuagcuaauguuuacuaagaucuuacaaauuacuucuuuuauuaguuuggaaaaaauaugggguuaguucaaugcuaaaucaaaauuguuccucucuuuucugcuuaagauaaucuauaguaauaccuuauauuaguauggauuauuaaagauuuacuguacauaauccuuccauuauuugauuuuauagaaacaucucaaaggaauuaacccaaggguaaaauacuacccauacauaauuuccaacauuuugaucagauucuacuggguaaguauauguauauuuuaagcuauaauuccuauaaucugugcaacaaacccccgugacacaaguuuaccuauauuacaaaccugcacauguaccccugaacuuaaaaguuaaaaaaaaaaguauauguccaugccauagaagacaaagaaacaccguagaaauuuucuagguuaaaggcagaguaaaagacauaacaacuaaaugcaagaccugauauauauauaugacugcaaaagcaucucuacugaccccagagaaugguguggcaacuauuguuuacaauuuuuauuuaguauuuauuucuaauauaagauugggaaaauagcaucaaaauacagcugcuuaguagucaagaagacuaauuaugucccuggaaauaauuacaacuguguacuucaccuucaggccagaguuuacuuauuauauuaauaagaaaccaauacugcaauugagucuugugagccuaacucaaagacacaagauuaaaugauuaguuuuacagaaugagaauauagugaugcaguaauguauauccauuggugacauugccauuagcauuggaggcaaguguccauuucauaauagaugguguccuaaguuggacugcuucuuuuuuuuuuuuuuuuuuuuuguuugauacggaaucucacucugucucccaggccggagugcaguggugcaaucucagcucacugcaaccuccacuuccuggguucaagcaauucugcugccucagccucccaaguagcuaggauuacaggcaugcaccacaacaccuggcugauuuuuguauuucuuuucaguagagaugggauuucaccauguuggccaggcuggucucgaacuccugaccacaagugauccaccugccucggccucccaaagugcuaggauuacaggcgugagccaacauaccuggccguacuuuuuaacuaugucuugccucauuugguuccuggcuaaaucuggcuuuucagucuucucauccauuccauauguacucaaucuaauaaauucauuuucugcuuaaauugacuagcaucaauuuuuaauuuacauuuuugcaacugacaacccagacuaguacagguccuaaaggggacucuaauucacauguccucccaagaaaggcagguagcaagguaucuuauuuguaugugucugauagggcucccaagaaaccaguggaagguacucuuaggauugauaguuaaagucuuaggcacaguaaucaaggaaccuaagaccgagugacagaggaauguuuuuacaugggagaacucugagauacaguguuagaaauucccuaaggagguuaguaggaaauauuuuccaagaauaaaacugacagaggauuaauauccagaauaaagagcauuuuauaagucaacauaaagagacuaaaaaugaaauagaaaaacauagcaaaggauauaaauggauaaauuacuaaauaugaaauuuagaugaucaauuaacauaugaaaauauuuuauuucacuagugaucagugaaauaugauuuaaaaugagguaccuuuuuuaauucaccagauuagcaaagaugaacaagucacguaguaucacauaugacaagcaugucaaauguaaauugggauagccauuccugagacaauuugguuguaucaguuaaaaugaaaaugggcauaaacugugacccaggaauuccacuguuaaguaucuucugaguagaaacacuuauacauguucaaaaggaaguauguaucaaaaaaagacauacuggugaggaugcaaaggcaugggagcccucagacauugcugguggaaauauaaaaugguacaggugcuuuggaaacaguuuuucaguuucuuaaaauguuaagcaucagauugccauacccagcaaugugcacuucuagaaaaauagccaagagagcuaaaaacacuccuccacacaauaauuuguacuugaauauucauagcaucauuauucuuaguugcuauacaguggcaacaauuggugaguaaagagaauauuguuuauccauacaauucaauacuauucaacaauaaaaaagaacaaggaaucaauacaugcugcaacaugauaaaccgcaaaaacaugcuaaugaaagaggugagacacaaaagaccacacauugugugauuucauuuauaugaaaaggaaaggcaaaucuguagauacagaaaguagacugaugcuugcucagggauaggggugagaauggaaaaugaccacaaaugggacugaggcuccuuuuuugggaugaugagaaaaaugauacaguauuaaauuauggcaaccauuucacaacuuauuaaaaaucaccgaauuuuacauuuaaaacuggcgaaauuugugguacauaaguuaucucaagaaaacuguuaaaaugauuaauagcuagggacuuuauaaacauuacuguaaccugggaugguagaccaacacuuguaggaaggauagcuggaagaaaucaggcaugucauguuaggagaaacaaaauggaaacagaaagaaacagacaugaacaugauguccauuauugaauuauuuguaauacuggaaacuagaaauaaccuaaaagcccaucaguaaagaaacagguaaaauauaguacauuugaaaaaaguaauuuucaaaauauguagagcaugauaccauccaggcaaauuagaaaaguaaagcuguauauguuuuccacauaaacauguauguaaaaguauaaaaaagacauuugaagguuauaagcaauuucagaacagugguuguuucuaagggcagagaaggagaaucaggauguggauaguaaucaggagggccuuuaguguuauuuguaguguucuuuuuuuuuuauuuuuacaaauguaugguguaacaugaauuuuauuacauguauguaauuuauagugaugaaguuaggguauuuagagugucagucacccaaguacaauauacuuuugcuuacuuacccuauucugcuaucaaacauugaauauauuccauuuuacuguaugguuguacccuuuaauucacuucucuucagccucaccgucccccucccugcuccguccuagucagccuucccagucucugcuaucuaucuuuccauucucuuccuucaugggaucaaauauuuuagcucccacauauaaaugagaacaugugauauuugucuuuuugugucuggcuuauuucaguuuaaauaaugaccuccaguucuagccauauugcugcaaaugacaagauuucauuuuuuuauggccaaguaauauugcauucugcauauaugccacauauucuuuauccauuuauaaacuggugaacauuuaguuugauuccauaucuuugcuauugcgaauagugcugcaguaaacacacaagugcagauauucuuugauacacugucuucuuuuccuuuggguagauacucaguagugggauugcuggaucauaugauaguucugauuuuagguuuucgagaaaucuccauaccauuuuccauaguggcaguacuaauuuacauucuuacaaaaauguauaagaauucccuuuucuccacauccuugccaauaucugcuacuuuuuuuuuuuuuaaugauagccauucugacuggaguaagguguuaccuaguuaagguuuugauuugaauuucucugaugauuagugauguugagcauuuuucauaaaccuguuggcugucuucuuuugcaaaaugucuacucaugucauuuaccugcuuuuuaaugggauuauguuuuuccuauuaaguuuuuugaguuucuuguauaugcuggauauuaguccccuguugcaugaguagcaugcagguauuuucuccuauugaaaagguugucucuucacccuguugauuauuuuuuuuuucugugcagaagcuuuuuaguuuaauuaaguuucauuugucuauugguguuuuuguugccuguauuuuugaggucuuaguuguaaauucuuugccuaggccaggugcgguggcucacgccuauaaucucagcacuuugggaggccaaggugggcagaucaccugagguugggaguucaagaccagccugaccaacauggagaaacccuuucucuacuaaaaauauaaaauuagcugggcgugguggugcaugccuguaauccuagcuacuugagaggcugaggcaggacaaucucuugaacccaggagguggagguuguggugagccgagaucgugccauugcacuccagccugggcaacaagagagaaaaaacucuugucucaaaaaaaaaaaaaaaaaaaaaaaaaaaaaaaaauucuuugccuagagcaauguccaggagaguuuuuccuagguuuucuucuaguauuuuuauaauuuguggucuuacauagucuguaauccauuuugaguugauguuucuauguggggagaaauaggguucuaguuucauucugcauguggcuauucaguuuucccaggaccauuuauugaagagagugucuuuuccccaguggaagcucuugucagguuugucaaagaucaauuggcuguaaauauguggcuuuauuucuagguucucuauuuaguuccauuaugugucuuuuuuuauaccaauacugugcuguuuggguuauuauagccuucuaauauacuuugaaaucagguaaugugaugccuccagcuucguucuuuuugcucagaguugcuuuggcuauuugggcuccuuuuagguugcacaugaauuuuagaauuauuuuuucuaauucugugaagaaugauguuaguauuuugauaugauuauguugagucuguagauugcuuugggaaguauggucauuuuuaacaguacuaauucuaauucaugagcauggacuuuuuucaucuucaauuucuuuuauuugugcuuuauaguuuuaaaugcagagcucuuucaccuucuuggauaaauuuauuccuagguauucuuuuuguagcuauuuuaaauaugauuggcuuuauuucuuucucagcuagaucauuauugguguauagaaaugcuacugauuucuguauguugauuuugucuccugcaacucuacugaauucauccaucaaaucagggaguuuuuggugaagucuuugguuuuucuagguauaagaucauaucaucagcaaagagggacaauuugacuuccucuucuccaauuucgaugccuuuuauuucuuucucuugccuguuuccucuggcuaggacuuccugcacugugucgaauaauaguaguuaaagugggcauccuggucuuguucuauuucuuagaggaaagguuuucaacuuuuccccauuuaguauguuguuagcuguggguuuggcauguauggccuuuauuauuuugagauauguuccuuuuaugccuaguuuguugaguuuuguuaugaagggauguugaguuuuuuuuuucagaugucuuuucugcauccauugagauaauaaugauuuuuucuguugauguggugcaucccauuuauugauuugcauauguugaaccauucuugcauucccggaaugaaucccacuugauuguagcuuauuaucuuuuugaugugcuauuggauuugguuuaguaguauuuuguugaggauuuuugugucuguucagcagggauguugaccuguaguuuucuuuuuuuguucuuugucagguuuugguaucagauuggugcugaccuuguagaaugaguuagggagaauuccuuccucuuugaucuuuuggaauagcuucaggaagauugguauuaguuauccuuaguacauuugguagaauucggcuguaaauccauccagccuuugucuuuucuuuauugagauacuuuuuauuacugauucaaucucucugcuuguuauugaacuauucagauuuucuauuucuuccugauuucauguuaguaaguuguauguuuccaggaauuuauccauuuucucuagcuuuuccaguuugucagcauuuaguuguucauaauagucucugaugaucuuuuguauuuuugugauaucaguuguaaugucugcuuuuucauuucugauuuuauuugcaucuucgcuuuucuugguuaguauagcuagcaguuuaucaauuuuguuugucuuuucaaagaacuaaacuuuuguugaucguuuauguuguuuuuaaagccucuauuucauuuaauucugcucugacuuuguuucuuuucuucagcuaauuuggaguuuaauuuguucuugcuuuucuauuuucuugaaguauauuguuauauguuaauuuguaaucuuucuacuuuuuugauaaugagcauuuauugcugcaaaacuucccaugaugacugugcucccaaaauggcaccuugcugcagcuguucaugcuuagguggagugagugagccagcaugaauuccuugucugaugcaaugccuucacacaaucuccaagucaccaaccaugcuaguuucagcauuccuguugguaaaggaguucuacugagguuuaguucacagcaguccaugguagagaugugaacugcuaaaguucugucacuuaugcugucccuguaauauggagcccuucuaggcucccacccaaucuugaccaagcgggccacuugcuuccuuuuccuucugugccucaaauguucccuguguguucuccauuguacucuaguguucuuuccuagauguucuauuuauaguaugauuaucuauucauaauugugguucuucuuucuggagagagcaggugucucacaucucuagucagccaucuuguaccaaaaucccauuauuuguaauuuucuaaauagauaauagauaauauauucaaaauguauacauuuuaacauuacagacagaaauauggacuugaagcaaauauuccaaaauaucaauaauaguauuucugggugcugggaauaagagugacaaaagaaaaaaucuaagaaacaaauauaaaacagccaucauucucuuugguuaccuaauauaaagcuuaaagugaagaagaaagccuggaaaauggcauugcagaccugagaacagcagaaagagugaaauaacagcuccccaccaaggacacugaccuuugaaacacagcaucagugacuacaguaggaaaaccuaggacucugcuuggaaacagaggggacuuaaggaucacuuauaauaauauuuacuucuucaguugaggaaggugggaagucauuucuguuguuaccuagcagcucuuagagaugaguuuauauaccaaaaguaguugacauauguaucaaaaguaggauaaucuaagaaauacucuuguuuuuggaauauauauuuaaugaguuucaguugcaagaagcagagacccuauucaaacugauugaaacagaaaggaaauaauuuuuuaagguaacuucaaaguucaaguggugaaacagcauuuaggcauugcaguauccaggaccucaaaugaugucauuagauuuauauauuuuucucccucuuucuguguuugucucucugccucugccaugucuuucucugucuuacaguaugaauaugauuuuuuucauuguucagaagcuggagcuggaagugacugaaauacuucugagaaaccuuauuuccaugaccaugcuugucaucagaaauacauauucaaauaucauagaagagcaucuaguggggagaacuuuauuuuuauccaaaacuuuaagaacaaggaguccaggaaauauauuuuauagcuuuccaaccuguccaacuauuaaagaaggagaauggaagggacauugaaugaaccaauuuacaauauccagcaugguccacucuuuuggcuguucaucaccuauuuauacccuucuacugaugcuuucaaagaauggcaauuacacuauucuacagcuaacuuaaugcuacuguccuucauauaaaugaaaacacucaacuucuacccaaaaagagagaucuaaaaauccaucagcccguauaucaauuucuagaugauauucacucauaucauuuagccauaauaucaccuugacuuuccacagcccuaguacuaaauuauaaaguuaaugaccacgccuuauguaaaauuccuggggaaaggcaagaaggaaauugauguguuuauauguacacacauacauaggcacacauauagcauagcaagguggcauuuaugaguagcugcuauaguccuuguucuguuugaaaguugcuauaaauuucccacugcagcauauaaguguagaagggauucuuuuucaggguaguaguuuagaccaucauucuugaaucauugagaccuugguaguguuuccuauauuggaauacugaagucuucucuguuuuuauacucaauaugcaaauuacaagaaaguaccccaccuccaucuauaacacaacuuuaugucucaguaauaaccaggauuaaucacucaaacagaaguaacuuuccuuuucggccuguauuuuucagugaaaugugaccagaaugcccagcuggcacucuaaacuucugguucaagggauuaauuguuacagguacuccccauacuugaagaguacuucuaaauucauauuucuugaagaguacuuccaaggguauuaaaaugucucaacuguuaaagaguccaaaguuacagagacaagaaguagaaaauuuucaaauggguaacuuaucauacuauaguucauuaauuuugacauacauacuuuugucucacauuuuaguguauucgaaauuaggaugcuuccuaaaaugaugacaucagucaggcaauucuugugaugugcuuguuauugucuauacaugcacaaacaugaaaaugcguaucagcagguuggaagaaaauauaggagaugguaguagagcgccucaaaaaauacuguaucaauauuuuugauauaaagaacaauaauuguguaaaaacacacaauaaugacugugcaucaaaaaauagucuggaagagucagacuaugaauaugaaagcauuuuaggaauuucuuaacaaguuuaaaauuuuuuucacuucauauguuuacaagagugauauuaaaaaguuaugucuaaauaaaucaaaaauaguucucucuuaauagggaaaaaauuuauaacugacaaaguaucucauaguuuaauugcuguacauuuuucuuuuuuuucuuagugguacaugauauaauggugauuuuuauaauugauagucauagauucagugaaauaggguggugauaucuaccacucccaccuccaccuucugguucccagauacuuguuuuuuaugguugaagaaacaccagguaauggucccugagaaguuucuuuuguguaugagcuacaagauuucaagacuuuucaaaucuugaucuuagguaauuuuugaaguaacaauaaucacuaauaguuugucuuuaauguucuuguacuagcuaucacgaguuuuauguaucuuuguuauuguuacuauuuugugucaauugccaagagacuuaaacaucuuuucuaacauguucauauucucuugauuaauuacauuaugaaacaacaugccuauucauuauuuuuauuuggaauuuuuccuuuuuucaugauuuaguguauuuguuacaaaaaauaacuugaauucacuuuucuauauaggaacauuuuuauugauuuuaugucuccucuuuauaaucucuuucauauuucauuauguuucuucuaaauuuaucuuguuuuuuuaauacauaaauuugaagaugaaaaaggagguacuccucauauacauucauguauuauacauauauauucauauacauauauauguacacauucaaaucacaagucugucauuuuuaacuuuuuaauugaaaaauccccaaacuucuugccaaucguagcuaaaacuguacauuaccccuaaacuuucccuuauucagaucucuaaaaugccuggugccacuccauuagcaccugacauaauggaaagugugaagaaggggaaguuggagagaaaagagacagcaaucucaaccaauugcuauuaaaauaucuuacuuuugcaagucuuacaaaagcauguguccuugugaacacaaugcuagaaucucucccaggguauuagaaggguugccugcacuugagagguccugaaauuuaaucucuguuagcuucacaguaaaccugcuguggcccucagauuucaguucucuuugugagagaagcccucuccucuggcuggcaauuuaugauucccuugcacacacucucuuuucuggggucuauaggacauaaauguauuuucccugcuauuccaaguugagcccccucucaacauaauucuuuucacucugccacugagcagaggugguuuuaucuaccauuuaguaccuuuacauuuuguacauuuggugaguccccccaaaacagucccuaacucuuauaaauccuagcagauaggguacauguuaagucucugagugguuuccuugaagccccucaguugauuugagguaagggugaccuccugcccugaauguguugcauaccucauaacugcuccaaaacaauucucuccagcacucuucagccucucccucugauguaaauuggcuaauguuggcagaucuggcuuuaaaaucuaguuucugugggugguuuuauuuuucauuugggaaggcuggucaccugauagaaaaauaaaaauaaccauguuaagacaaauugguguuuuagcugucugcuuaauugcuuuuggccuucaguuuucucuuugaaaucuuauacucaauugagcaaauguuucucaguugaggguuuauguguucuaaguccugugauagguaccaggaaugcagagauaaacagauccauuguaaacagucaaauguaauagaagaaucauauggcuaaucugccauauauuaagucauagugucuaaauugcauuaaaccagcucaauauaagaacaacuguuuucuuaaaaguuauaugagauuuuauaaaagauuuuaccuugccauuauauaguaauuaugauugaacuuaccaaauuaaauguaaugugacguuuacuaguauuuuuccauuaaauuguuagugaauuaaaaggacguuuuggaauuauaugggggaucuuuggaagacuuaauuuuuucauggguuguauaaauagauuuaugagagggaaaauggauauuaguuucugauaugguaguuuaugugagaauuuuauaguuugauuuguauaaauaaaauaauguuauugcauauuucugguacauuacacuuuuauuuguauaauaaccuaaacuuguguuuaucuuauauugcuaaaauuuaagguaaugacaauaaaagauuuuucugguauguaugugaagccuaaauggccccauucugccaccuucuggcugacuccguagcuuauaauauugugagguaagugucaucuaaccguucugccaugguuggcagcagaccauauauuuggggccugggugauuuaaaacagggucaguuuaagcaauaauguaguucuagugccucaggcucaccuuuauuucauaguucuaaaauguguuagaauuuauuggaauagaauaccacauagugauguaugagauuguuucucccaggguauggaguuguaguuaauuuugacuuuucugcaauacuaaaguuucuucagauauuacuugauaauuaaaacuguaucaacaugguaagcuauuuaucagaaucaucauaagaaaguuacuuggagagugauauagaaaugaaaguuacugaaaucagcaccaauuccuuauagagaaacuaauggguucaguaaucacuuacuagaguucuaaaauaaaaggagaaaccauauguacaacaacaaaguacuaacaaaaucuuaguaauuuaaaccucuaguuuugugacacuucuauauauugccauuuauuaaaaaaaagaauuugggaaggcuuaaaacuuuuggaaauguaauucauuuaaaauugguuugauaaacuuuuuggagagggauagagaaaauaaaguagaacgcuauaaaauguugcaauuugugaccuuuugcagcacacuuaaccucuuugucacucuggaaaaugggauaauaauauccaauauaaagguagauuguugugaggaauaaaugcuuuauuuacuucaugugaaacacuuagaaugauaucugacauauaauaaguuagcauuguuauagucaaucuuacaacauuuagaauauguuacauagucuaauauaaauggauuccaaaauauucuaggcaguaagcuuuguauuuucuuaacauuuuuacacucaauaauauuaaauuaaaagagagaaauugaagacuggaaaugcauagcucccuaaaguaguguagaaauauaugugauauauuggggccuaauaaagggccuuuauuucugucugugacucaucuuuuagauaccuaaagcuaucucauaaaaaagcuaugguaucuugaagaaauuaaucaauuuaaaaacauuuauugaguguauacugugugaucaucaguguguuagauucugguaagaaaugauaugagaaacucacaaaaagaaguauaaacaugcaauuacuacaauguggucaguacaguaacguggguguuaauauauuuuaggaacuagaagagaagaaauaacauugaacuacacuuugauuaacaaguaggaauuagcuaggagaaagucgucuuacauaaauggaacuucuaugcaugauuuuugacuacugguuuaccugaaguuucuuacauuuuguauuaguauaacuuuacagccuuucauauccagaaugcuuuuacacacauuaucugaagagugagguuuucagguuauuaucugaauggugaaaauuggguuucuaucguaguaauuaugggugaaggggaaauauguguuuuuuaaaacuggacauuuguaauguugcugucugagccuauagcccccuaccuucaccucuuuaugcuguggagucaggcaacuacacuagcagucaaaugccugagguucgcaguuugcccuaucagugcucuugaggguucucaugugagugaaaggagugacuaucccaugcccugcaccauuucuguggugguaguggugguugagggaagaaguuucaucuucacauuucagguauuuagaaagcccaucuggagauuuaguuaugggacuaccuggcuauagucuuggcuagggcguuaguagaucaaugaaauuuucucaucaacacgaagggcucuaaguguuaaagggagacagugcccacaucaaccaugacuaggaguuucacauguccauauuucauacauuuuaguacucuggaaauagaaucccacuuuccucauccccaucaccuuauuacauuuaagucuuguguuaauuuucuauuauugcuauaacuaaauaguggcuuaaauaguggcuuaaaauaacacccauuuauuaucucacuguucuguaggucagaauucuggcaggcucuuaucuggaguuucuggggaagaauuuacuuccaagcugauccauacuucuggcagaauccaguaccuuaugguuauaggacuagggucucuguuucuugguugacugucaucuagggggcucccuuagcucuuagagcccucucucuggugcuucuacauaggcuguaauaucucagagccaguaauggugugcugaucauucucacacgugaaauuucaugacauguugccauggcucucuucugcuccuagcuggacaagguucucugcuuucaagagcaaauuuuuuuagaucgggcccaccuaaguaauccagaggaaucuauuuagucacuaauuaguagccuuaauuacauccgcagaguccaguuaggcauauauugaaacauauccacaguuuccaggcaguagauggaauuaauagggggagcauucugcuuaucagaaauccaucgggaguuuagaaagaagaggaaguacagagagccuacgaccuuugguaugcauuucaagacucagucacaauuaagaggaggaucuacuuaauaguuaaagaaaauuuaaaccaucuuucuucccuaauacaaccagaaguauaaacuaguuguuaacagauaugcauaugauuaaaauaaaauuuagaaggcagugauguguuucagacucauauucagcuaucuuuuugaaaucuccauuuguaugucuaguaagcaucucaaauuuaauauguccaauagaauuuuuuauuacaacaccccuccagccccuuccuucagaaaugggauaguucccuugaccccuucgcgggacucacaaagggauugacuuguuuacucagcucgcagcucucauccccucacgggacggggagcaugcaggugaguggguacagggacugggacaagugcuucugggcauccgcaggaguagaauccugugcaguccaguggaagcuuccuggggggugggggggaggggaggggaaccugugaccuccggaguccuagagggcauguguuacagugugcucauuuagcuuugccauccacagacaacuuaaguguuuaacagaucaguggagggucagggugacagccuuuugcacccgcccucuugguacccgaguacuugucuggcauccaggaagaauaaggucauaugaaugaauugaaggguggugaauguggaggauuuuacugagcaguagaaguggcucuuggcaggauggggagcuggaaagcggauggagugggaagguggucuucuccuggaguucagccguccccuguggaacucuucugcgaaguccugcugucaagcuguuccucugaagucaagcugcuucucuuugauguccuucugcugccucucuucucuccucugccacucugccacucugcugguggggcuugggguuuuuauggguacaggauggggagguggggacagccaacaugguuuuggaaaaggcaaauuugggcaggaaaacaggaaugcauguucucacuuuggacugcagguccaggcuugagaguguggcccucguuggggucugcccucuucuacccaguauuuccccgccuccugucuauaucacuuccucacccuuccccagcuuaauaauaacuggcaucacuacuuauucacaugcucaagccaaaaaaaguaggaauuaucuuuuauuacuuuuauuaauuuucuggguucaaugaaucaucaaaucuccuuguuuuucaaaaauauauaugaaaucugucuguuuuucuuucccaccacaaccucaguucagguauccaucaucucuugccuggacuuuugcaguaguccuuaacuauuuuucauguuuccauucuuaccuuccaccuacacagaagauuccugaauccauucucuuccuaguagucauacucuuuuugccuuauuccucuaucugggucuuuaauucccagcuucaucugcauggcauacucuucuuccaucuuucuguaaguuccucuuuucuuuguacuucaggucuugacagcuguguauguuaccugaaacacauuauagaaaauguacauuuguacaugagaugaagauaaauagggaggaagaccaaagaguagaauuaucugcuaaguugaacaauuacaaaauaguaaucuaucaaauaaaaucuuaaaauagcuguauguaauuuaagcuuaucauuaauaagcauccuaauuuuccccugcuccuuaaaauuaccuauacgacauugagcuaaagcauuucuuuguuggaaagaaaaaaaauugaaaacaaaaaugcuuguguauucagcucugcaggagggauauucaacuguaucaguauuaaaaaucuaucuuuccagaaaagaaguaugaaguuaauuuaccugcugguauuacuaauaguuuaauuagguaaacagcaugaguucaaaacaauuaaucaucugccauaaaagucuaauuauuccuggcacauuacugagcuauuuuuacugugugagauaaauaugaauuuugcggguuuuuuuucuuuuucuuauauuugauagcuauagacaauaaauuuaguucuuauuuucuguuggacucugacuuuugaaauguuauuuugcuaacacauucaauugacuauauuuacuguuuuccuaacuugauuacuacuuuauuuuacuucuagugaauauauuuuauguuuugaagaaaauauaauauuuccuauacuuaaaucauaaaauuauuuuaaggauaaauauguacuuagugggaauuuuuuguuuaaaguaagccaauuugccaaauuuuacauuguguaaaaaauaaagaggcuuugcucaggauuccucagauuccagucuauucuuuguuagaauuauuucuuuucuuuuuuuuucuuuuuuuuuuuuuuuuuugagacagaguuucacucuugucacccaggcuggagugcaauggugugaucucggcucacugcaaccuucaccucccagguccaagcaauucuccugccucagcuuccugaguagcuggaauuacaggcgcccaccaccacgcccagcuaauuuuugucuuuuuaguggagacuggguuccaccauguugguuagaauuauuucuuuaauguauguaccuuagcugcaaaaaagcaaaauuaaaaaaaaaagauguuuuagcauacaagauuuuuagacaguauaggacacauagaacugacagcuuucauguugaagaacaauauugucuugauuucacuggaauuguucauuugggucuauagcauucuguccaaauugcagaaauugauuguuauggcauacccacgauuuucaugcucauauguuauaacagaauaguuuuuaaaaaucuuguuugaacaguuugguuguuugcaugcuuccaguguuuagacuuuuaaaaaacgauuugaaaaaauaugauauugaaguguacuuugauuuucuuuaauuuaaauaaauaauagucauauauuuauuaaucagauguauuaauguaauacaguuuacaaagaaauuuuauguauauucucuuaguugagccauacacaaaacuagugauauagucagggaaguuauuaaugaucucguucagcagaagaggaaaccaaagauuauagagguaacugauuaguuuaaaaaguggcauaucugucagcauuauguguguuccuauugcccaguuuugcccauguaauuuucugugauuauggaaauguuugauguuggcacugucuacacauguagccauuuagcuacauguggcuguugagcacuugaaaucauggcucaugugacugaggaacuaaauuuuuaauuuuauuuaauuuuaauuuacguaaccaugugucacuagugacuauaauauuggacaguguacccuagacucaaacauaugaauaaaagcaauuugaauuccuggaagaaaaauuagagaauacuuaccuuucaauguacagcauauguuuugagcaauugaauauucuuacauuagaauugugagauuaaauaaauuuccauaucucuuuuuauguugaauaguaagaucauuguuuuugcauauuguauuaacuuacugcuuaauauucagcacaauuauaaacuuuuuuaguuuacuauacuuugagauauauauuacuauuauaauuuuagguauucuggugaguucaaggauaaaaaacauggaguguaauugugaaaauuuguuuauguauuugaaaauauaucaguuugccaagagugaaucaauuucauauuaauaaugacaccauacuugauaguaguaaucaugaaauuuuguauaaaaauuacauuuuuuaaagaaauguaugcauguaacuuuuugucucauaaaguacugugacaaaaguacuacaacuuuacuguggauuuacucagaaaaauguaugucaauuucacacugagauuaaggugaagcauguugaaaguaaaacuuuuaucuuuuacauuuuuuauuucuaaaucuauuauuaaauuauuaaaaucagaagugaugagauuagcuucuaguuccaauuaagauggaguaaguaaaugcacaucacucuauuccucccacugauuaugccuaaaaaagauucugaacagaauacauaaaguagcuguagaaagacuuugaaaaguaaauauagcaggaagauuggaaagggaaaucaaaacuugaaaagagacaaauacaguagugaauuuccugcuuuuagcaauuucuuccuacauccuccagcuuagacucaaggcagucagaauuccagaacuguacaguggauucagacagaaaaugcuguggcucacgccuguaaucccagcacuuugggaggcccaggcaggcagaucacgaggucaggagauggagaccauccuggcuaacagggugaaaccccaucucuacuaaaaauacaaacaauuagcugggugugguggcgggcaccuguagucccagcugcuggggaggcugauggcaugaaccugggaggcggagcuugcagugagccaagaucgugccauugcacuccagccuaggcaacagagcgagacuccgucucaaaaaaaaaaaaaaaaaaaaaaaaagagaaacucucuuucucuaaugagagacccuguaaggaaaucccuggugacaaggaaaaaaaucaaugaaauuccauuuguuuguuuguuuucugguccugcuuugagacaagauauacuccuaaaacugcacuccugugucaguggcaguagcaacaaugaccaaacaaguaccucaaauuaugagaaagaauggagacaacccagaaaagagucagugaauuagaacagaagaucaggagaaauugucuauuguaaacaacaggaaaacauuuguuuaauaaagggaaaagagccuuaagaaucuguaaaacaauauaaaaaugucuaacccuacaggucuuugaaaucacaguagaagaggaaagagauugcugcagaaauuucuaaaaaaauugaauauguaauggcugaaaacuucucaaauuucgcaacugacauaaauuuacagauugaagaagcuuagugaaugccaagaaaacaacauccaaagauauaaccaaauuacuggaaaccaaagagauaauucaucaacagcaaugcugcuuuaaaagaaaugcuaaggaaaguuauuuaaacagaaaauaagugauaccagagagaaacuuggaacuucaugaaggaaaggaaagcaacaaaaauaauaaauaucuggauaaauauaauaaauuguuuuuucuccucuuaaguucauuaagauauguauaaugguagaaauaaaaaguuaacaauauugucuguugggguuuccaauguguauaggucggaaacaacuaauaauaugaaggagaagacuuuaaagagaaccaaaugucuguaagguuuauaaguuacccaugaagugauaaaauuuuaauucuagcugggugcgguggcucacgccuguaaacccagcauuuugggaggcugaggcagggggaucaccugaggucaggaguuugagaacagccucaccaacauggagagaccucccucucuacuaaaaauacaaaauuagguagucgugguggcgcgugccugaaaucccagcuacucaggagaaucgguugaaccugggaggcagggguugcaaugagccgagauggcaccacugcacuccagccugggcaauaagagcaaaacuccaucucaaaaaaaaaaaaauuaauucuaaguagacuuugaaaaaugaaguacauauacugaaaucucuagaacaacaucaaaaaaagggaaaaaagcaacucugcaaauuugcagauguucaaguaauucaaaagaaggcagagaaugagaaauggaagugaaaaacagagagaagagacuccauuuucagcagugacauguaaagaaccuagaaucuaccacuagcauucuuacaagauaaagcuaaaaaauugagaaucaguguuuuguuguuuucuuccccccaucagagaacugagauugcagggcaaccacuagccugaaaucuggagagaaaagcaaauccagagacucauggccgagaucugcuuacuuagagccaaagccacuggagccauaaauuggugggaacauuuaaaugauaguuuugacaaacugcuggaggcugaguguggacuaacaugggagugugacaccucugggagcagcagucuuagggaggcccccacacuuucauggguuuugcuucuauguauuuuaucagguacuucauauucugaugaagauccuggaaaagguccccucguaguucuugcagagagagggaggguaaucauuaugaaauauacccagaguauucuccaacaaaggucuacucuguaggggaaaauauauuauuagaccccuauccugguuuggggagggcauuucucccacuucagcucacucuagccuuccugugucgguuucagugggggaaaauguauaccacuggagaaaagcccaugaaggucacagcucagagaaaauaggcaaaguaaaaaauaaagguuuaauccuaaaauuauagacuguauuucauuccccauaccuuacuaccauaccaacagagcucugguauaauaacaaugcauuucagcuggaagaguugcaagaauggacucuuuuucugaggaauaguacugagauaagcucaaagucaauggaugagacaaacauaaggauacuagaggaacuugaaguuucugacaucuauagcaaacauuaaacacagcuuaccuccuggccagauuaacaaauccacaucauauguuuaccuuuguucuuauuacucaaugcaacauggugaacuuucaacaaaaaaaauuagaaggcacaccuaaaggcaagaaaaaacagucuguagagauaaagcaggaaucagaaccagacucagauguuacagauaugcgaauuaucagcuaaggaauauaaaaaaaccaugauuaauauguuaagggccauaauggaaaaaauagacaucauguaagagcacaggagauacauaaagcagagagacacuaagaaaagaucaaaaggaaaugcuaggcauaaaaaacacuauaacagaaaugaagaaugccauugauaggcuuaucaauagaaugggcacugcuggggaaagaaucagugaggcaaaaauaggucaauaggaacucccuaaagugaaauauaaagagaaaaaauaaugagaaaacaaaaacagagcauccaagaauggugggacauuuuaaaaagguauaugauuuaucuaucauuggaauaccagaagaagaaggaagaaaaaagaagaaauaugugaaguaauaauggccaagaauguuacaaaaucaaugacagacuuuaaaauauagauccaggaaccucagaaaauaucaagcagaaugaaugauaaaguaaguaaaccgugcacauuauauuuaaaaacugcagaaaaccaaaaacuaagagaaaaucuuggaagaagcaagagcuuggaggggaaaauaaaaacuuaccuauagaagaacagaauaagaauuauggcagacuucucaucaccaugcaagcaagaaaagaguagaguaaaauauuuuaaaaguugaaagaaaaaaaauaccaacugaccuauaauuauauaucugugaaauuaaccuucaaaacugaaggacaaauaaaauaaauaccuucucaaacaaauacuaagguuauucauugccaacagaccugaaacucagaucuacauaaagaaaggaaaauaaugauaaaaggaaaaaaaugaagguaaaauaaggaucuuuuauuuuucuuauuccucauugaucuaaaagaaacuguauaaaguaacaguaggaacaacaugcugggugauaaugaaacaggaaguuuucccugaugccuucgugguggugggggaauuggagugcuggugcuggagcuaguuggcggcuuuggucagcuucacuuggcuuuacucugcuucacuuggcuuuacucggcuucacucgcucagaucugcugcccucuaccccuugcgggagggggagcacagcugagccagugcaggagccaagacgagugcuucugggcacugccaggagccaaacuccaugcgggccauggcaacaccuagugagggaguaccugcaaccccucaaagccccagaaguaauguuacagucaguacucuuuuagcuuugccauccauggauggcuuaaguguuuaacaguucaguggacccuuugccuguucacaaguucagagagugugauagccuuguguauccugagcucuuguccugcguacaggaaagauuagguugcaugaaugaauugaaggacaguaagugugggggauuuuauugcugauggaaguggcucucagcgggaaagggagcuggaaagaggauggagugggaaaguagucuccccuugaagucucucuggcuagacucuucuccaaagucccacugucaagccauuccucugaagucaagcugcuucucuccaacguucagcugcuguuucuccucuccauguuuggcugcuucuccuucucugccagcugggucagggguuuuuauggguauaggauuuggggcagggcaggccaugggugguuuuggaaaaggcaacauucaagugagaaaacaggaauguauguucucacuuugggccgugcuuccaggcuugaggauggggccuucgcuggggacccugcccuuuucugccuagaauuuuucugccuccuguuccuaccaauaauaccauauggauaagggaaaugaaugacugcaauguuaaaagagauaggagaaaguauuugggaauacucuauuacaaaguaccuguacugcaaagaaaacaguguaguguuauuugaagguggacuuagauuaguuaaaaaugaauacugcaaacugcgggacaacuaaaaaggauucuaaagagagauauaagugaaauguuaagagauaagauuaaauagaaucauaaaauguucauuuaaaaccagaagaagaagaaaaauaggacggggaagaaagaauaaagucaacaguuagaaacaguuacaaacaagguggaauauaacuaugucaguagucacuuuaaaugugaaugguguaaacauccauuaaaagacaguucagaguggauaaaaaacgaaacuuaguuuagaaaagcaagacuuccucccaucucuuaugacauggcaguuauucauuuuccuuguccauauugaaauuaucacccaguauguuguuacuauuguuacuuuaaacaguuuccuuuagaucaguggggaauaugaaaaauaaaagauucuuauuuuacuuucaucuuuucuuuuaugauuuuuuaaggcaagcuaugcauugucuguaagaaacucacuuuaaauauaaagaauagguaagguaaaaaggagcgagauggagaaagauauaccauauaaucacuaaccaaaaggaagcugaaguagcuguauacauuucagagaaaacaaacuucagagcaauaaacaucagggauuuaaaaagguugggggagcauuacauacguauuuggcagucaauucuccaaaaagucuuaucaauccuaaauauaugaacuuaacaacaaaguaucaaaauacuugaagcaaaagcugacagaagugaaaugaaaaacagccaacuccacuauuauaguugaagacuucaacacucuucuuucaauaauugauauagauuaagcaggcagaaaaucaguguaaguagguaauugaccugagcaguacuaucaauuugauguaauuagcauucauuaaaugcuccauuuaacaagagcaaaauauacauuuuuuucuucagcuuauaggagcauuuaccaagauagaccacauucuuggccauaaaccacauuuaacaaaucuuuuaagauaguaaucaugcaaaguauguucuuagacuacaguggaauuaaacuagaaaucaguaacaggaagaaagcuggaaauuaguuaaagaacauauuucuaaauaacacaugggucaaagaagccuccagagaaauuuuaaaauauuuuaagcuaaaugauaaucagaguacaguuuaucaauuuuuuuuugcaauuuaguaaaggcagugcuuaggggaaauuuauagccuuaaaugcagguucuagaaaagaagaaagaucuaaaaucaguaauaaaaaguucuaccuuagaaaacuagagaaagaagagcaauuuaagcccaaugcaagcaaaagaaaagaaauaauaaaaauuagagcagaaaucauugaaauggaaaacaauaaauucaacaaaacuaaaaguuauuugaaaaaaauaaauaaaauugauaaaauucuagccaggauaaggaagaauaaaagaagauagaaauuaccaauaucagaaaugaaagauggaucuucuucacugaagcauccaugggcauuaaaaagauaauaaaggaauacuaugaaaaacuuuaugccccaaaauuugauaaaugaaauggaccaauuccuacaaacuaucaaaacuuacacaaguguaaauaaaucugaaugcuucuauagcuuuuaaaaauugaaucgauuauuuaaaaauuauaauuaauaauuuucagaaaaagaaagaaucaggaccagaugaauucacuggugaaauauacaaaauaaaaaucaguucuaagauaacaaacaacccuauuaaaaaguaggcaaaaaucugaauagccaucuuauuaaagauauagaugucaaauaaguauaugaaaagauauucaauauuauuugucaaauugcaaauuaaaaacaaugagauaccacuguacacuuacuagaacggccaaaaccacacacacacacacacacacacacacacucacucugacugccgauuggugacaaagaugcagagcaacauaaacucuuuuucguugcuggugguaaugaaaauggcacaaccacuuuggaagacaguuuggcaauuucuugaaaaauuaaauauaguuuuaccacacaauccagcaaucacacuuguagguauuuaaccgauuuaaaaacaauauccacacaaaaaccugcacaugaaaacugcacauuauagcuuccuucauaauugccaaaaacugggagcaaccaaaauguccuucaguaggugaauggauaaacugugauauauccauugacauggcuaggcuuugugucaccacccaaaucucaucaugaauuguaauccccauaaucgccaugugucaaagaagaaaccagguggagguaauugaaucauggagguguuuuccuccaugcuguacucaugauagugaguuuucacaaaaucugaucuuuuuauaaggggcucuuccccuuuuugcuuggcacuucuuccugccaccuugugaagaaggugccuugguuccucuucaccuucuggggugauuguaaguuucccgaggccuacccagccaugcugaccugugagucaaucaaaccccuuuccuuuauaaauuacccagccucaaacaguuccuuauagcagcaugaaaacagacuaauacauccauaugaucaaauauuauugaauuauauaaaagagcuauaaagccguaaaaagacauggauaaauuuuaaauacauauuacuaagugauaaaaacacugaaaagucuguauacuuuauaauugcaauuauaugacauucuggaaaaggcaaaacucaccagugguaaaaaauaucauuaggugccaagguucagggaaacacaagggauuaauuaggguugugaaauuauuggauacauggcauuaugcauuuguccaaauccacagcacuuacagcacaaagaacaagucuuaauguacgcaaacuuuaaaaaaacucauuuagaagguugauggaucugaggauggaaugcaggaggugaaaaaauaauauaacuguaguacaaauguaugaaacaaccuacugaagcaaauggaguugaaauguguugacuuaaguuaccuugaaaauaaguggaguccguaagacuggaggcaaaagaguacuguagucuaguugauaaaguuauuuuccaugggaauaaaguuguuaaccuaccuaccagguuaacaauucugauauuucuauauguauauacugaaauugaacaaguaaauaaguugaugguggauggugggagccagguuucucucuauuugaguaggauuuacagauaagcaaggggaggcagcuagaagaaaucauguaguaaugcauuagaguuggaaaccagaaugaacucaugcuuugcuuauagacacaguuacauauggaaauacuuaucgauaagggaauaggcaaauguuaguauacacguauauuuccuugcucucagaaaagagggccuagaagcaacaacaccccaguagaugaauguacccacuugccagaucuugauuucuaagaccauucuccaguaaaaggaacuaaggcuccuuggagaaauggaugauucuaaaagggcuggggcaggaaauacacaaagugagcauggggcaucuugcagugcuagaaaguaaggaugugcucaaacacauacacagguguacacacaugcacacauacacagugauggagguauaucaaagggacauaggaggaaguugauggagcuucccauggucaaaauggaauaauuugaccaacaaaauaaauaauguaauguuguauaaaugcuacaggcauuaaaagaguaauguguacauuagaaacaacuuuauuacacaaaguugacaacuuaguugaaauagaccauuucuugaaagaugcaaacuacuaauauucauucgagaugaaauugauaacucaguaauacucuguuuauugaagacauuguauuaguauuuguaaucuucaaaaaaaaucaaaaacaaaaacgaaaaacaaaacacugucccagauaguucugggaaauucuacaaaacauuuaaagaagaaaugauaccaauucucacaguuucuucuggaaaaauauaagacagaauacuucucaacuuauuuugugaagccaaucuuaaccugcuaccaaaaucaugcaaagauggcacaugaaaauaaaacuaccaagcaauguaucuuuaugaacacaaacagaaaaauccucaguaaaauauuaguaaguugaauccagcaauauauacaaggaauauuacaccaagaccaaaagggguucauucugauaauucaaagcugguucaauauuugaaaauuaaucugugcaacccaccauauuaguagacuaaaagguaaaaaccacaugauuuuaucaacaaaugcugaaaacacauuagguaaaauucagcauccuccuaagauaacucuucacuaacccaggaaaaaaaaaggaaacuuuguuaucucaauaaggggcaucuacaaaacagugucuacagcuaacauuuuaguaguuaaugaugaaaaacugaaugcuuucuuccuaagacuuggaauaaggcaagaauguucauugucaccaccuuguucaacauugcacuguaauucuugaccaaugcaauaaggcaagacaaauaaauaaaaggcauacagauuagaaauaaauaguuccuguugaaagacgacaugacugccuacauagaaaauugcaagaaaucuauaaaaagaaagucuccuaaaacugaguuuagcaacaauaauauauaaaaauaauauauaguagcaaugcacaauguauuaguuugguacaaaaguaauagagguuuuugccauugaaaguaauggugaaaaccacaauuacuguguacccaucuaauaaaacauuuuuaaagaacuguuuacaauagcuccaauuuuuaaaauacuuagguauaaaucuaacaaaauuaugugcaagaucuguguguugaaaacuguaaaacacugaugaaagaaauucaaaagacccaaguaaaugaagagacaugcuaugauuauggauugaaagacucaauaugguuaagaugucauuucuuccaauaagcauaauccaaauaaaaucccagcaagauuauauuuguagacauagauaaacugaucuuaaaauuuauauggaaaggugaagaaacuguaguagccaaaacaacuucgaaaaaaaggaaaaagggccgggcacuguggcuuacgccuguaaucccaacacuuugggaggcugaggugggcggaucacgaggucaggagauugagaccauccuggcuaacacggugaaacuuugucucuacuaaaaauaauuaaaaaauuaguugggugugguggcaugcaucuguagucccagcuacuugggaggcugaggcaggagaauagcuugaacccaggaggcggagguugcagugagucgaaaugacaccacugcacuccagccugggcgacagacugagacuccgucucaagaaaaaaaggaaaaaaaaauagaagauuuacacuaucagauuucagacuuacuagaaagcuaugguaaucaagacaguauaguauuggugaaagaauugacacauauauaggucagugaaagagaauagagaguccagaaauagacucacacaaauauggucaauugauuuuugacaaaggugcaaaugcaauucaacaguaaauggauauauaaauugugguaauuccauacaauagaauuuagccauauaaaugagugaauauuaagauacacaacauagauaaaucacaauugccauacuauacuaaaugaaagaagccaaucugaaaauguugcauagucuauaaguccacuuauauauaacauucuggaaaaagcaacacuauuacccuaaaaccuuuauuugaauagcaggaguuauagucaugucauuuguccucuacauggagcacauacaucauuuacacauuaaauauguuuucauguuuuucuuuuauuuaaccuuuaaacucuaaaguacauaguucugcuuggccccaagaugauuguaagaaacauggacaaugaaauuuuauggcuauaggugaccgucuuaauuaaaaccuucucauagcagauuuucagaccugggacaauauauccaagaaugaaucuuacccaccacuauuuuuucaccccaacuucuucacucuuauuuggaaaauaacugcauuuaaaaauaaaauguuuacuucaugugguaaucagugucuugcaguacaagaaacccugaucuaggaguuugaagaccuaggugacuuugggcaagucacuuaauguuuauuuuuuugcaucuuaaaauaaggauaauaauaccugugcugcuuacuuuauuuguaaggaucucaggugcauuacaguaauuucacaaugguuuuacagaguaaaucacuuuauaugugguaaagugcuugguaaaugugucaucacuauuauuaaauaaaagaaaccaauauuuugugguauuuuguggcaauuaaagcugguucaacucugaaaauuucuauaauuuuaaaaauuaaugcagaaugaaggaggaauaaaaucaaccucaugaaguugauuacucucuaguuuuaaaaucuuauuuaacuacaagauaagcuauucugguaaauucucggugcauggcgagacauuuagugcgaauuaaaguuguggaaacaccgcuaggaagaauaacaagcaauauacuucuuaaaguuaauugcaguuaugaaggaauucauaguuuuaguuaaaacugcaguuguuucuuucuagcaguagaugccaguagaguucuucuuuuuauuuuuauuucuuaaucaaaaaucaaauauccgaaguacuucuauagcaauagcuuccuggucacauuaccacauauagaaacauugcuuuaaauauuaaauauucuauuuucuggaaggacuugauaacaaauugaaacaauuuuauuuuuaaaacagugcagauuuaaaauacgguguuuucaagauacucaucuagugaaguuuacucuuuuugcuuuaguaauuuuguuuuaaagcuuaugcauuguuuuaaauaaaguaaucuuaguguucuaguuaggaaucugcaacuucuguacuugagcaacauugaauauaaauaaaaaaucuggcuagauguguuaaaaaugaauacgguccagcugaaauguuacgauuaguuuguguauuuggcaauggaauaccaugaguguaauacuuuggggagguuaauaugucagagaggugaaugauuaaaggggguaauuggaagcggggaaaacaagaaguuaagaaguccacauuggcacugaguaaaaauguaauucaaagaaugaauaaaauuuaguaacaaauagaaaaaaggagaaguucaaugauaacaguucuauuacucuugucucuauauaugagcaacuuggugcuucuuggauuaucuauaaauauggucccaucauaaauaaaauucaaacauuuucaaguauucggugauucuacuuagaccuuuaaauuguuaaaaaugagugaauacuuuuuucuuuuaacauguuuauugaguauguaauacaugcauuucauuuaugaauucaaguaacucacaauuuagggucauauaaauucauaaacaguaccuuuuaacauaauauuaugaggucagugaaaacaaagcagcaaaguuuguuuuccuaggaaguauguggcagacuucacugaagaggugacauuugaacuaagccuugaagaugauuagaauuuccuucaguagagcaaaucaagggaauucaguaauuuuauccacuucuucccuuacagaaucaguccaugcucuguagauauuuguugaagacuacagacauuuaauaagugucuguuuuguguaaggcacuaccagauguuaagaaacaaauuauuguuaugcacacauaauauuuauacauaaagcuacaaauuuaagaauuuugucauauagaugcuguugcauauuuguuuagauugauaaaaauuuuauuacacaaaacaaaguauacagaaaugagcuguuacauggcaaaauucauuggucaguguuuuguuaacuguuauucacacauaauauuuauacauaaagcuauaaauuuaaguuuaucuuauagauacuguuacauacuuguuuagauugauaugaauuccauuacacaaaguauacacaaaugaacuguuaaauggcaaaauucacuaaucaguguuuucuuauuggccuuuuauguaguccuaauuugauuacauuauuguuccuauuuauuuuacuuaucaguauuguuucuauuuuuuauguuugucaaacaguuggcaguaaaucugaaguaagauuuuuuuagauagauuguuuuagauagaccuuuuucuuucuuuccuuuccuucccuucccuccccuccccucugcuuccaaagagaaccacggaaauuucuuauccuuuagugucaaaaaaacaaguacucaaaauuuuuguuaaaugccacagguuacuuucuuuccugaaaauugacaaggcaaguuuuacuuacuuuuaaucaaaagagauguuuuggccaggcgcgguggcucacacuuguaaucccagcacuuugggaggccaaggcgggcguaucgcuugaggccaggaguuugagacaacuccugaccuggccaacauggagaaaccccaucucuacugaaaauacaaaaauuagccgggcaugguggugcgcgccuauaaucccagcuacucggaugucugaggggcgagaaucgcuugaaccuaggagcggaggucgcagugagcagaggucgcaccacugcacuccaaucugggagacagagugaaacaacguuuaaaaaaaaauagagagguguuucuaagugagaucacuaaaucagggguuuagguaaguaguagucuucagugguaagguuuuaaaauuaacaugucucagccaacuagaaggaacuuuuuucucucaauugaaauuucuugcuaugguggauuuuauauaauuuaaaucuuguauuuuguucuuuucaaauuuuagaauguuuuaaaauguaccccugguaauagacauaugucagcagauuauaaguuugauaagcaauacugacauacuaaguguauguaguuccuguauguauuaggccuaaaucaaugaauuagaaacauucaauuuuuuaaagugcuauuucacauuguuuuauuuauacguguuauaaauuuguuuugcaagaguuuuuucauacccauuucauacuaguuuuuuuuuaugaaaaguuagcugcuuauaaggauucauaaaaucuguauauuaguugauuuccuagaaaaaauacaaccugucuuuagcauguuguguuuggaggacagcuuggccuucaguuguuugcauagacuugucauacauguuuaacuaguuuucuuuuuaaagaauguuuagccuacuauauauauaaagcuuuauauuuaaugcucucauuagccuauauauuaauauuaaaacacccaaacauaaagccuuuuaggcagauauugcaaguuuuuaaaauccucaacucuagcugaaaaguguuuugcuaagaaaagcucaguaaugugcuguuuuauauuaacaggaaacagaacagcaguagugguuugaauacccugcaaacaggaaguuugacacaugcauagcucuuagcuucuguguaagaaguugugagcuccuucuggaaacauuugcaguuacauuaaguaaaguguaaaugcacaugaauggcagcuuauagagaaccaccuuguaaccaguauacagguacaacuacagcucuucagaaauuggaagguuuugcuagccgguuauuucauagacacucuaaagguacugcacaugaucagaaaacagcucuggaaaaugacagccuucauuucucugaacauacugccuuaugggacagaucaaguaaguuuuguuuuuuaaaugauacauuauaacuagcaacuaaaaugguaauuggaguuuuacaaucaaacauaaagaacccucuuuuguuuguuguuuucugauuuucacaaggacauuuugcaagaugaaguugaaagaauuccauaaaaacuugauuauaaguugagcugaaucauucagcuuucaucauuguaugguuuuauuuuugacuaaguucaauaucagugacaagauuuucuauaaaauucuuacaucauuucuaauguacuuuuuuuuguuguucuuacauaaaaaugaaauacuuaaguuucagaaacaaccaucuguuuacuucuuaaaaugucuuguauuuauaagcuuuaaacuuugaaaggggcaacaagacucuugaauuuauaauuacauuucuauuguguuugccaugguuuuauuuuuaaaugcaugugagaaaguuauuucaguuuuacaaacaggaauuucuaaaauaaaacauaauuauucuaucuaaauucuuacacuuauaacauuauggauaucaaaaacuuuauaauuauauuuuauguuauuuauacauaugacucaaaugcaggaaaaguugguuaugcaugaaucacauucuuucaggcauguuaaaauguuugaacuugcagcuuugcuaaaauggugcuggggaaccauuuuuggugccauacacucuaaaagauaaauugcacauauaaacaauacuagugccgccauucuacaucucaccuuggacccuccucaagguauuucugugacuccaauuagaggaacaauagaauuacccuugaaacuuuugcccucuuugguguguuuguuugaucaucaaauagcacuagcguuugacucuuucuguuuauguauuugguagcaguuaaggaagaaaacucagcuuaacaaccacaacagcaaaaucaagaauggcuuacaaaauuuacuccuagguuuauacagcaccuugacaguguuauagaagcuuauuugaauuaauuuuuuacuaaaucagaaauuuuuuuacauucuucaaacuauuuuugggagauugaggaagaacauguauuugugcauuuuuuccacuuaaaagguuuuggguuauuuauagucuuuacuguauagcaaguugauggaugaggaauaugaauauauaucuucaaguuaaugaacuguugaauauuaaaauagugguauaauauuaaacuuuaccauguaacaaaagcuuguuaauuauuguccuugcccuauucuuuuaaauugcagucuuuuaaauccuuuuggaaauuauuuuuaugcauuucaaguauguuuuaauuuaaaguuaaaugaggaauuaagacagaauugaauuaauuucuguuucauuaauaccugcucuucauauaguggguguuuaguaaaagugucucaaauaaaugaauguuagggguuuuuaauaauuaaaaguuauguuugaacuagacuuucaccacuuuuuaaauguaugggaucugugaugcuuucuaaaacauauuuuaaaaucuaguaauggaaaauaguaucaugagccaugauuucuauuggauaaaaugcuguuuuguuuuuuuuuuauugugaagucaaaacaaauaggauucuuguacacaaauaaaauuaggagcaaaccauguagcgcugcaaauaauaugcaugauguaagaaauacuuaaagaguaacugaauguucauuaauuaagcauuccucuacuugacucuccuuuuuauaucccugaauaccauaauagagauaauaauuuuaugucuaaggaugaguaugguagcaugaagcuauaauuuccuauuaugaaauguauuauuguagaggagaaaacacugauagagcugaaauagaggaauccgaucauuucaaaauuccaagguuuauuuuuguggugaaaacacaauuuuuauuuauuuggcgaaugaguuauagaaggaguucugacuguacaaaguuucauaugaaccacauucuucaaagcuacuuaaagcaguuuacuugcaugacucauuugacaagggaauguaaugucuccugaugauaaacacugaauauguuuguuccuaaaguguuuuuauaaugaaauaaacuaagcauagaaacuacaucaauuuacaaaaaaaauucauaaaccuuuguauaaagaucaguuaccaauuuaggagacaugaaaugcagcaugcuucaauccaaguuucuuucguguccagugacauuauguauaggaagaaacacagaacaaaggccacauaguggucucagguguuucaucuuuuacuauuaaacuaaguaacagaaauuccuguuugauuaaauaaauauguaacagcuaauugcaugcacauauaaauacaugaaguucaaagaaaagcauggaggaauucugcuuuuuguuccaacucagaaugaaugagagcauugacaugcguuaaguucucuuucuagcaaauuuauuauaguuagcuuuuuaaucuuccuuugaucauaaauguguagaguuauacaaugcugacuuaaugaaggucuaacuacaguauuuuaagaagcaaauaggucaauaccaucaaauacuuuuucuuucccuuuuccuaugaauugacaggcuauuucucuuguaaauacaaauccauuuuaguaaaucuuagauuuaaauauauuaaacaaaugagcaguuuugauuauggauguccucuagcaaaaucauaaagugguuacaguagaccacuucagucaguuuuaccuuugcaaauuuuauacaaucucucagacaguuuaccuccuauuuguuagcccauugaaucuguaucauuuuaacuucucagcuaaaagacuuuccaccuuugucuuuuuaucagcuuuuuccacuugaaacuauuccauaagcuucuugauaauagucaauuucuacucauuugguaaaacuuuuuugaguauuuacuauaucauaguaaguaagcaaguuuccaggaaaaauaagaucuaguucuuacccccaaaaagaagagcaaacauaauauaauauucaaggcauaaugaaauaguugcuuuaaaaugucuaagcuuacuguggaagcuaaguguaagaaaaaaguuguuacuaaagagaaaaugggggacuucaaaaauauuaaagaaugaauagaauuuugagaccuagagaagaagguuauuuuaagaaaauaacauacacaaguauuugaaaauaugaacauuuagaacuuacuuaaaagguuuaguaagauacugucuagaaaauuagguucuggauuuaaacuuuaaaaguuuucuauuagacauccagaauuuuguacuacgcuguauuaguggggagccaaugcaguuuuuuaaaguggaaaauaauauaaugcaaccuuuguuaaaagagccuaaagauuuuaacuagcauaauacaggauaaguuaacuuacuuuacuacagagaaauguguauagcuacuauacaucuuccguuuuugcugggcauuuaauuagaacuaacgcuuuugacgugacagucagcauggcaaugaauagucagauaauggauuccuuuuacaacagugcuuguucaaguugcugcuucugucuggaauucucuuucuucacuucuaccaguggugagauuugcccauacuuuaggcauccucucagguaucaucucuguaacaaaaccaccaauguauccuauucaucuauccuucauccuucuuagagucugugcucuuccuuauguucuuauaucaucuuauacuuaacuuuuauugugguuuauuuauaguauuuauaugguauaguuuguauacuauauauauuauaguuuauaauauuuaaaaugcauuacuauuaauccuuauguaucugucucucauguuugauuuugaacuccuugaaggcaaauaacuugucaguuuauuucaguauuacuagcauaauuuucaauaaaucuugaguuauuuguuaaauuaacauuaaacaucacugcaguauuacacaaaugagcuucuuacuaauuugugcuauugugaucuuugcaauuuauuuuaaaagcccauggccauuaaccaaaagcagucaaaugcugaccuggcucuaguaaauaccaauuuucaguguuaccuguguauuuuuaucaugauuuccaauaaaaauuuaaguaacaagcagacuuuauaguaaaacuaaaauaguugggauauuaaaugauguugaaaucaggaaaucauuccaugagccauuuagcaaugcaaguacuauaucaacuguacuaacauaacgagaagcuuuuacuugcuugugcuuugcaaaaauagccauaugacagaguuagaagacagcuugcuacucaaaguguggucccuguccagcauuauuagcaucuccugggagcuuguuaggaggaagaaucccaggucccaccuagaccuacuuagucagaaucagcauuuuaacaagauuucccagcugauuuauaugcacauuaaggugugagaagcacuuuuucccuaauaacauuuuaauaugauuuccaaauguauaucuucacuggagaaaauuuugaaacuacaggaaaaaacaaaaagguaaaaaaaaguauacauaauucugccaaaagguaaugacuguuaauuuuuguauauauacucuauuuuguguauagacacacaaauuucuaccagcuccaauuuuuuuuuuuuaaacagagucuuaccgugucacccaggcuggagugcaguggugggauuucgacucgcugcagccucugccucccaggcucaagcgauccucccaucucaguuucccaaguagcugggacuauaggcaugugccaccauacccggcuaauuuuuuguauuuuugguagagguggaguuucaccauguugcccaggucgaucuugaacuccugaacucaagugaucugccugccuuggccucccaaagugcugggaauacaggccugagccacugcacccagcccagcuccagaauuuggaucuuucaaaacauaauguuuaguuaacauuuuucuuuauaaagaguuguucuacaauacuauuuuguauuaaaucauaaggauauacuauaauuuauuuaaccaaucauuggccaucuaggcuguuuuuaauguuuugcuauuaaaaaaugccaugauaaacaucuuuauaacuaaauauuuguacauauuuaggauuauuuuuauauuuuauaggauuaauuugaagaaguuaugaccauuuuaaggcuuuugcauuaaauuaauugaaucccagauaaacaugcauaucuuuuuggaguuaauuauuauaauaauuauuuuuucauagauuauagcacuugagaaugugugaaaauaauuauauagcuacuauccuuaaugauauuuuuaaaaacaaauuuaaggccaggugugguggcucacgccuguaaucccagcacuuugggaggcugaggugggcagaucccuugcagucaggaguucaacaacagccuggccaacauggugaaacccugucucuacuaaaaaugcaaaaauuagccaggcuccaucuacaggugugguggcgcacaccuguaaucccagcuacuugggaggcugaggcaggagaaucacuagaccccaggaagcagaggcugcagugaggugagauugcaccacugcaguccagccugggugacagagugagacucuaucucaaaauaaauuaaaauaaaauaaaauaaagaaaacacauuuaacauuguaaaauuuauucucaaaacaguauauugauauuuuuaaaaauuaaaaauauaauggcccauuauacuuccuucuguuacaacuaccagggucaugguaagaacauuauauguuuguccccuccaaaucucauguuggaaugugauccccaguguuggagguggggccuaaugggaggcguuugggucaugggggaggaucucucaugaauggcuugguguccucccaauggguaaugagcugguucuugcuuuauuaguucaugcaauaacugguuguuuuuuuaaaacaaacauggcacuucccccucucucuugcucccucucuuugccugugacaugccugcucccucuuugccuucugccaucauugaaagcuuccugaggcccucaucagaagcagauguuggcaguaugcuucuucuacagucugcagaaccaugagccaaaauaaaucucuuuauaaauuauucugccuuagguauuucuuuauaguaaugccaaaauagaccaguccauaacaaaaaucugaaugugaaaaauauggauuugagaauuuaacuccauucuuaauaaguugacacuggaaaguuuauuucuuccucccucccccucagcuuuauuaagguauacuugacaaauaaaauugcguauauuuauaauguacaacaugaugguucaauauaaguauacauugugaaaugacuaaaacaaaugaauauccaccucacauaguuacuuuuucauggcaaaaaauuuaagauugaaucucuuagcaauuuucauguagucauaccucagagauacugcagguccaguuccagaccaccacaauacaacuaaagucacaguaaagcaagucacacauuuuuugguuucccagugcauuuaaguuauguuuacucuauagucuauucagugugcaauaacauuauaucuuuuuaaaaguacauaucuuaauuugaaauuauuuuauugcuaaaaaaauacuaaugaucaucucagcuuucagcauuucccaauuuuuuugcugguggagggucuugcauugauguuugccugcugauugaucaaggugauggucgcugaagguugggauggcaguggcaauuucuuaaaauaagacaacaaagugacacacuugacugacucuuauuuucauaaaagauuucucuguagcaugugauguuuuugguagcauuuuacccacaguagaacuucuuuuaaaauuggagucaguucucucaaaccuuguuacugcuuuaccaacuaaguugauguaauauucuaaauucucaggugucauuucaauaaucuucacagcaucuucaccagaaauagauuccaucucaagaaacuacuuucuuugcucaucugcaagaagcaacuccucacucguuauaguuuuaucaggagauugcagcaauagagucacaucuccaggcuccacuuuuaauucuaauuaucuuguaauuuuuuaccacaucugcagugacuuucuccacugaaauuuuaaaccgcucaaacgcaucuaugagaguuggaaacaacuucuuccaaacuccuguugauguugauauucugaccuccucccauaaaucacaauguucuuacggcaucuggaaugguaacuccuuuucagaagguuuucaauuuacuuugcccagauccaucagaggaaucacuaucugugacaccuuuagccuuauaaaauauauuucuuaaauaauaagaccugauccaugccugcagaauggauguuguguuaucaggcaugaaaacaacguucaucuccuuguacaucgagcucuugggugaucaggugcauugucaauuagcacuaauauuuuaaaaggaaucuuuuucugagugguucccaauggugggcuuaaaauaguaaacaaugcugcaaacagauauggugucaucuagccuuucacauuccauuuauagaguacagguagaguagauuuagcauaguuuuugagggcacuaagaguuucuaaaugguaaaugaauauuggcuucaauuugaagucaccagauguauuagccccuagcgagagucagccuguccuuugaagcuuugaagccaggcauugccuucucucuagcuaggaaaguucuagauggcaucuucuuccaauagagcacuguuaauucugcauugaaaaucuguuguuuagucuagccaccuucaucaauuauuuuagcuagaucuucuggauaaccuggugcagcuucuccauuagcacuugcugcuucaccuuguacuuuuauguuauagaaagggcuucuuuccuuuaaaccucaugaaccaaccucugcuagcuucagacuucugcaacuuccucaccacucuuagccuuuauagaauugaagagugucaaggccuuguucuuaauuaggcuuuggcuuaaggaaaugcuaugacugguuugaucuuuccagaccacacaacuuucucuauaucaacaauaaggcuguuuugccuucuuaucauuaguguguucacuggagcagcacuuuuaguuuccuucaguaacuuuuuucuuuugcauucucagcuuggcuguauggugcaagaggccuagcuuuuggccugucucagcuuucaacauaccauccuuacuaagcuuaaucauuucuagcuuuugauuugaagugagagaugugcaauucuuccuuucgucugaacacuaagaggccauuguaaggcuauugaucggcguaauuucaguauugcugugucuuagggaauaggaaggcccaaggagagggagagaaaugggggacuagcuggugaguggagcagucagagcacacacaacccuuaucaauuaagcucaccauuuuauuugggugcaguuuguggugcccuaaaacaguuaaaauaguaacaucugaacacagaucgccauaacagauauaauaauaaugaaaaaggaaauauugugaaaauuauuaaaaugugacacagagacaugaagugagcacaugcuguaagaaaaauggcaccaacagauuugcuugacacaagguugccccaacccucaauuugugaaaagugcaauaucugcugagugcaauaaagcaacacacaauaaaaugaggggugugccuguauuaaugcauuauuauuaacugcaguuaccauucuauacgaugaaucuccaggacuuauucauccugucuaagugaaauuuuguacccuuuagccaacaucuccuaaaucuuccuucccugaacccucccauccuucagccccugacaaccagcauucuauucucuacuucugcgauuuugauguuuuuagguuccacaugugugacauuaugcaauauuuguguuucugugucugccuuauuucacuuaauauaaugucuuccagguucauucacucuaucacaaaugaaagaauuuccuucuuucuuaagguugauaguguauuccaguguguagaauaccauacgucgaugccauaucuugugaauaaugcuguaaugaacaugggaguacagauaucuagauaucucuuagacauacugauuucuuucuuuugauacauacuuagaagcuggaucauaugauaguucauuuuuaauuuuuugaggauccuucauaucauuuuccauaauggcuguacuaauguauauucucaccaacagugugcaaggguucuguuuucuccaggucuuaaccagugcuuguuaucuuuugucuuuuuuauaauagccauucuaacagaugugagguaguagcucauugugauuuuaauuuucauuacccucaugaguagugauguugagcauuuuucauauacccauugaccauuuuuaugucugcuuuugagaaaugccuauucaagucaccugcccauuuuuuaaauuggguauuuguuuucuugcuauugaguuguuugaguuccuuauauauuuucaauaugaacuccuuauuagauaugugguuugcaaguauuuucucucauucuguagguugucucuucacucugucgacuguuuucuuuuugcacaaaagcuuuuaguuugaugcaaugaacaaaccaauaaggaauaugaagacucuuaaucaguaaucaaaaaaaccccaaacaaaauaaaaccuaguaguauuucauggcuucacuggugaauuucuaucauuuaacaaagaauuaaugccaguccuucucaaacucucccaaaauaacugaagaaggggaaauacuuccaagcucauuuaccagggcagcauugcucugauaccaaagccagacaaggauacugcaaaagaaaauuauaggccaauaucccugaugaacauagaugcaaaaauucucaacaaaauacuagcaaauuaaauucaacagcacauuaaaggaugauacaccacaaucgaggaugguucaacauacacaaaucaacauaugugauacacuauuaacagaaugaaggguaaaaguuauauauaaucaucucaguagaugcagagaaagcauuugagaaacuuuaacauucuuuuaugauggaaacuuuuuaguuauggaagugcuguacuucaacauaauaaaggcuacauaggauaagcccucagcuaacaucuuaauagcggugaaaagaugaaagcuuuuccuguaagaucaugaacaagggaaaggaugcccacuguuaaaacuucuacucaauaugauacuggaaguccuauccagagcauuuaggcaauaaauaaauaaauaaauagcaucuaaauuggaaaggaagaaguaaaaucuuuuacaugugcaaaugauauuaucuuguauauuaaagacccugaagacucuaccaaaaaaacuguuaaaacuaacaaauucaauaaagaugcagcauaaaaaauuaaaaugcauaaaucaauaguguuucugcauacuaacaaugaacuauggaaaaaagaaaucaagaaagcacuucuuuuuacaauaucacaaaaaaugcauaggaauaacuuuaaccaaagcagugaaagauuuguacacuggaaacuguaaggcauuuaugaaaaagugaagaaaacacagugaauggagauaucuaauguuuauggaucugaagaauaaauguuguuaaaaugcuucuaguauccaaagcgaucuacagauuaaaugccaucucuuccaaaguuucaaugacagguuucgcaaaaauaggaaaaacaauccuaaaacuuguauagaaacacaaaagacccuaauauccuaagcaaucuugaacgaaaacuuuuuccacuguuaaaaauuggucagugaguaauagcagaugaucugagagacaaagaacuuugaaaauaagaugucauucagaaagaaguaauaaguugaacaggaagaaugauaugugucugagagauugaauauuacuuucauguccugaaaccaugguugcuuucagcuuugguguuucauuauuguuauuuaacaaguauggcucacuugagagacaaauaaguugucaucuuuuaaauauucaguuuaaucaccggcacacuuaucuauucaaauuagcaagaauuccaaggaggucuuuucuuagagucuucguucagcugcuucaaguauugcuauacuccuaggaguuuacucauuccaaggagacuaauuugcucuccaaaaguuaguugaagaaagagauggagauuuuuauuuuuuggagacagggucuugcuauguugcccaggcuggagaguaguggugugaucauggcucacugcagccuuguucuccugggcucaagcuauuuucccaccucagccucccaaguagcugggaauauagaugcaugccacugugccaggcuaauuuuuuuuaaguuuauuuuuuguagagaugagaucuugcuguguugcccgggcuguucuugaacuccuggggucaagcaaucuccuguauuggccuccuaaagugcugggaucacaagcaugaacauauaagcuagugauaucacuuuuagccacuguugauuuuaccacugcuacauuguuucgugauuuaaaaguggccccaacaaauuuuauguaccuugucuuguugaugugaugccacugauccuugcggagaccucagugguucuuaaugacaggaugauucacucuucaguauuauguucauucaaagguuaugucaaaggauuucauuuccuuaauuuauacucauaugcuuagucaucuuggcuuccuugccaaguuggaugugugagaagguacuuucagcccauccccacacuguaccaaaauuagccuuucuuucuugaaaucuaguccagggauagaaaaccaguggucugugagccagaugcaacuugcagauauguuuuguuuaguucucaugguauuuuuaaaaauaguugaauuuuauaucauuauauaaaaauauaaaauaccgugauuuuaaaucaagagauucauauaaauaucuggacuuucauauucuugaaccauuggagaaacugauuucagugaccucuuauucucucaggagaaaaaauggguugcacugaauaauuguccucuuuaaucagauauacacuaucugauuugcuccagcauucacuauuucuguugcuuuaccugccuggccucuguagucacuuggauuuagccuacaaugucucuacuuuucagccugaaucaccaacccagauuaucauuuccccuuugauaaagccuccuuaagcauauauuccuacuuguaagccacagaccuaucacuaaaaucuaugaaagagauuuuuguaauucugaaccuugaggaggauggagucuaggaguugaucccuuucagaauuccuguuucauuuuuuuaugcagaucuauuuaccuucuuuacuuuaauuaucucuguuuaccacagaguauugagaaggcauggcccuuaugaagccucaaaagauuuuguuagaucauuccccugagguaauggaugccuaccagccuuacauuugcauaauuaaauuguccacugaaaugauucuucccacagcaaagaucuauuucaagccaacuguuuccuccucgguagagaagcauuugacaacuuuuuuuuuaauugagguauguuuucauaaccauauaaaucacucauuauaaguguauaauucaguauuaauuaguaaauuuaaggauuugcgcaaccaucagcacaaaucaguuuuagaacauuuaaucacccacaaaguucauuuguuacccauauccagucaauccccacucucaccucaaucucagauaaacacugaucugcuuucugucucuauagauuuucauuucuggauguuuuauauaaauugaauuauauaauauguuaucuuuuacuuuuggcuucuuucacuagaauaauauuuuuuagguucauccauguuauagaauauauuaauaauugguuccgauuuauuguugaauuauacuauguuguauggauauaauacauuuuguuuauccauucugcaguugaugcacaugagaauugguuuguuuuuggccauuuggauaauguugcuauaaauauuugaaaagaagucuguguggacauauguuuuuauuucucuuggguagauaucuagaaguagaauuucuaggucauaugguaaauuuauguuuuaaagaaauugccaaauuguuucccaaaguggugguaccauuuuauguuuucaccaguaagguaagaggguuccaguuuuuucacaugcucaucaaugcuugguaucaucagucuuucuuucuuuuuuuuuuuuccccuccugaaacaaagucucacucugucacccaggcuggagugcaguggcgcaagugauucuccugucucagucuugaguagcuggcauuacaggcaugcgccaucacucccggcuaaucuuuguguuuuuaguagacaugggguuuuacuauguuggccaggcugggcuugagcuccugaccucaagugauccgcccgccucagccucccaagugcugagauuacaggcaugagccacugcacccgucuuaucagucauuuugauuauggccauuaugugagugugaauccguuguucacaguuguuucacuuuguauuuuccuaauaacuuuaugauguugagcauauuuucaaguuuuuauaacccauuuguguauguacuuuggagaaauguauuuucaaaucuuuugcccacuuucaaaauugagucguuuuucuucuuauuaucaauucucaauaauucuuuguauauucugaacuaaguucuuuuccaaaaauauaaauaucaaauauuuccuucuagucugucuuauguugucauuuuuaaaaaugauguauuugaagagcaaaauuuguaauuuuagugaaguccaauuuaucguuuuuuccuuuuuggauuguacuuuugguaccagaucuuaagaaauuuguaucuaacgcaagguaaugaagauuuucaaucuguacuuccuucuaaaagucuauuuuuugaguuaauuuuuauauauguugugaaguaugaauugaaguucuuuuuucaacauguagauccauuuuuuacugcacuacuuguuaaaaagaauuuccuuucucuauuuaauuaucuuggcaucuuucucaaaaaucaguugaccauaaaugaaaggguucacuucugaauucucaauucugucccagugaacuacaugucuguccucauuccuauacuacacugucuugauuacuaaaacuuuaagguaaguuuugaaaucacauaguguaaguccuccaacuuuguucuucuuuuaucaaaauuguuuugucuauuuugggguccuuugcauuuucauauaaauuucuggaucaauuugucaguuucuaaagaaaagcuuuauuagauuuucauagagauuauauauugaguucauagauuaacuuguagagaauuguuauuuuaacaauuuugagucuuggaauccaugaacaugaaaugucucuccauuuauuuacauauucuuuaauuucuuuagcguuccagucuuguaaaaaugauuucuaaguguuuuauuucuguugauauuauugugaauggauaagucuuaauuucacauuuggauuguuuguugcuaguauauacaaauguuauugauuuuuauauugaucuuauaucauccuaugauguugcuaaacucauuuuuuaguucuaguaguuucuuuauagauuccuuauaauuuucuacauauagaauaauuucaucugcaaauaaagacaguuuuauuucuucuuuauccuuuaauaucuauuuucuugccucauugcacuggcuagauuucccaguacaaagaugcauagaaguggugaaugccuuaugcccuaucuuaaggggaaagcguuccaucuuucaucauuaaauaugacauaaguauagaguuuccccugccccacauguccuuuaucaguuugaggaaguuccuuucuaguccucguuguugagagguuuucucauggcuguuggauuuuguggagugcuucuucugcauauauugagaugauuauuugguuuuauacuuuauuaauauaacauaguucguuaauugauuuucaauguugaaccaaccuuaccuuucauggaauaaaucccacauggucauuguguaugauccucuguauauacugcuagauuaaguuugcuggcauuuugauaaaagguuuuugcaucaauguuugcaauggauauuggucugugguuuucguuugaucuuugccuaacuuugguauuaggccucuuagaaugaguugggaaguguuccugccacuucugaauucugaaagaguuuguguaggguugguauuaucuuugaauguuucauauaauuaaccagugaagccaucucgacuugagcuuuucuuugugggaaaaauuuuaauuacuaauucaauauuuguguuacagguuuauuuacauuuucuauuucuuuuuuaguuaguguugguaauuugugccuaagaguuuuuccauuucaucuguugucuuauaugauugggauaagguuguuuauaguauuccuuuauaauccuuuuaauuuaucuagcaucaguggugauaucauaguuucauuacugauuucuguaauuaauaucuucuguuuucuuuuuguucauuuuguuuugauauuuggucagucuagugaaaguuuuaucauaagacuuuugguuuaauucauuuuucucuacugcuuuucuauauauuuuacugaauauauuauauauaauauaauacuauaauauauaauaauauauacaaagcuuaaguuacugauuuggaacuuuucuauuuuacucuaaaugguuaaagcuaugaauuuuuuuucuaaaccugcuuuaucuaccuccaauaaauguagauaugcuguaguuuauuuucauuuaccucaaaauauuuucuaauuucccuuggaauuuguuugugauuuaauaucuaaauauuuagagauuucuaaaauuucuuucuguuuuuauuuauaacuuaauucugcugugauuauagaauauauuuugaaagcuuuggcaaacccuucaaauuaauugagacauuauauuuucuagcauuugcuuaauauguagaauauccaugugugcuugauaagaauguguauucugcugauguuaaauucuguauuuuauaaaugucaagauuuuuuugaugguguuauuuaaguuguuugucucuuuuccaauuuccugucuaguuuuuccaucaauuauugagagagaaguauggaaauuuccaacuauuaguauuaaauauuuuucuccuuucaauucuguccguuuuuauuuuaguacugugggggcucuucuguucaaugcauaugcauuucuaauugucacauuuuucagauguauuggccuuuuauaauuaugaaugucccuuuugucucauaauuuuucuagacuuaaagucuauuuugucuaauauugauauaggcauuccagcugucuuaugguuacuguuugcaugaugaaucuuguuuuccuguuuuuacuuuagccuauuuauaucuaugaaucuaaaaugugucucuuauagauguuauauaguuugaucuugauuuuuauccaaucugauaauuucugccuuuugauuuguguuucuuccauucauaguuaaugucacuauugauaugguuggauuuguagcuuccauuuuacuguuuucugucucauaguuuuuguuguuccucuuuucccuuucuaccaccuucuuuucuauuacguauguuuuaauuauuugguuuugauuuuuaaaaauaaaauuuaaaaggcauuuucuuaauauuucuuuagagauuauaauacacaagauuauaauuuaucuuaucauaguuuacuucaggauaguacugacuuaauucuaguggaauagaacugcuuugauccaauauagcuucauuucuuuuccaaauuuguguuuuuucacauauauuuauauauuuuauaaacccagcaacauaauguuguaauuauugccucauacaacuuuaagucucuuaaagaaauuaagagagaacagaaaaaauguguauuuauauagccuuuuauuuauauauuuaccauuuuuagugcucuucauuucuuucugucaauuugagcuguugucuaguauuauuuccucucagcuuuaaggacuuagguauuucugcuuacaacaaauauccuccguuguuucucugggaaucuuucauuucaccuuuauuuuuggaggauaauuuuccuggauagagaaauguugguggauggguuugcuuucuuguuucuuuuagcacuucauuucucugccuucuggcccuacuuauuucuaaugagaagucauuaaucauauuuuuccccuggacgugauucaucauuuuucucuugcugcuuucaugacuuuucuccuuaccuuucaacaauuugacuaugauaugucucaguguggaucuuuuggguuuuauucuaguuggcauuggcugagcuucuuggauccauagguuacuguuuuccaucaaauugggacauuuucagccauuauuccuucaaauguuuuuucaucacccuuugucucucuccuuuuuuucuaauucccaugagauauauguugguucccuugauaucccauaaguuucucaggcucuguccacuuuucuccugucuuuuucuguguucuuccgacuggaugauuuccauugaucuaucuuccaguucacugauuugaucuuuugcucuuuuaaaucugcuguugggcuuacuauacugaguuuuaaaauuuugguuauuauacuuuucaaaucugcacuuuuuauuuuuaaauaguuuuucuuucuauauugaaaguuucuauauguuguucauuacugucguguuuuccuuuagguauuuaacacaauuuucuuuuaauuauuuucauauauguauaauagcuauuuuaaagucuuuaaagccuuugucugcuaaauucuacaccugggcccauucagggacauuuuuuauugacugcuuuuuuuccucauuguggaucacacaaguuuuugucaaaaauguguuuuuuaaaauaacaugugguaguagcucuggguuuugauuauuuuuucccugaggguugguuuuguuuauuuuuuuauuaaaaacuuccuuugucuuaaucuauggaaucuguaucccucaugauaugugacuacugauuucucugcuuaguuuuuucuucuuauucuaauuuuuauuuuuuaaccugguuuccuagggauugcccugugucucuguagcuuaauuguuauuuaaugauugaucagagguuguacucaaacacugggaccagccagugcugauggaacugugugcaaauugaggagcacaugcaguauuuaggcaguucggaagucuguaccagcuuuaacuuuccacugggcccucuuucguguccuuugugcuugucauuaccuccuagucagauugcauagcaaggugggcagacuggguggccuggugaacuuacguagccucugucugucucaucuucauuuaccccaugcuauguuucuugcuauaccaccaauguguugcuuagcccuaccaaggccauagccuuagacuguuaauuucuuucagcuugcuuuuuucguugacaauaucacuaaugaguuuuuuggccuccacuucaaaucaaaucagcccccucucaugucagccccuuccagaagugaagcugcuaguuuucaugaccagcccuacccugguagaaguacucuccugacugagcuauaaaggagugggagcagccccaggcaagaacaucucugacucccacuguuuuuaggcagaguucagugguucgucacaaauaaauguuucuuaauuuguuguuuaugacugcucgauuuccagagccaugaaaucauuguuuuugauaauucuguucagcuucauaguuguuucuuaggaagauuuccugacuuacuuccacaucaccaaaaguccugccucacauggcaacuguuaaaauggcaaguucacgugcugaaguucuacuuaacaaggaaccauucuauagauucuuuguaccauuuugguacaaauuuuggaucucugguaaucaaaacaaucuguucaccaugcuacccagucagcccaccuugcuauacaaucugucaucuuaguccuguuucaugugaggaauuuuacauuucugcaauaauugccaguaacuuuuuuguguauuauuuucuuuugaauaccacauggauggcaucugacacuguuuguaaugcugaauuuaauggaaguuuacaaauaaguuauucuaugauucuccuuuaaaaaugcagauauacauauauguauauaauauuauucucuuccauaacacagaauguuuaaaugguuaacauuugugcugcaguauagcuuucuggcucaugaaaaaugaaagcuaucagcgaucucggcaauaagauucaucgccaauagucacuagcaacagcacacagcauuuuaauaucagugagguccacagcuagcaguaagagcugguguaauugaaagacguuuaggugcaaucauucugcuguuugcuccuugccagguucaacaugggauugugugaguauuugaagaaaacagcaauuuuuucauaucuuugaaagauguaaaaagcguagauuagugcuuaaauuuaagaaaucugguaauuuauaaucauguggcucuaaaauaaaaagguauuuuauuugucugguggauuaaagcuuuagaaaagcuacgccuuggauacaagugaaccgauaauucuggucuaauguugccgugguaacaacucaugcugauauaauugagaacaucuuauacauccugguucgaacauuuucucccugccauuuugaguuguucuagugguauaugaaggaggcugggauaacuagcuugaaagaaauucagucuaguuauagacaucuuuggcauuaaucugauguuuacuagugauaucucaugcuaggcaguuaugcuuugcuucuaggggcuucucuuuuuaaaacaaaagaaagcucuuuucguuuucugugugcugcaugcuccaguguguguguuuacaccaucgguucuucucccucuagagauuagcauaacucccuuugcuguuggauuguuauuuugagcaauauguuuuggaaagguugguuuucaucaugagugguaaguaugcucucugagacucugcagcuguuuauuuaaaaaauauauuuauaagaggaaaaaauauuuuuaaagggacaguuauaaagccacagcuacugugaauuauauuuuguggugacgcuuuuguacuuaggcauuauaguaaauugccuucaaaaaccaguaagaacuguaaacaauuaauggcacuauuaauaaucaauaccaauaaucaguuucuaauuuucuuuaugguucgauuuauuguauuuguugggcacuguuauuaauuguguuauaaauuaguaaguagacuaaccauaagagaggauuuucuuuuaguaucugauccugaagauaauuaguuuaacuuuccuuugauuagcuuugucauuccuaaugcuaauuuuuauuagauuauuuuuauuagauuuuuuaaauaguaauuuugaaaauaagaugcugccagaauuuuguugaugucuugguugcuuuuaccuacaauuuauugagaaauaaggauuuaaugaugaaauaauuagagcauuuugguuuuguaggguuuguuaaaauuuuuaauaaacaguuuuugggggaaauaauuuuuuagaauaaguacacuugugacaacuagucuuuuuuguuauaaugugauuuauuuuuucuaaauauuuccaaaacuguuuuuuugaaaaaauauacuacaguauguacugcaguuuaucauaggguaaaagcugucacuucaagccaaaccugcagcuaaaaauagauauccuguuguuagagugaaaaacauuugcuuagagcauaauucauuagcaucuuuugcuuaaauaagaugcuuggaaguuaaccuuugauucagauauuuuuaagagaaguagaauaugguuucucugauaacauaacaguccuauaauuugcauuuauaagauuuggaauuggaauuuagaaacugaaagguggauuuuugcuguauaaugauagaauucaaaauugacgaaccuuuucuuucauaacuggagaucaccucauuauaaccaauaaauauucuuuauccugcuacaguacaauauaaaccucuuaaacacuguuauauauuuguuuauagaauaauauuagauauuaaagggacauuuuaacaugcaaaauacuaagaauuaacuggauuguuauuuuccuguuacugaaauagaucuguuuuaaauaaucugcuguuuuaaauuugaacgaauauuacaaaaacaacuuaacauuccuuaggauuucuauggauaucaaacugaauauaccugguugucauacauauauuuauuugaaucaggccaaugcauauuuucucuuugaaaauuuggcauauaaucuagaaucuuuagguaaccaccaugguguucuggagguuuuacaacaggauggauuggauuuagcugaaggaaaauguuauugcuucacuauugcuuuauuuuucuuuaaaaagcuaugcauuguagauagcauuugauauauuugaucauauuggcuuucccuucuagccauuuuauaccacaaauaaucauaguaaucacaacuagguguucugacuuugucgagaaugcccaauuucaacugauuuuaaucaugucauaaaugguuaaguguccuagccauuucaacuuggaaaauuacaagagaagugugguuuuauuuguaaaaauaagcaaaugcuaggccuuuuaaucuaagucuguaacuacacaugugauauuuauguguacaugguacuuuucucguuauaagacuauuccuuuuauccuuugccaauuaaauguugguuuucucugagaaucuaucuuuuggccuucuuuugaugcuacauuuucuccaaaaaaucucauccaugccuacaucuucagucauuaccugaacguucaguucaaaaguggauuuucuuuuaucaucccuaaaucugcuccauuuucauugacucugauaucuguuaaugaucucacugcccauacaggaagugaaaacagaaaccuuggucauuucuaacuuguuucuuacccucagacauguacucagucauuaaguucuauugauucuacaucaaaaaucacucaauauucuccagucuuacugacacugggauggcuucuagaucucuucucaauccuauuauaauaacugcauuacuggucucccagcuuccaguuuuauauccuuccaggccauuuuccacacugaaaauuuuaaaaugcaaauaugcccauuuuuuaaacuaacaugaaaacuuucaguuacucccuauugccuuuaaaauaaaaguuaaacuccuuauuaggucacaugcaaucaaugacuuaccuuuuugguuuuguuugcaaaaucucucucacaaauuuugaucuagccauacuauauuacauauaauuccuugcuaccuuuccauauuuauagucuuuaucauaaaaauuuagagaaccagucauuaccuccgacacugacccuguggaauuaggugauuucucuguacucccaaagcaaacuuacaaacuacaacaauuauuguauuauauugaaauuauaaauuuguaugucacuuucuaaucucuaaauguugaacucaagucaaggacagugccuuauucauuguauguuucuaguagucaccccaguaccccaaacacagcaagguacccaauaaauacuuauagaauuaaugauaaacuaaauauaauucauuuuuacauacuugaacaguucccuuacauugccagugaaaaauaccaguguggguuuugacuuuuuuugguucagaaaaauacaauaaccauaguauuuacuuguuccuuuaucaacuuuguaggaugaagucauauaaaaugcuuaagaaacuaaauuguaccagucaguaccuuuaucuuucuaguauuuaaaaaauugguuauaugugaaaagagccuucacuuucuaaauguuuuucuuacucauaacucuuuuugugaaguuuuugcccuuguuaagcaaacaaggucuauaaagaaauacuaaaggaacuucucugaaaaucagucaaacuauuguaaggcccuuauguuuagagguuguagcaacucacucaaauaagcuuaagcagaagaagauacagguauuauugggaugcagaggaugucauggagcucaaaggcaaaaguagaguugagcuguuccaaagaguagaauugauuuggaaagcugacuggaaucauaacaguaccuuucucaguuuuucucucugagaucacaugacgucuuuacuuuuuuccuuguauuugcuuuauuauccucacuguguagcgaauagguuucucugaugcuugugcaaaauggagcuuagucaucugaaagcuucaaaguuuaugugcucuccuaguucaugugcuuuuugauguaacuagcaucauuauaucaaaauccugggugagaauccuggcccagcuguaguugagggcaaaucucugaagaagaaggcaugaaucugcuaugaauuacagcaccauacagacuugaauaccaacacuucauuaauuucccuuucuagauucugacugaaaauacugugagaaaaaaaauugggaaagcaguacaucauuucugaaauuaaagaugguuauuugcccaaauauguacaggauuuugaugaucagacuccaaagucuaauuaacaguuuuaacuugaguagcuuuucuuuauggaaaagaaagaaauaauaguuucacccucacuaacugggagggaugaggaaaauaaguggaagauccaacacugcucauuacuuucauucuaaaacagcuauagugggacaaccaagaauguauuaggccuuuucaaguugaaaaguggccucucuuuaaauauagaaggcucuuuccugacauagaaggcaucacuaccagcaaggaauccuauaguccuggccacauucccauuuaugaaggucacuggauuacuuaccugauaauguaaauauguguacgcuaaaugaugugaagaguuuagucuaacagcaucuaaacaggaaaugagaagggccaaagaaaaaccacuuaccuuauuuggggcauuuguaaaguuuugaaaagcuuguaauuguucuugaaugaauaaaaaagaaaagcaacaauguggaaccuauaaaagagguuauacaccauaaaacgauaaaguuacagucuccaagagguagagaaugaacuuauauuuagaaaauauuugugcaggagaguauaaacacaaaaaauuauagaugccaucuguguuaauucuuaaaauuucaagugagcauggaguuagugaacuaagacaugaaacaaagauaaaacaagaaccuagaaugaaaagauuacuggcugagaggcaggaauggaaaagaagcauaauguugugauaggaaaaaguuguaagaaauaaaccuggcauuuuuagaauauaaagcugcauuagaggcaauaaaaaccagaauaaucauugcagaaaaguaaauuaauaaugugaagaucucuccagauagacccuaauagaauguagaggaaauggacaagauaaaaauuauaagauggaaaguauguuaaauaaaagcaggacaagaaauuauaaaagaaaauaaaaggacauuuuacaaauugaauggauagcauuccacagaacagagcagauaugauuuauagaacagaaaagcaguaaucaaaaauaugauucaggaaaacuuguuaguugaagaaaaacuugaaucuuuaaauugaaagaccucauuuuguuuugacaagauuaacaaagaugccaaugccuaaauacauccuggugagcauuuggaauuuccagcauaaaaaaaugaaauccauaaacauucugaugucuuugcaucuuacaaucuaacaugaagcuuguccuauaaagaaaaaaaugcaaaauuggagacuagauaacuuaaaaaucuuuugagggcagaaauuauuuaagaucaacagcaccuugaaaugcugaauaaacuguaacaagugccccuuuaaaugaauaccugaauuuacccuuuaagugaauucuaauuuaauuaaaauuaaauaaauucccaaagugcaaaaauugaagugguaaaugagaaccagagcuguaaggggaagcauacuucaacugcccugaggacauuuuuagaccuugguggggcuuucguuuaaaauggccuaacagagauggaugauagguuguuuaaugcauacaguuuaggauuucuuagcccccuguauaaagccaggauccugcaaggaucauaaccucagugaaagcauagaugagaaaauaaaaccucuccacugacaaaaggagaaaauaaggaagcuuguguuucuuggcuuggguuccugggaacaggggagggaugugugugcauguguaggaugccucuccugagaauuuuuaaucaagugccuccucucaagcagguuucaguuuuuaaucuguauuaauuguguggucuaggaacaaccaauaaaacacauuaucagaagaguuguaggcuuguaacauauacucuacaccagcuaauacaaaauccuauacugggacacauucucagaccaagaccugcagguuucucgcagauaaagccccaaugaacuuuguguucacaauccaaaaacaaaauacacacacacuuacacacauacugcaaaugauauuuagauacaacaggauuagaaccugccaauaaugucacuagacauaguaaaauuaucacauaugacuacuauauuaaauuagugacauaaaaauaaauaugaggaaaaaauguauguaauucuaacagagccuuaaaauauacaaaacaaaauugaccuauguaggagaaauuuuauagauauagauagagaauucuuacccaguaauugaagaauacauaggaauauguagaacacuuacaaaauuaauaauaugacuaaauguauucaacaaauuucaaaugauugauauacaggcuacaguauaucaauucuuaauuacuuaacuaccacaaggcaauuaaguucaaucaguaauaaaaagcuuuaaaaaaaucacacaaauguauacauuuggagauuuaaacauuuuaaauaacuuaccaaauaauuaacucguaaauuuaagguguaacuauguaucagaacuuguggggugcagcaaaaguggauauagaguuaaauuuuaagugcucaaauuaggaaaaagaaagacauucaugauauaagaaaacaaguuuaaaaagccacaugguuaaucaaaagaagaaagaaacugauaaagacgagcaaagaucaguggguggaauagaaaauaaagauacaugagaaucaaagguuaguuuaugggaaaauauuuuaaaguacuaaauagaacuauaccuguuuuaaaaauugaaucacagaaucuuuaugcagaacuuaacaaaauuaggacuggagaguuuuacauacaaguuuuaggaaaccuucaaagaacaaaaacuucaaucuuguauggaauuuuccagagcauugaaaaagagaaaauacucuuaaaugcauuuacugauucuagaauaguuuuacaagucaaguauaggaaaagaaaauuagauacauuuucucugaaguugggaauaggaaaaggauguccacugccauuguuucuguacaucauuguacuguuagucauaaccugagcaguaaaacaagaaaaacguggagagaaccaaauugucauuauucacaaaugauuugugauugguuacauagaagacucaagugaaucuaccaaugugauuucagaauugauaacagaaucuggcaagauugccagauauuaaaaaaaucaauauauaaacaucgacuauguucuauacaucagcaacaaacaaaaaagguaauuuuuaaaaaucucccuuuuacaauagcaaccaaagugcuaaagaaccuagguauaaaucuaauaaaaguguaauaagaccuuuaagggaaaaaguauaaaauucuaccgagggauauuuaccuaaucuuuaacaaucagacaugauuuuuuauacucauuagauuagcaaaaaauggaaaguccaacauuaacaaauuuuguugaggauauagagcaucaaggauauggugggacaauaaauugaugcuaccauuuacugagucauuuguuacugccgaaguugauacugugcauuccuuaucaucuaggaauccauucuuaacuccauauugucgggaaacaagacaaaauauuugaauucaggccuuucuggaaaauccuugacauaugauuguaguagauauaauacugcuacaggaaaaagccucauugaacaauuaaggaaguaaaauauacuucaaggagcauuucaaagauugccugggucauuaguuuuaugacuauaaauuuacuuugaguuuucauuacaaaauuauguaggaaacaucacgagucaaacauggcauggauggccuacaaaauccauagcauccccagauggagagcuguugggagagaaggcauguacauaugauuaguugugaaugaauacacugugugaauucauaguguauccaucuauccauguagaugcuagucaaauaaguuaauguauuucuuucuagaaugauuauuuaaauauaugucucauuaaaaguguuuauauuuuuccauauaaaacuauaguaaaaauuuuuauuuuucacaguucagugagucagucaauuaugcuguucacuuguaacuaagacuugaugaaaaauuaacaaguaauaaaacacagagaggaaagaagaguaaaauaaauuuuguaauaggaaguguaacuuucauugccuauuaaacuuccaaauacucauauauauguggcuuuagucuuuauagaaagacuaauuaaucaucuuagaaaucaaagguaggcauaguccaauccaauaaacuguacaauuacaacugaaguauuaaaguuguuuuuuauacucgcuaucauuuuuaagguuauagugaauuuaguuugaaucaguauguuuaauaugaugaggcaagugccccuucagcaaagugaacacaauuauucuucaguuucaaaggacagaagaugauaauuuauuaacauauuuccagagaagaguuuugguugguuaaaaaaaaaggauauccaaagaauuucuuguaauccuuauauaauacauuuuugguauguauguucaauuguuuuaucauucuauuucuaugugcaguacaguagugaacauguauagauggguaacuucuuguagguauguuauuuuauguguuauuuaaucucuguuuauucuuuuugaucaagcacgcaaaucaucagaugcaucugguaggaaaaccccuuuuuuuacagaauaauucuguuacuuugauuaucguaagcuaaauuuuuaugagauauuuuguggcaauuagaauauuuuguguugaguuuuuacaauucuguuuacugaaaauauuuuuaguguguguguauguggggagggggagaguauuuuuagaaauaccaaauaaagcucuaaagagguagauauuugaauagggguggaagaagauggacuaaugcauuccccuagauuuacacuuuccagagauuuuucugcuguuauuuaaugauagaacuugguauuuucauagguaacuuaccuuaguuuccauccucuuuuguucuuucuggcaugcacuaaauaauucuuaaauagaauaaugcuuuuauuaagguaaaagagggagaugaaacuaaugacaaaguagaaggagcaugaauuauuaucuuuucaguaacaaauuuuuaaacuguuauuacaaaaaugacacuauuaaaaacauuauugcuugugguuccuaauauuuuaucuuucucuaauagaaaauuuuuaauagcccuguuccuuauucccuacaaaaauagccaucaacaucuaacauauugagacgucuaauccucaucaucccucauuauuuuauccuauuccccucucccuuagcaaaagaucuugccuucugguucccggaagaaauagaaucuagcaacugugaacuaacucaguuuacuucuguuucuacccaugcguugaaaagcaucacuaugccaaaaaaugccucccugauucggcaucugcuugccugugcacuucaucucccacugauguuuuacauguccccgaugcugcaguuauuacaagucaguugcuguuuccuggauaaaccaugcucuucuuccaugccauuuauguaagaucgucucagccuaggaggucuuuuuccccaacuuuaucugccagaggaauucuuaucuuucaagauucagcacaaaugcuguauucucuauuaugccuuaccuuacuguccaagaauuucccccucccagcucucacagcaccuuauaauugccuuuguuguagucuuugucccauuccauuaugaugauucauguaagcuucucauuuccuuaacaguggaaauauguuuauucuuuguaguauucagagucuagcucagaaucugacaccacuaaauggugcucaauaaauacuguugaaaagauuguuaaaccagcacugaggaaguggaaugacugaaaaauacuaaaguuuuucaaaaggaagaaaccagguguuauaaugcguaaugucuuuccuacaguagauuuugacugaauaacagaacuccagagaugguauugcaauaguuacaggauauguaugucaauauuugcuucuuaauauuguuaugaggacuauuguugugagaacuuaaaguuuuuguuaguuguuguuuuaaggaaaauaagaagguuauugauuuuggcacuaaacaauaguuacuuauuucuuuaccauuuaauuugaagauaacuuauuugaauacauacaaucaaauaauugaauuucuacauuaacauuuuauuucuguauauaguauucugaaaaaaugcguauuggugacuucaugcuaauauguuauucauauaauuuaaucauuuucuaauuuauuuuuuggacacaagcuugcuccucuucagaaauaucugguaggcaauuacuuuuuaauaaaacaaauauuaccuuuaaaauuuuuuauuuauuguuugcaaguuuuuauuuuccuuauaaaguuauauauuuuuaaguauaucaaguuaaugaaauauuuucauugaugaaggaaauaguuuguuuaguuuuguuggguuuuaucuauauaaaugauuuauauuguaauuucuugugugguauuuuagaaagaauaacuguagcaccaugaaacaguagauguacaaaguaguagaagaaagauuaauacaguaaaagaaagauaaauaaguagaagaaagauuuauaaacucuuaauacaaaauaugaaugauauucuuuuaagaauuggauaaugguauacugugacuaacaacauacucuuuuuaucauaagcaguaaccuaguuuaucuuacacagcagucaaaaauaucuaauaaauacauuuguuaaauguuaauagugaaacauucuuauaguggaauuaccugaauuauaugggaugaaguuaugcugugccugaauuuucagucaguuuuccuaauguuuaaaauaaacuuuaaaaucugauuuuuaaacuauguucuauguauaaauacauugaaaaauuugaggggggauaagaaguaaguuguguuuuuaugaacuugugaaaaugcauaaaaauugucucucuuuuuuuuuucaucucuugaaugugggugaauguuccugcaaacaaaucuugggugaacauguagauuccuuugguaugcucauuuccuuuagaaugcaaugugauagacuauuuaaaucauacaaacagaaaaaauauauaauugaaaauguauacuuuugggaauaaauuaauuuuuuguguguccucuuuuuuguaguaucuacuuuguucaauuauuuaccaguagagaauaaaauguguuucagaaaaaucauucuuugaaggauuuuuuucuuaagaagaguuacuaaucacuguuagaugcuuuggagauagguaccuauggucacacagcuaggaaguauuagagcuaauauucuaacucagauguuccaagcucugaaaccaucauaauaauuuaagugguuaaauguagauauggcuuauauauuagaacacaauaaguaaacuaaauaauugagaacuucaaacuauaugcuuuauagggaauucuggguugaauguggagcaguauuugaaucuggcugucucugucacaucuuauuuuauuaauuaucugccaacacuuuauuucaguggauagaaauuuuuuaaauaaccagagaagagaaaggcauuuagaaguuacauccaccaauaucuaaacauaauaaaauucaaagcaaaugcaugugguucuagauugcuuauuguuuuaggguuacacauaauccaauauauugugaaauauuuuauuuuugguagauuuguuauuaaaagauguauauuuugauuaacuuauauuuuuacaaauaauuauguuuaucuuugcaucuacauaguacacauaaaaacuagagauuucauauguguagauauuuuuauaugaaaaaaaauguuucaggaacagguuuuccucauagaacuauuuaauaacaucauacuuagugcccauccuuuaauguacucgaaaagaaaaucccuuuauauuuugaaguaauucacaaaauauaauaauauauuugauuaauacucauuucugauaauuuucacauaagaccuuuauaaaaacuuuucccuacuuuuacaguauuauuugacaguaaacucaggaauauugaugaguacagagaguauuuuaaagaauuucuugcauauucuauuagugaauaaaauuaaauaaugccggaaauuuuucuuuuagcuuaucaccaggcagggaaaaggaauuuuuuucaacuuaccaucuuugacaaauacugucaguccuuccuuugaucaguuacuuuuuucuuaacuccagauccacuuagcauaaagugacaggagaagcugaaacaggauguuaaaguuguuuuuuuuaccuucccuuacucuuuucuuugucucuaaauuauuuauacucauauaggcaucuggagaguuuauauugcaacuugaugugcaaguucuauaaauaaaagauaacuaaaaauauuuuucagaagaaacaagggguauauuuugggaaucacaaguuguuuuuucuuaaaugccacagugcauguugcaauaaauuauguuuuuaauuuaauuuauagccaucauguccaagugaaugccaugugcagauaugucugcuccaugcaaaaaaagaaaaucuuaccuauaaaauuacucuuuuucuguuguaacuagcacauucauuuuuagaagcaaggaugacuugaaccauccuaaauuccaagaaaaaauaacaauuuggccggacacaguggcucacaccucuaauccuagcacuuugggaggcugagccagaaaguucacuugagcucaaaaguucaggacaagccugggcagcacaguuagacccucaucucuacaaaaaguaagaaaauuagccagacuugguggugcacaucuguagucccagcuacucaggaggcugaggcagacggauugcuugagccuaguagucugaggcucuaguggacugugaucaugacacugcacuccagccugagugacagagcaagacccagucuuaaaaaaaguaauagaaagaaaagagaaaauguaagaauuugccacccuuaauccaccccucaggaagaauuagauuauauuuggaugauuagguaaaauucuuugauucauuguuuuagugcaugagauuuuccuacaaugggaaaauucuaaguuuaaaaauucuuuuucucaguuuuucuaaaaaaggcauucugagaguauuuuacaguaaaauacaaaggacaguuuauagaaaguacuaaaauaaugucuucagagauucauacucuaauguuacuuaaaaacuaaugucugcucuuggugccugucaucaucauuuugaaaucucaaaacauuuaaaaugccaaaagccuuuuugguuaguaacaguauuuucccaaagguaugacauugguaugacauuuauaaaggaggaaaaauaaaguauguuuuaaaauagguaccuaucucacuucaauacuacuguaucauugagaaucuuaaagaauuugugagcccuucacuaguauagucagguuuuauucuuauaccuaaagauaugaacaacaauacauuuuguuaaugcuauuuuaucucuuuggaauauuuuuccuauuuguuuuuaaacaucugaaguuguuuucuaagauagcuuuugaaaauggggaaaguuuuaacugguucaucauuuaauuuacaaauuuaaaacuucaaaccauagcucuauaaaauaauguggcuauuuuauacccacauuauuaaucaauauacaaacacuugguuuugaauugcuuuacuuuagugcauuuuaaauuggguauucagacauuuaguuuaugcugcaaauuuagaaugagauuguuaaacuggauuuuuuguugucgauguuuuguucuguuuuuaagucuuuguugguguccuuuaugugcuagucuuugcuuuuauuuuuucccuuugccauuaguaaagagaacacaaaucuaauacauaacauaaauccuuacaccugaaaacagcucuuuaucaagaucaacuauuuuugaaauuccacgaaucaguagguuaauguucuccacauguuuucaauucuuguaucuaaaggcuccguuaauauuacugauggccuuuuuacagucacuauuuuguccuaaauuaauuucugacuuucuuacauuacuuucuaguauguuuucaggaacagaauuuuuguuaugacauuugaaauuaucaaagugguuucuuuauagaacaauauuagagaaucuuagagauuugagaagguucuuagagauacuaaauagcucuuuaauguaucauggugauaaauauacauuuuaucacaauagaugacaugucuuuuuuuaagugagaaaaccauaugcaauauaaauauucuuauacagaauauaaauauucuuacaagauaaauuuguuuuuauauguauauuuucagugaaagaguuucuagccaaagccaaagaagacuuuuugaaaaaaugggagaauccaacucagguaaggaauauuuagauuuuucuaaaauuaaaaaucuuguauuaauaaaaucaggauucuugccuaagaaauuuauuacuuuagaaauuuuaauuuucaugugguguuaguaaacagaagcuuaaaaugggaauuuugccauaguuauacuuugauguauuaauuaauaaucuuaauguaugccuaaauugcaggaaauaauuuccaguauaauaccuaauuauaaauuugauacugauuccaguugcuauaaaaucuuaauauuuucaaauauauuaauuuugaauuaugccuuugauagcauacuuauaauuuuuauuaauuacaaaaauaagaguccuuacguacaguuuaaaauucucagucauagagaauuuggcuaucaacaacaucccugauacacaggcaucuuuuuuaucaucauuuugauggguuauguucuauauaauuaaaguauuuuagaucuuaacuaggaucuaaaaacuguauauaaaaaaccaucuauacuuuacaaaaauaauauuuuuggaguuauaaauaaugaaugaauuuuaauaguaaauuaaauuuuguuauacuucaaguucuggguugcaugugcagaaugugcagguuuguuacauagguauaaauaugccauggugguugcugcauccaucaacccgucaucuacauuagguauuucuccuaaugcuaucccuccccuagccccccaccccgcgacaggccccggugugugauguuccccucccuguguccauguguucucauuguucaacucccacuuaugagugagaacauaaagaccaaaaaaaaaaaaaaaaagaggucguuauuugaaaaagauacuugcacacgcaugcuuauaguagcacaauucacaauugcaaaauaguggaaccaaugcaaaugcccaucaaucaacgaauggauaaagaaacugugauauauauauauauauauauauauauguaugauggaguacuaugcagccauaaaaaagaaugaauuaacacauuugcagugaccuagaugagauuggagacuauuauucaaagugaagugaaaguaacucaggaauggaaaaccaaacaucauauguucucacugauaugugggagcuaagcuaugaggacacaaaggcauaagaaugauauaauggacuuuuggcacuuggugggggagaaugggagggaggcaagggauaaaagacuacaaauauggugcaguguauacugcucaaguaauggaugcaccaaaauuucacaaaucaucauuaaagagcuuacucauguaaccaaauaccaccuguaccccaauaacuuauggaaaauaaaagaaaaauaaaagauauuauaaccaaaaaaauuaaauuuugaaagucuuuucugccuagcucaaaaguuuuuauuucaaguauuuucucacuaaagaauucuaaguaaauguuucuuaaagaugccauuacuaucaagauuuagaguaugaccuauaaguuaaaacauagccacaaagauuaaacauugugauuacaaaauguuagacauuguguaacaugaaacaauaagagagguaaggaagauaacauauuuuuauaauacaaagaaaagcaaugaaaaaagcauaaagagcagaaacacauauucuguugucuauuaauaaaguuuguuuucauuauuugguugguacuaugguaaacauuuuaauccauccauguugauaaaaccuaagauuaaauauuaauuaaauuaauucagucagaauuauaagagcuuucuguguugauaaaaaaaucuuaugacuacuuaaaauuauuuuaaauuuuaagcugugaaaucaaacuaugaugaaaacaagcuauaaguaaaacagaauugccugcugucuguaaugauccaacagaaagcuaaaaugggucucaaaaggcaagguuugauuugcaauacagauaaaauccaacuacagugaacuguaauaccuauacaaauuccucacuggacaaagaaucauacugcaucacauuuuuucaagcuaaacacuacauacugggccuucagaauauuuuucugauauuuucauggaguucuuugcaaugaaaccuauuaaacaaaugggucagcaauuacuacuucuugccauuuaacacauaauuugucccuaauaauuuucauuuuguuguggcaggaacaaauuuaauagauugaugccuccaauuauuugcuucugugcuguagucaaagccaaacaaagauguuuccuuauaacaaaacaucuauucaagaaaaaaagagucugauuauuguucugggauucuggcuuuugguucuuuguagaaugaggaacucuucuuuccuuauuguuguuguuuuagauaauacuguguuuuuauaauauaaagagagaaagccacuaggcucucucaugcugcuacuaucuaguucuauaagcuuauauaaagacagaaaugaagcaagacugauuucuucacagguaacuuuagugaaagagcucugaucccucaguuuaucuauucauuacaguuauuugcaagugcauuaagucuguauggcuucuaugacucuuugucaguaugccucuggucaguuuguaauuauuaaaauaugaaacuaauuuauuggaaguucaguaguaagauuaaaguccaauacuaggaaugcauacuggaauauaaucuuuaauauuucagcugaggcucuuauuuccuccuauuacuauuaugcucuguuuuccaauacauucucuccucagauauuaaauacuuucuuauucaaagggaaaaauagaaccaauaaacuggaaucucaauagcuuuuuuguauugcauuuaaauggauaguuauaaaugggauuauccauuaugauuauguauuauuaaagcauuuauaauucccauaguguuuuuacgagaauuuuaaauuuuauuuauguauuuacauauagaauaaugccggacuugaagauuuugaaaggaaaaaaacccuuggaacagguucauuuggaagagucauguugguaaaacacaaagccacugaacaguauuaugccaugaagaucuuagauaagcagaaggugaguguauuuguuguuauuuaccuucaggguaaacuuuaguuuuaucagcuagacuauuaaacagauucaguauaaugacuuaccauugacagcuucaaauaauuuuauuauuaaauuuaauuuuuauuguaacuaaauuuuuauuguaacuauauuauacauaguuaguauacagucagcccuuccauaucuauggguuccacguccauggauuuaaccaaucacagauugaagauauuugggaaaaaaauuacaucuauaccuaacauguacagacuuuuguuucuuguuauuauucccuaaacaauacaguguaacaacuauuuacauagcauuuacaauauaucagguauuauaaguaaucuagagaugauuuaaaguauauggacaguguguauaggcuuuaugcaaagccucugucauuuuauauaagggacuugagcaccugggcauuuugguuucugcuguagguccuggaaccaacccccagggauacugauggacaacuauaauuuauugugacaauuauggacuaauuuguuuuguaacuauuacagaaguuaaaauguguacaguagugauccaaccacuucauguuacaaauuuugaaaaccugaggcccaaagauuugaaaucaucucaagucagaaaguuaguuaaauaaaaggccuagauuaaaacacaaaucugacuccuacucaauuuauuugcucaauauuaucaguauacuccuaauuuuauauauuaauaccuggcugguaucuuuaauuacuuuuguuauuuauauuuaacuucuugacuucugugacuauccucacauugaccauuagacuccagcaagaaagaaugccaccuucuaaugauuuacacauauacaagaaaauuauuuauaugucuugcuaaagucaccacuucuuaaauucaaaauagaaucacauauggaauagaaucacagucuucgugaagucaagauaaauuacuuuccccuucuauuaaauagaaaaucuagaggaagcuuaagucuaaaugaccuaggauacaaagauaguuuuuguuauaaagauaguuuuuuccccaauauuuuguguguccucuucuauggcaauauaaaauaaauuuuuagaauuuauaccuauauuuauuuagauauuauaaaaugaaaauuguucauuuuuacucacuauuuuucaguuauggacuuucucuucauuuuuaauuuucuuauucaucuucugaaguauuuaaaaucacuaucuacuuauugcagagauuugagccagcuuuuauagaggacuuuaagucauuaggaccuuaguauuuucacauucauuuuuaaauuaccuuaaguaauuauauauuuauuuaagcauaauugacauaacuaauuuuuaaaguaauuucuuaugaguuuguuucuuauuccuacuuagcucucacuucuuaauugaaaccauaauugaccuuccuaagaccaaguuuuaaauccucuauuagguuuucauuugaauccuauuauuaaaaguaauggcaaaaaccgcaauuacuuaugcaccaaccuaaaaguugguaauuguuauuaucuuccuuauccaauucuaacaauuuugcuuauccaaguuuauuacuauauggaaaacauuuuuuuaaaugauaacuuuuuaauuuugcuuaaauacauuaagagauauuuaucucucaauuacagguuguuaaacugaagcaaauagagcauacuuugaaugagaaaagaauauuacaggcagugaauuuuccuuuccuuguucgacuggaguaugcuuuuaagguaaauuuuaguaauaucuaaauaagauauuuucaaccuaaauuuuuuuuaagaugaaacuauaaauggauucuaaaccagaugauaagccugaagaauaugaauaaacaaaacgaauaccucuagaguuuguguaauuaaauccuauugugcuuauaacuuagguaacguuugaaaagguuuugauucucccuggggaaauuguucaaaggugauacucaugagaugguauuacaaaaagaaauauuucaauuuaucaaaaaccauagggauaucuuaauaacaauucuuaugcaaauucauacacccaacacauuuucuacuuugauuaagcccuuuuugccacuaucucaucuucuuuuacuuaguaauuugaguucuagucuuuucacuuauacaaagcaaaauuuuuguuccacuauucaaaugucugaaaaauuguaccacauuuauuauuuaaauuggucacuuuugagcucuuuggaaugauacuggcaucucucugcaauauugaaucauaugaaacauuuuaaucuuuuuucuccuuuauucuuuaaauuaaaugaagaccuauguauuuaaaauauuaaaaccauuaaucuuuuauacauaaaauguaaauauucuuauuaacuuuuuaaauuguuuuuuaccuuuguuauucuuuugcauauauuauaacguuacuucauugccugaguauuuaauuguuugagaacuagauguucucugcaagaaaaggaagagcaaaagucccagacuaguuuguggcaaaaauaacuaggaggggaaaaauaugagugucucuguauagaaaagcuagagcauguuccauuuauucuuuauuucucaagguuauuaaucugucagagagauuuuaaauuuuucuaauucagcauuauauaauauuaaaauaauuuugaccuaaguugaauaauuguauuuccuuuuuauuuguucauaggauaauucuaauuuauacaugguuauggaauaugucccugggggugaaauguuuucacaucuaagaagaauuggaagguucagguaacuaaugguuuugcuuucuucaaaucuuuauaugcuuguguuguuuaaccagauuuuuaaguugaugccaaugccaaaaacuuauuuuguuugauuaauauuuuggccauaugaagcauuagguggaaacaaagaggccacaucauacacaaguuuuaauauaaagaauauaaaaauuuaauauaaaaaaaggacuuugaagccaauuuaaauguuauacuacugcuagauauugugaggguccacuacuugaagaguuuucagaaaauggaaaaauuaauugaauuuuaaaauaucaauauuuauuaaacaaagauuaauaauacaacuccaggacagaggauuguuuuaaggaugaagauggaaaauaaauauauagagaaauaauaauaauaguauuaugguaauaagauuauaaaaguuuguuuuucacaaauuuaauucuccuuaaaguucuugcuaaguuuaguuuuuaaaauauacacauaauuuaacgggaguuuguaccucaucagguuaugacuaauaagaucucagaguuauuaaaauagguuauagaaucugaugguuuuaccuguacuuaauaguuuauaagcuucuaccguucauuaauaaucacuaauagaauaaagcuaaaauaaaaaacagguacagcuucauucaguauaguguguugaagucaaaauaaaaauguagagacaaaucucuaaauucaacauuuuauugaggaagcaagaauugcaguuugaggcauauacacagacuagguggucuucaaugugucuagaaaacaaagaaaagguuggagguuuuauaaaaagaaauuuuauguuuauuuguuuugaaacaaaguuuacuagcacuaguuaaguuuuggggagcuggcaagcucugauuggugagugaugguggugggucagacucgucuaagagucgcaguagguugucucaguagcuguuagagaaaacugguuucagguuacaauaggcaguuucagcaacuagacuuguggaaaauauaauuuuuuuguuuguuuuugguuuuuuuuuugagacugagucucccucuguugcccaggcuggaguacagcggcaccauuucgacuuacugcaaccucugccuccuggguuccagugauucucuugccucagccacccgaguagcugggacuagagguguccgccaccacauccggcuaauuuuucuauuuuugguagacacagguuuucaccguguuggccaggcuggucucgaacuccugaucucaagugauccacccuccuuggccucccaaagugcugggauuacaggugugagcuaccacaccuggccuuaauucuuggagcaggugcugugugcccugagugcguuauucccuggccccucgacucugauuuaguuagguaugaugagaaugacuaauuuguauaaucagcuuucacauuuuucccuuuugaucaagaucuuucucugaaagcauugcuugucaaccaucuugaaguuaggcuuaauuauuccuuggugcucggauggacuuguucugguugucucugucccacauaugagagaaguuaucuguuggggggugucuauguagggaccugggccacauucaaguaacgaggaggccagaaggaaaauuuuucucaaaguagauuuuugucuggaguccagccagcaucgaguucccacuuaucacuuccauagguauuagcagucaucuuuaaguguugggcuaacguuauucuguugggacagcugccuuuacaaagauuagauaggcacuaagaacaaagcuuacaaaugauaguacaaaaaaauuaacaauauaguaaaauguauuugugcagugcuuuugaacuaaagcccaggccuaagggcaaaaaacuaaagaaaucaaaggaccaggggaaacuggugagaccugcuauagccauugacuaacauuuuaugacuggguugaacuaaagcagagaaugccaaacuuugcaagagggaccaccagcacaaauuaaacaaaaaauuguguuaaggauauugucgauguugugacuagaugaacugaaagaauuucuuaagucaggcuuugucaauggcuuuagcaggucucaccaguaccuauagcaguuacugauugugaauuuuaaauuacaauauuauuugguuaagugaaaaagcaggcauuaagagggguaagaguuucauuacaauauggagucuuguucuaguguuuugagaaaagcuguucacaccauggaaaacaucaacuuucuuggcuuuguuuacaguguaaaugucucuggcuauggcuuugggcaguuugaugaacuuucuguguggcccauacaucaggcaugagacuuguuucuuaaaauuuauauaguuucagcuaacaggacuucaggaacagagcgguucucauuuuaguaauuuuauggaagaaaguucgauuggaggaaccuagaagaauuuaggaccuugucuagucuauagguagauaacaagacucaaaaauaauguacagacuuacagucuaauaacagguauauuauaguuauucuuuagaaaaaacuuuuuucucuacauugauuacauaggaaucuuggauuuaaaaaccucuugaggcaaggaagccgaaccaaggcagucuuagauuuuccuuacagucuugagguuccugguccugccaggaaguaacaguuuuuauuuacucauuguaaugcugagaaacccuugaagucaggcauuuuaugcacuuuuuaaauacgauaguucaguuagagccuuaguaauauaaucaguguuuucauauucugcuauaaagagagagcagauuuuuacuggaccugugcaaauagucauauucccauaaaaguacuuacaacuaauuuuugaauuaaggagaaaaaaagcaaaugcuuuuaucuuuuuuuacaaaaauauacuuuaccaaauugcuauaaauuauaaauagcuaaagagauaaguuuuuuuaaaucuggaaaccaaaauauuuaagaacuaacaauguaacaauguuuuaaaugaaaguuaugaaaacauuauuuuuaucaauuauuuaauuucauguaauuuuuguucugcuugaucuuaauuaguauuuucauauacucaucuuuuuuuauuaggguucuggaaauuuuuauuuagucuauugaucuuaaaguuauuaaaaaccuguauuuaaggguacuuguuggggucuuuucuaugaaucugauuguaaauaauuuugagaauucaaaauauuaacucuggaugacaaaaaucuagaauagccauggguaaaaaucugaugaaaguuuacaauuaacaaguaaaauuaguuauuucuauuuuaucuagcauuuuaagacaauaaccagaauuaugaauaacguuaauuucucugaauuuauauaauuuuugaaacauucauaugaacaacauagccauaaaugcaacuaaaagaucuaguaucacaucauuuauacaaucucuuauauaauuuaaaaauaaaucuaauuauuuaauacgucuacaagaugagaucugugucuucaaauguuuuccaagggcccagcuggaaaaucccaaagcuaauucuagauuaagaacauuuaauuuaggauuugauuuuugggaaguuuguuaaacaucuuaaaagacuuaaaacccuuggucaaaacggaguaacaggucacuguaaaauaauagucauuuauuuaaccagagugauaaucaaaagacaucagauguaauacagaaaguuauaugaaugugaaaacuuuuauuauuuuuaaagcucaguuuuucugaguaaugaaaaaccugauaaagacaacauaggauauuaucuugauaaaauauaaaaucuaguuuuuuagacaaaucaccaaaaugguaaagaaaaaucuucugcaguaugcucauuauuucuuuuucccauuuagagcuuuccauuaaaaaaauuaccaaucaucugaaaguugauugaguacuugaauuuaaucagacacaggaagaauguguccaggguuauugaguguacacuguguuauagaaaaauaugaacaagaagaggacuaucuugagcagggaaauacauggcucucaguaacagcaugagaaauuuccugguuacaugaaauaauacagacauaccaagaagagccaagaauacagauucaaauuauacugaaagaaaacuucguuuuucuaggccuuuaagauaaacguuucugcaucaggccauaacaaaguucaaacugaaaaaaaaaaaaaaguucuaggaguugaggaaaaagguugaaggagggaguuaucaacccagccaagcaaaaagauauaccuuucaagaaagagaaggggauguaugaccuucaaaucauguguagugugacacagcaaaagccgaacuucugaaauauaaauuucaaaaggaaaacuuuaccucaagaaauggaauuacuauuuuuaaugaagaggacagcauuucaaaccuaaaacuagggaaauuaauuagaucucaggaagaaauguggcagaaauagaaauugcacuuuggaagauggcugucaaagaaacagauuuuauaauuaaaaaucacaaccuuuugcaguauuauugagagcagaucaauacuucaagaaaguuuuguuuaaauauagagagcaagauucugguccuuugucagugcacccuugacaccaaucauuaauuuuuagaaaaauauguaaacaauuuuccuuuccaauuucuuucccuaacuauuuacacauaaaacuuuuuucauaagguccauccuuucauuuuuccaaacccccagucuuaaucuuauaauuuuucuuuucuucuuccuccguuuuuggaacagccaaucauuuuacuuuaggaaaaauauuuaccaccuaauauacuuuucauacaacauauuuuuuucuuacauucauauuuugacuacuagaccucaauauacuuaaacuuuuuauagaacuuaagaacccaauaagggauuuauauuuauuuagcaauuuguuuuaguuuuuaaacuuauuuguuauggcccagacaucuaauaaguaucuuauuauuuaauuuaauauaacauaacuguaagacuuuaaauuacaugagacauugauuuauaaauguuuauuuaauuaacauucaccuaauuuauucauuuuuauuaauuaucccuggauuacuuaugaaaauugagauauuaggcagagucguuauuuuaaguuauuuuuauuagccaauuuuauagccuguuaauaucaaauguuuaccuaaauaagaacuuaaaguuagauacaugaauauucuuucaauaacucagaagauacacguuuauuaaaucaguaauauuaaaucuuauuuaucaaauaauagcauauacaaagaucauuuuguuuuagucuggguuuauagcuucaugaccuuaagaaauuuaucagaggcaaauauaaaacucucugaccaggaaaucuaggcaaaaaucuguguugacaauuuugaagacauuucucauuuuauuuuguuaguaacuuuuuaguauaguuaagucuuguugaauugaacccuugaucuuuauguaaugcccuucuuugucuuuccugaucauuuaaguucuguuuuauuguauguaagaauagacuccuauucuuuuuuguuuuccauuuccaugguaguucuuucuccaucccuuuacuuugagcuugugaguguccuuauaggugagaugggucucuugaagauagcagacaguugggacuuuucuuuuuauccagcugccuuuuaagugggucauuuagaccauuuacauucaggguuaguagugauaugugagauuuugauccuguuauuauguuaccagcugauugcuuugcagacuugauuguguaauugcuuuauauugucugugggcuaugagcuuaaguguguuuuugugguagcagauauugaucuuucauuuccauguuuaggacucccuuaaggaccacuuguaaggcugaucuggugauaaugaaauuccuuuaguguuugcuuggugucugagaaagauuuuauuucuccuucacuugugcagcuuaauuuagugggauauuaaauucuuagauggaauuuuuuuucuuugaggaugcugaaaauaggcccccaucucuuuuggauuguaagguauaagcugagagguccccugcugaugcaccugauggaauucccucuguaagugaccugacauuucucugaagcugccuucaaguuaaaugugguauauauacaccauggaauaguaugcauccauaaaaagaaugaaaucauguccuuugcagcaacauagaagcugcuggaggucauuauccuaagugaauuaacacaggaacaaaaauccaaauacuucauguuuuuacuuuuaagugggagcuaaacguugaguguacguggacauaaagauggaaacaguagacacuagggacuacuagagaggagagggagggaggagaauaugggcugaaaaauuacccagugggugcuaugcucaccaccuggaugauaggaacauucauaccccaaaccucaggaucauccaauaugcccauguagcaaaccugcacauguacucucugaaucuaaaauauaaauuuuaaaaaauaaauaauuaaaaaaccaauuaauuuaucaaagauguacuuaagucaugugaacuaaaauauuuuauauaagcacccauuuauccaaauagaauucuuuaagggauuucuagacaacuaugucagauauuauuauauagacacagcauacaauauauguacauaugcauaaaagcaucuaaacaccuauacuaauguauaaauaaaaauauuacagcuuuuauuuuagaacuuuaaucaugagauaguaaaacaauaagcacaucaguuuauaaaaagaguuagauccaaauuauuuuucuaacaaaaugggaugaggcuaaacuuuaagcuuuuuuuaauagguaauauuaugaaguaugugaacuaaauuauagguagaguaguuugagucaguuagcaauauacuggaauagacaaagaacuguuaacugagaaaaugugaaugaauuaugugaggagacccaaaugauaggaguuauucuaauuaggucuguacaauauuuucuugucucaauucuuugucccugaagguaagauuguugccauuucuuuuaguauagggacaguguccuuuacauuggaauuuuaucuuaaaaacaaaacagcaugaaaaucacaaugauuuucuuuuuuaucugaugauuuucaaguguuuuuaauuaaauaauaugccaaaauagcugaggauuuuugggaaaaaagaguuuagucuagauuaggauaaagaagaggaauuguaaacguggagggaaaagcuccagaagggaacuugucuccgcuagcuuugagacaguauuuuguaacaaggcaaucucugaguccugaaauuuuuauuagccuuaagauaucaguugagauaugagucuuauuuggaguauaugauuuugucaccauggucuuuuaguuuuguuguaagaacaacagacuguuugaaugauuccuauaacguuugaacauguuaccagcuggagucucagaaaauaucuuggcaugccuucaaacuuugagagccuauuuuuaacuaaauguauuuaggugauucgguuuaaugccaaauacguaagagccaacuaaacacaggugcugaauacacaaggccaaauaaacacaagcaccaacagaaaauaaaguauguccuuaccaggaagaacaauaagccuucuccaaaugaaggggaaagucuccucauccaaaccucaaaacugaggucuaaaccuuacaccugaagucaacagggggaaaauaacccuccccaacaggagaucaguuaaccaggaggcaaaagacgccucucaaacaggagugggaaagagaaagaccccuucccagccaaaucccaaauaaaacagaacucaaccaaaauuaagaguuuaguccaaaagagacucacuaaggggaaaagaggggacuccccagaagcagcgggacugaaagggcuccaauggggguacuucaugcuguaguucccagggccagugauucucccugaaguaugucagcuuuaggaucccacuucugacaccaaguauaucaaagucaaaauaaaaauauagagaugaaucucuagauuugauauuuuauuugggaagcaagaauuacaaugcaagguauccacacagaccagguggucuuuggugugacugaagaauaaaaagaagguugaaaguuuuauaaaaaggagaaguuuuacguuuugggacaaaguucauuggcacuagcaaaguuuuggggagcuggcaagcugugauuggugagugauggugguggguucaaacuagucuuagagucacagcagguuguuucaguagcuauuagauaaaacuggcuucagguuacagcaggaagcuuuagcagcuaggcauguggaaaauuuaauucuuggagcaggugcugggugcucugagugcuuuauugcccuggcccaucaacucugauuuaguuggguaugacaaaaaugacccaacuuacacaauuaacuuucauaauuaaauacuggcauaacuaaaacacaaguaugaacugaaacaggacugaugaugguaauuugauucauaaaaugaugguggcagacucagaauaucacaagaugauaucaaguaaugagcaaacauuggagucauuuuaauuacccgaggccuaagccaagauucauuuauugacuuacuaugcacagggcaacuaauauaauuaauauagugucaggcacugugcaaaguagcuucugcuuaucuuugagaauuuucuuuccucuccuaucguccucucucuccuacugccccuuguucaagcagaauccucauauugccuuaugguuauuuaaaguuuacacuaaaguaccacaccugaaccuguucucaaaaaaguuuuuguuaacuuuauauaauugguaacuucuuuucuuugcaacuccucacagucuuaguacucuuugauauugacucuuuaauacuugacuugguacuaaaaggauagcaaguugauugaaggaauucacacugagacacuugccuuaucucaucuuucacaaguacuacauauacacuugaacaauugccaguguccaucuuagaaguuuugaggcaauaggaauaugaguuauuguuuagcauggcuuuaaucagaaucaaaugaggcauuauaauucucuacuuaaagcugucuggacuuaaaacugcuacagcauuagcccuuaccauugucuuccuacauucaauuaaauauuaaguagaaauacccaauaacacuuugcacuuggaacauuuuacuuucaccuuucaagaauucgauuauagguugagcacaguggcucauguaagccuguaaucccaggacuuuuggaggcucaggcagguggaucacuugagcucaggaauucaaaaccagccugggcaacauggcaaaccaaacccuccacacacacacacauacaaauacaaaaaauuagcugggcaugguggugugcaacuguagucccagcuacucgguagacugaggugggaagauugcaugagcccaagaguuugaggcugcagugaucaugcuacagcacuccagccuggugacagaguaagaaaaaaaaagaauuuuauuauagaucuauguaauguauguguuccuccaauuaaacaccagcauauggaaauuaauauuuuauaaguaaaaaguaaucauauuaaugacauuuuacauuuacagaugcauguaaacgugcauuuuauguuuacagaugcauggauaaaguaagaggggaccucccaggucagauguuucccaguuuaagcauaaauguugcaaugaccagaaugauuauuuuaaucucugcuuacaauguucuccucauuccuugucauuuggcauacaauguggauugacaguguugggaugaagcugaaacuggaaggguauuauaaaauuuugcuccccaaaagcauuuuucuuuacauaugcauucuuucaacaaauauuuacugagcacuugggaaaugcagugacaagcaaaaaaaggcagcacauaaagucuuuuguuggaauuuguauuucucuugcuaccagaucaaauucauaccaaccaucuugagggaaauccuauucauaguuaagguuguucacugaggaaacaaaucugaaagucauuguuauuuaucaggcagauuaguagaauucaaguaauacauuagaagauaaauuagaaacucagaaaauugguacauccuuuuggauuuuucagauucugacaucaaaauuacacugaucuauuaaucuaauauauacauaaaagaacuagcugggugcgguggcugacuccuguaaucccagcacuuugggaggcugaggcggguggaucauuugaggucagguauucgagaccagccuggccaacauggugaaaccccgucucuacugaaaauacaaaaauuagccgggcaugguggugggcgcuuguaaucccagcuacucaggaagcugaggcagaagaaucgcuugaacccaggaggcggaguuugcagugagccaagauugugccacugcacuccagccugggcaacagagcaagacugugucucaaaaaaaaaaaaaaagaacuguacguauuuacacuaacauagagauuauacuuaugucugugaaucuauguaaacaagcauaguaaaagauuuggaaauucugaugccaagauuguaucuaugguuucugaauagguuuaugaguauucauuauucuucaucaauauuuuaugauauuuuuccauaacgagcguaugucauuuuuguaacaggaacuauuacaaaauggguaaaauggcauuaaucugcagauaaaugcagcuaaagagcuucuacauagggaaauucuauaaacacuugaaauuugugagaaaaguagauggagccuguuaacuauagcaguggccccgauagacacuccauuuggcacauuugcuuuccaauuauucucaagaucagacauaauuagaaagacaucaauauauuuaaauaugggcaauaaugauucacaaugagcuaacuauuuuagguuuauauuuuuccucaacauaugcuuccccauaaauuuaucagagcguuauuugaacaaaauauagagauuuaauaaauauuugaaaaguaacaagguucuuuacauacuuuuuaaaaaaauacuuuuuguucccaaaguaccucuacuucauauuaguuuuuaugcauaaucuacuaauuagaauguauuaacucauuuuuacagaaaaucaaugguuuuauuucuuugcagugagccccaugcacgguucuaugcagcucagauagugcuaacauucgaguaccuccauucacuagaccucaucuacagagaucuaaaaccugaaaaucucuuaauugaccaucaaggcuauauccagguaugacuuuaacacauuauguguacuguauaugagaaaauacuaggcaagacauuguauguauguaaccccaacuuggaauuuuuuuugaagaagacacuuucuccuaauaguuuaaguagagcucagaguuuugcugcuauuacagagaagcaaaaauccuguuaugaaaggaacuuguuuauaucuccauuaaucuauaguugugaacugaguauagccucuugcauaaggagauauuaauagcuaaaucuaugagcaguuauuagugccaggcauauuccacuuguuuuacauguauuauuucuuuaauccugauaaaccuaugaaguggaaauaccauuguuaucuucauuuuaagauuaacaaaacuaagacauagcaaggucauuuagccaauaaaugguagagucagaauuugaaccuaggcagucugaucccagaguccaugcccuuuacgacuacaauauaacugccaaagaaucccugacuaccaauacugaacucguagcaacguuuucuuuccacuucuacuacuaauaaagugggagcauuucuuuuuacacaauuauugauagauucucccauugacguuuuuacacuucugauggugcaacuaauggcagaggacacauugggguaaggcagacauuuagcauuguuucauuuuuauuaaugcuauuuauuuuuaccuuuuauuuucacuuuuuuauuccuugggucuaggaucuuauaauaaugacugaaaagaguuuuguuguuauuaauuuguuccuuuucuuugaguugaggaaggauuuccaacuuggauuguuuaaacuuucauucacuagauauucaugaaugaauuucaauuacguggacuuaauuuuuuuuccauuucuuucauaguuucaauuugaauuuuaaacuuucaacguaggugcaauaaauacauuuauugugagguaauacauuuucacuaguauucuuuuuuucuuuuauaggucacagacuuuggguuugccaaaagaguuaaaggcagaacuuggacauuauguggaacuccagaguauuuggcuccagaaauaauucucagcaagguauauucauaauaucaacacauaagaaguagaaauaugagacaugcaucccuauggacuuuuguaaaaacaguuuauugaucuaauuuuacauuuuuaauuugaucuaaguuaugaauuuaaaucuauuugugcaugauuacuaaagaauuauuauuuagcaucuaccacuaauccuguaaccucugucaauuuuaacucugggucuuagagauauaauaugaauaaauaugaccucuagauccauguuuugcaaccaaaaacauagucuuuucuuaauuauuccuaguaacggaaggguagagaagacuugcucuggauuauaccaagagguaaaucuagagaugauauguacuaguuguccauucuuucuuuguuucaaauuuaccaguuaaauaaaaggaauguaugagaaguguuuuuaaauuuuaaauaggacuauuaacagcaauugaauaguuuuagucuuauugaaggcagcucugcuuuucuaaauagugaaacguggugagagaaacuguaccuauauccaaaagaaugguuaacuuuuccucugccaucacuugguggagaaaucuagaaaggagaaccuaacaauaaccaggcacaaauaggagagaggaaaaggaaggggauaagacacaugcuucacugguucccaaauggaaucauugaaauauggcuaacuuauagaaguguuaaaauaaaagauuucuuucaacuuuucucucauuaucuuucauaauuuaaauaauauguaacuucuugauauuuuauaaucuaaauaucauuguaguuaacacauuucuuuaaauacaguuaacaaauaaugggacaacaaaaugagcacuaaaacuuuuacaaauguguauauauuguaaaaguaauacucauuauacaaaauuuagaaaauacagaaaaacauaaacaaacaaccaaaaaaaaaccuauauguaaucccaccaaccuagacgcagccuuuuuaaaaacauucauauauguauguacauauauguauauauguguauauguguauauauauacaccacauauauguguauauauguguauauauauacacauaugugugguguguguguauauauguauauguguauauauacauauauauucauauauauguguauacgcauauauguauauauguauauguguauauauacauauaugcguauauauacacauauauacgcauauguaugcauauauauaugcguauauaugcauauauguauauauaugcguauauaugcauauauguauauauaugcauauauauauauauauacacacacauuuuagcuuuauuuuagcuuucauuuuagguucagggauacaugugaagguugguuacagacguaaacucaugucauggggguuuguuauacagauuauuucaucacucaggaauuaagcccaguacccauaguuaucuuuucuuauccucucccuccucccuaccuccacccucaaguagaauccaguaucuguuuuuuccuucuuugucuucauaaauucucaucauuuagcucccacuuacaagugaaaacaugugguauuugguuuucuguucugcauuaguuugcugaggaugauagccuccagcuccauccauguucaugcaaaagacaugaucucauuccuuuuuauagcugcauaguauuccguaguguauauguaccacauuuucuuugucuagucuacaauugguggacauguagguugauuccaugucuuugcuuuugugaauagugccacaaugaauaaacaaaugcaugugucuuuaugaugaaaugauuuauaauccucuggguguauacccaguagugggauugcugggucgaaugguaguucugcuuuuagcucuuugaggaaucuccauacugcuuuccacaaugguugaacuaauuuacacuccuaccaacagugucuaaguguucacuuuucucugcaaccuugccagcaucuguuauuuuuugacuauuuguuuauuuauuuauuuauuuauuuauuuucuggagauggagucuugcucugucgcccaggcugcagugcaguggcgugaucucgguucacuacaaccucugccuccugaguucaagcgauucucgugcuucaggcucccaaguagcugggacuaccggcaugcacuacaacaccugguuaauuuuuguauuuuuuaguagagacaggguuucaccauauuggucaggcuggucuugaacucccgaccucaaguggugcacccuccuuggccucucaaagugcugggauuacaggggugagccacuaugcccuuccauuuuuuuacuuuuuaguaauagccauucugacugguguggaaugguaucucauugugguuuugacuugcuugcauuucucuaaugaucggugauauugagcauuuuuucauaucuuuguuggccgcauguaugucuuguuuuagaaagugucaguucauguccuuugcccaccuuuucaugggguuguuuguuucuuguaaauuuguuuaaguuccucauagaugcuggauauuagaccuuuggcagaugcauaugguuugcaaauauuuucucccauucuguagguugucuguuuaccguugauaguuucuuuugcugugcagaaucucuucaguuuaauuagaucccacuugacaguguuugcuuuuguuggaauugcuuuuggugucuuugucaugaaaccuuuguccauucuuauguccaggguggcauugccuagguugucuuucaagguuuuuauacuccgggguuuugcauuuaggucuuuaauccauuuugaguugauuuuuguauaugguauaaggaagggaucuaucuucagucuuuugcauguggcuagccaguuaucccagcaccauuuauugaguagggaaacuuuuccccauugcuugguuuugucagcuuugucaaagaucggguggucguagguguauggacuuauuucuggguugucauaguugaaaucauaguaaauauauauagucuugucucugacuuuuuucacuuuuauaauaacaagcaugcaaacaucauucuaauggcuuguuuguaaauguaccauaaaauauguagccacucuucuaucguugaguguucagguuuuauuuuugauuuuuuuauuauuauaaauaacuaugauaaacauccuuauacauaaaaguuuuuuccuuauuuuacauuauuuccuuagcauauauucccagaaguagaauuacugggucaaggaauaggaacauuuuuaaggcuuuugauacauauugccaaauugcuuuccaaaguuauuaugccauuuuacacuucuaccauuaguguauuauagugccuauuucauaacacuaucacuggguauacucauuuuuaaaauauuuacugauuucauaggcaauaaauuguaucucauuguuuuaauucucauguuuuuuauuuauuuuucaaaugguuaauagccauuugguauuucuuuaugugucuguaaauuauuaguucauuuccuuggcccauuuaucuauuguaauuuaacauuuuucuuauugauguguuuugauuucuauaccuuggguauuaacuugugucugacauauuuacuauaaacauuagcacacaauuuaaacauaugaaucaaaaaguuaaagagaguuaaugccuauuucuauuaaaaaacaaagugcuauuccuguuauaccacuccuucccuuaaaaagauauacacaguaucaggaaaaaaaagagaaaaagaaaaucucuauagcgcuaaaguauuauauuuuugcuagaauuuugaaaacuaaguaguuuguaaagcuaaaauuuugacaaaaggguggaauguggugagucgugaugguagaggguaccucugagggcagagcaauagaucuggguagaauucagcuuauuucucuucaugacagguuuuugggguuguuaaaaaaucucuugugucaguugauacugaccauaguuaauaaacuauauuagcauguuaauaugaagauguuauucuuauuuauuuucuuaugaauacuuacaaauuuuaauuuuaguaagcuuaauaugaaaaaaacaaacauaaccugugauuuuuacauuugguuugcaaagcacuuuuuacacacguuacucccuuucauuugauacaguccucacaaaacucugugaauucauuuuuuuccugcauaucuuuuagauauaggaagcaagacaguagauagcagaaguaaaguauaccuaaauauuuacaugaauugaauuuuacauuaaacuuuuugcuuucacaaaauccuaugaagcagaugggauuaucccuagcacauucacccuccuaacuccaaaaauauagaguauuuugaagucaacuucauuauuuacuauguaguccaguuucuauuauuuucuuugaaaacuuuugaucuuucuaggcaugcuguggaaaaucuguuucauaagauuauggaccuagagugggccuuaagaaguaauguggucuaacugccuuccuguuauugagcaagaacuaaauuauaccagugaaauaaagaaaauuucauugucuauaauauucuuaauaauuuuaggaagaagauuuaauacucuuuccuaauauccaauuucaguaucuggaaauccucuccuuuguuuaauuuaaaucugaccugauacauuugguucauuuuuaaauucuguccugaauagcugcucagcaauugcuuuaaaaaaauuuuuauaugcuuccagaucauuuugaaauuaucuuugacuucauucucuuuugaguaacuuaaguaacaauugacauugguguugguuuaucucagggcuacaauaaggcaguggauuggugggcauuaggagugcuaaucuaugaaauggcagcuggcuaucccccauucuuugcagaccaaccaauucagauuuaugaaaagauuguuucuggaaagguaaguaaaacauuuuauuauuccucucuuauuacuguauaugaauuuuaagcuucaugaauugaaacuauauugugucauaauuauuauucuacauugggaaaaauauagaaaaaucuacaguugcugcucuuacuaucauaagaauugaaucauuucagucucuuaagaaaaaaagggcaguuuuauaaagaaauuaacaaaacaguaaagcaauuucuguauuuaguauuuuuaucacaaagaacaggaucauagccauaauucucgauauuccuucaaauaaauaaaaauaguuuauuauuucaugugucuaucuucauggagaaaaguuuuaggggcuguuuuauaugcccuuccauuuucaggagagacuucuuguuuuaauuauguccaauacuauaacauuggaaguaaaaguaaauauaaaaugaauaagccuuuuucagauggaaauuuauagaauugauuuuaacagaauuguucauauagauugugauuauacuugucauugguuuuuagcaaacauggaaauaacauuaauuuuucuucaacaugaguagacuuacuguguuguaguauuuuacauuuuguaaauuucuucauaaaccuuccuucuuuugcacuuauaaccucuaauuugcuuucaagaguguuuuguuuagggucagucauuugcuguugccuuagcucagaccucggaucuuuuuuuaaaagaccauugucaauucaauagaaaugagcuugaauuuccuaccaugcagcaaugaaagaauaggcuuuuaaacauucccagaaggagaccuucuauacauuaaugacaaaauauaugggaagggauauuuugcuuauuuucccuucuuucuauuucuacaugugguacugcuuugucuuuucuuuucuuucccacauagucccauuuagaauaugaucaggaaauagagcaucaaucuuuaucacauuagccugagauguuauagaguugagguuuuuuuguuuuauuuuuuauuuguuugcuuuguauuuugugaccuucuuaggcagagauaagccggaaggagauaguagagggaaggucuuuauuucuuuguaucucagccauauucaagcucuacauuuagugugaaagcuuacccuuggcaucuaucaacuuacaauuuccauuguuaacuauucacaagguacccugaaugucucuaaugugguaauuuauuuuuuuugccaacacucaaauuuaaaucauagaugcugcacagcugggcuguagcaacaagacauuugccaauagaauuagucuauccaaucaccuagaacauacauuucagcacaguauuguucccuaucucauaguacauaugcacucuaccugggucaugagauuuucccuuguauuuugccacguuuuauguagaaaguuuuauuuauuaucaguauucacaaauuaggagacugacuaaagaauuuauacuccaacuaugucaaagguaaaaaaauaaauaccucuuacagauaaauaaaccuagcuagguguugaaugcugugcacugauaaaggcaauacagaaaagcagaaugcaguacuuauuuaaacaaguaucaguaucacugcuguucuucuuacauuuguagaucucuggcuucagacuucuuaucuuuguaauuguuuucucccagcagaacuuuugauaugaacaaaacaaaacuuugagaaaaauuaacagacaaggcagugauuuauuuuugaagaauuugagaaguguagacucucaagaggacuaaaggucauaugaagaaugaugagagaaccaaaauacauuaaaaucacaaauggaagaagaauauuuuacuaauacaaaaacuaagaauguaaauguuauaauaauuguuucaaaucauuuaauugacaguaauuauaaaguucuugaaucuuuacuauauuacuuuuauuuauauucauauaagaaauccaauuuucuaacaaggauacugucauaacuaaauuuacauuuauuaagaaaaacugcuuuaguuaaaauuaaugugucuucauuuuuaugcauuggccucgauuugccaaucauucucuauugguuaaauuuuauauucagcuguuuaugaauauauauucauuuuauaucaaacuuuaaaauuuuguaucuaauaaucagcauauauucuaaaaucauaacagucuaaauccugggcaccuuagaagaaugacaccagaaaaccuuauuauaucacaauauucuguuuuccccuucauuuauuuagaaauaugacaggauauuugguguacuuuuguuuuuuaacuaaaaguaccagauuaucucuccccaugugggauauaaaauuauccccaucucuuacucccuuuacucaucuaaaguagaagucaugaaaguggaauuuuugccauuaaaaggcucuguauuaugugaaguuagauuguauuaaccauuucccaauaaaucaucuguuucaaaacucaaauucaaacuagaaugugucucuauucacauugcaaaaauauuauugucucucugguuaguggcuaaaagccaaauuggaaacuaacuaguuuuuuaaauuuuuuaaauugugcaaauuauuaaaaauccaauuuggucuuauauuuguggauccuuauauuuauauuugcauuugaacuuuuaaugguuuuaaugauauaucauuuaagaauaugcuuuucauucagaauuguuuuuguugauuuuagaagcauauuauuuuaugaaacagcaucuuauauugauuauauccaccauucugaagucacguuauaaagauuauagguaucaaugacuuaucaaaguuaaauuuauuaauuaagugauaaauucacuaaaguacauauauaugaauauuagauuguaaaauacuuucucuauuacaauauuuuaacucaagcugguauuuuuaaaugcacacaaagaugaucaaucaacuuguuagauucucuccuacacauauuuugccuuuaaaaaaacagaggaggugguauuuaaaugucacauuauucaugcaauguuaagguuugagucuacaaauucauaguugaaagaaaagauuuaugauuccugcauuaacuaugccucauccuaacaauacauaugcugaguuucuguauguagucuuuaaauuucaugucucagugucauguacuccaugacaagaaucaguuauggucucuauagcaccuuugucuggcugcguuacccauggaaauauagaaaguuuauauugcagucaaaaauuauacuugcaaauaagguacucaaguaacagcuacuauggaaaccauaacuuuagagcccuuggcuuauguaauuuaaaaaaauucuuagcuucaacauaucuaauguaaauauuguuccacuccuaaugaguaacaauauauaaggagacaugcaacauagagaaguauaaacauaaguauauacugaaugaucaaagaguugguuaauuuuuccugaagggaaauucaauauuuacaugaaggguaauugauuaucagcccaauugcuauuccuuucugucucaggaguccccaagacugucuccagguuugaugauucaccaggaggacucaacaagauucagcauacagugguacuugaggcuaagauuuauuacaacaaaaggguacaaagugaagauagcaaaaguccagaagacaccaggcacaagcuuucaagaguccucucccagggcauucacaagggaugcacauaauuccuucagcaacaagcugugacaagcgugaaauuuuaucuaccagcaacacucauuaaauacucaaugcccaaaguuuucauuggggguuggucacauaugcacccucugccuagcacaugccaaaaucccagccucccagaacaaaaguaguuguucagaauaaacuauguuguuuguaccaacaguguaggcacagugagccacucuaauccuuuagggaaaguuucauguugguauaagggcacugguacuauucaaguugccagacaucucucaagggccaaacuuguaagcaguucuuucuaaggguagcagucucaggccuacuauguuaagucuuuucuacacacauucgguuuccuaaauaacauacacauaugcagauauuccacuauacuuuuucuaagauacuauuguuaaugcuuuuggggaaauuacaaugucauuuacuauuuugcuauggccauaguuaaagagacuuagaaguauucagaaaucauuuucauaaaacacaaaagcaguuuuacucuuuucauaaaacccagggccaguuuuaaacacuucacuguggcuauuuaaaauucuuauuaauaccuucuuucugacagcucuugugguccuaugagcaaauaauugcaaaacuggcuucuuaugugagagcagggggagggagaaugggguggaucauaauccucugcaaccuuguagacucauuauaucuaccacuguuucugcauagguaagggaacagauuagagagcccacagaugcaguaccaauauuuauaaauauuuuuaaugucuuagcucuuucuuuucacauauagaauccaggcugauuaaagaugcccaggucuuaugagguaguguggaacucggcaccauaucuauaacaugccuagcguaugaaaaguuauuaugccuguugaaaaauugucuaauguguauguucauuuuugaucaaucaauucuuuacugggauugcagauauuuugagaacuuacuguaccuaauuuauaaauaauuuguuaaaauuuaucucaacaugcucguagccaguaguuaguagauuauugcuucuuggcuguauauaaacccuuuugagucauguaagccuaauaauuuuauccugauucauaaaagauaauguuacuaguuaaaugaucauuucuccugccaauaauugcagaauagcaguaagauuuuucccuccuuucgaauaucaacuuuguaauuucugugauuaagcuuaguguaaacaaauuugauuuggcuuuauuuuauuucauuuucuucuuauucauuuuuauuuuuuacuuuuuugagauggaaucuugcucuguugaccaggcugaagugcaguggcacaaucuuggcccgcugcagccucugccuccuggguucaagugauucuccugccucagccuccugaguagcugggacuacaggcaugugccaccacgcccggcuaauuuuuguguuuuuaguagggacaggguuucaccauguuggccaggcugguuuugaaauccugaccucaagugauccaccugucuuggcgucucaaauuacugggaguaguaauuugaagucaguaaacuagauagugaguuuaaaucacucaguauggauaccaugaacaacaugaauggauuuacuuuuugguuguaacuucaucuugaacuuuuagaagauaauaguuauuucuaaaacucaaauguacaagacuuuauaaucagugcugaaagcagaaaaaauauucuguugaguuugcucaauucagagugaauuuuauaguucguuuaacauauuacauaauguaauuugacaguaguuuaggauaucagccauauugacaauggugucuuuauaaaacaaauuuauaguaagacauuuucucccucacuuuaucaaacuuaggaccuuaagaaaagaugaaaguguuuauucuauaaauuaacagguggagccugagacaagaugaaaggaggaacuuccuauacuuucccaaugacuuuucuagcacagacuguccuuggcgcaucuguaaaaauaaugauagauauggcugucuucuacguucuuucuuuaauucaaaaauucaguuucagaucauuaaaauaguauucuaaugggaaggcuuaaaaaauaaaaacuguguugaauuaaugucuacagaauacuaggcauaauacaaggcaguuucauguuaagucacauaauuucuuuucauaccugccagaugagauauacucucauuguuuuauaaaugaggaaacugagacucagaaaaguuuucccuagauugcagagcauguauguaaguagaguugggauuggaacccaggaauucuuucuacuaaagaaauagcuugguagaauuuuuuagguggcaaggauguucacuuuuauuucauuuaacucucuaguccuauauguagguaaaucaaaacucagaauuacccaaagacaaaagguaguuuguggcaaagcaggaaauagaagaaucuaguucagugauucauuuguuauuccuucacuuggcuucagugacuuuguaucacuaaucauucccucucaaucuccuuggcuugauccccuucucuucuuucuaugcacuuccucaaugggugguuucauccagucucaugacucaggacaauucccaaacucauuuuuccaguccauaccugauucccaaauuccauacucuuguaucuaguuucuaacuugaaaucuucacuuggauaucugauaccucaaauucaaccugucuaaaacugacaaguuuuuguccucuuuccuacacuccacccaccccccuccacgaagccuuccccaucuaaacugauggcaacuccacccuuucaguuggucaggccaagacaccuucgaguccucacuucauaucuaaugcacagggaaaccauuuuugcuuugucuuuagaauuuacagaauucagccacuucuuaccacauccacugcugucacucuuaagugagucacuagagugguuccuuaaaaauguuaaauaauauccuauuauucuuuucaaaaccuugcaaggauuccccguuuucuucagaguaaaagucgaagaccuuacuaugcaaaguuucaugaaaaagauaggauaacauuguuaaaggaucacucgguugcuaaguuuuaauugucuuccucacuagaauguaaacuccaugaaggcagaaaucuucaucuuauuuuguuuacuuauauaauccaagcacaaauuccugagauauauuaguaagcacauaguacuugcuuaauucaagcauaacacauaguagagguucaaucaauauuuguugaauuucaauucaugcauucauuaaauauuuaugaagcuccuaguaugugccagaccaguucuacaugcuggauacagcaagucaguuguggucucugccuucaugaagcuuucaugaaguguacucuaucuuugguaucucuccagagacauacugacucaagaggccuucuguggauucaaaacuuuuuuuaaguaucacaagugauucugauaaacaccauguguugagagcuuguuuuguguaucuguaccucacuggggaauuagauuuauucucaagaaaauauaauuagaaaaaucagaaguaauauggucucuaaugguuggaaaacaauccuaaacaauaaauaauauugaagaaaaaauauuaaagaaaacacguugggaaguguauauaucacaaacaccucuuuuauguuguacaaacaccucuuccauguuaaaugaugccaguuucccauaaccuuaucucucagaccuaauggcuuaaugauuuuagacuuucucuuuucaauaucugacucuuuacauuuacuuucacauuauuugccuaucuuggacuggcagaaagcucauagguauaugucaggaagauuagguuauuuucccaauaauucuacuaacggaguugguagccucacaggagcucagauuccuuaucuuuaaaaugagaguuuagacucaauuaaacuaagcucccucuagcuccaauauuagaagauucucauuucacuuucuauaguaguuauaauugauaaugauaaaaguaauacccuuuugauauaguuuuaaaggaaaaauuagauagucgcucuucccaucauagaaaucuuuagugucuccagguugauguauuacaaauaaagguuguacacuuaaaacaauuuuguugaaguuauuuucuguuuuucacuaauuccaguuugauaaaucaacaugacucuuugaaaaguucagucaacaaggaaauuacauuucagguuaaauuucagaauaaucaugggaaaaaauacuuucacaaugacuuucauuauuucucccccaaaauacuuuaaauaugugauggauucccauuauuaacaugaaccacuaugagagugugggcuaccuaugagaaucucuggggaagagggugugauauggaggugaggaggauaugucuaugauuugaaaagguucccaaaucguucugauaucugcugucacaacccaccaccacuccacugucacacacacacacacacacacacacacacacacguucaagaccaucacuuuauuugcauuccaaaauaaagaauuacauuauuuagaugauuuuauuuuucaugcauuccacugcauauuaccugaauuccaaagauaauuuauauguaguacauuacugucugccaucugaauguaaugaaagagauaacugguacauuaccauggaacaguucacacaaauuuaaucuuaaauauagauguacuucaaauaaauuauuucuuuggaaucuaaauaaaguuuagauuuaucacuggaaaaaucugagcuaauauacccacuggaaaaaugucauguuauuuuuaaaguagacagugugccuuuugaaaaccccuuauucucuaguuauuacuucaucuagguaaaugaggaaaugugcagcaaaauauuuuuaagaaaauuucagucuuuuagaagguuccugauaaugacuauuuuuagguuauugaaucauggaaggagaauagauaauuaaaaauaaguacccugaagucaguguacccaguuuggaauuacaccuuuacuauuuauuagcucuguaaucuuaggcaaaauaauuucuguaggucucaauugcuucaccccuaccuaugaaauuuggauaauaaucauaccuauguuuuggauuuuaugagccaguacagaaaguguuuagcauaaugccuagcuucuaguaaaccacugugucaagaauaaaacuagagaagguagaaguucacauaucuuauuauuuuagaacauaaaacugcucauaaucuaggauaauaaagggccuugcaaaaaugagauuuugaguugcuaauuuauaugaguugagccuaaauccuggucauuuauuaacuauuaacccuuuaaauagucuuuaguuguugauagaauauuaguuuuccucugguaugauaaugauuucaauuuacaguacuguauuauuuacauuuaaaauguuaugaucuuuuacuagcauagaaaauaaaaccucugcauaaaguagugaacagaguugagaauagugcuuuucaagcuuuuauguacauaugaaucccuuggagauaaaagcucagauuuucaggcccaaugcccccaucaucugaggcaagccacaggaaucuacauuuuuauccuuuugucucccaguuuauucugaugugcauggguccuaggaccagauuuugaaaaaauuuacuuauagacuagcacaaaaguggcagucaaaagcuaugguuaugaauuuaacuuuacuauaaaaccuaucuuugcaugcaugauuuaacuucuacuuugagaacaugagaauguaugucaaguagguugagcuuuuagaaagucagaauauaaauuaaggagucuauauauuugaagacaguguaauaaagagcaaaauucaugaagcuacaaaucaugacuagauuacuggucccaacucugccacuuuauggccugaugacuggggaagcuauacccaguaacauugcugaaucuuaguuucuccaucuuuaaauuggaguuaauaccauauucacugaauuuguccuauccaacuagaauguaaguuccaugaaaucagagacuugccagguuuugcucacugcuauauauccagcaccuaaaauagugccuggcauauaguagguauucaauaaauaauuguaaaauggaugaacuacaguauuugaaauagucuaauaaauacugagaauaaaaauggcacaauaccuucccucagaagcucagagccugggggagacagaaauaugcacaaauacuauagcauaguugaauaaauaaauguauuauaaagagcaacugagguaauguaaugaugcacuauguaaguuaugaagugaugguaguacuuguagugguagcacuuguagagaaacaaaauaagaaugcagagaguuuggggaugcgccucuuaacccuuuaaaguguuuucuacaaagugcuaugaucaauuuguaguugaggcuguaauaauccagauauguauacacauacaugugugcauacauauguauguaugacagggaagaggguaaugaaagggauugaacacaagcuggaaaggauaguggagaggugguagugaugacaaaaaagaauaaggaggcauagaugcagcuauuccuucauccuuuggugguacccauuuuaauuuuuuagguacccauaucaaugaaacaguaauaaccagaaguuagauugguauagaggagaagaauguguuuaaacaaaacaaaaugaaaaauagacuuaggucuccuauaaauguuacuuuaaccuuaucgauugccaaaaaucuucacuuauuuggggguuuuccauuuauuuuuaaggccagaggccagucuaguaauuguaaagucuucacaauuuaguagguagaaaaaugcuuuuaaaccaaucuaaaucauuuuuauacuguugcauaauaggagaauuauuuuuaaaagccaacuucugauaaaugaaaaauguuuuccuauacugugaaaggcaguguggguuuuuacaaccauuuuuagacuuccuuuuugauagaucucuuuucaaaauguacauacugauuuccuucauaugcugguucuucuauuuauauuacaaaguuaaauuuauguaucuuugagacacagguuuguaauguaugauccaaagagauugcucuuaaagauaggugaacuuucugauauuuugcaaaaguucuguaggugugcacauuuuucuggagacugcuccauguucuuaaagacaucauaaccaaagcaaggcccuaagagaacagguuuaguucauucacccaaguaauucucuucuuuauggcuacuguggggacuguaacauguaguuaaaaguaugugaaggucaucgcuccauauuuuuguuuauauaauggcuuguugccuugaaaaaaaaacuuuaugaaaucaaaacagaaauaucaugagucuuagaauguguguuuuaccaaaugguguguuuguguagguccgauucccaucccacuucaguucagaucucaaggaccuucuacggaaccugcugcagguggauuugaccaagagauuuggaaaucuaaagaauggugucagugauauaaaaacucacaagugguuugccacgacagauuggauugcuauuuaccagaggaaggugagacuuucuuuuuuaauuuaaaagcuuuuuuaaaguugguguuuaaauuauaugugguggagauauuuucaacuuaacacauaguuuuaauuuuuuuaccuuuugaauuaaucuugugcaggaucuaaaguacuuuacagcccauaacuuaaaaaugaguuucccccuagaauuuuuuuuuuuuuuuuuugagguggagucucacucuguaguccacgcuggagugcaguggcacaaucucugcucacugcaaccuccgccaccucaguucaagugauucuccugcuucagccucucgaguagcugggacuaugggugcaugccaucacaucuggaugauuuuuuuguauuuuuaguagagacaggguuucacuauguuggcuaggcuggucuugaacuccugaccucaagugaucugcccaccucggccucccaaagagcugggauuacaggcaugagucaucacaccuggccuuaccuagcuuaaaaagaaagcauauaugcuauuuugaccaucaaccugaaauguuuccuuuguuaaauuuuuccuaucuaugcuuguuacgcuucacaaaacuguggaaauuauauauuagacaauguccuaaggguuuucaaaacugaugugaagccacauuaggaagauauauaaauaaauguaguugcccauccagaauuggcaugugccagauauauaauaacauuaaauugcuaguuucauuccuuguuagucuucauuuucaccuucuuguggcauauuggucucucuuuagagauacagcuuuccuuuauccauuugaaagcuaauuugaacauaauucauacaaauuagggguuuuaauucaugcauuuuuggaaggucaaagcaaauuaucugaaguuacuacuuuuuuccuuuuaacaauuauuuauucacguaagauuuuuuccaaauaguuaucaggucccugcuuguauguuagguauucugcaaggugcugagaauacaaugaugagcaaaaccaaccuuuauuccugcccauaugaagcuuauacuuccaggggacagggagauuagucagauggucguauaaauaaauguaaaaguacuauacugugagaaauguggaaauucagaauaacuuugcaccugaguuuuugagauuuguuuuguuuggucuuuuguuugacucuuugcucgcuaaagggauucuuagaguuagaaauucaggcaacuugaagacuugaauauaaguauagaucaaguuaaucgcuggcauuauuauaccaccauaauaaaauagagaagaaaccccagcuaaacuguagcauauuuaaaagaaacuaguauuuuguuuuguuuuguuuuuugcuacacaaguugccaguaugacaguugugguaacaguacuauauuaauugauagcaguuaucauuucacuuuuguaauaauuugagacauuuaagaaaagauuuugcugcacugaauuaccuuuaucucucauuuugcuucuuacaugcuuaaagaugauuugcaugaauaaaguguuuucauuuugaauauauuuaauuuuuuucuucuuuuuuuucauaaaaccaaaacuucuaauguuuuagagacaugucaucuuuaauaaugcugugcaacuacaugauugaguuuccuuaaggaaaaaaaaauuuaaugcucuaauuaaguauuaaaagcacaguuuuucuaauuuauauauuuuacaaaugauuacaguaacaagcugggugcccuggcucacaccugaaauccuaacacuuugggaggccaagguggguggauugcuugagucucacucaagaguuugagaccagccuggcaaacauggcaaaaccccgucucuacaaaaaauacaaaaauuaucuggguaugauggcucaucccuguaauccgagcuacuugggagacugaggcaggaagaucacuugagccugggagauuggggcuacggugagcugugauuaugccacugcacuccagccugggugacagaacaagaccccgucucaaagaaauaaauaaauaaauaaagauuacaaaaacaaaacaauuaaagaauuuuaaaaugcagcaaaaagaacauauagccagaccaaaacaaugugaaugcaauacagccuaucucacaagagggauccagaaacucucuguuaaguucaugaaucauggcugucagcauuauuaucgcaaauagauauguuauauagucaauaacaagauugauagcacuuuaaaauagauuuagaucucauaaaaaacuuuauuuuuuauauuuuuucuaaauuugcuaacaccaaugcaauacuguauaauuaauaaaagcaacucccuauaacuucucuuuucagucuucaaaauaauccugugaaauaagugauaccauuuuccccauuuuacugauguggaaaucagcucagagagguuaauuaauuuaaacauaaucaugcagcugcuaaauaauaccuauauuugaucccagguucuucagauucucaauuccaggucacauuaucccuuuaaaguccuuuugacaugauucuuaaaaugaaacuccaaaccacuaaacaauaaauuguuucacaagauuuucaugaauuuuacguguaucaucuucuuaacuuuuaugcuuugagcauuuugggaguaggaagacucugucucaaaaggcagcaaaaaaagagaaugaacugugguguuagguagacauugaucugaaucccugaucaaccaaucauuagcaguaugaucaugaacaaacgauuuaaccucucuaaagcaucaguuuuaucacccuuaaaauuugaauuuggauagagaauacaaaaggaagagcaguuuggugagaaagauuagauggauuggcccaggcuccauuuuccuuucugguugagauauguuucauauacuuauaaccagguaauuuauuaagcaaaugaauuugaaauuaucauaauuccaccauccaaauagaaccuaguauuugauauaugucuuuuuacuuuuuuuuucccugugcccuucaucacugcaguucaguccuaugaucucaguagccaauuaaaaucuaccuccuccaacccugcacuuuaccauuuccuucagucucuuaucucacaguugcuacauacuacauaauuacaucugagugacuuacugccauauuauacaauuguuuuaaaacaggccaggugcaguggcucacaccuguaaucccaucaauuuaggaguccacagugggaagaucacuugagccaagaguucaagacuagaugggcaacauagugagacaucaucucuucagaaaauaaaaaagaauuagccaggugugguaacacacacuuggucccagcuacccuggaggcugaggcaggaggaucacuuaagcccaagaggucaaggcugcagugagccaugaucaugccacugcacuccagccugggcuacagagcugagacccugucucugaaagaagaaaaaaacccuacuccacaauaaguguaucuaucgaacuucuauuuucuuuuagugcuuucugaacucuaacuuauuuuuuguuguuguaauuaaccaguuguccccuccauauuuauugaauaauucuuauuuggccucuuauuugaaauucuaccuuuacuaauauuaaauuaauauauacaucugucuauuucugaacuuuuuaaauuuuuauugcugcauacuauuuuuauauauucaugaaguacauguuauauuuuaauauaugcguaguauguguagugaucaaagcuggguauuuagcauauccacuaccuugaucguuuauuguuucuuuguguugggaacauuucaaauuuucuguuccaguuacuuugaaauauauaauauauuguugugaaauauacaauauaaccagccugcugugcuaugaaaugcuagaacuuauuccuucugucuaacuguauguuuguucucaguaccuuaguucucuucaucccuucccccacacacacacauccuucucagccucugguagcugucauucuauacguuaccucuaagagaucaacuuuuuuagguuccacauguaaguaagaacaugugauauugucuuucugugccuggcugauuucacuuuacagaaugaucuguuucuauccauguugcuacaaaugacaagauuucauucuuuuuuuuacagccaaauaguauuccuauauauauuacauuuucuguacccauucauguguugaaggacacuuagguugauuccauaucuuugcuauuaugcauagugcugcaauaaacaugaggauucagguauugcauugauauacugauuuccuuuggauuaauggaauugcuaaauuguaugauaguucuauuuuuagauuuuugaaaaaucucuguacuauuuuccauaguagcuguacuaacuuacauuuuuaccaacaguguauaagaauucccuuuucuccacauccccuccagcacuugguguuuuuugccuuuuugauaauagccauuccaccuggguacgaugauaucucacugugguuuugauuugcauuucccugaugauuaaugguguugagcauuuuuucauguaccuguuggccauuguaaaucugguuuugagaaauguguacacauauccuuuacccauuuuaauuagauuguuuauuuuuggcuacugaauuauuggaguuccuuguauauucugcauauuagucccuucuuggaugaauaguuugcaaauauuuuuuucucccauucaacagguugucucuuuacucuuuugaaugucuccuuugcucugcaaaagcuuuuaauuuaauauagcccaaugugccuauuuuuguuuuuguugcuuguacuuuucaggacuuagccauaaaaucuuuuuuguuuguuuauuagguuuuuuuuuuuuuugaguuggaguuucgcucuuguugcccaggcuagagugcaacgguacaaucucggcucgcugcacccuccaccucccagguucaagugauucuucugccucagccuccugaguagcugggauuacaggugcccacaaccacacccagcuaauuuuuguauuuuuaguaaagacagaguuucaccauguuggucaggcuggucucgaacuccugaccugccucagccucccaaagugcugggauuacaggcgugagccaccaugccccacccauaaaaucuuugacuagaccaauguucuagagcauuucccguauguuuucuucuaguauuguuaugguuuggggccuuauuuuuaaguacuuaauucauuuugagugauuuggggauauggugagagagagggaucuaguuucagucuucugcauauggauauccaguuuuuccgcaccauguauugaagagaguguccuuuccccacuguauguucuugaugccuuugucaaaaaucacuuagguguaauauguggauuuauuuauggguucucuauucuguuccaugggucucugugucuguuuuuauaccacuaccaugcuguuuuaguuacuauagcuuuauaguauauuuugaagucagguagugugaugccuccagcauugcucuuuuugcucuggauuccuuuggcuauucaggcucuuuugugguuccauacaaauuuuaggauuuuuuuuucuauuucugugaagacuaucauugguauuuugauaggaauugcauugaaucuguaaauuuauuugcauaguugaucauuuuaauauauuuauuuuucugauucaugaccaugaccaugggaugucuuuccauuuguuucuguccuuuuuaauuucuuucaucaguguuuuguaguuuuucuuguagaggucuuucaccuucuuggucaaauuuauuccuagguauuuuauuuauuuuuuuguagcuauuauaaauggaauuauauuacugauuucuuucuuagcuugaucauuauugguguaucgaaaugucacugauuuuuuauguucauuuuguauucugcaccuuuacuuauuuuuuuaugaguucuaagaauauucugguggagucuauauguaagauuaugucaucugaaaggaggggcauuguauuuagaugccuugcauuuagaugccuuguauuucuuucucuucccugauuaaucuggcuaggacuuccauuacuauguugaauaggaguggugaaaguggacauccuugucuugguccaauucuuagaggaaaggcuuucaacuuuuccucauucaguauguuagcugugaguuugucauauaugaccuuuauuauguugaguaaugccucuucuaugccuaauuuguugagaguuuuugucaggaggggauguuggcuuuuaucuaaugcuuuuuucugcaucuauugagaugaucauaugauuuuuguuguucauucuacuaaagugauguaucguguuaauugauuugcauauauugacccauccuugcaucccugggauaaaucccacuugaucauguuguauuauauauuuguuguguuguuggauuuuuguuagcuaguguuuuguuaaaaauuuuugugucuguauuucucagagauguuggucuguaguguucuuuuuuuguugugugcuugucugguuuuguaucagaguacugcuggccucguagaauaaguuaggaagaauucucucuucuuuaauuuuuuggaauaguuugagaugaauugaugcuaguucuucuuuauaagguugauagaauugagcaguaaagccaugcagcccugggcuuuucuuuaauguuugaugggaaucuuuuuauuacauauucaaucuguuccccauuauuggucuguucagauuuucuguuucuaucugguucagucuuuguagguuguauguguccaagaauuuaucuauuuccucuagguuuuccaguuaguuagcauauaguuguucaugauagucuccagugaucuccuguauuucuguggugucaguuguaaaauauuuuucuuuucugauuuuguuaacuuggaucuucucucuuuuuuucuugguuagucuagcuagcaguuuaucaauuuugguuauuuuuuuaaaaaaaaaaccuuucauuuuuaugauccuuuguauguuuuuucucuauuucauuuaguugugcucugauuuuuauuauuucuuuccuucuacuaauuuuguuugguuuguucuugcuuuucuaguuccuugagguacguuauuagguuauuugaaaucuuuauacuuuuugguguuuauugcuauaaaccuccccuuagcacugcuuuucuuauauuccauagguuuugguauauuguguuuucauuuuucuuugcuuuaagauuguuuuuauuucuuucuuaauuucuucauuagcccaauagucauucgggagcauauuguuucauuuccaucuauuuguacaguuuccaaagugcuucuuguuacugauuucuaguuuuucccaucaggaucugagaaaaucuugauaugauuucaaguuuuuaaaauuuguugagacuuguuuuguggccuaauauaaauggucuauccuggagaauguuccaugugcuuauuagaagaauguguauucugcaacuauuggauaaaauguuguguaaaugucuccuagguacauuuugucuacagugcaguuuauguccaauuuuuuugguugauucucucucucaauaaucuguacaaugcugagaauggaguguugaaguccugaacuauuauuguauuggagucugucucucucuuuagaucuaauaauauuugcuuucuauaucugugugcucuaguauuggaugcauauauauccguuauauccuuuugcugaauucaucccuuuaucauuauauuaugaccuucuuugucucauuuuacuguuuugacuuaaaguuuccuuuaucugauauaaauuuagauacuccugcuuguuuuuguuuuccauuuguaugaaaucuuuuucugucucuucacuuucagucuaucuguguguuuacaggugaagugagguuuuuuguaagcagcauauaguuagaucauguuauguuuauauauucagacaguccauaucuuuuaaguagauaucugauuuauuuacauuuaaaguuauuauugauaggugaggacuuauuccuaucauuuaaaaauuguuuucugguugcuuuguauauccuucauuccuuucuuucucucuaauuguuuaucauuauaguuuggugguuuucuguaaugguaauauuugaguccuuucucuuucucauuuaugugucugcccuaccagugacuuuuauacuuucuuguuuucaugaugguaaauaucauuguuucacuuccagauguaggacuaccuuaagcauuuccuguagggcugcuguaauagugguaauucccucaguuuuugcuuaucugggaaagacuuuuuuucuccuucauuuuugaagaaagguuucuugguuagucuaguaguuuaucguugguggcaggguuuguuuuuuuccuuuuagcacugugaauauaucauccaauucucuccuggccugcagggucuccccugagaaauccacguuagucugauggagguucccuuauaugugacuugaugcuuuucucuugcuguuuuuagaugucugucuugucuuugacuuuugacaguuucaguaaagugugucuuggaaaagaccuuuuuggauuguaucuauuugauguuugagcuuccuguaucuggauuucuaaaucucuuaaaagaacuaggaaguuuucaacuauuauuaaauuaaaugaguuuuucuaugucauuacccaucacuuuaccuucuggaaaaccccaaauuugaauauuucguugcuuuaagguguccccuaugucauguaugcuuuguucauuaauuuuuauuuuuuauucuuuuuuggugggucugucugaauuauuucagaagaccuguccucaauucuucucccugauauagucuauugacaaagcucucaguuguauuuuucauuucauucauugaauucuucaguucugggauggaucuguuugguuguuuuuuuuuguuuuuuuguuuuuuuugaaauggugucucgcucugucgcccaggcaagagugcaguggcgugaucucaacucacugcaagcuccaccuccuggguucacgccauucuccugccucagccuccugaguagcugggacgacaggcacccgccaccaugccccggcuaauuuuuuguauuuuuaguagagacaggguuucaccauguuagccaggauggucucgaucuccugaccucaugauccacccaccuuggccucccaaagugcugggauuacaagcgugagccaccaugcccggccuguuugguucuuuuuuaugcuaucucucuguugaauuucucacucauauccugaauuguuuuccugaugucuuuguauuguuugucuguguucucuuauaucucacugagcuucuuuaauaucauuaguuugaauucuuuuucagacauuucaucauuuuuuguuuaauuggaaucuguugguggagaauuauguucuuuuggaggugucauguuucuuugcuuuuucauguuucuuguauacuuacauugacaucuccacaucugguguaacagucauuuccuccaguuuuuaggauuggcuuuuguaggguaagacuuuuuucuguggauguauuaucauguugguuuguugggcaguuuagcuuuuauucugggugcaugcaguaguguagucucuaugauuucuucagcuguaauuagccucagugggugucugcgauuuccucaguggcuuaggccgcauuauugguguagccuguggugaggcuuugcuggggacagggacaccaggcauccugauccucaggccccaguggugguagcagcaggccaagcauaccugccccugguggccauacacuggcaucaauuuuagcaggucugcaagggccaauucuuaggccucuauguggcuugcucagguaccagcaguggcagugguaggcugagcauauggaugagaccuuagucuccugugcagcauguguggcauaagcgauuguaauagugauggcaggccaacccucaggcucccaggcaguacacacugcugcuagugaugguagcaacagauugggcaagccagacccuaaacccucagguggcauauguggguaagcgccagcagugguagugguggcagacugggcaggcccagccucaggccaguaguggguggggcagggcaauccccaggcccucagauggcaugcuugagcauugggguugcagugccaggcagugcaggcauuuacucaggccccucaauggugcacgugggcacaggcuguguuggaccaagugaggcaauccccagacccucaaacaauguguuugagugcaggcagucagugguuugggucuguuguuagacccccugauggugcagugcaugccagaagcagcaagcaggguggauggauccccaagccuccagacagugcacucaaucacugugggaggugccaccaggcagggaaggccuguccccaggcuccucuguuguaccugugggugcaggcuguggugaacagggcagucuuugggccacuggacagcauauuuugaugccaguggcugauagccugagucuuucgucaugcuucuugaucauauguauguguacccagagugauagacagaggggggcacuccccaggccucccagguggugugcuagggcacuaggagggguggcacuuaaagggacaggccuguccucaggccccuauuggugcacacagauacagacucugguaggcagggaaggacuauuccuaggccccuggauaaaauacuugagaggugguaggcagagugagucuguccucaugcccccaaauagcauccaguugggccaguucccagguccacugaaggugcugcaaguaccuggcaguccuguugugggggcugggcauugcuaucaguggcaguggccccaggcaggaggcccucagacucuggggaguguaugcuuuggcuuccggccccagaaacagccuucccuagugugcugcccugcuuguucuuuggaguauaagacacugugugggcucgagugcuggggacccagccgcaccauuggguccagccagcacuguaccacuggaaccccuuugauagacauggggcacugucaguugggcuccagguguauagagaugcauacucucuaaugguaguuggcuucucaaaauggcacugugcuucagcuucuuggguccugggggugggugugggaccuggaacaaacucccucucuggaacaaugcuauugugugaacuccaggcaggucccuauacuugucucagaauucacgaggguuguggggaucuuacauggcuaggauugcaagagucugugguggaaauguggaccacuggggaucucucaguuacccuuuccccauacuggagaaccucuuguggcugccagcuggucccagcuaggccagcugcuucacuuccuuuugcuuaucugccucagauguucccugucacuucccugcuaaauuucaguguucucucuuagaggcuuuauucaacaugugauuaucuacucacuguuuugguccuucuuuguggaggagaguucugagucagccaucuugaagcccugaccuuuauuuuuuaggaguucuuuuugucuguucuuguacuguauaugucacugcuuuauguagcuuuaaaauauuuuaauauuagauggguccaguuucuucacccuuguuuacccuuuccaaauguucuguucucuugccccauaugcauuauuuuagagucaaguuagguaauuuauauuuccuagaaaaucauccuuaucuccuguauguuuucucuuccuuuuuugauuagacuugccaaugguuuguggguuuuuuguuuuuuuuuuuggucucucuaaagauuuauugaauuuggggauuaacaguaaaguugcauauuaggagagaaccugaaucuugagaauuuaccauuaugaacauguugcuucugcauuuacucaaauaucuuucgucauucaguaaaguuuuagagaaccccccuuccuccauauaggaaggaauuuaugucuuaaaauuauugcuuaaauuuauauuuugguugcuauuauuaauguguuugcuuucccguuauaguaggauaugggcaaaacaucauuuuuauguuuauauuauaauugaccauguuacuaaauucuguuauugauuuccacauuuuucagugauuccuuuggauuuuuauugacaaucauaggagauuggcauaucauuuugucuguuccuuuucaguauuuacaucucauuuccauuuuuguuuuaguacauauauuagaaugucuaaaacaauauuuuaaugcaguagggcccuugagcuuucuugucuuguuccugcuuugaauggaagugcccaagaauauacuuucagggaucauuucuauaauuuguugccuuucauguuuuaccaccaaauauaaaguuggccauuuggcugagauagguauucuuuaugagguuaacaaaacauuguugauuucuaauacacuguauuuuaucuuuuuugacauguuagugugaugaauuauaugagggagacauccucacuuuccuggaaugaauaccauuaaucaugggguauuaacauuuuaauauuugccugaaaucuauuugccaaaauuuuauuuaggguuuuuacuucuguagucauaaguuuuauuagucuacaguuucuguuuuuuugaaguugggauuauaugggauucauaaaaugaguuuagaaaguuuccaggcuuuuauucugcagaaaauuuaggaacauagagucaucuuauaucuauuccuuauaaauuuuaacagacuaauucuuggguauuggucucuucaaguuuuuacuuuuugacucaauuuaagaaauuuauauuuccaauaaaaucauccauuucccuuucuaauuaucauugcuuauauuaucuuuauuguuguauuuauuguuaauuaaugcuauuucgagguauauucuuuagauugccuugaggcuugucaacuuuauuaguaugcuaaagauuuaugguguauuugaaucuuuucauauuuauauuuagaaauaaaaucuucugccaaauagcagucauuuacuuaucuauuccuauuauguguuuaauuuuuaauaauuauuccuaaaaggggauagaacaggaaggccacuacucauuuaaaguguaugugcuuuucagagggcuugacuuaucccagguaguaaacagguaaccuaccaacaaguggcacacuguaacauacagauuguaguaauggacaaauugauugacagccaaaucuugaauuaucaaugaaacagauguaaggauccauggacaauuuacaaauaaaaauagcagaguacuuuaaccauuuguuuuaauaucuucucaaguauuauaacuaugcacagcagugcaaaaaucauaguaaauaugaauaguuuuaauugucuucuuuauucucugaugcaucuccaaaugaucaaggaaaaaaaaaggcagaagaaagaaguagccugaacaacucaaacuguacaaucauuuucuacacaugauugccccaauagguuuguuauucuaaauugcuggcuggcuagacgugaagcaacugucugcuuagcucauucuucuggguagugcaaaacagcaguccccaaagcagggcgugcaaggcaaccagcucucaaacaaaaagauaauauuagaagucccauuccuacuuauuuuuaccuuauucuuuuucaauaccuuauuuguguguguaucuuauaauaguauagucauacaucuaaauaaauuguaaguaaauaacuauauauauguugauuauguguacuagaaaauguuuuaaugaaagggauauaaauuaaaaacccuuggagagcucugggccagaaguggagaaucaugaauaugaaaccugcuuuagccgcuuaucagucaugugaauuuggucaaucgacucuuuuauaaucuguaaaaugggaguaagaacaccaguccuuccuuccucacaguguuguacugagaacagaauaaagcaacuguaauuguuuguaaauucuauaaaggcugugcagauuaugauuuuuuuuuuuuagcuuuuaaaaucuuuuccucaaauguauucaguacccacauuuaaucuuuauagaagaccauauucgaaguagugggaagacauuuuacuuuuaggaucaaaggagaaaaauguuuaagguuuaacaauucucuaauucuaaaagaguuauauuucuuuccaaacucucagaaaguuuugauggccagauauuuuaaacaaaauaaacuugggaauuaaaaaaggaaagcaauuaaaaguaagucugagauuuagcuguaacuugaggagaaaagaauuuuuacaagagggauaggaaaagauaaggucuuaaaaacaaggaacuaaaaauuaagacugaaguuuuguaaccuuaggagccaggauuuugaugccaacaguuaauuaucccagaaauuucuuuuuuuuuuuauuauuauacuuuacguuuuaggguacaugugcacaaugugcagguuaguuacauauguauacaugugccaugcuggugcgcugcacccacuaacucgucaucuagcauuagguauaucucccaaugcuaucccuccccccuccccccaccccguaacaguccccagaguaugauguuccccuuccuguguccauguguucucauuguucaguucccaccuaugagugagaauaugcaguguuugguuuuuuguucuugcgauaguuuacugagaaugaugauuuccaauuucauccaugucccuacgaaggacaugaacucaucauuuuuuauggcugcauaguauuccaugguguauaugugccacauuuucuuaauucagucuaucuuuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuauuuccugacuuuuuaauguuugccauucuaacuggugugagaugauaucucauugugguuuugauuugcauuucucugauggccagugauggugagcauuuuuucauguguuuuuuggcugcauaaaugucuucuuuugagaagugucuguucauguccuuugcccacuuuuugaugggguuguuuauuuuuuucuuguaaauuuguuugaguucauuguagauucuggauauuagcccuuugucagaugaguagguugcaagaauuuucucccauuuuguagguugccuguucacucugaugguaguuucuuuugaugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaagucuuuaacccaucuugaauugauuuuuguauaagguguaaggaagggauccaguuucagcuuuccacauauggcuagccaguuuucccagcaccauuuauuaaauagggaauccuuuccccauugcuuguuuuucucagguuugucaaagaucagauaguuguagauauguggcauuauuucugagggcucuguucuguuccauugaucuauaucucuguuuugguaccaguaacaugcuguguugguuacuguagccauguaguauaguuugaagucagguagugagaugccuccagcuuuguucuuuuggcuuaggauugauuuggcgaugcgggcucuuuuuugguuccauaugaacuuuaaaguaguuuuuccaauucugugaagaaagucauugguagcuugauggggauggcauugaaucuauaaauuaccuugggcaguauggccauuuucaugauacugauucuuccuacccaugagcauggaauguucuuccauuuguuuguaucuucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugccugugauuuuuguacauugauuuuguauccugagacuuugcugaaguugcuuaucagcuuaaggagauuuugggcugagacaaugggguuuucuagauauacaaucaugucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcguguugaauuuugucaaaggccuuuucugcaucuauugagauaaucaugugguuuuuucuuugguucuguuuauaugcuggauuacauuuauugauuuccauauauugaaccagccuugcaucccagggaugaagcccacuugaucaugguggauaagcuuuuggaugugcugcuggauuugguuugccaguauuuuauugaggauuuuugcaucaauguucaucaaggauauuggacuaaaauucucuuuuuugguugugucucugccuggcuuugguaucaggaugaugcuggccucauaaaaugaguuagggaggauucccucuuuuucuauugauuggaauaguuucagaaggaaugguaccaauucauccuuguaccucugguagaauucggcugugaauccaucugguccuggacucuuuuugguugguaagcuauugauuauugccacaauuucagauccuguuauuggucuauucagagauucaacuucuuccugguuuagucuucagagaguguaugugucgaggaauuuauccauuucuucuagauuuucuaguuuauuugcguagagguguuuguaguauucucugaugguaguuuguauuucugugggauugguggugauauccccuuuaucauuuuuuauugcgucuauuugauucuucucucuuuuuucuuuauuagucuugcuagcagucuaucaauuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugccauaaauuucccuccacacacugcuuugaaugugucccagagauucugguauguuguguguuugcucucguugguuucaaagaacaucuuuauuucugccuucauuucguuauguacccaguagucauucaggagcagguuguucaguuuccauguaguugagcgguuuugagugagauucuuaauccugaguucuaguuugauugcacuguggucugagagauaguuuguuauaauuucuguucuuuuacauuugcugaggagagcuuuacuuccaacucuguggucaauauuggaauaggugugguguggugcugaaaaaaauguauauucuguugauuugggguagagaguucuguagaugucuauuagguccacuuggugcagagcugaguucaauuccuuguugacuuucugucucauugaucugucuaauguugacagugggguguuaaagucucccauuauuaaugugugggagucuaagucuuuuuguaggucacucaggacuugcuuuaugaaucugggugcuccuguauugggugcauauauauuuaggauaguuagcucuucuuguugaauugaucccuuuaccauuauguaauggccuuuuuugacucuuuugaucuuuguugguuuaaagucuguuuuaucagagacuaggauugcaaccccugccuuuuuuuguuuuccauuugcuugguagaucuuccuccauccuuuuauuuugagccuaugugugucucugcaugugagauggguuuccugaauacagcauacugaugggucuugacucuuuauccaauuugccaagucugugucuuuuaauuggagaauuuaguccauuuacauuuaaaguuaauauuguuaugugugaauuugauccugucauuaugauguuagcuuguuauuuugcucguuaguugaugcaguuucuucauagucucgauggucuuuacauuuuggcaugauuuugcagcaacugguaccgguuguuccuuuccauguuuagcacuuccuucaggagcucuuuuagggcaggccugguggugacaaagucucucaacauuugcuugucuguaaaguauuuuauuucuccuucacuuaugaagcuuaguuuggcuggauaugagauucuggguugaaaauucucuucuuuaagaauguugaauauuggcacccacucucuucuggcuuguagaguuucugccgagagauccgcuguuagucugaugggcuucccuuugaggguaaccugaccuuucucucuggcugcccuuaacauuuuuuccuucauuucaacuuuggugaaucugacaauuaugugucuuggaguugcucuucucgaggaguaucuuuguggcguucucuguauuuccugaaucugaauguuggccugccuugcuagauuggggaaguucuccuggauaauauccugcagaguguuuuccaacuugguuccauucuccccaucacuuucagguacaccaaucagacguagauuuggucuuuucacauagucccauauuucuuggaggcuuugcucguuucuuuuuauucuuuuuucucuaaacuucccuucucgcuucauuucauucauuucaucuuccauugcugauacccuuucuuccaguugaucgcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaagucauucuccguccagcuuuguuccguugcuggugaggaacugcguuccuuuggaggaggagaggcgcucugcuuuuuagaguuuccaguuuuucugcucuguuuuuuccccaucuuugugguuuuaucuacuuuuggucuuugaugauggugauguacagauggguuuuugguguggauguccuuucuguuuguuaguuuuccuucuaacagacaggacccucagcugcaggucuguuggaguaccuggcccuaugaggugucaguguuccccugcuggggggugccucccaguuaggcugcucaggggucaggggucagggacccacuugaggaagcagucugcccguucucagaucuccagcugugugcugggagaaccacugcucucuucaaagcugucagacagggacauuuaagucugcagagguuacugcugucuuuuuguuugucugugcccugcccccagagguggagcuuacagaggcaggcaggccuccuugagcuguggugggcuccacccaguucgagcuucccagcugcuuuguuuaccuaagcaagccugggcaauggcgggcgccccucccccagccucacugccaccuugcaguuugaucucagacugcugugcuagcaaucagcgagacuccgugggcguaggucccuccaagccaggugcaggauauaaucuccuggugcgccguuuuuuaagcccgugggaaaagcgcaguauucgggugggagugaccugauuuuccaggugccgucugucaccccuuucuuugacuaggaaagggaacucccugaccccuugcgcuuccugagugaggcaaugccuugcccugcuucggcucgcacacggugcgugcacccacugaccugcgcccacugucuggcacucccuagugagaugaaccugguaccucagauggaaaugcagaaaucacccgucuucugugucccucacgcugggagcuguagaccguaccuguuccuauucggccaucuuggcuucuccucuuaucccagaaauuucuuaaguauuuuguugaccugcauacuuccuugaaucaaaauguugagguuaauagcuaaccuacugcuugcugcuucuucuagcacuauuauauuuuaggaaccuaauggcaucuaaggauuucaccguguaauaacagugggaauuuauuuuucuugguguuuggaaacucucaggaauuuuuuuuuccuuuuucuuauuuuucucucccucucaauuauagguugaagcuccauucauaccaaaguuuagaggcucuggagauaccagcaacuuugaugacuaugaagaagaagauauccgugucucuauaacagaaaaaugugcaaaagaauuuggugaauuuuaaagaggaacaagaugacaucugagcucacacucaguguuugcacucuguugagagauaagguagagcugagaccguccuuguugaagcaguuaccuaguuccuucauuccaacgacugagugaggucuuuauugccaucaucccgugugcgcacucugcauccaccuauguaacaaggcaccgcuaagcaagcauugucugugccauaacacaguacuagaccacuuucuuacuucucuuuggguugucuuucuccucuccuauauccauuucuuccuuuuccaauuucauugguuuucucuaaacagugcuccauuuuauuuuguugguguuucagaugggcaguguuauggcuacgugauauuugaagggaaggauaaguguugcuuucaguaguuauugccaauauuguuguuggucaauggcuugaagauaaacuuucuaauaauuauuauuucuuugaguagcucagacuugguuuugccaaaacucuugguaauuuuugaagauagacugucuuaucaccaaggaaauuuauacaaauuaagacuaacuuucuuggaauucacuauucuggcaauaaauuuugguagacuaauacaguacagcuagacccagaaauuuggaaggcuguagaucagagguucuaguucccuuucccuccuuuuauauccuccucuccuugaguaaugaagugaccagccuguguagugugacaaacgugucucauucagcaggaaaaacuaaugauauggaucaucacccagauucucucacuugguaccagcauuucuguagguauuagagaagaguucuaaguuuucuaaaccuuaacuguuccuuaaggauuuuagccaguauuuuaauagaacaugauuaaugaaagugacaaauuuuaaauuuucucuaauaguccucaucauaaacuuuuuaaaggaaaauaagcaaacuaaaaagaacauugguuuagauaaauacuuauacuuugcaaagucaaaaauggcuugauuuuuggaaacaauauagagguauucauauuuaaaugaggguuuacauuuguuuuguuuuguaaccguuaaaaagaaguuguuuccagcuaauuauugugguguacuauauuugugagccuaggguaggggcacugcugcaacuucugcuuucaucccaugccucaucaaugaggaaagggaacaaaguguauaaaacugccacaauuguauuuuaauuuugagguaugauauuuucagauauuucauaauuucuaaccucuguucucucaguaaacagaaugucugaucgaucaugcagauacaauguugguauuugagagguuaguuuuuuuccuacacuuuuuuuugccaacugacuuaacaacauugcugucagguggaaauuucaagcacuuuugcacauuuaguucaguguuuguugagaauccauggcuuaacccacuuguuuugcuauuuuuuucuuugcuuuuaauuuuccccaucugauuuuaucucugcguuucagugaccuaccuuaaaacaacacacgagaagaguuaaacuggguucauuuuaaugaucaauuuaccugcauauaaaauuuauuuuuaaucaagcugaucuuaauguauauaaucauucuauuugcuuuauuaucggugcagguaggucauuaacaccacuucuuuucaucuguaccacacccuggugaaaccuuugaagacauaaaaaaaaccugucugagauguucuuucuaccaaucuauaugucuuucgguuaucaaguguuucugcaugguaaugucauguaaaugcugauauugauuucacugguccaucuauauuuaaaacgugcaagaaaaaaauaaaauacucugcucuagcaaguuuuguguaacaaaggcauaucgucauguuaauaaauuuaaaacaucauucguauaaaauauuuuaauuuucuuguauuucauuuagacccaagaacaugcugaccaauguguucuauauguaaacuacaaauucuaugguagcuuuguuguauauuauuguaaaauuauuuuaauaagucauggggaugacaauuugauuauuacaauuuaguuuucaguaaucaaaaagauuucuaugaauucuaaaaaauauuuuuuucuaugaaauuacuagugcccagcuguagaaucuaccuuagguagaugaucccuagacauacguugguuuugagggcuauucagccauuccauuuuacucucuauuuaaaggccgugagcaagcuugucaugagcaaauaugucaagggagucaauuucugaccaaucaaguacacuaaauuagaauauuuuuaaaguauguaacauucccaguuucagccacaauuuagccaagaauaagauaaaaacuugaauaagaaguaaguagcauaaaucaguauuuaaccuaaaauuacauauuugaaacagaagauauuauguuaugcucaguaaauaauuaagagauggcauuguguaagaaggagcccuagacugaaagucaagacaucugaauuucaggcuggaaaacuaucaguaugaucucagccucaguucucuugucuguaaaauggaagaacuggauuaggcaguuuguaagauuccuccuaacuuucacagucgaugacaagauugucuuuuuaucugauauuuugaaggguauauugcuuugaaguaagucucaauaaggcaauauauuuuagggcaucuuucuucuuaucucugacaguguucuuaaaauuauuugaauaucauaagagccuuggugucuguccuaauuccuuucucacucaccgaugcugaauacccaguugaaucaaacugucaaccuaccaaaaacgauauuguggcuuauggguauugcugucucauucuugguauauucuuguguuaacugcccauuggccugaaaauacucauuguaagccugaaaaaaaaaaucuuucccacuguuuuuucugcuuguuguaagaaucaaaugaaauaauguaugugaaagcaccuuguaaacuguaaccuaucaauguaaaauguuaagguguguuguuauuucauuaauuacuucuuuguuuagaauggaauuuccuaugcacuacuguagcuaggaaaugcugaaaacaacuguguuuuuuaauuaaucaauaacugcaaaauuaaaguaccuucaauggauaagacaauug

SEQ ID NO: 13870 - RNA, 605 nt, Homo sapiens
uucucuuuuuuuuccaccaaaaacuuuuuauuggccuuuuugauggaaacggguuuauuugucaggaaggaugaucccaucauacuuaugcuggaagcaacgcaucaucuccucuuugcugagucuguguuuggccccagugcagccuguccugugcuucuugucugugaugcugaaaccuggccuacccagcaccacagagaaguccaggccguagauaccaaugcuugggucauauaugauacccaaaucgauguguuccuggaucccaaaaccaaaguuucuaguaucugagaaguuauuuuuucuuaacucauacuucugcaccuuuagauccuucuccaggauuucuucugccuuggauccuugaacugugcaguggacagcaaucuuuucauuucucugcaugccagaggaucugauuguaucuagcucuggaaaacacaggacucugcccugugagcugcuccaaugccuuggcugcucggguuagucugucuccacucuccuccacacagauguugaggcagagcuugcagaugugaaguuucugcaugggguucuccuuuucaccuugauccgccaugauagagaacaggaagagc

SEQ ID NO: 13871 - RNA, 1064 nt, Homo sapiens
guuaucuuuucuuuucuuuuuuuuuuuuuuuuaagaaacugauguuuauuuuccgccaaucauuuuuccguguugcuuaagagccuaugcaagaacagcuuaagaccagucagugguugcuccuacccauucaguggccugagcagugggagcugcagaccagucuuccauggcaggcugagcacuccugucuucaguagggaacuacugaauaggcacagagggcaccuguacaccuucagaccagucugcaaccucaggcuuaguagcagugaacucaggagcuggagcaguccauucacccugaaauuccuccuuggucacugccuuuucaguagcagccugcucuucuuuuucaaucucuucaggaucucuguagaaguagagaucaggcaugaccucccauagguguucacgagaaauggugccacgcaugcgcagaacuucccgagccagcguccaccacaucaaacccacugagcgagcucccugguuguugcauggaauggcaauguccacauagcgcagaggagaaucuguguuacacagagcaaugguagguagguuaacauaagaugccuccgugagaggcugguggucagcccuggggucaguaaccacaagaagccuuggcucccagaagucugccuggaucugguuagugaagguuccaggagugaagugaccagcaauuggaguggcuucaguggcagcagcaaacuucagcacagcccucuggccaguauuccuggaggauauaacacugacaucagcaggguuuucaauagcaauaauagcacgagcugccagcagaagcuucucccagguccucuucagauuuaugauauagaugccaucacuuuuccuuuuauagauguacuguuccaucuggaagucaagauuggugccaccuaaguggguuccugcuacaaggaacuuaaggacauccuccuccuucauuugcaggacaucaagcgcuccagacauugugaaaguuucccuuuaaguuacgacgggaauccagaacgacgcuguauggaccccucuguagguagcgcggaaag

SEQ ID NO: 13872 - RNA, 963 nt, Homo sapiens
ggaaggugcucacgccuugaacggccggcggaauccgggacaucuggagcaaacacauuugcaagcggaagaaagguugccucccucaacccgcuucccaaaggccagaucucggagcaagggggacugugacuuucugcgguccugccaaguuaaauuuucccuuccagggaaggcacacucacuuucccccgggacgcccccggcggacucaacacggcaucggauuucgcgcuccgggaaacgccgcucaacccuccugggcccacagaaauacgcgcggcgcggcgcggcgcggcggagaggcgggagagccugagcaccuggcgccuuaccuccgacggcgagauuucaaacgcgcccgcgaucugggcguagagcuccuggaugcuggagaagcccuccacucggcccguggcacuaccgugcgccagcugcgcguggaagaccagccugcgugcgggagcccgggacgcugagaggcucccgccgcccgcgcccgucggcucgcccuccaccagcccggcggucuccuuggacuuggccuucuucuucccccgcagcuucaggggcaucuugcagggccgagagcgcgggcccaccugcgcugccguccgccgccuccuccccccggcgccucggacuuugcgccccgggccccgcgcagguaaaagcagccuccaauggcagccgcgcuuccgccuggcugcgucgggucagggccccgaccuccaccccuggaccggagcagccgcccgcccgcccagccucccccgggauggaucuggagagaaagaaaguuacguagucccucauccuaucaccagguuuaucccuacuccuuguaaaaaauggcucuauuuacgugaacgccugaggaugccgacgcuacagaacaauacgccuuagaaggcaaacacgcuggcccuucucugcuuuucauaaaucuguaguaggcaccca

SEQ ID NO: 13873 - RNA, 53444 nt, Homo sapiens
uuaguuuuucuuaaaauacauuuucauggccaggugugguggcucacgccuguaaucugagaacuuugguaggcccaaggcaggaggauugcuugaggccaggaguuugagagcagcccgggcaauauagugagacccugucucuuucucucucucucucucucucucucucucucucucucuauauauauauauauauauauauauauauauauauacacacacacacauauacguauauguauauauuuuuuuuugagacagaguuuugcucuaauugcccaggcuggagugcaauggcgcgaucucggcucaccacaaccuccgccucccugcuucaagcaauucuccugccucagccucccgaguaccugggauuacaggcaugugccuccacacccagcuaauuuucuauuuuuaguagagacaggguuuauccauguugaucaggcugaucucgaacucccgaccucaggugaugugccugccuuggccucccaaagugcuggaauuacaggcaugagccacugugcccagccccuaaaaauauauuuaaaaaaaagaaaagaaaauauauuuugauggcuuugaaaaauauacauguaugcacauacaccacuuaaugcaaauuaauuuucuaauuucuaacuuacuuauaaaaacaauuauuagacaauucuuggcuguugccucagagauguauuuaaguggcccauuuauuucuaucccagaagcacacuuuguacugaaauagcaauaauaaagaggauacuuaccuaaaggucuauggauucuaacaggcuacacauagauacuauguacagucuccuaaaacauuaagauuacacugaaugcuuagaaaugaaagccauugaauaacucuccucuacauuauauuuguggucacugaugauaaccauacaauuaagaaacaauaugaaaauaaaauuuagucagauacuuuuuuuuuugagagacagagucuugcucugucucucaggcuggagugcagagacaugaucucagcucacuaaaaccuccgccucccagguucaagcaauucucuugccucggcuucccaaguagcuaggacuauaggcaugcaccaccacgcccagcuaauuuuuguauuuuuuuaguagagacgggguuucacuauauguuggccaggcuggucucgaacucaugaccucaggugaucugcccgccucagucucccaaagugcugggauuacaggugugagccaccacauccagccuagucagauacuuuuaaugguguuuuguuuucucauauauaauccuuagaggaaugguugugaugcuggcaaacugaguagaaauuuuuuaaaguaaauuuuaagcuuauuuuaaaauuuaaaguaaauuuuuuucuuuuuuauuuuucuuuuucauuuugagacagagucucacucugucaccgaggcuggagugcagugcugugguuauggcuggcugcaaccucaaccuccagggcucaaguaauccucccaccucagccucccaguagcugggaccucaggugcgcaccaccacacccaaccaauuuuuguguuuugaagagaugggguuucaucaaauugcccagacuggucuugaacuccugggcucaagcaauccucccaccucacccucccaaagugcugggauuacaggcaugaaccaccgcacccagccccagugaauuuuuaaaaauuuuuaaaugugauuuauuuagaaguucucuuuucuguaaucaggguaaagcaacgcaucagaaauaaacucacucaaaucuauuuugaacuaaaaucuaaagaaaucuaaugagaagcuuaagaaauuucuguuucuuacuaaaacacccauuucuucauguaugaccuucauaaagucuuugguuaguaaauuuauuuuuuuucuaauguuacuagcauagguuugcuaaaauacuauauagacagaauuugaaggaaaucugaauguuauugucaccacugacaugagaauuuaauagggcaaauucaacagaaauuuacuuuuccuaucuauaauuaucuuaaguugaagggggaaauaaacucaucuauaaacuaaucaaaauaauggucguuuauuagaauuugucuuaugacccaaaaauagcuauauagcuauaucuacugcuguuccaacaaucaaauaaugaguaaaaauuuuccagucaguaguuuuuaaaugaauuuaaacaaauugacauuuaaguuuuaaaauuuaacaauuacuacauuuauauccuuaugagaauucuaggaguguuuuucaaacuguggagcuguuucacaaauguagaucaugaaauaaaugccgugggaugcaauuagaaaaaaauuaauaaacuagaguauaauuuuaaaacaucagaguuauucuaucuaggaaugguaaguaaugguuuauuaaacuuccauuuuauauacauauauguaaaugaaauuauuauuuucauagguaaaagauagguaauuucauauugccacuuuuauagaucaaaaaaguugaguaucugugauuucauauggcuuaaacuaauauacacauacauucacacacaauguaaacuaguagaugacacuguaaaauguauucuuuuuuuuuuuuaaagauagugcagacccaaagagugagcaguagcaagauuuauugugaagagcaaaagaacaaagcuuccacgguguggaaggggccccgagcggguugcccguaaaauguauucuuacuggcaaagaguaacaacaaaaacaacccccacacacacccaagaaugcucucuauauuacauaguucuagaaaauagccuaaagaguuuuuauuucuguugaauuucagaguaguuuuacuuauuuauuaaauguuugugguuauuaaauuuuauacuauguuauaaaguggauggauauuuaaaaauuuauuguaaacaagcuuuguaacaagcuuuuuuaaacaaagcauuguaaaauagucaacuaccuaacuuuaauaccaugcaucauuuacugugauuucuuaacauuaaaaagaacaucaaguuuuuuuuucuacccuaacauuauuauuuuuuuauuuuuguuaggauacuugccgacacuuccaaauuucuuaacaacacaaacuucuaguccaugauuuuuaaaaaauacacacuaacaaauuaaauuuuacucuagucuauuuuccagggugaacucugguaugaucucuaaaggcaguuucgucuacagaaggagagaccucaucuaaugucaucuccuucuaacggccgucaccaaaauuauaaucaaagccaaggcuaguagcuccuaaucugaugucuccacaucccaaggagacuacaaaggagguagguaauauagauaagugaugcuacuuucaguauuggaaaucaccuaaugggaaucacacaccuaacagguuauagagugaauuuuuuuaaauagcauucuuagccaggugcuauagcuuaugacuguaaugccagcgcuuugagaagcugaggcaggaggauugcuugaggccaggaauucaagaucagccugggugacauagcaaggaccuugucuguacaaaaagauaaaaucacauuuuuuguuucuagcuguucacuuccuguuuaucaguaguugacuagcugucauauuauguuggauauauuaaaauaauaguucuguuuuucucagaggcagggccucacucugucacccagguuggaguauaguggcaugaucauaggucacugcauccucaaauccuagggcucaagugauccuccugucucagccucugaagucgcugggaccacagccaugugccaccaugcccggauaauuuuuuuuauuuuuuguagaaauggggucucacuauguugcccaggcugaucuugaacuccugacuucaggcaauccuccugccucagccucccaaagcacugggauuacaggcaugagccacugugccuggccuaaauauaauaauucuaacagccauccccaaauauaaauauaauaauuauuaauaaauacagucuguucaucacaaaaaaaaguuuaauuuaauauggguggggguaagaauguaauaaaaggccuauuugggguaaaaaguuuagaaccaaugcuaugaaauaaauuuuuaauguaguauacccaugaucuuuaaaauuuuuauuaugaaucuuaucuguaauuuaauuuuuauuuucauuuucaagagguaaagcauuucaaaauuuaagaguaugagggagacuaucaauauaugaaucagcagccugagaaauauagaaucauaugucuuuuaaaaucuucauuuaaaaaaauuugaacaaagauaacauuuuaauguaacauaauuuaaaaugucugaguaaacuucucuuucaacauuaucucauccauaccuaguauuguuuauagagaacuguauucuauuaagagguacauaugauaaguauucuccauuuacaaauaggaaacacaagccugaaaagaaauggccucuauagacagcaagagccaggaucaggcgccaacacuugacauuuucuagucauaucuuuggcuagcugcaauggcucacaccuguaaucccagcaguuugggaggccaaguaucauggaauacuauacagccauaaaaagaaugaaaucauguccuuuacagccacauggauggagcugaaagccauuauucgaagugaaauaauucagaaacggaaaauaaaaauacuugagagcuaaauaaugguuacauguggaccuacagauggaaauaauagacacuggggacuccaaauggaggagaggugggaaugggguaagauuaaaagaccagccugggcaaccuggugaaaccccguaucuacuaaaaauacaaaaaauuagccagcaugauggcgcaugagaauaucuugaacccggagguggagguuucagugaguugagaucacaccacugcacuccagccugggugacagagugagacucuaucucaaaaaaaaaaaaaaaaaaaaaagacauuuucuagucccauuuucuuuaucugacaucuacuucugccucuuugauauguauuaggaaacauaacaucaacaggauuugaaaauuaggaaguaaauuauauauuuuucugcuuuucaauaaagguucccaucucaggacuuuugucauugcuguuccuuuuuccuuaaaucuucuuccaacagcugcccgcuuugaaucauuaagggcugaaugcaaaugucucucuccccagagaggcugucuuugaugacucuagcuaaaaaguaacacacuucuucccccuccagucaguuucuaugccguuaucauucuuuucuuaaugcuuaucauuauucaaaaaaaugacuuacuuguuuuuuaaugcaaguaauguuucuuaguguuuaucuucuaugauuagaauguaaggucuuuaaggguaggacuguaucuuuagcaccuacaauguuauagccucagugugcucaguaaauacuuguuuaacaacuaacuaaaggugauuugauaacugauaaauguugauacguuuaugaaaaacagugugaagauuucucaaugagcuaaaaauagaacuaccauuaaaccuagcaaucccacuacuggguaucuacccaaaggaaaauaaauuauuauauuaaaaaagacacuggugcuuguuuguuuaucacaguacuauucacaauagcaaagucauggaaucaaccuaaguguguccaucaaugguugauuggacaacgaaaaugugguauauacacaucauagaauacuauacagccauaaaaagaaugaaaucauguccuuuacagccacauggauggagcugaaagccauuauuugaagugaaauaauucagaaacagaaaauaaaauacuugagagcuaaauaauggguacauguggaccuacagauaauagacacuggggacuccaaauggaggaaaggugggaaugggguaagaguugaaaaauuaccuauuggguacaauguucacucuuugggugauggguacacuagaagcccaaacuucaccaucaugcaaaauauccauguaacaaacccacacauguauccccugaaucucaaaagaaaaaaauuuuaaaacauacuguauugaaaggaggcagagguugcagugagccgagaucaugccauuguacuccagcaugggggcagaaugaaacuccaucucaaaaauauaaaaaauaauaauaaguucuaugaggguaaggaacagguugguuaaauucaccauuacaucuaacacagaucuuggcacagaggagaaaugaauuuuuauuuuaugucuaucaaauuaauguaaaauaauaaauuuccccaucuuuccuuaauuugugcaaagcaggagaaaagagguguauuuggguaucauaaaacuaauacaauuuagacaaaaggaaaaaauaaccucauauucuugguucugccccuaaaugauaccuaggcagaaacaacuacuagugguagaaaacacauuucucauaggaggagggcauaugguacauuuccacugucaugcauuuuauguauuauguccucaauucucaaguuuaugaaggccuuuauaaagaucauucuuaucugugaccccagcauagccuggugcccuaugcaaaaaaaaauucugacacugacaacagcaaggcaucauaaugaauuugucacuauucauugaaagaaauugguggcuucugucaaucuccuaaaauuauuauccuaaauaauucaguggauauggaaggauugguucagguuuuucaggcagaacaaaugaagacaacuaccaucuucacaaccauguagccaugaacaguagaaauagcaggucgaaaaucacaaucugggcgugaaucucaguugcaucucuaucugugugaucugggauagaggacuuaagaaugccugaaucucuguuuccucaucugccacaugaaguaguaauaacaaauaacuacuucacaaaauuaucaauuacuauacaaaaauauugggccacguauuugaaaauguugauuaugaacuauguguuugcacucuaugcucucaugaaguuaguauuucauaaacuaaaaucaaaagcaggcaggguuuuuauuuugauuuuuuuuuuuuuuuuuuuugagauggaguuucacucuuguugcccaggcuagaaugcaauggcacaaucuuggcucaacacaaccucugccucccgaguucaagugauucuccugccuuagccucccgaguagcugggauuauaggcauuagccaccacgccuggcuaauuuuuuuuuuuuuuuuucaguaggcaugagguuucucuauguuggucaggcuggucuugaacucccgaccucaggugauccgccugccucagccucucaaagugcugggauuacaggugugagccaccaugcccggccuuuauuucgaauuuuaaaaauacuuacaaaucccacaauguauaaauacuucaaaccaucauguuuuacagaguaaauacauacaauuuuauuugucaauguaaagaaaaaaguacuuacagcaauauauaaguaggcauaagauacuugguucaaucuuuucagaauagucacacauucacaguaauuuugaaauauuuuuucuuucaugugccucuagauacaauaaaauguuuuaacauuagauauauuuaacauuaaaguauuuaagucuaacuacauuuacuaguuagaauuauauguugcucuuugauuuagugccuuuucugaaaaaaaauuuuuuucuuuuuuuuuuugaaacagggucuugcuuugucacccaggcuggagugcaguggcacaaucauaacucacugcagccucacuuucccaggcuuaagcaauuaucuggugccagccuccuguguugcugggaccaaagauguggaccaccaugccugguuaauuuucauauuuuuuguagaggcagagucuugucauguggccaagcugaucuugaacuccaaggcucaagcaauccaccugccuuggccucccaaaguacugggauuauaggcgugggcucaugcugggauaugcccaugggcacaggcagaucacuugagcccuggaguucaagaccagccuggccaacauggcaagacuucaucuauacaaaaaauacaaaaauuauuggggcaugguuuauacaaaaaauacaaaaaguauaggggaauggugguguuugccugucgucccaacuacaugggaggcugaggccagaggaucacuugagcccagaaguucgaggcugcagugagucauaaucaugccacugcacuccagccuaggugacagagugagacccugacuaaagagaaaaaaauuaauaaaauguuauuucauaagaacaaaaaacacauuuuuaaaucaaauaccuauguaaagaaauuauugauauuuacauaguauauauggucuauauuccuuuuuuuaaagcuacauauaggucuugaaauaauucaaauccauuacaauuaucgaaaauacaaguaaaaaauaaaauauuuuuauauuaauuaaaagauugguaaaguuuuaaaaucucuuagcaacauaaaauuagaauuccuggcuaaugguucaucuucuuaauauucaaacccaucacauuuauuaagacaaauuauuaaaugagaugacugguaucuauucauaauauuaaguaagucauuguuuaaaauuugaaaacugaaagaaaauaaauaaguuucugagucaggcaugguggcucacaccuguaaucccagcuacuugggagguugaggcaggaggauuguuugaggccaggaauucuagguugcaaugagcuaagauggugccacagcacuccagccugguugacugagcaagaccucauuucuauaaauaaguaaaauaaauucauuucucauacgcaacaccucaagauucuaacuguaaaucaaaauaagauaucaauuucauuuuaaaauguuugacuuauuuuaaguuacauuauuuugguuaaauaauacaguuuauauuguauaaauuuugugauauauaagucuaccuuuuuuuggugccaaaacagaagugauauaacuuuauauaccaucuucaaacuuaaugagaauaagccuauauaaccuagcaacuaauuuuaaauaauacuaagccccaucuuaagccugguuuucaauuuuaacaucugauuaauuucuuccaaaauuuauacauaaaauauucugggaaaaaaguauaaaaugucuaacuauuccuauuguguaauuacuacucugaaguuagcugugccaauuuucaagguuuccuucauaaguaagggaguguaauguauaaaagccauaguaaaauauaauuucccagucugaagcagauauguuucugaaaacacugagauaagaaaacgauuaggauuuaaguugugaagggaaaaaaaauaguuuuaggcagaacccuaagaagacaguuuuuagauucacuaaaaugaagauuguauuaaauaaagaggauaagaguaaauuuaauuaguaauaauaaauacuauaugauuuacaauuccuugaucacuagaaauuuuucaggaucucccauuuucauagcuucaauaaaaugcuugcaaauucauuuuugguuuguuaaacauaauaggcacaucaagaaggcgauuuuuaaaaagucuaaccucauuccuaauguuuaaacuuuucagaucuuaugauuuucaguuaaccucaucucucucuuuuuuuuuuuuuuugagauggagucucacucugucacccaggcuggagugcaguggcuccaucucagcucacugcuaccuccacuucccagguucaugugauucuccuuccucagccucccaaguagcagggauuacaggcaccugccaccacgccuggcuaauuuuuguauuuuuaggagagacgggguuuugcaauguuagccaggcugaucucgaaggccugaccucaagugaucugcccacgucgggcucccaaagugcugggauuacaggcgugagccauugauccggccaaucucauuucuugaaccucuucauccccagucacagagaugcaaaauguauacuuaagauaaaaaacaauuacacaacuuuuacuuaagugacucagauaaacauaacuaagccgagagcgguggcucacgccuguaaucccagcacuuugggaggccgaggcgggcaggucacgaggucaggagauggagaccaucuuggcuaacacggugaaaccccgucucuacuaaaaauacaaacauuuagccaggcgcuguggugggcgccuguaaucccagcuacucaggaggcugaggcaggagaauggcgugaacccgugagguggagcuugcagugagccaagauagcgccacugcaggucuggccugggcgaaagagcaagacuccgucucaacaacaacaacaaaaauaauaaauaaauaaauaaauaaaauaaauauuucuugagcucgagaaaguuauauaauaauauaauauaauuuauauuauauuauuauauagaaauuauauuauuauauaaauuuuaaauucaucuuacaaaacuacuucccauccaggcuuuuuguauccauuucaauggcaucccuuuagcaaaaacagcagcagugguuuguaccucuggcuauauugauugauugagacacagucuggcuauguugccaggcuggagagcaauggcgugaucuuacuauaaucucugccuccugggcucaaaucagccucccaccuaagccucccaaguagcugggacuacaggagugccccaccacacuggacuaauuuuuguauuuuuuguagagauggaguugugcuauuuugcccugacuguucucgaacucgugggcuuaagagaucugucugcaucagccucccaaagugcuggcaugagccaccacaaccggccuuggcuuuauuucuuauguguaagucugcaucaaaaauuucucaucuuccucaaccauucgcuuuacucucauuuccuuuuuuccaaccucugguuuccucuucuuaaaauuaucucaauuaauaauggcucagccugggcaacauggugaaacuccaucucuacaaaaaauacaaaaauuagccaggcauggaggggcacgccuguaaucccagucacucaggggaggcugaagugagaggauugacuugagccugggaggucgaggcugcagugagcccagauugcacuacugcgcucuggccacaccaccaugccuuaaaaaaaaaaaaaacucacuagauuaagaaaauguggcacauauauaccauggaauacuaugcagccauaaaaaaggaugaguucauguccuuuguagggacauggaugaagcuggaaaccaucauucucagcaaacuaggacaaaaaaccaaacaccgcauguucucacucauaggugggaauugaacaaugagaacaccuggacacaggaaggggaacaucacacaccagggccuguuguggguuggggggaggggggagggauagcacugggagauauaccuaauguaaaugacgaguuaaugggugcagcacaccaacauggcacauguauacauauguaacaaaccugcacauugugcacauguacccuagaacuuaaaguauaaaaaaaaaacuucaagaacuaaguuuauacaaaccaaaauucuaacggcuggagagaagauguacuaacgaauuuuuaguuugggaggaguuacaauauuugcaaauguuuguagagauuccguauguuauuugucauuacaaacuuuucuucucaauaaaaucugcaggguuuuuuucuuccuuucuuccccccuucuuuuucucucgccuuuuuucuuuccucucucuccuuuucuuuuuacaaugauauaauuuaauauuugaauaguauuuuacuuguaaaaaucuucauuuguuauuuauguaaauuaaaauaauaugcuuguuuuuugcucagauguggccuuacacuauuuugagaauaacauuggcauauauauuuguaaacuaaugaaggacacagcccaauuauggacuauuacuucuauuaauauccuuaaaaagaaaaagccuguuuuuguaauuaauguuucaaaagcuuucuagugagcaccaaauuauaacuuuguauguuccuaaaugaccgaauauauuucaaauguauaugcuaaauuacacagacuacauaaauaaauaggcaaaugaacuuuucuuuuuaauauuuaaauggagucuugcuauguugcccaggcuggucuugaauaccuaggcucaagcaauccuucugccuuagccucccaaagugcuaguauuauaggugugagccaccacacuuggccagcaaaugagcuguaaaagaauuuaaucuagucuuggaaauugagaaacaggggauaucaauggcauacuggagaaaaauggcacugagaauaagaauucccuuuccagcuuccuuuuuuugagacagucucccucugccacguugcccaggcuggagugcaguggcaugaugucagcucauugcaaccuccaccucccagguucaagcgauucuccugccuuagccucccaaguagcugcgauuacaggugcuugccaccaugcccggcuaauuuuuguauuuuuaguacagaggggguuucacuauguagaccaggcuggucucgaacuccuagccucaagugauccaucugccucggccucccaaagugcugggauuacaggcaugaaccacugcacccagccugcucuccuuuuuuuuuuuucuuuuauuuuuuaaugaccagaagaguuucgaauacaucaaaccugcucuuuaacuacagacaagccacuuagccucucuggguuuacuucuuuaucuagaaaaugggauuuuaaaaauuauuuccagcuccaaauguuuuaugaauuuuaugaaguaucacaaaaaaauuuaaaagguugaaauauuuacucuauaaaacuucaucuauuuacucacauuuugauuaagcuauuauuugaaaguaacauaccacauuuuuuuucuauacuucuccauaaaggguaaaaaauaaaccauguauacaugaagucagacauauaggcaguauacuacauuacacguuaguagauaaaaauuauuuuuagauuaagaaugauauuuagucuuaacucuuugagguuauguaaauaguccuuggaauaugaagauagucccuucugagccauuuacugagucuaaucacauauauuaauuuccuuuauccaucauaacuauuugaaugacaguuucccaaaaauaaacaaacaagaguauuuucaacuccuugucuccaaggaaggcuaacaauaggcaggagugaugagcuacaguagaugugacuaacucagaugcuuucagaggcccaggcaacauaacuaaacaugugaagcagcuuuauguaacgcaauagauaaugguaggucaguggcaacagaagaguccaugucuugccuaaaagcauucuaauuaaaaaauaguuuuuaaaccacugagcuggccaaacaaaauaccucuauuagcaggccauuaaucaccuuggcuuauacuuguuuuuuguuuuuguuuuugagagagggucucacucugucacccaggcugagugcaguggugcaaucagggcucacuacagccucuaccuccugggcucaaguaauccucccaccucagccucccaaguaguugggauuacagcacaugcuaccaggcucagcuaauuuuuaaauuuuuuguagagauggagucuuacuauguugcccaggcugguuucaaacuccuggacucaaguuuugauuuuccccugccucagccuccccaagugcugggauuacaggcauaagccacagugccuggccuucgucgucuucuucuuuuuuuuuuuuuuuuaacauaagcaauuugugguuuuucuuuuagggaagauaaacaucuucuuuaugggaucuauaguacuucaaaacuauuccggcuauccaagaaccugguugaauuuaaagaaaacauuuuaaaauaaaaaguacucucauaauuugaaaaaauaaauuaaaaaacuuuaaaacucuacucauuacuacuuuuaauucaacauucaacacauaaaaacugagcaguuacuacaugcuaaagcauugucaauauccuuuaagauaagagagauacugguauacugguuuuguguaguuauguaaauuuauuuacuacuagaauaauaauucucugcuuaaaaaaacuuuuuaauccaaagauuauuauauaucuaucuauaaaucauuuauuuuaccugggagaaaaugcuuaaucaagaaaauugcaauaaauaaugauggguuuaaaacagaaaccacuaucauucaccacguugacugaugcuuuucagaucuagaucuuuagacuugugagaaaauuucuguaauguucacacuucuguagggaguuuuaacugucauucagagagacaguuauagaggaaucauuuaugaauuagaguaauaaauacgauuagcugaauucuguggcauuuuuuucaagcauuuuccauuugcaacucaaauauaugguuacucccagaaauuccacuuuuagguauauacccaugagaauugaaacacaaaaacuugcacacaaauguucacagcagcauuauuuauaauagccaaaaaaguagaaauaagccaaaugcccauaauuaaugaaaagauaaacaaauugugguauauccauaugacgugccacacaaaaaauaaaguacugauacgugauacaacauagaugaaccuugaaaacauuaagcuaaaugaaagaggccagaccaaaaaaaaaaaaagccauauauuguuugagucuauuuaugugaaauguccagaacagacaaauccauacagaugaaaaguagaugguaguguuuucaggggcuggaggaagggaagaaugggaaguaacugcuaauggauuuaggauuucuuuuuggggugaugaaaauauucuggaauuagaaagugaugaugauuguaccacuuuguaaauaucacuaaaaaccacugaauuauauauuuuaaggguaaacuuuauggcauguaaauuauaucucaauaaaguaauaaagaauauggcuauuauaaccuauuuauauuggauuucuaaaagaauauuucauauucuacuaaaaggcgauaggauccaguauauauauauauaauccugaaaacuauuuuauaaccaaaaauuuugcuucaaaacaucauucucacuauaguuauaaaacagaaaacaaaacuaaauuuuuaaaacauaaauauauuuaaaaaauuaaaacaccuaagaaaugcaaucuauacaugugaaaaaguaaaauauuuauaugcauaacaaguaguugcaacauuauccauaagcagcaguuaguguuuauuuucccuauauuuugguuuaacaccauaguguagugguaguucauucuuuuuagggaaauuacauaaaguacauauagaauauuauuaguaaguuauagaagacuguauaacuggaaaauuaauuccaaguaacagcauuuccucuaaaaacacaucuauuauuaaacgaauuacuuuaaacuagcagagaacaaaaugagccuauaauuuauuaaguacaagauauauagucaacuugcauaaaauuacauauggcauuuuaaaaagucuauucuaaaauaucaguaauucaagcaauugggauuuccacaggagagaaauugccauuacuuuccuuuuuaugaagaaagaucugccuuaagaacaucacaacgauguuauuaagaaaugcuacagcauacuuuaaaaaucaaaauggugaaacagaugcaucaggauauucuuuuacagauaccagcccuauagcagcauuucagaaggugauuuaaaucuaauaacugacuuggguuuuuauucucuucuagaaauacauauuacauguauaguuuaguuaagaauuuucauuuccauuauaaaugggaacuuuucauacugauuaucuaaagguauaagaaauuaaguaauuggauagucuagcacuucauuagaaauauauccacugacuccacaaaaacaacuuuuacauauaagcaaauuacuaaaaauaucugaaucaggagaaaugaaauaaaauacagugaaugguuuucucuuuuaucucuaacuguaaaaaucccuuuugccuauuuauuugacccgucucuauucaugcaauuuaaugaacccucaaaagaauuuacacaucuuuauacagaauucacaucuacaucaguaaacuaccaguccuuuuauauuuucagugccuuaucaaaauauguguaacaaaguucuucauucuaugaggcaggaagauguuuccuaaguacuucuuuggaugaagaagauauaguaucugggaaggacaccucaaauucuauuagaaggucaccacguuggucaggauuuuuuggaaauggcagcccauauccaauaauucuucuccucauuccggguuucacaauaucauuuacugacauagguauguuucuuccauccaguguugguacauuaauugagcagccacacaaugccuaaaauggaccaaauaaaauaaaaugaaaacacuucaaaacucaaaaaucuaagcacaaauuuuaccagaugguaaaggauaauaccacuaagguaaaacuuuaaccuccaaaagaauaacaauaguuauaaauuuuuuuuccucauuagaaaauuccuucagaggucaggcacgguggcucacaccuguaaucucaacauuuugggaggccaaggcgggcagaucaccugaggucaggaguucaagaccagccucaccaacauggagaaaucuugucucuacuaaaaauacaaaauuaggcgagcgugguggcacaugccuguaaucccagcuacucgggaagcugaggcaggagaaucacuugaacucagcaggcggagguugcagugagccgagaucgugccauugcacuccagccugggcaacaagagcaaaacugucucaaaaaaaaaaaaaaaaaagaagaaagaaagaaagaaaaagaaaaagaaaagaaaagaaaaaaaggaaaauuccuucaggacaugcauuauuagauauguuacaaaaaaaaaaaaaaaagaagaagaaaagaaaagguaaaagagaaguaaaggauauauuccacauugcccuggaaugacaugguuauuuugaagcugcuauuaauauauucaagaugcagggauuggaaugggagaagagggagaaauucaggacuagaaagaacuggauaggagcaacuauuucucuggaaaguauuaggacaagaaauauauuuguuuuagauaacaaauguuuacugagcauuuacuauaugccacacauucuggcuagauggugagccuuauagggaccaugaacacagaccccagcucaaggaaugcacaaggaacucacagaaacauagaagcaaacuagccauuauaauacuguauaguguaagaacagagguaagcauggaggucuuuuguaagagaaagagcacccaacuuaaccccuuagauuccgggaguagaggaugcuugaacuaagcauugggcaguagcagguagguauuagagcaggguaagaaacaauaguguuccauagaguacagcucaaguauacaagauaauaauagagcaaacugggccaggugcgguggcucaugccuauagucccagcacuuugggaggccgaggugggcggauuacuugaggucaagaguucaagacgagccuggccaacauggugaaaaccuaucgcuacuaaaaauaugaaaaucagcugggcaugguggcgggcaccuguaaucccagcuacucaggaaccugaggcaggagaauuacuugaaccugggagguggaggcugcaguacuagcugagauugugccacugcacuccagcaugggugacagagcgagacuccaucucaaaaaaauaauaauaauaauaauagagcaaacuuggggaagugcauauacauuuuauggguagacaucagauuuaaaaugacuuauuuuaagcuaaagaguuuggacuuuaugguagagguuauauagagcaauuuaagaauuugaagcagggaacugcuaugaccauauuugcaaaguuacaauccaauuugagaaauaguacaaauaggccaggcgugguggcucaugccuguaauccuagcacuuugggaggccaaggcaaguggaucaccugaggucaggaauucaagaccagccuggccaacaugguaaaacccugugucuacuaaaaauacaaaaauuagccaggugugguggggggcgccuguaaucccagcuacuuaggaggccgaggcaagagaaucacuugaacccggaggcagagguugcagugagccgagauugcgcugugggugacagagcaagacucugucucaaaaaaaaaaaagaaauagugcaaauaagaacucaaauaauaauuguauuaacauaguagcauuauaauuuauaaauguauauauuuauaugcacuuauaaauguauuuuuuauuaauauaaauguauacaaauuuguagugaauuauaaauuauuuucuucuaaucuuuuuugguaugcaauuauuacuccauauuaacaaauuuagaacaaacccuauauacaaagacuaauguguugagauuaccaaugcagaucucauaaaccacauuuguaaaagcagccucauaguacauaauccaguuaacacuugacacuuuaauuauaaguaacuaaaguuagaaaauauaaucacauccauaaaagagguauaauacuaguacuaucuuagaggauuuuuauaguaauuauuuuuaacguauaauaggcauuaaauaaauguuagcuauuaucuagauacacucccuaugaucaacuacauaauuauuuggucuuaggauuuuagguccuaccaacuuaccucucguaaacuaauuuuagcaguauaaauuauauuugauccaucccuuuuaaauuuuggaugaucuuugucuuuaaugauaaaaacaaugucugcuggaauacuauuugguguuucaucuccuucucuuggaaaaguaauuuuggugccuucuuuccacccuuuuuuaaucucaaugguaagaauuuuguccucagaucuguaacuccuuccaucagcguuuagccuuuuucgagaaaucuucauccguuugguacaaccacuauauaucucuucaagugauacucuaaguucaugaauaacuggaggaucuuguuugaggcgggauggccccacagaauuccugucucuuggauauccauucaugcugaaaccaaaggcacuaaaaggaucaccaucuauuuccauuucuucagaaucucuaccaccacccauucgucuuccaaagaaaauuucaaagggguuggacccuccgaaaaaugcagcaaauguagcaugaggaucgccaugaaagguguaccggaagguaccuccuuguccaucaguaccuccugcuccuccuuucaacccuaauugaagagauaagcaugauuagaaaaaagcuugcaacucuuaaaaguuaaacuuucaaaaacuguauugcuaauaaauuuuggcuaacuuacauuaaaauguauuaauauuggccagaaaugccacuuuacuaaauacagaacagcuauaaaacucuugaugauuacauccuaaguuaaauuguuaaguuuucaaauucuuccuccaaaucagcauuuuuguuuguuuguguuuuugagacagaguuucgcucuuguuugcccaggcuggagugcaauggcgcaaucuuggcucaccgcaaccuccgccucccagguucaaacaauucuccugccucagccucccgaguagcugggauuacaggcaugugccaccacgcccggcuaauuuuguauuuuuaguagagacgagguuucuucauguuggucaggcuggucucgaacucccaaccucaggugaucugccugccuuggccucccaaagugcugaaauuacaagugugagccacugcuuccggccaaaucagcaucucuaauauuuauuccugauucuuuguuccacggguaaguaagaaaaauaaaauaaggccgggcgcagaggcucaugccuguaaucccaacacuuugggaggccgaggcaagcagaucaugaggucaggaguuugagaccagccuggccaacacagugaaaccccgccuccacuaaaaauacaaaaaauuagccaggugugguggcaggugccuguaauacuagcuacucaggaggcugaggcaggagaaucacuugaaccugggaggcagaaguugcagcgagcugagaucgcaccacugcacaccagcccgggcaacagugugagacucugucucaaaaaaaaaaaaaaaaaaaaagaaaagaaaagaaaaagaaaauaaaacugggaacuccuuauaaacuacugaucuggcaugcugaaguauauaaauuauauaaguaucuacuuauaaauauauaaguuuuuaaaagaugucaguuggaaggucuucagcaaucaacacaaagugcagaacuuaaaucuuuaauuuuuauuacaaucaaacaauauauauaacauuuaaaaauauaaauauauuaauaaaauauauagcaaaauauaaaauaccauauucauacuguuuauauauaaauaaaauagaaauauguaaaaauauaauguaauaaaaauaccauauucauucuaacuaguuuuauuucagaucaucuuuuacuguuuaggaauuaaaauagggccaggugcaguggcucacaccuguaaucccagcacuuugggaggccgagucggguggaucacuugagaucaggaguucgagaccagccuggucuacauggugaaaccccgucucuacuauaaauacaaaauuagcugggcaugguggcacaugccuauaaucccagcuacuugggaggcugaggcaggagaaucgcuugaaccugggaggcagagguuacagugagccaagacugcaccauugcacuccggccugggcaacaggagcaaaacuccaucucaaaaaaaaaaaaaaaagaauuaaaauagaacucugugucagagagugaaaaaaauucuaauaaugaggacauucuaugaaaaaugguuuuuuagacacuacgauugucauuccuacucuagauaccaaauuuuuuaggcauaucacaucuuagcauuaauuucaaugcuuguaagaagacugaaaucaagagcuguaaacuuugacacguaaggccucuauauggguuauuucugucucuugugaacaguccaccucaggcaacaauauagugacuuuuugacccuuugcuuaaggguuccacuaaguaauauuuaacccacaaaagauuauauuugaaacaacauuuuccacuaugaaagaaauguucuacuaaaacucaaaaaacaacaguauggugaucuuuuaaggggucaauacagaucaagaaacaagcaggaaaagaaucuaaaaaucauaaaacuaugaaaaauccaacagauuaagcuaggagauucuaauaucuccaaacagugagugauuugaaggcaggaaauauauuuauuuugcacugcucaugcauacagggcugaaaaugguagguauucaugcuuagugaaugaagggaaugaacuaauuccuaaaguccuucuaaaucaaaacuaaaaaaggugucuugaguaucgguacagagaaaaaggcagaagcaaaaacaauguaaaauauaaucacacauauacauauaugagagauuuaacaauuuaaaaugccacuaacacacagcauacuuuaaagaaacuuaguuuugcuuacgucuuauucugcauuuggcuucuuccauuaaaagguauauaucuacucuauuucaucuaacagggucucaagugauaucuaaaauuuuuaccuucauccaugaauagaaaucuggagagaucaagagagaccuaauaaucugaaaauugccaaaauauguauugaacaauauauccaaauagcaguuagggaaauuccuuguagaaugacaaguauaagcaggacaagaucuuuucauaagcagcucauccaaauuucccuuuuauaaauuuuaguaguauaauuauaacuccaaauguuaaaaagguaauggcagauuuuuuuuuuaaugauagaauaauauguagcucaaggucaugaccaaagugacucaaccaaugcuuaaauuauuuaaauaauuuuauccuucaucccauagacuuaagggaguauaauuauuuaacugaguuaaguaaacuggguaaaucagccugcccaaucuagccucuuauaagacaaaauuuaaauacuugcacccauaaugaauucaugaaaagaaagaauaauguuuuaauuuauuacaucauggguuuggcuuucuggaaaaccucuuccuccucugccaaaaagggcaauucggucauaauuacaaagucucugagaagauucauacaaagucugaaguaacuuaccaaagcugauaaaaagacuccaaugcagcuuugagguuuuccuagacacuauuaaacagucaacuaugcagcucagacaaagaacgaagcuacucuaaugaaugaaaaaaauccuaggcugggcacaguggcucacaccuauaaucccagaacuuugggaggccaagguggguggagcaugaggucuggaguucgagaucagccugaccaacauggugaaaccucgucucuacuaaaaauacaaaaauuagccaggcgugguggcgcacgccuguaaucccagcuacucaggagacugauucugucucaaaaacaacaaaaaaaagaaaaaaauccuaccaaaauucaugccacuuuaauauacauuauuaugcaaguaucacuugcauugucuagcacauaaaauuauaaguaaugucacauuaacuauauggucaguucuuaaucauguacauuuugaacgcuaauggaaauguuuaauauccaauuggauucccucugcuauucaaaauguuuucuagacaucgucaucacuuugugugaucaaaaaacgcaccagagaagcaacauuugccuaugauuuagcaagacugcuauuauuuuacaacuaaccagucaaccaguuugcagucccaaaccaaauauguguuuggaauacuaucuauaacaaugauucccacuaauuaguuaagguugacuaaaaguuuccaaaagaagaaacacuggagaaaaauucagauugcaaagaaaaaaacaugauaauacuuuaauaacucuuacuccauccaaggagaucuaauauguaaaaauccagauuuacagcaagacuucaguuaucaaauaaugagauucugagauuuuuuaaacaguuuuaauucacaaaaaucaaauuuacuuacauguuuuuagaacacacagugaauuaaaaaaaauccagcuagcuaaauauauaaguuaaagaacagaagagaacuaguauaaagauuaauaaauacaaguuuuaucauuuaaacacuaccuuuuaauauuugaaguuacugaauaaaucauaugcaauaacaaaauaaggaaagcauaaaaaaagaaaaauuagaaaacuagaauaaaugaggauguguuauugaaaaucuuuucuuuuaaaucucuuaacacaaauuuuuguugacauccacuaaacuauucaagacuaaaccuaaaacuuuagagagugguucagaauccaauuuuaaauuucuguaguucugugguuuuuguuuucaaaugauucaacuauagagaaauuuuauuuuuaaaaagauuuauuacauauauaaaauuaaccuauuguacaaauacaauucaauugauuauaguaaauugauagagcuguauaaccaucaucacaauccaguuauagaacauuuccaucauuccaaagaauucucuaguucuuauuuguagcuaauccccgcucccaccucaaguccuaggcaagaaagaucugcuuucuuuuucuauauacuggccuuuuccagacauuucacauaaauaaaaucauacaauauauagucuuuuacaucuggcuucuuuaauuuagcauaguuucugagguucaucaaugguguagcauguuucacaaauugguccuuuuauugcuaaauaguuccucauugaauguauauagcacauuuuguuuaauucaccaauuuauggugcuuucagauuguuuccaguuuggggcuauuauaaauaaugcugcuauaagcauucagguacaugucuuuguguggacauguuuuuguuucccuuuuauagauuccuaaaaguaaauuugaguuauccguauuuuuuuucuuuccuuugcuuuuucuagagguagggucuugcuauguugcaaaggcuggacucaaacucuugggcucaagcaauccuucagccucagccucccuauuagcugagacuacaggcauaugccaccucacccagcuagccaacuguuuuuaaaacaaagcauuuuaaauugugaauauucagaacacaaauauacuguguucuggauuacugguucuuucacuccuaaauacauaaauuuagcauaugcaacuuacauacuuuucaguuuaugguuccuuauucccaccaucccagcucuaagucccaagacuguaauaacuuggggggagcgggaagaaggauaccagguaaauuaauaguguuuccauaguccuaaaguucaguguuuuguuacuacuggagacaccuauggaaccacgucuggagauaaauaaaaggcaaagagaaaaaauguuuuccccuacuuucacaguguaucuaaaugggauuuuuuaauagaauaaaugagauauucugaauaaacggcaaacaaauauaauacuuuccugugaaggaagaauaauucuaaaaaauaauucaaauaacuuucauucaauuguauuuucuuuuuuuccuuuucuuuuuuugagaugaggucucgcucugucgcccaggcugaagugcaguggcucgaucucggcucacugcaaccucugccucuuggguucaagugauucuccuaccucacccuuccaaguagcugggauuagaggugucugccaccacaccuagcuaauuuuuguauuuuuaguagagacaggguuucaccauguuggccaggcuggucucgaacuccugaccucaggugaucgccugucucggccucccaaaguguuggaauuacaggcaugagccacggcgccuggcccauucaauuguauuuucaaguaaccuauaacuagagaaugguauuucugcauaauauauuucuauguuuuaaaaaaggcauucucuccucacucuuuccuucuaucacuuauaucaauuauguaaguuaaaaaaaaaaacccaggguauacagauucagggugauuuaguuuuuaaaaaauucacucauuguguaaugaccaauaaaaauuaaaugagaaaaaucacucuagaaaagcacuauuaagagauaauguuaaaucaagaaaaauguaucauuuggugacuugaaaauucugaagacaaauauccuuacuaaacccuggauccaauggcuuagccacaaacuugagcuaucagugaauuguugcaaaauauuuuaaauacaaagcaguggauaucugcuuuuucacaggaauucacagugucauuccauguuugugaauuucuuuacaaaauuacaaaauuacuccuuuagaaauaguaguacauuauugguaguaucucagaauccugcuuagcuuuugagauaaaccaagucaugauauuuuggguaauauggccauagguaucaugcaagauugaacugcccaguauuugccuuuuucaauauuuacuuuguaagaaccugacacuguagguccucaccacaccaaaaccugcaacauaaacuucaauuuugggcaacucauagaccaaaaaagcuaaacaaaacaaaaaggaaaaaacccucuauauacaaucacccugcuugucuacauuuaauuuguuucauucaaaauaagcagucacugcuugacuauauuuuaaggauauauuucuaauuaggaaaauuugauguuaaauguaauaaaggaaucaaagggauaacaaguuuucauagcuacagugauuugaaagccaguauuuugggagaaaaacuaauaauaaaauaacuuaguccugauguuaaaaguugaaaauccccaaaacaguacaaguuaaaguuuuuuguguuaucaauuagcaauuuaaaauagucuuacuucauagccccguuuauauggaagugauggacaaaccugauuuaaaaugcagaaugagaaaaggauaaucugaaauuauccuccuuuacugugcucacuaguuuuugaucucacaaugcaaaaaacaaaaguauggcagggagaggaaagggaaguugucauguuuuucucuauaccuagauaguaaaauuucuaaauaaauaauguuaucuaaaaguaaaucaguaauuauucuaacuagguggccauuuuaggucaaaaauuguauuucugagauuucauuuucuuggcacaaaauuauuguuuacaauuaagcuaaaaacuuguucugguauuuuaugacaucaggaaaauucuuuccucuccaggcagaaugccaaaaacaacuagaagcuaaaugccugcgccuucugcuucugagagucacaacucugucuuguucagucuaaacuagccuugcuauaagaaaggcaaaaaacuacuuuuuguuuuugugaauaagcuauaaacuacucagaaucugaaaugccaaucuuaagguuuuaaaugacuaaagacucuuuauugguucuggcagaaaauucauuagaaaacgaaacagguuucauaagacuuuugacacaauuuacuaauagguaugggaauucaagguuuauuuuaaaauauacauuguuaacauuguaagucuaaugauaaaauauguauaauacaaaaugcuaaaauaaaaaaggcaaacaaggacauuucauucauggcucugcaauacucauucauaugaucagagaugaaaccuuguuauuauacauuuguccuucuacuuuugauaugacugagaauccaauuuaaggauaaccuuaacaagcugagagagaggggaaaaaggcuggcagagagagagaaaaaaaaaaaagagacagagcugaagagacagaaagauauacagagaauacuuaccuuccuccccaaacugaucauauauuucucucuuuuuaggaucacucaauacuucauaagcuucugcgaccucuuuaaauuuuuccucugccugaggagauuuguucuuguccggaugaaauuugagggcuuguuuucgguaagccuuuuuaauaucuucaucugaagcuccuuucucaauucccaaaaugcaauaauagucuuuccccauuucgaaugccuugaaauuaacuuagauuucccuuuguaaaagaaaacagcguccccagucuuagcaacagauucuaagaaaaauaaaccaagcuggguauuuuaaaaguuaaucagcaauucagcuagcugucuuaaggcagcaagcagacagcgucucuguauucaauccuuccccaacggcucacuuacagauaaauauacacuacacaggagacagccuccuucuagauccucccauuuucacuacgugucucuguacuuucuagaacagcaaaugcuacaggacgucacuuucccagcugccucuagucaaaguacugagcuauguuuucuccuccuccacgauuaacuauucauuuuccgacuagcucuaccgucuuuauuuccuaauuaaacaggacaaauggguuaacaugccaauauuucaacacagaaugucacaacuauauauuuauguacuccauacuaggugaaaaucaucacagucauuaaacacccuauguuaaaagaaguuaaaguuaauauacagauaaaaggaacgacaauucuacuuuagggauuuuuuaauuuuaagcuauuugucuguuaaguauauaauaccaaaacgcagguuguuuaaauuaggauuuccaaguaauuuaugucgucuucaaaauuccuggggucuaucaaucagaaacgccagaaaguuuguguacuaguuucacauuguuaagggaguaucuauaauaaaauucaaaugcguuauuuuaaaauaaguaaaggacuuaaacaugauuuuagcuaacuaguuauuucuaguauacaugaguucauaguucuggcaaacaaauacuuauuuuugaaauuuuaguaucugaacuuaguuacuucaacuaaacuaaaacugaaugaggucccugccaccccucaacccccguccccugcagccgccccacaggaucccuauuuaaagaacuguggugcugcaggaaagcuagaacaaaguaucagguuacagacaguacauacucauguuccuuacaagacuuaacugcaacugcaucaauguaaaauuuggauaugccacuuaaggggcaguaauaugagaaauauuuuuucuuucaaaaacacauuucccuaauuauaaauauauauucauuguuggagauuuuggaaaacgcagaaaaaaguuuuuaaaaaucucccuauaauaucauuuuagguaaucccuguuaaauauuacuguauuuacuucuaauucuguuuucuauaaaucuucaugguuauuugcuguaguuuuauaauuuuuuguuaacaaaguuagaucauagcauuuauauacccuuuugaugccugcuuuugaaaguauaacauauuucagguauuuaugagacauuuucuauguauauaacucaucuuuuaucuccuguaugguuuucucaucuuuucaaaaauguucccauuucuauuagagagauaaauaagaaaagucagaagaauugcacacaguccaaauaaaauguuagaaaaccuuuaugaggaaaagaaaauguacauauauguuuagaauauaauaaaggguaauaaucauguguuaaccuuuaaagaaaugagaacgccuacucuauaugccaagcaaugaugauucagcaauucuuucugaauguucaucuuugugcauuuugacagcuacgauuuucuacucuucaaaauucucuacuuuaacaacaccaugacauuagaaauguauaacauugaucuagccuaccuguagguuacagagguuugucagcuauuuaucaauuuuuuuagccucaccaagaaauaauaucaaaagguacuuucaaauccaaaaaacuuagugaaaaaugcuaauauccagucaccuuaagacucccaguuuuaaaaagcauauugccaaacugaaauccagugcaaggaucaguaucacauagaguaaaaacagaauaaaaaucaccuauuacaaaauucauuuccaagggaguuccuuuaaauauuccuuaccaaaggaacggugacuuuacuauuuaacaaccggaaauuguucuggcggguaguguuugcagaaaaaaaaaauagacacuuauuugauucaaucauuuucagagagcuaggaauauuaucaaaacuugacacaguaaauuauuuuagagaaccugaagaccgggucuuucauauuugugagaaauuguauuauauauuaacagacggaaagaaaucuggcucccuagacacugaaaagggugaaaagggauuuucacauuucuuuaaauaucacacacacauaagaaucguaauuguaaaguugaaaagcaagaauucaccucaacuuugacauuucaaguuaauaagaaagcaaauauaaucgugauuuacgcgauuguuguauuacgugauuguuguauuaauacaacaaucuggcuagcuuuugguaaaaugaacagauacuugcacacuuauagcuuuguaaagcuuuguaaauaauucaaacauuuggcaauaguaaaagccacuaaauauuauuuuaauagcucuauaaauaccacaccuggaauuuauccuuagaaaauaauuuaaagacaauaauuauauguacaaauauacccauugcaaauagaugaaauaggguaaagcaucaagaugaucaucuuuaaaaguacauagcauuuuggagauauuuuacccuuacauucaccuuuucagacugagaugucuucucuacuaccuaggaguugaaaauccauuauacaauacgaucacuuuacauuaaaucuuggucauccaaguuuguaugauaugaaugcggcaauuugggggagggguugggauugucauuccugcaaauaauuaugacaaaaacaggaagaguauguaaaagggagaguagugguagccuguaggggaaauggaacagagaagagcugagaucaaagcuuauuuaauaaaaguaaaauaaauaaaagcuuuuuuaaagguuaaaauaaaaccaaaaaaauacauagaaauagucuauauggaauauuuagauaucacauaaaugcugcuuauaugauguuauagcuuacauguaugugugacggaaaguuugaagagaacaaaaacuagcuugaguuaguaacugacauacauuuuuucccuuaaaacuaaagaaugcugcauuuuuaacaaagauauaaaaauuagcacuugcauuuuuaaauuuuuacuuugcuacucaaacauugguaagauuauuccaugaaaacacaauuaucuucccuuuauuauaagaaaaguacagucaggugagguggcucaugccuguaaucccagcacuuugggaggccaaggcaguaggaucacuugagcucaggaguucaagaccagccugggcaacauaaugagaccuuaucucuacuaaaaacuaauuuuuuuaaaaaauggaaauuaagauagcauuuuaaccacaaaaaacuaaaaguauaauuuguuauucaguugaugucaucuucaucuucuacuuugacuuuauucauauauaauaaaaaacaaguuuucuuuuuccaacucacaaaucauuucucaguuuauaauaaaauaguacagaagaagauaaaaugccaugagucucagaagaaauuacaucaaaauucagaucaucacuuaaaugcuggaggacaaaugacuucucauauuuuaccaucgcaccugugaauaacuuuuccuggcaauauuuaauucuuaaaugggucauauuuaguccuaaauuuuuuuuuuuuuucuuuuuugagauggggcuugcucugucacccaggcugcagugaaguggcacaaucauagcucacugcacccuugaacuccuaggcucaagugauccugcugccucagccucucgaguagcugggacuacaggccaaugcaacaucuggcuuauuuuaauuucuuauagagaccaggucucacuauguugcccaggcuagucuccaacuccugagcucaaacaauccuccuuccuugaccucccaagauccugggauuacaggcauaaaccagggugcuugguacuugaaauuucgauccuggaauuacaggcauaaaccagggugcuuggacccugaaauuucuuuuuuuuuugagacagggucucgcucugucgcccaggcugguccagaauagagugcaguggcacaaucucggcucacugcaaccuccgccucccggguuuuaagaaaucucugcuucagccucccgaauagcugggauuacaggugcgugccaccacgcccagcuaauuuuuuuguauuuuuaguagagacgagguuuugccaccuuggccaggcuggucuugaacucuugaccucgugauucacccgccuuggccucccaaagugcuggauuacaggcaugagccaccacgccuggccaugaaauuucuuagucauucauauuagaaaauuaugaccuccauuccccaauaauuccuguccaagaauaagcaaauaaacugaggcucuuuuaaacucuguuaacagugcuuuagauauuugaauauauaaccucagaguauguaaaagugauuauauuugccgaggugacacccagggaauauucauaauauagugguuaaaagcauagauuuuggagcuggagugccuggguuagaauccugguaauacuacuuacagcuguaagaccuuggacuuaaaucucucugaccucagcuuccucaucugucaaacagaguuaacucuguuaacuguuaagcugguaacauuaauaccaauuuaggauuguugugaggauuaaaugcaaucaaugugugauacuuaaaugugauuggcacguagugaggaauaccaaagugcuggcuacucuuaucaugaugaugaucucauaugaacuugaaaauuuuuuuuccaggaaaauuacuauaccauaugcauaacaaaauguucuuauuuauaagcauacaugcacacacacucacacauacacacacagcuguccaauugguauuucuaaauauuccaguuaauauuugcuacucauucauguugauuuuguuaaaauuuaaaaucauuaaaacuucccauagguagcauucauuguauuucaguuccaauauuuauauucuuaaaguauauauauuugauuuuggaaucagaagaucuguccagccuuaauaucuguugaugccucacauaucucagucguaccaaauuacuugaaaauuaucuaggggaaaccauuauuuaucaauuccucuuagagggcuaguacaaaagaauaaagacuuaaaaaucugaauacuugguuucuaaucucaguucucccacuuaacaggugaguaacuuagaugaaucauuuaaauuaucugaauaccuaacucacaaagauuauugugagagucagaugagauaguacaugugucagcacuacaauuuauaugacaucuacauauacauuauuuucaguauuuuaagcuauauaaacuauuuugcuaccacuuggauguuuauugacaaauagucuccuuugacucaggaaguuuuacuuggcauaaagcauuaaaguaacuaccagauucacccccaaaggagucuggcaucccccaagaucuugccucuugccaaguucccuuuucagaccuuuaucucugaauuuuacuaucuucucaguguuaaaaaaaaaaaaaaccuguucuaugccuuccccauaauaacauuuauauaauacuuuacaguuuauaaaauacuuccauaugcuuucucacauacaucugauacucaagugauaagauuucaaagagcuuuucuauagcuacagucuaauaaugagcuaagauauucuugacaauucuuaaacauacacuguuccaauauuuacauaaaacuagaggguacuaggcugugucuauccuaauguuucaccuguuuuuaagauaauaucuaaauaguuauauaaaaucaaauuauuggccauuuaauaacggacuauaucuuaccucuacauacuauaauuuccuaaaaaaccaguaagcacuaagagguaucauuaccauagauugcuauagagcaaaugcuugauguaaguuugcaacucagacccucaauucucauuccugugaaaagguuccagagcauaauacuuacaguaccuuuuaauuuugugauggcuacaaaugcaacuuugucuuuaggggaaaaauagggaaauuuuuauuuauuguguauguguugccaagauacagacccauaaaaucuauuuauuuauuuauuuauuuagagacaggaucucacucuguugcccaggcugauuguguuccugaucucacaaucucagcucacugcagccucgaccuccugagcucaagccauuuucccaccucagcccccagaguagcuaggaccacaggcaugccaccaugccuggcuaauuuuucuauuuuuaguacagaugagguuucgccauguugcccaggcuggucuagaacuccugggcuuaagcgauccacccauuuuggucucccaaagugcugagauuacaggucugagccaccgcacucagcugagaaauuuuaaagagauucacuucuuaccuuaucuacguuacaagcugaaauacauaaacuuaaggcaagugucuuuaagacauuaagcccuauccauuuaagcuuaaauuguuuuagaaauccuacucucccacgccccuuaccuguaaauguccuuuuuuaggcaaugacaguaguuuggauucauuauauuuggaauuugucaacaguaucugacuguccauuuuauaguauuugauggguacacaaacuguuuaaaaaggugguuaucauagugcacauuuuccacaaauaaaguauuucaaucacucagcaaauauuuauggaguguuuauuuugugucacacacuauuuuaggugcuguuaacuagauagacauuauccuugcucucauucaacucauucuagagggggaagacaaacaauaaaaaguuaauaacgaaaugagaucguuuuaagagcuuuaaagauagucaaacagaggccggugcgguggcucacgccuguaaucccagcacuuugggaagcuaaggacugcagaucacuugaggccaggaguucaagaccagccaacacgguaaaaccccgugaaaauacaaaauuagcugggcaugguggcgugcaccuguggucucagcuacucaggaggcugaggugaaaggaucauuugggccugggagguggagguugcagugggccaagaucaugccacuauacuccaaacugggugacagagggagacugucucaaaaagaaaagaagaaaaaaaaaguuaauuauuauccucaacuugggcuggagugguggggauaggaaagacuucagaacagaaaauugugagcaaagucaugaaagacugauagauuuugacagagaaagggagaauuugcaauuuggaucaggaacacuaagucaagaagcaaaagagcauaaaauguauuugauacagcaaaaauacuggugagauuaaugcaugcaaauuaggaaggcuugcccugggaagcuggcagaaaauaaguuacggucagauuguucgaaguuuuuuuuauggagacaggguuuuacugucaccgaggcuggagugcaguggcauugucacagaucgcugcagccaugaucucuccugggcucagccucccaaguaacugguauuacaggcucacaccaccaccacaucuugcuaauauauauauagauauauagauauagauauagauauagauuuuuuuuuuuuuuuuuuuguagagacagguucucacuaugucucccaggcuggucucaaacuccugggcucaagcaauccucccgucucaaccucccaguguugggauuacaggcaugugcaacugcacccagcugaaaguuuuuaaugucacacuugaugacugcucuuuuaugcucuucaaaaagcacuaauucaauaguuuggucuuugaaaaaaaauuacuugaagagguugcuucauuucuuaaguguccauuuauucccaaaccagugaaauuacuuuucugguugucaguaagguaaaggguucuuaacaaaguuucauuaauaaucuguaagcuuccuggccaggcgcuguggcucacgccugugguucuggcuacucuagaggaucacuugagaccaggagcucaagguugcagugagccgugaucgcaguccacccgggugacagagggagauccugucucaaauaauaauaauuuguaagccuccaagagcaccaacauaagauggcaaacuaacuuaaaaugguugguaggaagaauaauuuuagucauaauucucuguggacuauugucuguaucaucaaaauuuccauuuuaucgcuacaguaauauuaguaauuccccaaguuuucaaauguugauacugugucauggcuugguuuuauaauacuuuccccgaagcacuauaauauauacauuuaauuuuuuugucuaguggucuuuaaaacaagauuuuaaauuguuuaaaaaauuaaaaaguaccuaccuuucaaaaaacaagaaaauaaaauugcuuuaaauguauagaaauuacuagauuuggagacacccaggggaucagacauauuuuauacuuaaaaaaauaaaucagccaggugcaguagcuuacaccuguaaucccagcacuuuagaagcacgaggugagaggaucacuugagcccaggaguuugagacuagccuggguaacaaagugagaauuccaucccuacaaaaaauuuacaaaucagccaggcaugguggcaugugccuguagucccagcuacucaggaggcucaggcagggggauggcuuggguccaggaggucaaggcugcaggugagccgugaucaugccacuguauucaaaccugagugacacaauaagacccuguauccaaaaaauauauauaucauuuccuuuuuuggggaguauagaacuaacuuauucuaacugggaugaauaaaauauucaagcaacaacuagcccuucuuuguuacccucuuuuacaauaaguccuugaaagcuugcuaaugacuagugaauguauggcgagcuaauauacuuuucuggcauuuugaaauaauuuaaagaguucuuuuuuuguuuuguuuuguuuuuugagacagaaucucacucuguugcccaggcuggagugcaauggcacagucugggcucacuguaaccuccgccucccggguucaagugauucuccuauuucagccucccaaguagcugggacuacaggcaugugccaccacacccagcuaauuuaaaauaaaguguucuuuacacugauuuuaaacacugaguuaggcccagggugauagcucacacuuguaaucccaguacuuuaggaagccaaggcaaaaggaucacuugagucuaggaguucaagaccagcugagcaacauagugagaccucguaucuacaaaaaauaaaacagauuagccagauguaguggcaugcaccuguaguccuagcuacuugggaggcugaggcaggaggaucacuugagcccagggagaugaggcugcaauaagccaugaucacgacaccacugcacuucaagccugggcaacagagcaagacugucucaaaaccaaaaacacuguauuagccaaaaaauuuuaaaaagagcuagaguuucuacaucauuuuaaaugggucuugauaaacuaauauuucauuauaacauuuugccuguguugaaagaucacacuauuuagaccagugcuguccaacagaaauauaaagcaagcuacaaaugcaagccacauuuccagaaaccauauuuuuuuaaaguaaaaacaaacgugaaauuaauuuuaauaauguauuuuauuuaaccuaguaaauccaaaauauuaucauugcagcauauaaucaaaauacaaauuaucaaugaaauacuuuacauucuuuauuuuuuguacuaaauauuugaaauacagcauguauuuuacacuuugaccucaauucagauagguacauuucaguagcuuaagagucucauguggcuaguggcuacuguguuggacagugcagaucuagugguuccuucuagucggcaguacuauaauccaauuuuucagaaaucucagccugugaaucucagcccaaguauaccacacauacauaccucucacaugcacauuuaggguaaauaaagucuuaacaggugaacucuauuuuacuuauaaaauaguacuacauuguucauccauauaaacaauaugauaauuuuuuucaaaauaauacuuuacacuuaagguaguaggaauguauuuacacaugcucaguugacauacacuuucacaauguuuaauuguaaaagcaacacuuggaaaugaggaaucuacgugauuuucacuuuuaucuuuucuaaaaugucucuucucauacucuuuucuuauauguggccugagaugucaucuuaauuggcucauuagaaaaaugagaguaguuaaaaaaaaaaaaaaagagagagaguaguuuaaggaguacacagaaaaaaaaugucuguagcccaagaggaggagaggauaugcagcuguuucauugaauuauuaggcucuuagccaagacugcaacaaacugauuauuuagcaaguuuguuuagcuaauuguuuacaauucucaaauaauuuuuuucuuuuuuuuuuuuuuuugagacagucuugcucugucacccaggcuagagugcagugguuucauuauggcucacugcagucucagccuccggggcucaaguaguccucccaacucagccucccaaauagcugggacuacaggcaugugccaccaugucuagcuauuuuuucuuuuguagagauagggucucccuauuuugcuuaggcuagucuugaacuccugggcucaagcuaucuucccaccuccgccucccaaagugcuaggauuacaggugugagccauugugccuggccucucaaaugauuuaauuuaaaucaguaccaaacuuuaacuaugaauuaacuuuaucguauacugcauccauuaaaacauaaucacgaaaccacugcuaccauggagacuuaacuaugauucgaagacuuuaauaauggcuaccaaauauaaguauuagaacauuuauauaaauaagcccguauguccuauaguauuuaccaacuacuauaaaauucagccauugacuaccuaauuccaaaugcauaagcuugaacuauuauaauugucuaaagaaggauauuuagagaaaaauauaucucuaaaauaaauuaacuguaaauggauggguuuuaauguucaaguuauuaauauuucaaaaauauaaacuuuuuguuaucuaggucaaaucagcauaucaagccaaccauuacugagaccccacugugcuauacuguuacauguaacaugaaggauaaaacaguauaauacauagucccuacccuuaaggaguuuauacuauaaauaagucaggcacgguggcucaugccuauaucccagcaccuuagaaggccaaggagggcggaucaauugaggucaggaguucgagaccagccuggccaacguggugaaacccuaucucuacuaaaaauacaaaaaaauuagccagaugugguggcacacacuuguagucccagcuacuugggaggcugaggcaggagaauuguuuaaacccgggagguggagguucagugagccaagauuguuccacugcacuccagccugggugacagagcgagacucgaucucaaaaaagaaaaaaaauaaaagaaaaaggaguuuauacuauaacuauauaaaguaauaccuaaugucuauuguugcuuuugccagacagcgguagaguugaguagcugcagcagagacuguauggcccacaaggccuaaaauaguuaccgucuggcccuuaccaggaaauguuugccaacuucugcuuuauacaaauuauucuucgcuggagggagagcaaagucuaaauaaagcacuaaacaugauaaaauuuuauugcaucuggcaaacuuuaaaaacuauaguuuuuacaauaaacacucagaaauaggccgggcgcgguggcucaagccuauaauccuagcacuuugggaggcugaggcggacagaucaccucaggucaggaguucgagaccagccuggccaacaugguuaaacccugucucuacuaaaaauacaaaaauuagccaggugugguagcacaugccuguaauuccagcuacucgggaggcugaagcaggauaaucgcuugaacccgggaggcagagguuguagugacugagaucgcaccauugcauuccagccugggcaacagagacucugucucaaaaaaaaagaauaaaggucaaccuguuuuugcuugucugaugguaaaauaaaacuuauacgcugauucucaaccuggacaugacugcuaaagggaauauauuagaauauuuaaagugugaggugagaugcuuaucaaaaaggguggcauguguuuuaaaaggcagagaaagacuguuuaauaaucauaccucuguauuguuccccuugaccauucccaucuaauucaucgguccuggucauaaaugauaauggcuauuucccaaaaugaaauuuacccugaaguaguugauucucauuuguuauguucuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggugcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccucauuuguuauguucuauaaaacccauaguuauguucuauaaaacauuugccaugguuauguucuauaaaaucaucccaaaugcuaaauuagagaauagugaaucacugccccuaagggaaauacaguguuagguuccugccaggcucuggucacauuuucaucaacuggucaauacauaaccucuucuauguguauuucuguuaaagauaccuuaauaauauauauuguugauucacugacauugaacucauagccaacagaacuaugacucaugccugaaugaagcuuaccuaacaccugaauuuucucuguaaggcacaucacagccuucuugugcuuagcaacacuagacagcacuuuagcacuaugcuuagaggccauuuuaaauaguaaagucaccaauaaaaaaaaagcacaaaaauacaaaaauguggcacuaaauggaccaugaaaaggagacuuguuuaaaaguaugagagcugaaacaugagggcagaccacugacuuguucaaccucagcuaguucauuuuuuguguguguagagauggugggagggguugcacuauguugcccaggcuggucuugaacuccuggccucaagcaauccuucugccucagccucccaagguggugggauuacagaugugagccucugugcaaagcucagcuaguucuuaaauauuuugccacucugaacaugcguaugucuaaaaaugaccuugaaagcauuucaaguauugcuuuugggguuacaaauacauuucggugaguaggcaaauucauaaauacagaacugacaaauaaugagaaucaacuguauaauaauaucauuacugagaaucuucugcauuaaccauaaucaguuaaaaaauuguuuuugaacaacgguaacauuaaugaguacacaggcaccaaaguuaauaccuuugaagggauauuuguuauauauaaagcaaauagggcauguguguagguguauuucccucuucccuacuccaggagcccuucaccuagcuuacuucugcuuugagacucacccuguagaugggcuucugugaagcccaaacuuggguuagauuccccggaccuugagcuccuacacuuccccccauaucuccacuguauuacacaucaccuuacauaaccaucuguguguuuaugccucauccacuggauuguaaccagcgggguccuguuuuauuucuagaacaaggcguuuacaauauauugcuguucaauaaacuuuuacugaaugaaugaaucacaaagagaugagaaauaacaagaaccuaaaguaggaugacuaugauauaaccagaccaacagguaggauuaaguaguaagaaauagcaucuguauaauuugcccaucagcuggauguagagaagaggaaggauuucagacugcccauuucuggauugacaaaggugugcacaguugugcuacuaaugaaaguauagaauauaagaagaguacuuuuuaaguguaaagacaaguucuacugugaacauuccuguaaccuuauuaauaaccccuucaucuaugcuacuucaauaguugguaaguuuugcugcauaagacugcauuccuaguuaucuauuucucuggcuaacuaccucauuaaaauguaagauaauauaagguaaauuuuauuuaauuuuugacucaccaaaaaccaacacaacaauauucauuugaauugaacguggaugaagacauccaggagauauucugaacuggagcuuagaaauauuaguuggagacaaauauuuagaaaggauccuaaugcaagugauauuuuauagugugaaggaggaacaauuuuuggaaagaaucaaagacagaacuuugggaugaccagcauuuaaggggcacaucaaucaacaggagacaauaaaaaagacagaaggaaccaucagagaucaaccaggugagaaugcuacggcagacacugcugguuacauaccaaagaaccauucauaucuucuuucuagcuaacagauaucuucucccagaaauagaguaaugaacucaaggaaggugagagcaucccccagucucuuggggauggcucaggguugauuuaaaucaaucacaguaguauuuccuuugccagugauuguuuaagggcagacaugugacaugguucuagccaaugagauguaagagagauguucuggggauuuuccucccuauaaggagauauccaccaaggagaaaccccagcacugcauccuguuuuugaauaaugaaauucuuacaauccuaaagguagacgucuaugacacagugaaaacggcagaauacaaagacaguaagagccuaacuugacaguguugcaucucuaaaucaaucuuggaacuaccuaucauuggacuuaagagauucucuuacuuggagcugaaggcauccugacaccacuaguguccaaaaaccaaaagacagaagcuauuucaugagggauacagaaaaguaaauaaagaugauagaaaaguaucuguaagagugagaaugauuuuggcuucaguaguaauaguuaauccuggugagcccucaaaaaaauauuaaccuaaaaacacauguauccucauuuagucucucagaauucuaugagguagauagaauugugaccaauaaaagcuagaaugugguaaauugaacauuaagagggaaaugaaaaugaaaugguaaauuuaaauauuucuaacaaguugucugaaggagauagacuuguaauaaggaaaggauaaaagagguuuuaagauaguccagagaagaagaaaacaauauagaggaggauauuuaaaaacauguaagacauauaauaaaagaaauaauugcuuaaaugacaucucaaagaagauaaaauuugauacgauuugauaccaagaguaccaguagaugagacgugaauaaaauuagaggugggcucugagagcaaaaggaaguagacgacgacaauuuauaaauuugaaaguaaaaggacuaggaagaccaagaaguucauacacaguaucaauacucuguuuaaaaagagaggaguggggggacauccacugcuaaggauucagaguaaaguaggguguuugauaagaauggugguaguucaguaugucaauuauggaaaauagggaagcagcugaucagaaacaaacaauuacuaaaucccacuaaggacccagcugaaaccagaaugaaugaacauucauuuacucacaaauuuuuauuaaggaccuuucauaugccaaggcaccuuucuaggugcuagggauacaguaugaacaaaaaucccugccucauucucuguacauucuaguagggggagauacaauaaaaauuuuuaaauacuguaaguuguguuagacggugauaaaagcuaagaaaaauaaagcagaaaauguaaauaaggagauucaaaauuuagauaggguagccagaaaugauuucagagaaaaugauauuagcacuacaaucugaaaggaaaggaggaaagcuaugcauccauaugguagaacuuauuggauagagggaaauaucaaacaccaaagccuagaagugagggaaugcaaggcaucuuugaggaaccgcaagguggcugagucagaaugauagagauggugaagggguugaaagauggucagagaaauaacagaugcaauacagaggcuuguaggccacuaaagacuuugacuuacauucugagggaagauacaaugccauuggagaguuuuacgcgaaugauaggucacuuugauucuuaacagcgugggaaagacggugggcaaggguggaagaccaauaagaacugaugggcacaguggcucagaccuguaaucccagcacuuuggaaugcugaggcaggaggauagcuugaggccacgaguuucagacuagccuggacaauauaacaauacucugccucuacaaaagauaaaaaaugucagccagauaugguggcacaugccuguaacccuagcuacucagaaggccgaggcaagauugcuugagcacaggaguuugagguuacagugagcucugauuauacacugcacucaagccugagugaccaagugagacacugucuggggggggggggaaauacacacacacacauauauauauaauguaugcauauauauuauguauauauauaauguaugcauauauauuauguauauauauaaaaucuuuauguauauauauguacauauauaaaauauauauacauauauacauauggcuuagggugccaaagacuaaacaaacucaaaaaagguuaaagaauuuggcaaggucacugaaguagcaauauacauauauauucaggugguuuggaccaugauguagcaguggaggugaugagaaguggugaacuucuggauauaucuuaaagguagagucaacaggauuuccuggugaaucaaacagggaaugugaggaaaaaccaauaaggacaccaagguuuuucaacuucagcaaacacagaacagacuugcuacuuacuaaaauagagaggggagaagggagaaacugaggaguucaauauuggacauauaaaauaaagaugcauggggccaggcacaguggcucaaacucagcacuuugggaggccaaggcagaaggacugcuugaggccaggaguuugagaccagccuaggcaacauagcgagacccccaucucuacaaaaaauuuaaaaauuagccaggugugcugaugcaugccuguaguccuagcuacucaggaggcugaggcagggggaucacuugagcccaagagcucaaggcugcagugagcuaagauugcaccacugcacuucaguuugggcgacagagauccugucucuuaaaagagaaaaauuugggaagaguguaggugauauuugaaaccaugagacuagaggaaauuacuagaaucauagauaggguaaaagggcacaaggauugaguccuagcacucacaaaugcaguaguaagaauaacuauuacuaggaaaguggggccucucccucaccccugagaugaauccuaauuauucuaagccaguaugacacuugauagaguaagccugugacucaacucuggucaggacaagguuaauaagauuggcaguuguggcagggguggaggguagggacacugguagcagaaacuuuccccuuccauuuaacaaucaugacugcaugacaccuggaacuguggcaaccauuaugcaaucauuaggggaguaaagucaagaagcugagggugguagaaggcaaagaugaaaaaaacauggguaccucauaaauuguugagcugcucaucaaccagccuuagagccacucuaccccuggauuuuuuauuauuuaagccauuuaauaaggguuuucauuacuuguggucaaaaguaucuggauacaauaaucucauuuaauuuucaaaacaaugcuuagggugacaaggaguaaacaaacucaaaaaagguuaaagaauuuggcaaggucacugaaguagcaaauggugauuugaaguucauccgacuccaaagucaauuugaacugauuaagaguuguugauuuaaagaauggacacaacuaaaagacaaaggggagugggaguugagaauuacugacgugaauggcaaagaaggaaagccagcaaguaagagauggaaagaaaagagaagugucaagagacuagaggaacggaagaaguacauuaggaaacaaacugacaagaggucaucuugaggagaauaucagacuugaagauuuuuauuguuugaguugucuggaugaagacuagaugcaggcuguggccauaaguagugaggaaauugcauuucgaguaguuaaggauuaauguaguaauauuuacuacauggcacacauuauuuuaugcacuuaggauucagugguaugugaucugagaugaaguucccgggcuguaaccuggccagaagcuugaagucuuuaccccaagauauaaacagagcacaagaaucaggcugacaauugggaugacaaugacucacauucacuagcuuguuucaaauaauuuaacauacacuaggaaauuaaauguuuaaugaaugaaugaucuaucugaucauucagcuucucccauucugacucuucaaaccauugcuuaauuagcuacaggauauuauugguuagacugauacaaauaauugucugaaaacaauagggagucucugcaaagugauccaugguuucaauccaccuucacucacuagcaugcucaagacaagacggugagauauaugucuauuuuguuuacuacuguaucucuagcacuuagaacaaugcccagaauuuuuguugaauugaauaaaugaauagauuaauuaggaccuacuagaugccaggcauuauugucaucucaaagguaaauaagauagcuccugcccuugaccguuuaccacuuaaaagcucuaacuaaaaccucucaaucuucauuuauaucaaagugcauaguuaaggagcaagguuguuaagaaucuaaagguaauaucuguccuggauaaaaggugucuaaagcuuaauaugcacauaaauuuuuuaaaacuaacauucuugcuugaaaaaauaguauuuauauuauugcuacaauuagauaaccuggcauaaacaaugauuaugauaaaccauagaaaaauaguaccuccagauauuucuuauaaaaaaauuaauuccuuuuucuuaaguacaugucccuucaaauuuuuuuuaaaugaagugagaauaucaguuaauaugaagcaacauaaaggaacaaauggaaucagaaggcaaauuccaaagagaucacuacuauaaauagagacauggaaaugucagaacagagaagcaagguuccacuaaaaaacaacaaaauuguuauaccaaaugaguuuucuaucuuguacccacccacuuccaguuaaggauuucacuggcaaagauccuugaucuuucaauaaccuauuuucagaaggaaauguugucaguaaauguugucaguaaagguagacauccugauuacaaaaauuaagauguuuuugguucuguacagauucuucuuccucuuguaccuaagaagcagaaaaccuccaacccaaacaccgaugcuucauauagaagacaguucacaaaauaaagagcacuggauuagaaaucuagucuuggcucugcaauuaaucuuggcacuuuguagaaggcacucagcaaucuguguuaugguuuccuccaauauaaaaugaaacaaaugggcgagauuaccuucaaggucuuuccaagacugauauucuaagaaaaguuugugugaaacuacccuucagugccaucuggccucaaaggcccuccacauucauaaucauauguagcuuuguaggaaaaugauaaguggaauaaagaauucaacuugauauuuauuaaacuuuuaccaacauaaaagcauacugggcaaaccaaagaauaagacgcgguccuugacaagcccucuuuuauacagaggaggggaaaagggagaagacaaaauuucuguauucauaacauuuacuacaaucuagccagggaaacaaaauuuaauucacuuuaauuccucaaauauuaaauauguuuuguguaaaaggguaguuuucaaaucuugaugaguagaaucaacuaugaugcuuucuggaaaaaaaaagaaagaaagaaagaaagaaauauagauuccccaaaacaugauucaguagguccacguacggcuaaaaagcacucuugaugaugcuggugaccuuuuguuaagaaacucugccuuagucuagcuaacaaaaaguuugaguuaguccaguuaaaagaaaaacuuucaauugauucaugaauaggacagaccccaauugaaaguaguucaaugacuuagggcugaagggauaaggaggauuuucacaggaugaaugcagaaacaaggcaaagaaaacauuugauuaaaguggagcaacagccugauuuggaccauuccagugaaaagucccuaguuaaagguuaauuggcaguuucugauugguuaagacaguuuacauugaauuagguuucaguuugcuuauguaggaacacagggcacuggagguaccccagucuaaucacuucccauuuaauuauuuuaacaguuuaaaaaaagcuguuucuagacccugaauucaucucaagacuauauacccauaacuagaaacaaacugcaagccauuaaaaauaagcaaaagucggccagagcuuguacacuuguguauuucagugguucucaagugugucugcacuuuaggauuaaccuguggggaaaagcaagagagaucagauuguuacugugucuguguagaaagaaguagacauaggagacuccauuuuguucuguacuaagaaaaauucuucugccuugagauucuguuaaucuauaaccuuacccccaacccugugcucucugaaacaugugcugugucaacucagaguuaaauggauuaagggcggugcaagaugagcuuuguuaaacagaugcuugaaggcagcacucuccuuaagagucaucaccacucccuaaucucaaguacccagggacacaaaaacuguggaaggccgcagggaccucugccuacgaaagccagguauuguccaagguuucuccccaugugauagucugaaauauggccucgugggaagggaaagaccugaccgcccccaagcccgacacccguaaagggucugugcugaggaggauuaguauaagaggaaggcaugccucuugcaguugagacaagaggaaggcaucugucuccugcccaucccugggcaauggaaugucucgguauaaaacccgauuguauguuccaucuacugagauagggaaaaaccgccuuagggcuggaggugggaccugcgggcagcaauacugcuuuguaaagcauugagauguuuauguguaugcauaucuaaaugcacagcacuuaauccuuuaccuugucuaugaugcaaagaccuuuguucacgugucugcugacccucuccccacaauugucuugugacccugacacaucccccucuucgagaaacacccacgaaugaucaauaaauacuaagggaacucagaggcuggcgggauccuccauaugcugaacgcugguucagcauacuuugucuuugugucuuuuucuuuccuaagucucucguuccaccuuacgagaaacacccacagguguggaggggcaacccaccccuacauuaacccaggaagcuuuuacggauucacauauaguccaauuaaaucaguuucugggaguaggaguuagggcuaaccuuucuuucuuucuuucguuuuugagacagaaucucgcugugucacccaggauggaguacaguggugcgaucucagcucacugcaaccuccccgucccggguucaggcaauucuccugccucagccucccgaguagcugggauuacaggcguccgcuaccaugcccagcuaauuuuuguauuuuuaguagagccgauguuucacuauguuggccaggcuggucuugaacuucugaccuuaggugauccacccgccucggcaugaggcaccucgcccagccuaccuuucauauuuuuuaaaagcucccuguagccaauguggguaaccacugaauaaauaaaaggucacugcaauugguuagucagguuaaguuucaugagaaaagacuauuuuuaaucuggauuuauuuagcuaaagguuaaugaaaaagauaaauguaauagaagaacugauuaucuaaauauaugauccaauaggaaaagaaacaauaaauguuuugaccacaaaaaaagggagaauaagaacaguaaauauaugaauuuuagacauuuuguuuuugaggcaacauguaaaaccaaaguuuuguagguagcuguuuggaaacaucuaggaaacaaguauaggaucaauuuacaggaaauuacaaguauauuagugcauauuuguauauagcagcuuuauuauaaauuauuguaauguaugcuauggaauaagcuaaacucacuuaagaaccggaugauaaggccaguuauuuaagacagaugcuuucaggagucccaaacuuucaaucuaacauuauuaccuaaaguaauggaaagcugggaguguugucuuacaagaagagguggagagcuccaaauuuuucucuaaaaauuaauaaucuauuuccuauauauccuaugaugcccuguuauaucucccaugaucauaaucaaaggacagauccuggcaaugaauguguggagugaccaaacaaauacuccauuaauauucaaagaggccuuuuguauaauacacuaaagauguuuguucuuuuauuagauuugaagaacacugaaaaguuuggaaugacaccuuagcaaccccccaaauauuccucccagcuucacugaagagauccuaaaaagcaguuuauuuauauuuucacaaagaaccuuugucucaagcauuaauuuuuccaaaagauuaagcuaucaagaauuuuauuguggcugggcgcgguggcucaugccuguaaucccagcacuuugggaggccaaagaggguggaucaugaggucaggaguucgagaccagccuggccaacauggugaaacacugucucuacuaaaaauacaaaaaucagcugggcguaguggugggugccugucaucccagcuacucgggaggcugaggcagaacugcuugaagccaguaggcagagguuacagugagccgagaucaugccacugcacuccagucugggugacagggugaguccgucucaaaaaaaaaaaaaauuaggcauaguggugcacaccugugaucccagcuacuccagaggcugaggugggagaaucucuugaaccugggaggcugagguuucagugagccaagaucgugccacugcacuccagccugggcaacagagcgaguauguaaaaaaaaaaaaaaaaaaaauugagguccuuacauauuuucaauauucagugauaacuaaaauaaauugagauauacauaaauuuguuuugaggguaaauuauagcacugugguaaauuacauugaucaaaagaucugauuguauugccuaauuaauaaaauaugaaaaaaucaagacauuuucaaaauacaacuggaaaauuucuaccuagccgcacacccaacacugcuuuuacuguuuuucuauacauuaugauuaaaucuguagucccauacgugcacugauuuuucaaaugcaaauuccaccaaaauuuauagggauggccaugaacacugaaaaagaucaucagagcuauaaauggauacuacugccuuaaaagcugauuaaagggaaaugauggcucaccuguaucuacauucauauuaacugcuauuuuggugcuuaagcaaaugaacacauuacuuuuagguuuucagaaagaaugcagcauauauauauuucucacaauuacucuuaagagcugcugaaaaaguauuuuuuuagaccuaaccaaguaagacaaaaugccacaaagucgagaaaguucauuuuaccucauuguuuguuauuuaaacaaauaauuuuggaaaaaaaaagucacugugauauacucaauaauaaagaguaagacuucuaaaguauccucacgauuccuggagcuuacuacuauuaacacaguaaauuacaugccacgauauguuggagaaggucugaagaaaugucuggcauuacuugguaacugaaguacauaacauaaaauaccaauuuacacacacacacacacacacacacacacacacacauauauauauauauauaccuaguccugugaugacaauucagaauaugaucuuacauuugaguacccacaggauggggugggagaaacuacgccuaagaagcuacaaaaucuauuuuggucaagaaacaaugcuguucuuaacuuaagagaccuuaacaggccgggcgcagugccucgcgccuauaauccuagcauucugggaggccgaggcggguggaucacgaggucacgagaucgagaccauccuggcuaacacggugaaaccccgucucuacuacaaacgcaaaaaauuagcccagacgugguggcaggcgccuguugucccagcuacucgggaggcugaggcaggagaaucgcuugaacccaggaggcggaggaugcagugagccgagaccgcgccacugcacuccagccuggguaacagagcgagacucucaaaacaaacaaacaaacaaaaaaaaacccuuaauaaaaauggccauggacacauacauauacuagguuauuaaaucuggcuaacacugaacuuuaagaacaaucacguuuuuggauaaagaaaagggcagucauacuuuuagagccucauccacauuauuuuaaacaaaaaacuuaaaauauggucgagaacuaacaggcuuccagccugaauucaacacccacccucgugauaaaacuaaaaaaucggacagucuguaaguaaaauacagggacacuuuacuacccugaaaaucaugcuggguucccgcuacgccgggcagacguuuucaggagcaucaccgcgcggcgucucggacgcacuucuccuggcgcccuccgggcggcagcgcucucgagacacuguugcuucgccgucacgcccgucguugucacgcccuuccccgcggacaccgagaaugacccauagcggaaaauucuaccgcacuaccucccugaggcagcgaccgguaagaaacaaccuuuucuucaggcuucccaccacccaaacacagucgcagucaacuggccacuaucacccaccacccugcaggaacaauuacccagccucaccccaagaacgcgcggagaggag

SEQ ID NO: 13874 - RNA, 53444 nt, Homo sapiens
cuccucuccgcgcguucuuggggugaggcuggguaauuguuccugcaggguggugggugauaguggccaguugacugcgacuguguuuggguggugggaagccugaagaaaagguuguuucuuaccggucgcugccucagggagguagugcgguagaauuuuccgcuaugggucauucucgguguccgcggggaagggcgugacaacgacgggcgugacggcgaagcaacagugucucgagagcgcugccgcccggagggcgccaggagaagugcguccgagacgccgcgcggugaugcuccugaaaacgucugcccggcguagcgggaacccagcaugauuuucaggguaguaaagugucccuguauuuuacuuacagacuguccgauuuuuuaguuuuaucacgaggguggguguugaauucaggcuggaagccuguuaguucucgaccauauuuuaaguuuuuuguuuaaaauaauguggaugaggcucuaaaaguaugacugcccuuuucuuuauccaaaaacgugauuguucuuaaaguucaguguuagccagauuuaauaaccuaguauauguauguguccauggccauuuuuauuaaggguuuuuuuuuguuuguuuguuuguuuugagagucucgcucuguuacccaggcuggagugcaguggcgcggucucggcucacugcauccuccgccuccuggguucaagcgauucuccugccucagccucccgaguagcugggacaacaggcgccugccaccacgucugggcuaauuuuuugcguuuguaguagagacgggguuucaccguguuagccaggauggucucgaucucgugaccucgugauccacccgccucggccucccagaaugcuaggauuauaggcgcgaggcacugcgcccggccuguuaaggucucuuaaguuaagaacagcauuguuucuugaccaaaauagauuuuguagcuucuuaggcguaguuucucccaccccauccuguggguacucaaauguaagaucauauucugaauugucaucacaggacuagguauauauauauauauauguguguguguguguguguguguguguguguguguaaauugguauuuuauguuauguacuucaguuaccaaguaaugccagacauuucuucagaccuucuccaacauaucguggcauguaauuuacuguguuaauaguaguaagcuccaggaaucgugaggauacuuuagaagucuuacucuuuauuauugaguauaucacagugacuuuuuuuuuccaaaauuauuuguuuaaauaacaaacaaugagguaaaaugaacuuucucgacuuuguggcauuuugucuuacuugguuaggucuaaaaaaauacuuuuucagcagcucuuaagaguaauugugagaaauauauauaugcugcauucuuucugaaaaccuaaaaguaauguguucauuugcuuaagcaccaaaauagcaguuaauaugaauguagauacaggugagccaucauuucccuuuaaucagcuuuuaaggcaguaguauccauuuauagcucugaugaucuuuuucaguguucauggccaucccuauaaauuuugguggaauuugcauuugaaaaaucagugcacguaugggacuacagauuuaaucauaauguauagaaaaacaguaaaagcaguguugggugugcggcuagguagaaauuuuccaguuguauuuugaaaaugucuugauuuuuucauauuuuauuaauuaggcaauacaaucagaucuuuugaucaauguaauuuaccacagugcuauaauuuacccucaaaacaaauuuauguauaucucaauuuauuuuaguuaucacugaauauugaaaauauguaaggaccucaauuuuuuuuuuuuuuuuuuuuacauacucgcucuguugcccaggcuggagugcaguggcacgaucuuggcucacugaaaccucagccucccagguucaagagauucucccaccucagccucuggaguagcugggaucacaggugugcaccacuaugccuaauuuuuuuuuuuuuugagacggacucacccugucacccagacuggagugcaguggcaugaucucggcucacuguaaccucugccuacuggcuucaagcaguucugccucagccucccgaguagcugggaugacaggcacccaccacuacgcccagcugauuuuuguauuuuuaguagagacaguguuucaccauguuggccaggcuggucucgaacuccugaccucaugauccacccucuuuggccucccaaagugcugggauuacaggcaugagccaccgcgcccagccacaauaaaauucuugauagcuuaaucuuuuggaaaaauuaaugcuugagacaaagguucuuugugaaaauauaaauaaacugcuuuuuaggaucucuucagugaagcugggaggaauauuugggggguugcuaaggugucauuccaaacuuuucaguguucuucaaaucuaauaaaagaacaaacaucuuuaguguauuauacaaaaggccucuuugaauauuaauggaguauuuguuuggucacuccacacauucauugccaggaucuguccuuugauuaugaucaugggagauauaacagggcaucauaggauauauaggaaauagauuauuaauuuuuagagaaaaauuuggagcucuccaccucuucuuguaagacaacacucccagcuuuccauuacuuuagguaauaauguuagauugaaaguuugggacuccugaaagcaucugucuuaaauaacuggccuuaucauccgguucuuaagugaguuuagcuuauuccauagcauacauuacaauaauuuauaauaaagcugcuauauacaaauaugcacuaauauacuuguaauuuccuguaaauugauccuauacuuguuuccuagauguuuccaaacagcuaccuacaaaacuuugguuuuacauguugccucaaaaacaaaaugucuaaaauucauauauuuacuguucuuauucucccuuuuuuuguggucaaaacauuuauuguuucuuuuccuauuggaucauauauuuagauaaucaguucuucuauuacauuuaucuuuuucauuaaccuuuagcuaaauaaauccagauuaaaaauagucuuuucucaugaaacuuaaccugacuaaccaauugcagugaccuuuuauuuauucagugguuacccacauuggcuacagggagcuuuuaaaaaauaugaaagguaggcugggcgaggugccucaugccgaggcggguggaucaccuaaggucagaaguucaagaccagccuggccaacauagugaaacaucggcucuacuaaaaauacaaaaauuagcugggcaugguagcggacgccuguaaucccagcuacucgggaggcugaggcaggagaauugccugaacccgggacggggagguugcagugagcugagaucgcaccacuguacuccauccugggugacacagcgagauucugucucaaaaacgaaagaaagaaagaaagguuagcccuaacuccuacucccagaaacugauuuaauuggacuauaugugaauccguaaaagcuuccuggguuaauguagggguggguugccccuccacaccuguggguguuucucguaagguggaacgagagacuuaggaaagaaaaagacacaaagacaaaguaugcugaaccagcguucagcauauggaggaucccgccagccucugaguucccuuaguauuuauugaucauucguggguguuucucgaagagggggaugugucagggucacaagacaauuguggggagagggucagcagacacgugaacaaaggucuuugcaucauagacaagguaaaggauuaagugcugugcauuuagauaugcauacacauaaacaucucaaugcuuuacaaagcaguauugcugcccgcaggucccaccuccagcccuaaggcgguuuuucccuaucucaguagauggaacauacaaucggguuuuauaccgagacauuccauugcccagggaugggcaggagacagaugccuuccucuugucucaacugcaagaggcaugccuuccucuuauacuaauccuccucagcacagacccuuuacgggugucgggcuugggggcggucaggucuuucccuucccacgaggccauauuucagacuaucacauggggagaaaccuuggacaauaccuggcuuucguaggcagaggucccugcggccuuccacaguuuuugugucccuggguacuugagauuagggaguggugaugacucuuaaggagagugcugccuucaagcaucuguuuaacaaagcucaucuugcaccgcccuuaauccauuuaacucugaguugacacagcacauguuucagagagcacaggguuggggguaagguuauagauuaacagaaucucaaggcagaagaauuuuucuuaguacagaacaaaauggagucuccuaugucuacuucuuucuacacagacacaguaacaaucugaucucucuugcuuuuccccacagguuaauccuaaagugcagacacacuugagaaccacugaaauacacaaguguacaagcucuggccgacuuuugcuuauuuuuaauggcuugcaguuuguuucuaguuauggguauauagucuugagaugaauucagggucuagaaacagcuuuuuuuaaacuguuaaaauaauuaaaugggaagugauuagacugggguaccuccagugcccuguguuccuacauaagcaaacugaaaccuaauucaauguaaacugucuuaaccaaucagaaacugccaauuaaccuuuaacuagggacuuuucacuggaaugguccaaaucaggcuguugcuccacuuuaaucaaauguuuucuuugccuuguuucugcauucauccugugaaaauccuccuuaucccuucagcccuaagucauugaacuacuuucaauuggggucuguccuauucaugaaucaauugaaaguuuuucuuuuaacuggacuaacucaaacuuuuuguuagcuagacuaaggcagaguuucuuaacaaaaggucaccagcaucaucaagagugcuuuuuagccguacguggaccuacugaaucauguuuuggggaaucuauauuucuuucuuucuuucuuucuuuuuuuuuccagaaagcaucauaguugauucuacucaucaagauuugaaaacuacccuuuuacacaaaacauauuuaauauuugaggaauuaaagugaauuaaauuuuguuucccuggcuagauuguaguaaauguuaugaauacagaaauuuugucuucucccuuuuccccuccucuguauaaaagagggcuugucaaggaccgcgucuuauucuuugguuugcccaguaugcuuuuauguugguaaaaguuuaauaaauaucaaguugaauucuuuauuccacuuaucauuuuccuacaaagcuacauaugauuaugaauguggagggccuuugaggccagauggcacugaaggguaguuucacacaaacuuuucuuagaauaucagucuuggaaagaccuugaagguaaucucgcccauuuguuucauuuuauauuggaggaaaccauaacacagauugcugagugccuucuacaaagugccaagauuaauugcagagccaagacuagauuucuaauccagugcucuuuauuuugugaacugucuucuauaugaagcaucgguguuuggguuggagguuuucugcuucuuagguacaagaggaagaagaaucuguacagaaccaaaaacaucuuaauuuuuguaaucaggaugucuaccuuuacugacaacauuuacugacaacauuuccuucugaaaauagguuauugaaagaucaaggaucuuugccagugaaauccuuaacuggaaguggguggguacaagauagaaaacucauuugguauaacaauuuuguuguuuuuuaguggaaccuugcuucucuguucugacauuuccaugucucuauuuauaguagugaucucuuuggaauuugccuucugauuccauuuguuccuuuauguugcuucauauuaacugauauucucacuucauuuaaaaaaaauuugaagggacauguacuuaagaaaaaggaauuaauuuuuuuauaagaaauaucuggagguacuauuuuucuaugguuuaucauaaucauuguuuaugccagguuaucuaauuguagcaauaauauaaauacuauuuuuucaagcaagaauguuaguuuuaaaaaauuuaugugcauauuaagcuuuagacaccuuuuauccaggacagauauuaccuuuagauucuuaacaaccuugcuccuuaacuaugcacuuugauauaaaugaagauugagagguuuuaguuagagcuuuuaagugguaaacggucaagggcaggagcuaucuuauuuaccuuugagaugacaauaaugccuggcaucuaguagguccuaauuaaucuauucauuuauucaauucaacaaaaauucugggcauuguucuaagugcuagagauacaguaguaaacaaaauagacauauaucucaccgucuugucuugagcaugcuagugagugaagguggauugaaaccauggaucacuuugcagagacucccuauuguuuucagacaauuauuuguaucagucuaaccaauaauauccuguagcuaauuaagcaaugguuugaagagucagaaugggagaagcugaaugaucagauagaucauucauucauuaaacauuuaauuuccuaguguauguuaaauuauuugaaacaagcuagugaaugugagucauugucaucccaauugucagccugauucuugugcucuguuuauaucuugggguaaagacuucaagcuucuggccagguuacagcccgggaacuucaucucagaucacauaccacugaauccuaagugcauaaaauaaugugugccauguaguaaauauuacuacauuaauccuuaacuacucgaaaugcaauuuccucacuacuuauggccacagccugcaucuagucuucauccagacaacucaaacaauaaaaaucuucaagucugauauucuccucaagaugaccucuugucaguuuguuuccuaauguacuucuuccguuccucuagucucuugacacuucucuuuucuuuccaucucuuacuugcuggcuuuccuucuuugccauucacgucaguaauucucaacucccacuccccuuugucuuuuaguuguguccauucuuuaaaucaacaacucuuaaucaguucaaauugacuuuggagucggaugaacuucaaaucaccauuugcuacuucagugaccuugccaaauucuuuaaccuuuuuugaguuuguuuacuccuugucacccuaagcauuguuuugaaaauuaaaugagauuauuguauccagauacuuuugaccacaaguaaugaaaacccuuauuaaauggcuuaaauaauaaaaaauccagggguagaguggcucuaaggcugguugaugagcagcucaacaauuuaugagguacccauguuuuuuucaucuuugccuucuaccacccucagcuucuugacuuuacuccccuaaugauugcauaaugguugccacaguuccaggugucaugcagucaugauuguuaaauggaaggggaaaguuucugcuaccagugucccuacccuccaccccugccacaacugccaaucuuauuaaccuuguccugaccagaguugagucacaggcuuacucuaucaagugucauacuggcuuagaauaauuaggauucaucucaggggugagggagaggccccacuuuccuaguaauaguuauucuuacuacugcauuugugagugcuaggacucaauccuugugcccuuuuacccuaucuaugauucuaguaauuuccucuagucucaugguuucaaauaucaccuacacucuucccaaauuuuucucuuuuaagagacaggaucucugucgcccaaacugaagugcaguggugcaaucuuagcucacugcagccuugagcucuugggcucaagugaucccccugccucagccuccugaguagcuaggacuacaggcaugcaucagcacaccuggcuaauuuuuaaauuuuuuguagagaugggggucucgcuauguugccuaggcuggucucaaacuccuggccucaagcaguccuucugccuuggccucccaaagugcugaguuugagccacugugccuggccccaugcaucuuuauuuuauauguccaauauugaacuccucaguuucucccuucuccccucucuauuuuaguaaguagcaagucuguucuguguuugcugaaguugaaaaaccuugguguccuuauugguuuuuccucacauucccuguuugauucaccaggaaauccuguugacucuaccuuuaagauauauccagaaguucaccacuucucaucaccuccacugcuacaucaugguccaaaccaccugaauauauauguauauugcuacuucagugaccuugccaaauucuuuaaccuuuuuugaguuuguuuagucuuuggcacccuaagccauauguauauauguauauauauuuuauauauguacauauauauacauaaagauuuuauauauauacauaauauauaugcauacauuauauauauacauaauauauaugcauacauuauauauauauguguguguguguauuuccccccccccccagacagugucucacuuggucacucaggcuugagugcaguguauaaucagagcucacuguaaccucaaacuccugugcucaagcaaucuugccucggccuucugaguagcuaggguuacaggcaugugccaccauaucuggcugacauuuuuuaucuuuuguagaggcagaguauuguuauauuguccaggcuagucugaaacucguggccucaagcuauccuccugccucagcauuccaaagugcugggauuacaggucugagccacugugcccaucaguucuuauuggucuuccacccuugcccaccgucuuucccacgcuguuaagaaucaaagugaccuaucauucgcguaaaacucuccaauggcauuguaucuucccucagaauguaagucaaagucuuuaguggccuacaagccucuguauugcaucuguuauuucucugaccaucuuucaaccccuucaccaucucuaucauucugacucagccaccuugcgguuccucaaagaugccuugcauucccucacuucuaggcuuugguguuugauauuucccucuauccaauaaguucuaccauauggaugcauagcuuuccuccuuuccuuucagauuguagugcuaauaucauuuucucugaaaucauuucuggcuacccuaucuaaauuuugaaucuccuuauuuacauuuucugcuuuauuuuucuuagcuuuuaucaccgucuaacacaacuuacaguauuuaaaaauuuuuauuguaucucccccuacuagaauguacagagaaugaggcagggauuuuuguucauacuguaucccuagcaccuagaaaggugccuuggcauaugaaagguccuuaauaaaaauuugugaguaaaugaauguucauucauucugguuucagcuggguccuuagugggauuuaguaauuguuuguuucugaucagcugcuucccuauuuuccauaauugacauacugaacuaccaccauucuuaucaaacacccuacuuuacucugaauccuuagcaguggauguccccccacuccucucuuuuuaaacagaguauugauacuguguaugaacuucuuggucuuccuaguccuuuuacuuucaaauuuauaaauugucgucgucuacuuccuuuugcucucagagcccaccucuaauuuuauucacgucucaucuacugguacucuugguaucaaaucguaucaaauuuuaucuucuuugagaugucauuuaagcaauuauuucuuuuauuauaugucuuacauguuuuuaaauauccuccucuauauuguuuucuucuucucuggacuaucuuaaaaccucuuuuauccuuuccuuauuacaagucuaucuccuucagacaacuuguuagaaauauuuaaauuuaccauuucauuuucauuucccucuuaauguucaauuuaccacauucuagcuuuuauuggucacaauucuaucuaccucauagaauucugagagacuaaaugaggauacauguguuuuuagguuaauauuuuuuugagggcucaccaggauuaacuauuacuacugaagccaaaaucauucucacucuuacagauacuuuucuaucaucuuuauuuacuuuucuguaucccucaugaaauagcuucugucuuuugguuuuuggacacuaguggugucaggaugccuucagcuccaaguaagagaaucucuuaaguccaaugauagguaguuccaagauugauuuagagaugcaacacugucaaguuaggcucuuacugucuuuguauucugccguuuucacugugucauagacgucuaccuuuaggauuguaagaauuucauuauucaaaaacaggaugcagugcugggguuucuccuugguggauaucuccuuauagggaggaaaauccccagaacaucucucuuacaucucauuggcuagaaccaugucacaugucugcccuuaaacaaucacuggcaaaggaaauacuacugugauugauuuaaaucaacccugagccauccccaagagacugggggaugcucucaccuuccuugaguucauuacucuauuucugggagaagauaucuguuagcuagaaagaagauaugaaugguucuuugguauguaaccagcagugucugccguagcauucucaccugguugaucucugaugguuccuucugucuuuuuuauugucuccuguugauugaugugccccuuaaaugcuggucaucccaaaguucugucuuugauucuuuccaaaaauuguuccuccuucacacuauaaaauaucacuugcauuaggauccuuucuaaauauuugucuccaacuaauauuucuaagcuccaguucagaauaucuccuggaugucuucauccacguucaauucaaaugaauauuguuguguugguuuuuggugagucaaaaauuaaauaaaauuuaccuuauauuaucuuacauuuuaaugagguaguuagccagagaaauagauaacuaggaaugcagucuuaugcagcaaaacuuaccaacuauugaaguagcauagaugaagggguuauuaauaagguuacaggaauguucacaguagaacuugucuuuacacuuaaaaaguacucuucuuauauucuauacuuucauuaguagcacaacugugcacaccuuugucaauccagaaaugggcagucugaaauccuuccucuucucuacauccagcugaugggcaaauuauacagaugcuauuucuuacuacuuaauccuaccuguuggucugguuauaucauagucauccuacuuuagguucuuguuauuucucaucucuuugugauucauucauucaguaaaaguuuauugaacagcaauauauuguaaacgccuuguucuagaaauaaaacaggaccccgcugguuacaauccaguggaugaggcauaaacacacagaugguuauguaaggugauguguaauacaguggagauauggggggaaguguaggagcucaagguccggggaaucuaacccaaguuugggcuucacagaagcccaucuacagggugagucucaaagcagaaguaagcuaggugaagggcuccuggaguagggaagagggaaauacaccuacacacaugcccuauuugcuuuauauauaacaaauaucccuucaaagguauuaacuuuggugccuguguacucauuaauguuaccguuguucaaaaacaauuuuuuaacugauuaugguuaaugcagaagauucucaguaaugauauuauuauacaguugauucucauuauuugucaguucuguauuuaugaauuugccuacucaccgaaauguauuuguaaccccaaaagcaauacuugaaaugcuuucaaggucauuuuuagacauacgcauguucagaguggcaaaauauuuaagaacuagcugagcuuugcacagaggcucacaucuguaaucccaccaccuugggaggcugaggcagaaggauugcuugaggccaggaguucaagaccagccugggcaacauagugcaaccccucccaccaucucuacacacacaaaaaaugaacuagcugagguugaacaagucaguggucugcccucauguuucagcucucauacuuuuaaacaagucuccuuuucaugguccauuuagugccacauuuuuguauuuuugugcuuuuuuuuuauuggugacuuuacuauuuaaaauggccucuaagcauagugcuaaagugcugucuaguguugcuaagcacaagaaggcugugaugugccuuacagagaaaauucagguguuagguaagcuucauucaggcaugagucauaguucuguuggcuaugaguucaaugucagugaaucaacaauauauauuauuaagguaucuuuaacagaaauacacauagaagagguuauguauugaccaguugaugaaaaugugaccagagccuggcaggaaccuaacacuguauuucccuuaggggcagugauucacuauucucuaauuuagcauuugggaugauuuuauagaacauaaccauggcaaauguuuuauagaacauaacuauggguuuuauagaacauaacaaaugaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcaccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaagaacauaacaaaugagaaucaacuacuucaggguaaauuucauuuugggaaauagccauuaucauuuaugaccaggaccgaugaauuagaugggaauggucaaggggaacaauacagagguaugauuauuaaacagucuuucucugccuuuuaaaacacaugccacccuuuuugauaagcaucucaccucacacuuuaaauauucuaauauauucccuuuagcagucauguccagguugagaaucagcguauaaguuuuauuuuaccaucagacaagcaaaaacagguugaccuuuauucuuuuuuuuugagacagagucucuguugcccaggcuggaaugcaauggugcgaucucagucacuacaaccucugccucccggguucaagcgauuauccugcuucagccucccgaguagcuggaauuacaggcaugugcuaccacaccuggcuaauuuuuguauuuuuaguagagacaggguuuaaccauguuggccaggcuggucucgaacuccugaccugaggugaucuguccgccucagccucccaaagugcuaggauuauaggcuugagccaccgcgcccggccuauuucugaguguuuauuguaaaaacuauaguuuuuaaaguuugccagaugcaauaaaauuuuaucauguuuagugcuuuauuuagacuuugcucucccuccagcgaagaauaauuuguauaaagcagaaguuggcaaacauuuccugguaagggccagacgguaacuauuuuaggccuugugggccauacagucucugcugcagcuacucaacucuaccgcugucuggcaaaagcaacaauagacauuagguauuacuuuauauaguuauaguauaaacuccuuuuucuuuuauuuuuuuucuuuuuugagaucgagucucgcucugucacccaggcuggagugcaguggaacaaucuuggcucacugaaccuccaccucccggguuuaaacaauucuccugccucagccucccaaguagcugggacuacaagugugugccaccacaucuggcuaauuuuuuuguauuuuuaguagagauaggguuucaccacguuggccaggcuggucucgaacuccugaccucaauugauccgcccuccuuggccuucuaaggugcugggauauaggcaugagccaccgugccugacuuauuuauaguauaaacuccuuaaggguagggacuauguauuauacuguuuuauccuucauguuacauguaacaguauagcacaguggggucucaguaaugguuggcuugauaugcugauuugaccuagauaacaaaaaguuuauauuuuugaaauauuaauaacuugaacauuaaaacccauccauuuacaguuaauuuauuuuagagauauauuuuucucuaaauauccuucuuuagacaauuauaauaguucaagcuuaugcauuuggaauuagguagucaauggcugaauuuuauaguaguugguaaauacuauaggacauacgggcuuauuuauauaaauguucuaauacuuauauuugguagccauuauuaaagucuucgaaucauaguuaagucuccaugguagcagugguuucgugauuauguuuuaauggaugcaguauacgauaaaguuaauucauaguuaaaguuugguacugauuuaaauuaaaucauuugagaggccaggcacaauggcucacaccuguaauccuagcacuuugggaggcggaggugggaagauagcuugagcccaggaguucaagacuagccuaagcaaaauagggagacccuaucucuacaaaagaaaaaauagcuagacaugguggcacaugccuguagucccagcuauuugggaggcugaguugggaggacuacuugagccccggaggcugagacugcagugagccauaaugaaaccacugcacucuagccugggugacagagcaagacugucucaaaaaaaaaaaaaaaagaaaaaaauuauuugagaauuguaaacaauuagcuaaacaaacuugcuaaauaaucaguuuguugcagucuuggcuaagagccuaauaauucaaugaaacagcugcauauccucuccuccucuugggcuacagacauuuuuuuucuguguacuccuuaaacuacucucucucuuuuuuuuuuuuuuuaacuacucucauuuuucuaaugagccaauuaagaugacaucucaggccacauauaagaaaagaguaugagaagagacauuuuagaaaagauaaaagugaaaaucacguagauuccucauuuccaaguguugcuuuuacaauuaaacauugugaaaguguaugucaacugagcauguguaaauacauuccuacuaccuuaaguguaaaguauuauuuugaaaaaaauuaucauauuguuuauauggaugaacaauguaguacuauuuuauaaguaaaauagaguucaccuguuaagacuuuauuuacccuaaaugugcaugugagagguauguaugugugguauacuugggcugagauucacaggcugagauuucugaaaaauuggauuauaguacugccgacuagaaggaaccacuagaucugcacuguccaacacaguagccacuagccacaugagacucuuaagcuacugaaauguaccuaucugaauugaggucaaaguguaaaauacaugcuguauuucaaauauuuaguacaaaaaauaaagaauguaaaguauuucauugauaauuuguauuuugauuauaugcugcaaugauaauauuuuggauuuacuagguuaaauaaaauacauuauuaaaauuaauuucacguuuguuuuuacuuuaaaaaaauaugguuucuggaaauguggcuugcauuuguagcuugcuuuauauuucuguuggacagcacuggucuaaauagugugaucuuucaacacaggcaaaauguuauaaugaaauauuaguuuaucaagacccauuuaaaaugauguagaaacucuagcucuuuuuaaaauuuuuuggcuaauacaguguuuuugguuuugagacagucuugcucuguugcccaggcuugaagugcaguggugucgugaucauggcuuauugcagccucaucucccugggcucaagugauccuccugccucagccucccaaguagcuaggacuacaggugcaugccacuacaucuggcuaaucuguuuuauuuuuuguagauacgaggucucacuauguugcucagcuggucuugaacuccuagacucaagugauccuuuugccuuggcuuccuaaaguacugggauuacaagugugagcuaucacccugggccuaacucaguguuuaaaaucaguguaaagaacacuuuauuuuaaauuagcugggugugguggcacaugccuguagucccagcuacuugggaggcugaaauaggagaaucacuugaacccgggaggcggagguuacagugagcccagacugugccauugcacuccagccugggcaacagagugagauucugucucaaaaaacaaaacaaaacaaaaaaagaacucuuuaaauuauuucaaaaugccagaaaaguauauuagcucgccauacauucacuagucauuagcaagcuuucaaggacuuauuguaaaagaggguaacaaagaagggcuaguuguugcuugaauauuuuauucaucccaguuagaauaaguuaguucuauacuccccaaaaaaggaaaugauauauauauuuuuuggauacagggucuuauugugucacucagguuugaauacaguggcaugaucacggcucaccugcagccuugaccuccuggacccaagccaucccccugccugagccuccugaguagcugggacuacaggcacaugccaccaugccuggcugauuuguaaauuuuuuguagggauggaauucucacuuuguuacccaggcuagucucaaacuccugggcucaagugauccucucaccucgugcuucuaaagugcugggauuacagguguaagcuacugcaccuggcugauuuauuuuuuuaaguauaaaauaugucugauccccugggugucuccaaaucuaguaauuucuauacauuuaaagcaauuuuauuuucuuguuuuuugaaagguagguacuuuuuaauuuuuuaaacaauuuaaaaucuuguuuuaaagaccacuagacaaaaaaauuaaauguauauauuauagugcuucggggaaaguauuauaaaaccaagccaugacacaguaucaacauuugaaaacuuggggaauuacuaauauuacuguagcgauaaaauggaaauuuugaugauacagacaauaguccacagagaauuaugacuaaaauuauucuuccuaccaaccauuuuaaguuaguuugccaucuuauguuggugcucuuggaggcuuacaaauuauuauuauuugagacaggaucucccucugucacccggguggacugcgaucacggcucacugcaaccuugagcuccuggucucaagugauccucuagaguagccagaaccacaggcgugagccacagcgccuggccaggaagcuuacagauuauuaaugaaacuuuguuaagaacccuuuaccuuacugacaaccagaaaaguaauuucacugguuugggaauaaauggacacuuaagaaaugaagcaaccucuucaaguaauuuuuuuucaaagaccaaacuauugaauuagugcuuuuugaagagcauaaaagagcagucaucaagugugacauuaaaaacuuucagcugggugcaguugcacaugccuguaaucccaacacugggagguugagacgggaggauugcuugagcccaggaguuugagaccagccugggagacauagugagaaccugucucuacaaaaaaaaaaaaaaaaaaaucuauaucuauaucuauaucuauauaucuauauauauauuagcaagauguggugguggugugagccuguaauaccaguuacuugggaggcugagcccaggagagaucauggcugcagcgaucugugacaaugccacugcacuccagccucggugacaguaaaacccugucuccauaaaaaaaacuucgaacaaucugaccguaacuuauuuucugccagcuucccagggcaagccuuccuaauuugcaugcauuaaucucaccaguauuuuugcuguaucaaauacauuuuaugcucuuuugcuucuugacuuaguguuccugauccaaauugcaaauucucccuuucucugucaaaaucuaucagucuuucaugacuuugcucacaauuuucuguucugaagucuuuccuauccccaccacuccagcccaaguugaggauaauaauuaacuuuuuuuuucuucuuuucuuuuugagacagucucccucugucacccaguuuggaguauaguggcaugaucuuggcccacugcaaccuccaccucccaggcccaaaugauccuuucaccucagccuccugaguagcugagaccacaggugcacgccaccaugcccagcuaauuuuguauuuucacgggguuuuaccguguuggcuggucuugaacuccuggccucaagugaucugcaguccuuagcuucccaaagugcugggauuacaggcgugagccaccgcaccggccucuguuugacuaucuuuaaagcucuuaaaacgaucucauuucguuauuaacuuuuuauuguuugucuucccccucuagaaugaguugaaugagagcaaggauaaugucuaucuaguuaacagcaccuaaaauagugugugacacaaaauaaacacuccauaaauauuugcugagugauugaaauacuuuauuuguggaaaaugugcacuaugauaaccaccuuuuuaaacaguuuguguacccaucaaauacuauaaaauggacagucagauacuguugacaaauuccaaauauaaugaauccaaacuacugucauugccuaaaaaaggacauuuacagguaaggggcgugggagaguaggauuucuaaaacaauuuaagcuuaaauggauagggcuuaaugucuuaaagacacuugccuuaaguuuauguauuucagcuuguaacguagauaagguaagaagugaaucucuuuaaaauuucucagcugagugcgguggcucagaccuguaaucucagcacuuugggagaccaaaauggguggaucgcuuaagcccaggaguucuagaccagccugggcaacauggcgaaaccucaucuguacuaaaaauagaaaaauuagccaggcaugguggcaugccugugguccuagcuacucugggggcugaggugggaaaauggcuugagcucaggaggucgaggcugcagugagcugagauugugagaucaggaacacaaucagccugggcaacagagugagauccugucucuaaauaaauaaauaaauaaauagauuuuaugggucuguaucuuggcaacacauacacaauaaauaaaaauuucccuauuuuuccccuaaagacaaaguugcauuuguagccaucacaaaauuaaaagguacuguaaguauuaugcucuggaaccuuuucacaggaaugagaauugagggucugaguugcaaacuuacaucaagcauuugcucuauagcaaucuaugguaaugauaccucuuagugcuuacugguuuuuuaggaaauuauaguauguagagguaagauauaguccguuauuaaauggccaauaauuugauuuuauauaacuauuuagauauuaucuuaaaaacaggugaaacauuaggauagacacagccuaguacccucuaguuuuauguaaauauuggaacaguguauguuuaagaauugucaagaauaucuuagcucauuauuagacuguagcuauagaaaagcucuuugaaaucuuaucacuugaguaucagauguaugugagaaagcauauggaaguauuuuauaaacuguaaaguauuauauaaauguuauuauggggaaggcauagaacagguuuuuuuuuuuuuuaacacugagaagauaguaaaauucagagauaaaggucugaaaagggaacuuggcaagaggcaagaucuugggggaugccagacuccuuugggggugaaucugguaguuacuuuaaugcuuuaugccaaguaaaacuuccugagucaaaggagacuauuugucaauaaacauccaagugguagcaaaauaguuuauauagcuuaaaauacugaaaauaauguauauguagaugucauauaaauuguagugcugacacauguacuaucucaucugacucucacaauaaucuuugugaguuagguauucagauaauuuaaaugauucaucuaaguuacucaccuguuaagugggagaacugagauuagaaaccaaguauucagauuuuuaagucuuuauucuuuuguacuagcccucuaagaggaauugauaaauaaugguuuccccuagauaauuuucaaguaauuugguacgacugagauaugugaggcaucaacagauauuaaggcuggacagaucuucugauuccaaaaucaaauauauauacuuuaagaauauaaauauuggaacugaaauacaaugaaugcuaccuaugggaaguuuuaaugauuuuaaauuuuaacaaaaucaacaugaaugaguagcaaauauuaacuggaauauuuagaaauaccaauuggacagcuguguguguaugugugagugugugugcauguaugcuuauaaauaagaacauuuuguuaugcauaugguauaguaauuuuccuggaaaaaaaauuuucaaguucauaugagaucaucaucaugauaagaguagccagcacuuugguauuccucacuacgugccaaucacauuuaaguaucacacauugauugcauuuaauccucacaacaauccuaaauugguauuaauguuaccagcuuaacaguuaacagaguuaacucuguuugacagaugaggaagcugaggucagagagauuuaaguccaaggucuuacagcuguaaguaguauuaccaggauucuaacccaggcacuccagcuccaaaaucuaugcuuuuaaccacuauauuaugaauauucccugggugucaccucggcaaauauaaucacuuuuacauacucugagguuauauauucaaauaucuaaagcacuguuaacagaguuuaaaagagccucaguuuauuugcuuauucuuggacaggaauuauuggggaauggaggucauaauuuucuaauaugaaugacuaagaaauuucauggccaggcgugguggcucaugccuguaauccagcacuuugggaggccaaggcgggugaaucacgaggucaagaguucaagaccagccuggccaagguggcaaaaccucgucucuacuaaaaauacaaaaaaauuagcugggcgugguggcacgcaccuguaaucccagcuauucgggaggcugaagcagagauuucuuaaaacccgggaggcggagguugcagugagccgagauugugccacugcacucuauucuggaccagccugggcgacagagcgagacccugucucaaaaaaaaaagaaauuucaggguccaagcacccugguuuaugccuguaauuccaggaucgaaauuucaaguaccaagcacccugguuuaugccuguaaucccaggaucuugggaggucaaggaaggaggauuguuugagcucaggaguuggagacuagccugggcaacauagugagaccuggucucuauaagaaauuaaaauaagccagauguugcauuggccuguagucccagcuacucgagaggcugaggcagcaggaucacuugagccuaggaguucaagggugcagugagcuaugauugugccacuucacugcagccugggugacagagcaagccccaucucaaaaaagaaaaaaaaaaaaaauuuaggacuaaauaugacccauuuaagaauuaaauauugccaggaaaaguuauucacaggugcgaugguaaaauaugagaagucauuuguccuccagcauuuaagugaugaucugaauuuugauguaauuucuucugagacucauggcauuuuaucuucuucuguacuauuuuauuauaaacugagaaaugauuugugaguuggaaaaagaaaacuuguuuuuuauuauauaugaauaaagucaaaguagaagaugaagaugacaucaacugaauaacaaauuauacuuuuaguuuuuugugguuaaaaugcuaucuuaauuuccauuuuuuaaaaaaauuaguuuuuaguagagauaaggucucauuauguugcccaggcuggucuugaacuccugagcucaagugauccuacugccuuggccucccaaagugcugggauuacaggcaugagccaccucaccugacuguacuuuucuuauaauaaagggaagauaauuguguuuucauggaauaaucuuaccaauguuugaguagcaaaguaaaaauuuaaaaaugcaagugcuaauuuuuauaucuuuguuaaaaaugcagcauucuuuaguuuuaagggaaaaaauguaugucaguuacuaacucaagcuaguuuuuguucucuucaaacuuuccgucacacauacauguaagcuauaacaucauauaagcagcauuuaugugauaucuaaauauuccauauagacuauuucuauguauuuuuuugguuuuauuuuaaccuuuaaaaaagcuuuuauuuauuuuacuuuuauuaaauaagcuuugaucucagcucuucucuguuccauuuccccuacaggcuaccacuacucucccuuuuacauacucuuccuguuuuugucauaauuauuugcaggaaugacaaucccaaccccucccccaaauugccgcauucauaucauacaaacuuggaugaccaagauuuaauguaaagugaucguauuguauaauggauuuucaacuccuagguaguagagaagacaucucagucugaaaaggugaauguaaggguaaaauaucuccaaaaugcuauguacuuuuaaagaugaucaucuugaugcuuuacccuauuucaucuauuugcaauggguauauuuguacauauaauuauugucuuuaaauuauuuucuaaggauaaauuccaggugugguauuuauagagcuauuaaaauaauauuuaguggcuuuuacuauugccaaauguuugaauuauuuacaaagcuuuacaaagcuauaagugugcaaguaucuguucauuuuaccaaaagcuagccagauuguuguauuaauacaacaaucacguaauacaacaaucgcguaaaucacgauuauauuugcuuucuuauuaacuugaaaugucaaaguugaggugaauucuugcuuuucaacuuuacaauuacgauucuuaugugugugugauauuuaaagaaaugugaaaaucccuuuucacccuuuucagugucuagggagccagauuucuuuccgucuguuaauauauaauacaauuucucacaaauaugaaagacccggucuucagguucucuaaaauaauuuacugugucaaguuuugauaauauuccuagcucucugaaaaugauugaaucaaauaagugucuauuuuuuuuuucugcaaacacuacccgccagaacaauuuccgguuguuaaauaguaaagucaccguuccuuugguaaggaauauuuaaaggaacucccuuggaaaugaauuuuguaauaggugauuuuuauucuguuuuuacucuaugugauacugauccuugcacuggauuucaguuuggcaauaugcuuuuuaaaacugggagucuuaaggugacuggauauuagcauuuuucacuaaguuuuuuggauuugaaaguaccuuuugauauuauuucuuggugaggcuaaaaaaauugauaaauagcugacaaaccucuguaaccuacagguaggcuagaucaauguuauacauuucuaaugucaugguguuguuaaaguagagaauuuugaagaguagaaaaucguagcugucaaaaugcacaaagaugaacauucagaaagaauugcugaaucaucauugcuuggcauauagaguaggcguucucauuucuuuaaagguuaacacaugauuauuacccuuuauuauauucuaaacauauauguacauuuucuuuuccucauaaagguuuucuaacauuuuauuuggacugugugcaauucuucugacuuuucuuauuuaucucucuaauagaaaugggaacauuuuugaaaagaugagaaaaccauacaggagauaaaagaugaguuauauacauagaaaaugucucauaaauaccugaaauauguuauacuuucaaaagcaggcaucaaaaggguauauaaaugcuaugaucuaacuuuguuaacaaaaaauuauaaaacuacagcaaauaaccaugaagauuuauagaaaacagaauuagaaguaaauacaguaauauuuaacagggauuaccuaaaaugauauuauagggagauuuuuaaaaacuuuuuucugcguuuuccaaaaucuccaacaaugaauauauauuuauaauuagggaaauguguuuuugaaagaaaaaauauuucucauauuacugccccuuaaguggcauauccaaauuuuacauugaugcaguugcaguuaagucuuguaaggaacaugaguauguacugucuguaaccugauacuuuguucuagcuuuccugcagcaccacaguucuuuaaauagggauccuguggggcggcugcaggggacggggguugagggguggcagggaccucauucaguuuuaguuuaguugaaguaacuaaguucagauacuaaaauuucaaaaauaaguauuuguuugccagaacuaugaacucauguauacuagaaauaacuaguuagcuaaaaucauguuuaaguccuuuacuuauuuuaaaauaacgcauuugaauuuuauuauagauacucccuuaacaaugugaaacuaguacacaaacuuucuggcguuucugauugauagaccccaggaauuuugaagacgacauaaauuacuuggaaauccuaauuuaaacaaccugcguuuugguauuauauacuuaacagacaaauagcuuaaaauuaaaaaaucccuaaaguagaauugucguuccuuuuaucuguauauuaacuuuaacuucuuuuaacauaggguguuuaaugacugugaugauuuucaccuaguauggaguacauaaauauauaguugugacauucuguguugaaauauuggcauguuaacccauuuguccuguuuaauuaggaaauaaagacgguagagcuagucggaaaaugaauaguuaaucguggaggaggagaaaacauagcucaguacuuugacuagaggcagcugggaaagugacguccuguagcauuugcuguucuagaaaguacagagacacguagugaaaaugggaggaucuagaaggaggcugucuccuguguaguguauauuuaucuguaagugagccguuggggaaggauugaauacagagacgcugucugcuugcugccuuaagacagcuagcugaauugcugauuaacuuuuaaaauacccagcuugguuuauuuuucuuagaaucuguugcuaagacuggggacgcuguuuucuuuuacaaagggaaaucuaaguuaauuucaaggcauucgaaauggggaaagacuauuauugcauuuugggaauugagaaaggagcuucagaugaagauauuaaaaaggcuuaccgaaaacaagcccucaaauuucauccggacaagaacaaaucuccucaggcagaggaaaaauuuaaagaggucgcagaagcuuaugaaguauugagugauccuaaaaagagagaaauauaugaucaguuuggggaggaagguaaguauucucuguauaucuuucugucucuucagcucugucucuuuuuuuuuuuucucucucucugccagccuuuuuccccucucucucagcuuguuaagguuauccuuaaauuggauucucagucauaucaaaaguagaaggacaaauguauaauaacaagguuucaucucugaucauaugaaugaguauugcagagccaugaaugaaauguccuuguuugccuuuuuuauuuuagcauuuuguauuauacauauuuuaucauuagacuuacaauguuaacaauguauauuuuaaaauaaaccuugaauucccauaccuauuaguaaauugugucaaaagucuuaugaaaccuguuucguuuucuaaugaauuuucugccagaaccaauaaagagucuuuagucauuuaaaaccuuaagauuggcauuucagauucugaguaguuuauagcuuauucacaaaaacaaaaaguaguuuuuugccuuucuuauagcaaggcuaguuuagacugaacaagacagaguugugacucucagaagcagaaggcgcaggcauuuagcuucuaguuguuuuuggcauucugccuggagaggaaagaauuuuccugaugucauaaaauaccagaacaaguuuuuagcuuaauuguaaacaauaauuuugugccaagaaaaugaaaucucagaaauacaauuuuugaccuaaaauggccaccuaguuagaauaauuacugauuuacuuuuagauaacauuauuuauuuagaaauuuuacuaucuagguauagagaaaaacaugacaacuucccuuuccucucccugccauacuuuuguuuuuugcauugugagaucaaaaacuagugagcacaguaaaggaggauaauuucagauuauccuuuucucauucugcauuuuaaaucagguuuguccaucacuuccauauaaacggggcuaugaaguaagacuauuuuaaauugcuaauugauaacacaaaaaacuuuaacuuguacuguuuuggggauuuucaacuuuuaacaucaggacuaaguuauuuuauuauuaguuuuucucccaaaauacuggcuuucaaaucacuguagcuaugaaaacuuguuaucccuuugauuccuuuauuacauuuaacaucaaauuuuccuaauuagaaauauauccuuaaaauauagucaagcagugacugcuuauuuugaaugaaacaaauuaaauguagacaagcagggugauuguauauagaggguuuuuuccuuuuuguuuuguuuagcuuuuuuggucuaugaguugcccaaaauugaaguuuauguugcagguuuugguguggugaggaccuacagugucagguucuuacaaaguaaauauugaaaaaggcaaauacugggcaguucaaucuugcaugauaccuauggccauauuacccaaaauaucaugacuugguuuaucucaaaagcuaagcaggauucugagauacuaccaauaauguacuacuauuucuaaaggaguaauuuuguaauuuuguaaagaaauucacaaacauggaaugacacugugaauuccugugaaaaagcagauauccacugcuuuguauuuaaaauauuuugcaacaauucacugauagcucaaguuuguggcuaagccauuggauccaggguuuaguaaggauauuugucuucagaauuuucaagucaccaaaugauacauuuuucuugauuuaacauuaucucuuaauagugcuuuucuagagugauuuuucucauuuaauuuuuauuggucauuacacaaugagugaauuuuuuaaaaacuaaaucacccugaaucuguauacccuggguuuuuuuuuuuaacuuacauaauugauauaagugauagaaggaaagagugaggagagaaugccuuuuuuaaaacauagaaauauauuaugcagaaauaccauucucuaguuauagguuacuugaaaauacaauugaaugggccaggcgccguggcucaugccuguaauuccaacacuuugggaggccgagacaggcgaucaccugaggucaggaguucgagaccagccuggccaacauggugaaacccugucucuacuaaaaauacaaaaauuagcuaggugugguggcagacaccucuaaucccagcuacuuggaagggugagguaggagaaucacuugaacccaagaggcagagguugcagugagccgagaucgagccacugcacuucagccugggcgacagagcgagaccucaucucaaaaaaagaaaaggaaaaaaagaaaauacaauugaaugaaaguuauuugaauuauuuuuuagaauuauucuuccuucacaggaaaguauuauauuuguuugccguuuauucagaauaucucauuuauucuauuaaaaaaucccauuuagauacacugugaaaguaggggaaaacauuuuuucucuuugccuuuuauuuaucuccagacgugguuccauaggugucuccaguaguaacaaaacacugaacuuuaggacuauggaaacacuauuaauuuaccugguauccuucuucccgcuccccccaaguuauuacagucuugggacuuagagcugggauggugggaauaaggaaccauaaacugaaaaguauguaaguugcauaugcuaaauuuauguauuuaggagugaaagaaccaguaauccagaacacaguauauuuguguucugaauauucacaauuuaaaaugcuuuguuuuaaaaacaguuggcuagcugggugagguggcauaugccuguagucucagcuaauagggaggcugaggcugaaggauugcuugagcccaagaguuugaguccagccuuugcaacauagcaagacccuaccucuagaaaaagcaaaggaaagaaaaaaaauacggauaacucaaauuuacuuuuaggaaucuauaaaagggaaacaaaaacauguccacacaaagacauguaccugaaugcuuauagcagcauuauuuauaauagccccaaacuggaaacaaucugaaagcaccauaaauuggugaauuaaacaaaaugugcuauauacauucaaugaggaacuauuuagcaauaaaaggaccaauuugugaaacaugcuacaccauugaugaaccucagaaacuaugcuaaauuaaagaagccagauguaaaagacuauauauuguaugauuuuauuuaugugaaaugucuggaaaaggccaguauauagaaaaagaaagcagaucuuucuugccuaggacuugaggugggagcggggauuagcuacaaauaagaacuagagaauucuuuggaaugauggaaauguucuauaacuggauugugaugaugguuauacagcucuaucaauuuacuauaaucaauugaauuguauuuguacaauagguuaauuuuauauauguaauaaaucuuuuuaaaaauaaaauuucucuauaguugaaucauuugaaaacaaaaaccacagaacuacagaaauuuaaaauuggauucugaaccacucucuaaaguuuuagguuuagucuugaauaguuuaguggaugucaacaaaaauuuguguuaagagauuuaaaagaaaagauuuucaauaacacauccucauuuauucuaguuuucuaauuuuucuuuuuuuaugcuuuccuuauuuuguuauugcauaugauuuauucaguaacuucaaauauuaaaagguaguguuuaaaugauaaaacuuguauuuauuaaucuuuauacuaguucucuucuguucuuuaacuuauauauuuagcuagcuggauuuuuuuuaauucacuguguguucuaaaaacauguaaguaaauuugauuuuugugaauuaaaacuguuuaaaaaaucucagaaucucauuauuugauaacugaagucuugcuguaaaucuggauuuuuacauauuagaucuccuuggauggaguaagaguuauuaaaguauuaucauguuuuuuucuuugcaaucugaauuuuucuccaguguuucuucuuuuggaaacuuuuagucaaccuuaacuaauuagugggaaucauuguuauagauaguauuccaaacacauauuugguuugggacugcaaacugguugacugguuaguuguaaaauaauagcagucuugcuaaaucauaggcaaauguugcuucucuggugcguuuuuugaucacacaaagugaugacgaugucuagaaaacauuuugaauagcagagggaauccaauuggauauuaaacauuuccauuagcguucaaaauguacaugauuaagaacugaccauauaguuaaugugacauuacuuauaauuuuaugugcuagacaaugcaagugauacuugcauaauaauguauauuaaaguggcaugaauuuugguaggauuuuuuucuuuuuuuuguuguuuuugagacagaaucagucuccugaguagcugggauuacaggcgugcgccaccacgccuggcuaauuuuuguauuuuuaguagagacgagguuucaccauguuggucaggcugaucucgaacuccagaccucaugcuccacccaccuuggccucccaaaguucugggauuauaggugugagccacugugcccagccuaggauuuuuuucauucauuagaguagcuucguucuuugucugagcugcauaguugacuguuuaauagugucuaggaaaaccucaaagcugcauuggagucuuuuuaucagcuuugguaaguuacuucagacuuuguaugaaucuucucagagacuuuguaauuaugaccgaauugcccuuuuuggcagaggaggaagagguuuuccagaaagccaaacccaugauguaauaaauuaaaacauuauucuuucuuuucaugaauucauuaugggugcaaguauuuaaauuuugucuuauaagaggcuagauugggcaggcugauuuacccaguuuacuuaacucaguuaaauaauuauacucccuuaagucuaugggaugaaggauaaaauuauuuaaauaauuuaagcauugguugagucacuuuggucaugaccuugagcuacauauuauucuaucauuaaaaaaaaaaucugccauuaccuuuuuaacauuuggaguuauaauuauacuacuaaaauuuauaaaagggaaauuuggaugagcugcuuaugaaaagaucuuguccugcuuauacuugucauucuacaaggaauuucccuaacugcuauuuggauauauuguucaauacauauuuuggcaauuuucagauuauuaggucucucuugaucucuccagauuucuauucauggaugaagguaaaaauuuuagauaucacuugagacccuguuagaugaaauagaguagauauauaccuuuuaauggaagaagccaaaugcagaauaagacguaagcaaaacuaaguuucuuuaaaguaugcuguguguuaguggcauuuuaaauuguuaaaucucucauauauguauaugugugauuauauuuuacauuguuuuugcuucugccuuuuucucuguaccgauacucaagacaccuuuuuuaguuuugauuuagaaggacuuuaggaauuaguucauucccuucauucacuaagcaugaauaccuaccauuuucagcccuguaugcaugagcagugcaaaauaaauauauuuccugccuucaaaucacucacuguuuggagauauuagaaucuccuagcuuaaucuguuggauuuuucauaguuuuaugauuuuuagauucuuuuccugcuuguuucuugaucuguauugaccccuuaaaagaucaccauacuguuguuuuuugaguuuuaguagaacauuucuuucauaguggaaaauguuguuucaaauauaaucuuuuguggguuaaauauuacuuaguggaacccuuaagcaaagggucaaaaagucacuauauuguugccugagguggacuguucacaagagacagaaauaacccauauagaggccuuacgugucaaaguuuacagcucuugauuucagucuucuuacaagcauugaaauuaaugcuaagaugugauaugccuaaaaaauuugguaucuagaguaggaaugacaaucguagugucuaaaaaaccauuuuucauagaauguccucauuauuagaauuuuuuucacucucugacacagaguucuauuuuaauucuuuuuuuuuuuuuuuugagauggaguuuugcuccuguugcccaggccggagugcaauggugcagucuuggcucacuguaaccucugccucccagguucaagcgauucuccugccucagccucccaaguagcugggauuauaggcaugugccaccaugcccagcuaauuuuguauuuauaguagagacgggguuucaccauguagaccaggcuggucucgaacuccugaucucaagugauccacccgacucggccucccaaagugcugggauuacaggugugagccacugcaccuggcccuauuuuaauuccuaaacaguaaaagaugaucugaaauaaaacuaguuagaaugaauaugguauuuuuauuacauuauauuuuuacauauuucuauuuuauuuauauauaaacaguaugaauaugguauuuuauauuuugcuauauauuuuauuaauauauuuauauuuuuaaauguuauauauauuguuugauuguaauaaaaauuaaagauuuaaguucugcacuuuguguugauugcugaagaccuuccaacugacaucuuuuaaaaacuuauauauuuauaaguagauacuuauauaauuuauauacuucagcaugccagaucaguaguuuauaaggaguucccaguuuuauuuucuuuuucuuuucuuuucuuuuuuuuuuuuuuuuuuuuugagacagagucucacacuguugcccgggcuggugugcaguggugcgaucucagcucgcugcaacuucugccucccagguucaagugauucuccugccucagccuccugaguagcuaguauuacaggcaccugccaccacaccuggcuaauuuuuuguauuuuuaguggaggcgggguuucacuguguuggccaggcuggucucaaacuccugaccucaugaucugcuugccucggccucccaaaguguugggauuacaggcaugagccucugcgcccggccuuauuuuauuuuucuuacuuacccguggaacaaagaaucaggaauaaauauuagagaugcugauuuggccggaagcaguggcucacacuuguaauuucagcacuuugggaggccaaggcaggcagaucaccugagguugggaguucgagaccagccugaccaacaugaagaaaccucgucucuacuaaaaauacaaaauuagccgggcgugguggcacaugccuguaaucccagcuacucgggaggcugaggcaggagaauuguuugaaccugggaggcggagguugcggugagccaagauugcgccauugcacuccagccugggcaaacaagagcgaaacucugucucaaaaacacaaacaaacaaaaaugcugauuuggaggaagaauuugaaaacuuaacaauuuaacuuaggauguaaucaucaagaguuuuauagcuguucuguauuuaguaaaguggcauuucuggccaauauuaauacauuuuaauguaaguuagccaaaauuuauuagcaauacaguuuuugaaaguuuaacuuuuaagaguugcaagcuuuuuucuaaucaugcuuaucucuucaauuaggguugaaaggaggagcaggagguacugauggacaaggagguaccuuccgguacaccuuucauggcgauccucaugcuacauuugcugcauuuuucggaggguccaaccccuuugaaauuuucuuuggaagacgaauggguggugguagagauucugaagaaauggaaauagauggugauccuuuuagugccuuugguuucagcaugaauggauauccaagagacaggaauucuguggggccaucccgccucaaacaagauccuccaguuauucaugaacuuagaguaucacuugaagagauauauagugguuguaccaaacggaugaagauuucucgaaaaaggcuaaacgcugauggaaggaguuacagaucugaggacaaaauucuuaccauugagauuaaaaaaggguggaaagaaggcaccaaaauuacuuuuccaagagaaggagaugaaacaccaaauaguauuccagcagacauuguuuuuaucauuaaagacaaagaucauccaaaauuuaaaagggauggaucaaauauaauuuauacugcuaaaauuaguuuacgagagguaaguugguaggaccuaaaauccuaagaccaaauaauuauguaguugaucauagggaguguaucuagauaauagcuaacauuuauuuaaugccuauuauacguuaaaaauaauuacuauaaaaauccucuaagauaguacuaguauuauaccucuuuuauggaugugauuauauuuucuaacuuuaguuacuuauaauuaaagugucaaguguuaacuggauuauguacuaugaggcugcuuuuacaaaugugguuuaugagaucugcauugguaaucucaacacauuagucuuuguauauaggguuuguucuaaauuuguuaauauggaguaauaauugcauaccaaaaaagauuagaagaaaauaauuuauaauucacuacaaauuuguauacauuuauauuaauaaaaaauacauuuauaagugcauauaaauauauacauuuauaaauuauaaugcuacuauguuaauacaauuauuauuugaguucuuauuugcacuauuucuuuuuuuuuuuugagacagagucuugcucugucacccacagcgcaaucucggcucacugcaaccucugccuccggguucaagugauucucuugccucggccuccuaaguagcugggauuacaggcgccccccaccacaccuggcuaauuuuuguauuuuuaguagacacaggguuuuaccauguuggccaggcuggucuugaauuccugaccucaggugauccacuugccuuggccucccaaagugcuaggauuacaggcaugagccaccacgccuggccuauuuguacuauuucucaaauuggauuguaacuuugcaaauauggucauagcaguucccugcuucaaauucuuaaauugcucuauauaaccucuaccauaaaguccaaacucuuuagcuuaaaauaagucauuuuaaaucugaugucuacccauaaaauguauaugcacuuccccaaguuugcucuauuauuauuauuauuauuuuuuugagauggagucucgcucugucacccaugcuggagugcaguggcacaaucucagcuaguacugcagccuccaccucccagguucaaguaauucuccugccucagguuccugaguagcugggauuacaggugcccgccaccaugcccagcugauuuucauauuuuuaguagcgauagguuuucaccauguuggccaggcucgucuugaacucuugaccucaaguaauccgcccaccucggccucccaaagugcugggacuauaggcaugagccaccgcaccuggcccaguuugcucuauuauuaucuuguauacuugagcuguacucuauggaacacuauuguuucuuacccugcucuaauaccuaccugcuacugcccaaugcuuaguucaagcauccucuacucccggaaucuaagggguuaaguugggugcucuuucucuuacaaaagaccuccaugcuuaccucuguucuuacacuauacaguauuauaauggcuaguuugcuucuauguuucugugaguuccuugugcauuccuugagcuggggucuguguucauggucccuauaaggcucaccaucuagccagaauguguggcauauaguaaaugcucaguaaacauuuguuaucuaaaacaaauauauuucuuguccuaauacuuuccagagaaauaguugcuccuauccaguucuuucuaguccugaauuucucccucuucucccauuccaaucccugcaucuugaauauauuaauagcagcuucaaaauaaccaugucauuccagggcaauguggaauauauccuuuacuucucuuuuaccuuuucuuuucuucuucuuuuuuuuuuuuuuuuguaacauaucuaauaaugcauguccugaaggaauuuuccuuuuuuucuuuucuuuucuuuuucuuuuucuuucuuucuuucuucuuuuuuuuuuuuuuuuuugagacaguuuugcucuuguugcccaggcuggagugcaauggcacgaucucggcucacugcaaccuccgccugcugaguucaagugauucuccugccucagcuucccgaguagcugggauuacaggcaugugccaccacgcucgccuaauuuuguauuuuuaguagagacaagauuucuccauguuggugaggcuggucuugaacuccugaccucaggugaucugcccgccuuggccucccaaaauguugagauuacaggugugagccaccgugccugaccucugaaggaauuuucuaaugaggaaaaaaaauuuauaacuauuguuauucuuuuggagguuaaaguuuuaccuuagugguauuauccuuuaccaucugguaaaauuugugcuuagauuuuugaguuuugaaguguuuucauuuuauuuuauuugguccauuuuaggcauuguguggcugcucaauuaauguaccaacacuggauggaagaaacauaccuaugucaguaaaugauauugugaaacccggaaugaggagaagaauuauuggauaugggcugccauuuccaaaaaauccugaccaacguggugaccuucuaauagaauuugagguguccuucccagauacuauaucuucuucauccaaagaaguacuuaggaaacaucuuccugccucauagaaugaagaacuuuguuacacauauuuugauaaggcacugaaaauauaaaaggacugguaguuuacugauguagaugugaauucuguauaaagauguguaaauucuuuugaggguucauuaaauugcaugaauagagacgggucaaauaaauaggcaaaagggauuuuuacaguuagagauaaaagagaaaaccauucacuguauuuuauuucauuucuccugauucagauauuuuuaguaauuugcuuauauguaaaaguuguuuuuguggagucaguggauauauuucuaaugaagugcuagacuauccaauuacuuaauuucuuauaccuuuagauaaucaguaugaaaaguucccauuuauaauggaaaugaaaauucuuaacuaaacuauacauguaauauguauuucuagaagagaauaaaaacccaagucaguuauuagauuuaaaucaccuucugaaaugcugcuauagggcugguaucuguaaaagaauauccugaugcaucuguuucaccauuuugauuuuuaaaguaugcuguagcauuucuuaauaacaucguugugauguucuuaaggcagaucuuucuucauaaaaaggaaaguaauggcaauuucucuccuguggaaaucccaauugcuugaauuacugauauuuuagaauagacuuuuuaaaaugccauauguaauuuuaugcaaguugacuauauaucuuguacuuaauaaauuauaggcucauuuuguucucugcuaguuuaaaguaauucguuuaauaauagauguguuuuuagaggaaaugcuguuacuuggaauuaauuuuccaguuauacagucuucuauaacuuacuaauaauauucuauauguacuuuauguaauuucccuaaaaagaaugaacuaccacuacacuaugguguuaaaccaaaauauagggaaaauaaacacuaacugcugcuuauggauaauguugcaacuacuuguuaugcauauaaauauuuuacuuuuucacauguauagauugcauuucuuagguguuuuaauuuuuuaaauauauuuauguuuuaaaaauuuaguuuuguuuucuguuuuauaacuauagugagaaugauguuuugaagcaaaauuuuugguuauaaaauaguuuucaggauuauauauauauauacuggauccuaucgccuuuuaguagaauaugaaauauucuuuuagaaauccaauauaaauagguuauaauagccauauucuuuauuacuuuauugagauauaauuuacaugccauaaaguuuacccuuaaaauauauaauucagugguuuuuagugauauuuacaaagugguacaaucaucaucacuuucuaauuccagaauauuuucaucaccccaaaaagaaauccuaaauccauuagcaguuacuucccauucuucccuuccuccagccccugaaaacacuaccaucuacuuuucaucuguauggauuugucuguucuggacauuucacauaaauagacucaaacaauauauggcuuuuuuuuuuuuuggucuggccucuuucauuuagcuuaauguuuucaagguucaucuauguuguaucacguaucaguacuuuauuuuuuguguggcacgucauauggauauaccacaauuuguuuaucuuuucauuaauuaugggcauuuggcuuauuucuacuuuuuuggcuauuauaaauaaugcugcugugaacauuugugugcaaguuuuuguguuucaauucucauggguauauaccuaaaaguggaauuucugggaguaaccauauauuugaguugcaaauggaaaaugcuugaaaaaaaugccacagaauucagcuaaucguauuuauuacucuaauucauaaaugauuccucuauaacugucucucugaaugacaguuaaaacucccuacagaagugugaacauuacagaaauuuucucacaagucuaaagaucuagaucugaaaagcaucagucaacguggugaaugauagugguuucuguuuuaaacccaucauuauuuauugcaauuuucuugauuaagcauuuucucccagguaaaauaaaugauuuauagauagauauauaauaaucuuuggauuaaaaaguuuuuuuaagcagagaauuauuauucuaguaguaaauaaauuuacauaacuacacaaaaccaguauaccaguaucucucuuaucuuaaaggauauugacaaugcuuuagcauguaguaacugcucaguuuuuauguguugaauguugaauuaaaaguaguaaugaguagaguuuuaaaguuuuuuaauuuauuuuuucaaauuaugagaguacuuuuuauuuuaaaauguuuucuuuaaauucaaccagguucuuggauagccggaauaguuuugaaguacuauagaucccauaaagaagauguuuaucuucccuaaaagaaaaaccacaaauugcuuauguuaaaaaaaaaaaaaaaagaagaagacgacgaaggccaggcacuguggcuuaugccuguaaucccagcacuuggggaggcugaggcaggggaaaaucaaaacuugaguccaggaguuugaaaccagccugggcaacauaguaagacuccaucucuacaaaaaauuuaaaaauuagcugagccugguagcaugugcuguaaucccaacuacuugggaggcugaggugggaggauuacuugagcccaggagguagaggcuguagugagcccugauugcaccacugcacucagccugggugacagagugagacccucucucaaaaacaaaaacaaaaaacaaguauaagccaaggugauuaauggccugcuaauagagguauuuuguuuggccagcucagugguuuaaaaacuauuuuuuaauuagaaugcuuuuaggcaagacauggacucuucuguugccacugaccuaccauuaucuauugcguuacauaaagcugcuucacauguuuaguuauguugccugggccucugaaagcaucugaguuagucacaucuacuguagcucaucacuccugccuauuguuagccuuccuuggagacaaggaguugaaaauacucuuguuuguuuauuuuugggaaacugucauucaaauaguuaugauggauaaaggaaauuaauauaugugauuagacucaguaaauggcucagaagggacuaucuucauauuccaaggacuauuuacauaaccucaaagaguuaagacuaaauaucauucuuaaucuaaaaauaauuuuuaucuacuaacguguaauguaguauacugccuauaugucugacuucauguauacaugguuuauuuuuuacccuuuauggagaaguauagaaaaaaaaugugguauguuacuuucaaauaauagcuuaaucaaaaugugaguaaauagaugaaguuuuauagaguaaauauuucaaccuuuuaaauuuuuuugugauacuucauaaaauucauaaaacauuuggagcuggaaauaauuuuuaaaaucccauuuucuagauaaagaaguaaacccagagaggcuaaguggcuugucuguaguuaaagagcagguuugauguauucgaaacucuucuggucauuaaaaaauaaaagaaaaaaaaaaaaggagagcaggcugggugcagugguucaugccuguaaucccagcacuuugggaggccgaggcagauggaucacuugaggcuaggaguucgagaccagccuggucuacauagugaaacccccucuguacuaaaaauacaaaaauuagccgggcaugguggcaagcaccuguaaucgcagcuacuugggaggcuaaggcaggagaaucgcuugaaccugggagguggagguugcaaugagcugacaucaugccacugcacuccagccugggcaacguggcagagggagacugucucaaaaaaaggaagcuggaaagggaauucuuauucucagugccauuuuucuccaguaugccauugauauccccuguuucucaauuuccaagacuagauuaaauucuuuuacagcucauuugcuggccaagugugguggcucacaccuauaauacuagcacuuugggaggcuaaggcagaaggauugcuugagccuagguauucaagaccagccugggcaacauagcaagacuccauuuaaauauuaaaaagaaaaguucauuugccuauuuauuuauguagucuguguaauuuagcauauacauuugaaauauauucggucauuuaggaacauacaaaguuauaauuuggugcucacuagaaagcuuuugaaacauuaauuacaaaaacaggcuuuuucuuuuuaaggauauuaauagaaguaauaguccauaauugggcuguguccuucauuaguuuacaaauauauaugccaauguuauucucaaaauaguguaaggccacaucugagcaaaaaacaagcauauuauuuuaauuuacauaaauaacaaaugaagauuuuuacaaguaaaauacuauucaaauauuaaauuauaucauuguaaaaagaaaaggagagagaggaaagaaaaaaggcgagagaaaaagaaggggggaagaaaggaagaaaaaaacccugcagauuuuauugagaagaaaaguuuguaaugacaaauaacauacggaaucucuacaaacauuugcaaauauuguaacuccucccaaacuaaaaauucguuaguacaucuucucuccagccguuagaauuuugguuuguauaaacuuaguucuugaaguuuuuuuuuuauacuuuaaguucuaggguacaugugcacaaugugcagguuuguuacauauguauacaugugccauguuggugugcugcacccauuaacucgucauuuacauuagguauaucucccagugcuaucccuccccccuccccccaacccacaacaggcccuggugugugauguuccccuuccuguguccagguguucucauuguucaauucccaccuaugagugagaacaugcgguguuugguuuuuuguccuaguuugcugagaaugaugguuuccagcuucauccaugucccuacaaaggacaugaacucauccuuuuuuauggcugcauaguauuccaugguauauaugugccacauuuucuuaaucuagugaguuuuuuuuuuuuuuaaggcauggugguguggccagagcgcaguagugcaaucugggcucacugcagccucgaccucccaggcucaagucaauccucucacuucagccuccccugagugacugggauuacaggcgugccccuccaugccuggcuaauuuuuguauuuuuuguagagauggaguuucaccauguugcccaggcugagccauuauuaauugagauaauuuuaagaagaggaaaccagagguuggaaaaaaggaaaugagaguaaagcgaaugguugaggaagaugagaaauuuuugaugcagacuuacacauaagaaauaaagccaaggccgguugugguggcucaugccagcacuuugggaggcugaugcagacagaucucuuaagcccacgaguucgagaacagucagggcaaaauagcacaacuccaucucuacaaaaaauacaaaaauuaguccagugugguggggcacuccuguagucccagcuacuugggaggcuuaggugggaggcugauuugagcccaggaggcagagauuauaguaagaucacgccauugcucuccagccuggcaacauagccagacugugucucaaucaaucaauauagccagagguacaaaccacugcugcuguuuuugcuaaagggaugccauugaaauggauacaaaaagccuggaugggaaguaguuuuguaagaugaauuuaaaauuuauauaauaauauaauuucuauauaauaauauaauauaaauuauauuauauuauuauauaacuuucucgagcucaagaaauauuuauuuuauuuauuuauuuauuuauuauuuuuguuguuguuguugagacggagucuugcucuuucgcccaggccagaccugcaguggcgcuaucuuggcucacugcaagcuccaccucacggguucacgccauucuccugccucagccuccugaguagcugggauuacaggcgcccaccacagcgccuggcuaaauguuuguauuuuuaguagagacgggguuucaccguguuagccaagauggucuccaucuccugaccucgugaccugcccgccucggccucccaaagugcugggauuacaggcgugagccaccgcucucggcuuaguuauguuuaucugagucacuuaaguaaaaguuguguaauuguuuuuuaucuuaaguauacauuuugcaucucugugacuggggaugaagagguucaagaaaugagauuggccggaucaauggcucacgccuguaaucccagcacuuugggagcccgacgugggcagaucacuugaggucaggccuucgagaucagccuggcuaacauugcaaaaccccgucucuccuaaaaauacaaaaauuagccaggcgugguggcaggugccuguaaucccugcuacuugggaggcugaggaaggagaaucacaugaaccugggaaguggagguagcagugagcugagauggagccacugcacuccagccugggugacagagugagacuccaucucaaaaaaaaaaaaaaagagagagaugagguuaacugaaaaucauaagaucugaaaaguuuaaacauuaggaaugagguuagacuuuuuaaaaaucgccuucuugaugugccuauuauguuuaacaaaccaaaaaugaauuugcaagcauuuuauugaagcuaugaaaaugggagauccugaaaaauuucuagugaucaaggaauuguaaaucauauaguauuuauuauuacuaauuaaauuuacucuuauccucuuuauuuaauacaaucuucauuuuagugaaucuaaaaacugucuucuuaggguucugccuaaaacuauuuuuuuucccuucacaacuuaaauccuaaucguuuucuuaucucaguguuuucagaaacauaucugcuucagacugggaaauuauauuuuacuauggcuuuuauacauuacacucccuuacuuaugaaggaaaccuugaaaauuggcacagcuaacuucagaguaguaauuacacaauaggaauaguuagacauuuuauacuuuuuucccagaauauuuuauguauaaauuuuggaagaaauuaaucagauguuaaaauugaaaaccaggcuuaagauggggcuuaguauuauuuaaaauuaguugcuagguuauauaggcuuauucucauuaaguuugaagaugguauauaaaguuauaucacuucuguuuuggcaccaaaaaaagguagacuuauauaucacaaaauuuauacaauauaaacuguauuauuuaaccaaaauaauguaacuuaaaauaagucaaacauuuuaaaaugaaauugauaucuuauuuugauuuacaguuagaaucuugagguguugcguaugagaaaugaauuuauuuuacuuauuuauagaaaugaggucuugcucagucaaccaggcuggagugcuguggcaccaucuuagcucauugcaaccuagaauuccuggccucaaacaauccuccugccucaaccucccaaguagcugggauuacaggugugagccaccaugccugacucagaaacuuauuuauuuucuuucaguuuucaaauuuuaaacaaugacuuacuuaauauuaugaauagauaccagucaucucauuuaauaauuugucuuaauaaaugugauggguuugaauauuaagaagaugaaccauuagccaggaauucuaauuuuauguugcuaagagauuuuaaaacuuuaccaaucuuuuaauuaauauaaaaauauuuuauuuuuuacuuguauuuucgauaauuguaauggauuugaauuauuucaagaccuauauguagcuuuaaaaaaaggaauauagaccauauauacuauguaaauaucaauaauuucuuuacauagguauuugauuuaaaaauguguuuuuuguucuuaugaaauaacauuuuauuaauuuuuuucucuuuagucagggucucacucugucaccuaggcuggagugcaguggcaugauuaugacucacugcagccucgaacuucugggcucaagugauccucuggccucagccucccauguaguugggacgacaggcaaacaccaccauuccccuauacuuuuuguauuuuuuguauaaaccaugccccaauaauuuuuguauuuuuuguauagaugaagucuugccauguuggccaggcuggucuugaacuccagggcucaagugaucugccugugcccaugggcauaucccagcaugagcccacgccuauaaucccaguacuuugggaggccaaggcagguggauugcuugagccuuggaguucaagaucagcuuggccacaugacaagacucugccucuacaaaaaauaugaaaauuaaccaggcauggugguccacaucuuuggucccagcaacacaggaggcuggcaccagauaauugcuuaagccugggaaagugaggcugcagugaguuaugauugugccacugcacuccagccugggugacaaagcaagacccuguuucaaaaaaaaaaagaaaaaaauuuuuuuucagaaaaggcacuaaaucaaagagcaacauauaauucuaacuaguaaauguaguuagacuuaaauacuuuaauguuaaauauaucuaauguuaaaacauuuuauuguaucuagaggcacaugaaagaaaaaauauuucaaaauuacugugaaugugugacuauucugaaaagauugaaccaaguaucuuaugccuacuuauauauugcuguaaguacuuuuuucuuuacauugacaaauaaaauuguauguauuuacucuguaaaacaugaugguuugaaguauuuauacauugugggauuuguaaguauuuuuaaaauucgaaauaaaggccgggcaugguggcucacaccuguaaucccagcacuuugagaggcugaggcaggcggaucaccugaggucgggaguucaagaccagccugaccaacauagagaaaccucaugccuacugaaaaaaaaaaaaaaaaauuagccaggcgugguggcuaaugccuauaaucccagcuacucgggaggcuaaggcaggagaaucacuugaacucgggaggcagagguuguguugagccaagauugugccauugcauucuagccugggcaacaagagugaaacuccaucucaaaaaaaaaaaaaaaaaaaaucaaaauaaaaacccugccugcuuuugauuuuaguuuaugaaauacuaacuucaugagagcauagagugcaaacacauaguucauaaucaacauuuucaaauacguggcccaauauuuuuguauaguaauugauaauuuugugaaguaguuauuuguuauuacuacuucauguggcagaugaggaaacagagauucaggcauucuuaaguccucuaucccagaucacacagauagagaugcaacugagauucacgcccagauugugauuuucgaccugcuauuucuacuguucauggcuacaugguugugaagaugguaguugucuucauuuguucugccugaaaaaccugaaccaauccuuccauauccacugaauuauuuaggauaauaauuuuaggagauugacagaagccaccaauuucuuucaaugaauagugacaaauucauuaugaugccuugcuguugucagugucagaauuuuuuuuugcauagggcaccaggcuaugcuggggucacagauaagaaugaucuuuauaaaggccuucauaaacuugagaauugaggacauaauacauaaaaugcaugacaguggaaauguaccauaugcccuccuccuaugagaaauguguuuucuaccacuaguaguuguuucugccuagguaucauuuaggggcagaaccaagaauaugagguuauuuuuuccuuuugucuaaauuguauuaguuuuaugauacccaaauacaccucuuuucuccugcuuugcacaaauuaaggaaagauggggaaauuuauuauuuuacauuaauuugauagacauaaaauaaaaauucauuucuccucugugccaagaucuguguuagauguaauggugaauuuaaccaaccuguuccuuacccucauagaacuuauuauuauuuuuuauauuuuugagauggaguuucauucugcccccaugcuggaguacaauggcaugaucucggcucacugcaaccucugccuccuuucaauacaguauguuuuaaaauuuuuuucuuuugagauucaggggauacauguguggguuuguuacauggauauuuugcaugauggugaaguuugggcuucuaguguacccaucacccaaagagugaacauuguacccaauagguaauuuuucaacucuuaccccauucccaccuuuccuccauuuggaguccccagugucuauuaucuguagguccacauguacccauuauuuagcucucaaguauuuuauuuucuguuucugaauuauuucacuucaaauaauggcuuucagcuccauccauguggcuguaaaggacaugauuucauucuuuuuauggcuguauaguauucuaugauguguauauaccacauuuucguuguccaaucaaccauugauggacacacuuagguugauuccaugacuuugcuauugugaauaguacugugauaaacaaacaagcaccagugucuuuuuuaauauaauaauuuauuuuccuuuggguagauacccaguagugggauugcuagguuuaaugguaguucuauuuuuagcucauugagaaaucuucacacuguuuuucauaaacguaucaacauuuaucaguuaucaaaucaccuuuaguuaguuguuaaacaaguauuuacugagcacacugaggcuauaacauuguaggugcuaaagauacaguccuacccuuaaagaccuuacauucuaaucauagaagauaaacacuaagaaacauuacuugcauuaaaaaacaaguaagucauuuuuuugaauaaugauaagcauuaagaaaagaaugauaacggcauagaaacugacuggagggggaagaaguguguuacuuuuuagcuagagucaucaaagacagccucucuggggagagagacauuugcauucagcccuuaaugauucaaagcgggcagcuguuggaagaagauuuaaggaaaaaggaacagcaaugacaaaaguccugagaugggaaccuuuauugaaaagcagaaaaauauauaauuuacuuccuaauuuucaaauccuguugauguuauguuuccuaauacauaucaaagaggcagaaguagaugucagauaaagaaaaugggacuagaaaaugucuuuuuuuuuuuuuuuuuuuuuugagauagagucucacucugucacccaggcuggagugcaguggugugaucucaacucacugaaaccuccaccuccggguucaagauauucucaugcgccaucaugcuggcuaauuuuuuguauuuuuaguagauacgggguuucaccagguugcccaggcuggucuuuuaaucuuaccccauucccaccucuccuccauuuggaguccccagugucuauuauuuccaucuguagguccacauguaaccauuauuuagcucucaaguauuuuuauuuuccguuucugaauuauuucacuucgaauaauggcuuucagcuccauccauguggcuguaaaggacaugauuucauucuuuuuauggcuguauaguauuccaugauacuuggccucccaaacugcugggauuacaggugugagccauugcagcuagccaaagauaugacuagaaaaugucaaguguuggcgccugauccuggcucuugcugucuauagaggccauuucuuuucaggcuuguguuuccuauuuguaaauggagaauacuuaucauauguaccucuuaauagaauacaguucucuauaaacaauacuagguauggaugagauaauguugaaagagaaguuuacucagacauuuuaaauuauguuacauuaaaauguuaucuuuguucaaauuuuuuuaaaugaagauuuuaaaagacauaugauucuauauuucucaggcugcugauucauauauugauagucucccucauacucuuaaauuuugaaaugcuuuaccucuugaaaaugaaaauaaaaauuaaauuacagauaagauucauaauaaaaauuuuaaagaucauggguauacuacauuaaaaauuuauuucauagcauugguucuaaacuuuuuaccccaaauaggccuuuuauuacauucuuacccccacccauauuaaauuaaacuuuuuuuugugaugaacagacuguauuuauuaauaauuauuauauuuauauuuggggauggcuguuagaauuauuauauuuaggccaggcacaguggcucaugccuguaaucccagugcuuugggaggcugaggcaggaggauugccugaagucaggaguucaagaucagccugggcaacauagugagaccccauuucuacaaaaaauaaaaaaaauuauccgggcaugguggcacauggcuguggucccagcgacuucagaggcugagacaggaggaucacuugagcccuaggauuugaggaugcagugaccuaugaucaugccacuauacuccaaccugggugacagagugaggcccugccucugagaaaaacagaacuauuauuuuaauauauccaacauaauaugacagcuagucaacuacugauaaacaggaagugaacagcuagaaacaaaaaaugugauuuuaucuuuuuguacagacaagguccuugcuaugucacccaggcugaucuugaauuccuggccucaagcaauccuccugccucagcuucucaaagcgcuggcauuacagucauaagcuauagcaccuggcuaagaaugcuauuuaaaaaaauucacucuauaaccuguuaggugugugauucccauuaggugauuuccaauacugaaaguagcaucacuuaucuauauuaccuaccuccuuuguagucuccuugggauguggagacaucagauuaggagcuacuagccuuggcuuugauuauaauuuuggugacggccguuagaaggagaugacauuagaugaggucucuccuucuguagacgaaacugccuuuagagaucauaccagaguucacccuggaaaauagacuagaguaaaauuuaauuuguuaguguguauuuuuuaaaaaucauggacuagaaguuuguguuguuaagaaauuuggaagugucggcaaguauccuaacaaaaauaaaaaaauaauaauguuaggguagaaaaaaaaacuugauguucuuuuuaauguuaagaaaucacaguaaaugaugcaugguauuaaaguuagguaguugacuauuuuacaaugcuuuguuuaaaaaagcuuguuacaaagcuuguuuacaauaaauuuuuaaauauccauccacuuuauaacauaguauaaaauuuaauaaccacaaacauuuaauaaauaaguaaaacuacucugaaauucaacagaaauaaaaacucuuuaggcuauuuucuagaacuauguaauauagagagcauucuuggguguguguggggguuguuuuuguuguuacucuuugccaguaagaauacauuuuacgggcaacccgcucggggccccuuccacaccguggaagcuuuguucuuuugcucuucacaauaaaucuugcuacugcucacucuuugggucugcacuaucuuuaaaaaaaaaaaagaauacauuuuacagugucaucuacuaguuuacauugugugugaauguauguguauauuaguuuaagccauaugaaaucacagauacucaacuuuuuugaucuauaaaaguggcaauaugaaauuaccuaucuuuuaccuaugaaaauaauaauuucauuuacauauauguauauaaaauggaaguuuaauaaaccauuacuuaccauuccuagauagaauaacucugauguuuuaaaauuauacucuaguuuauuaauuuuuuucuaauugcaucccacggcauuuauuucaugaucuacauuugugaaacagcuccacaguuugaaaaacacuccuagaauucucauaaggauauaaauguaguaauuguuaaauuuuaaaacuuaaaugucaauuuguuuaaauucauuuaaaaacuacugacuggaaaauuuuuacucauuauuugauuguuggaacagcaguagauauagcuauauagcuauuuuugggucauaagacaaauucuaauaaacgaccauuauuuugauuaguuuauagaugaguuuauuucccccuucaacuuaagauaauuauagauaggaaaaguaaauuucuguugaauuugcccuauuaaauucucaugucaguggugacaauaacauucagauuuccuucaaauucugucuauauaguauuuuagcaaaccuaugcuaguaacauuagaaaaaaaauaaauuuacuaaccaaagacuuuaugaaggucauacaugaagaaauggguguuuuaguaagaaacagaaauuucuuaagcuucucauuagauuucuuuagauuuuaguucaaaauagauuugagugaguuuauuucugaugcguugcuuuacccugauuacagaaaagagaacuucuaaauaaaucacauuuaaaaauuuuuaaaaauucacuggggcugggugcggugguucaugccuguaaucccagcacuuugggagggugaggugggaggauugcuugagcccaggaguucaagaccagucugggcaauuugaugaaaccccaucucuucaaaacacaaaaauugguugggugugguggugcgcaccugaggucccagcuacugggaggcugaggugggaggauuacuugagcccuggagguugagguugcagccagccauaaccacagcacugcacuccagccucggugacagagugagacucugucucaaaaugaaaaagaaaaauaaaaaagaaaaaaauuuacuuuaaauuuuaaaauaagcuuaaaauuuacuuuaaaaaauuucuacucaguuugccagcaucacaaccauuccucuaaggauuauauaugagaaaacaaaacaccauuaaaaguaucugacuaggcuggaugugguggcucacaccuguaaucccagcacuuugggagacugaggcgggcagaucaccugaggucaugaguucgagaccagccuggccaacauauagugaaaccccgucucuacuaaaaaaauacaaaaauuagcugggcgugguggugcaugccuauaguccuagcuacuugggaagccgaggcaagagaauugcuugaaccugggaggcggagguuuuagugagcugagaucaugucucugcacuccagccugagagacagagcaagacucugucucucaaaaaaaaaaguaucugacuaaauuuuauuuucauauuguuucuuaauuguaugguuaucaucagugaccacaaauauaauguagaggagaguuauucaauggcuuucauuucuaagcauucaguguaaucuuaauguuuuaggagacuguacauaguaucuauguguagccuguuagaauccauagaccuuuagguaaguauccucuuuauuauugcuauuucaguacaaagugugcuucugggauagaaauaaaugggccacuuaaauacaucucugaggcaacagccaagaauugucuaauaauuguuuuuauaaguaaguuagaaauuagaaaauuaauuugcauuaagugguguaugugcauacauguauauuuuucaaagccaucaaaauauauuuucuuuucuuuuuuuuaaauauauuuuuaggggcugggcacaguggcucaugccuguaauuccagcacuuugggaggccaaggcaggcacaucaccugaggucgggaguucgagaucagccugaucaacauggauaaacccugucucuacuaaaaauagaaaauuagcuggguguggaggcacaugccuguaaucccagguacucgggaggcugaggcaggagaauugcuugaagcagggaggcggagguuguggugagccgagaucgcgccauugcacuccagccugggcaauuagagcaaaacucugucucaaaaaaaaauauauacauauacguauauguguguguguguauauauauauauauauauauauauauauauauauagagagagagagagagagagagagagagagagagagaaagagacagggucucacuauauugcccgggcugcucucaaacuccuggccucaagcaauccuccugccuugggccuaccaaaguucucagauuacaggcgugagccaccacaccuggccaugaaaauguauuuuaagaaaaacuaa

SEQ ID NO: 13875 - RNA, 8784 nt, Homo sapiens
gugccacauuuuuguauuuuugugcuuuuuuuuuauuggugacuuuacuauuuaaaauggccucuaagcauagugcuaaagugcugucuaguguugcuaagcacaagaaggcugugaugugccuuacagagaaaauucagguguuagguaagcuucauucaggcaugagucauaguucuguuggcuaugaguucaaugucagugaaucaacaauauauauuauuaagguaucuuuaacagaaauacacauagaagagguuauguauugaccaguugaugaaaaugugaccagagccuggcaggaaccuaacacuguauuucccuuaggggcagugauucacuauucucuaauuuagcauuugggaugauuuuauagaacauaaccauggcaaauguuuuauagaacauaacuauggguuuuauagaacauaacaaaugaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcaccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaagaacauaacaaaugagaaucaacuacuucaggguaaauuucauuuugggaaauagccauuaucauuuaugaccaggaccgaugaauuagaugggaauggucaaggggaacaauacagagguaugauuauuaaacagucuuucucugccuuuuaaaacacaugccacccuuuuugauaagcaucucaccucacacuuuaaauauucuaauauauucccuuuagcagucauguccagguugagaaucagcguauaaguuuuauuuuaccaucagacaagcaaaaacagguugaccuuuauucuuuuuuuuugagacagagucucuguugcccaggcuggaaugcaauggugcgaucucagucacuacaaccucugccucccggguucaagcgauuauccugcuucagccucccgaguagcuggaauuacaggcaugugcuaccacaccuggcuaauuuuuguauuuuuaguagagacaggguuuaaccauguuggccaggcuggucucgaacuccugaccugaggugaucuguccgccucagccucccaaagugcuaggauuauaggcuugagccaccgcgcccggccuauuucugaguguuuauuguaaaaacuauaguuuuuaaaguuugccagaugcaauaaaauuuuaucauguuuagugcuuuauuuagacuuugcucucccuccagcgaagaauaauuuguauaaagcagaaguuggcaaacauuuccugguaagggccagacgguaacuauuuuaggccuugugggccauacagucucugcugcagcuacucaacucuaccgcugucuggcaaaagcaacaauagacauuagguauuacuuuauauaguuauaguauaaacuccuuuuucuuuuauuuuuuuucuuuuuugagaucgagucucgcucugucacccaggcuggagugcaguggaacaaucuuggcucacugaaccuccaccucccggguuuaaacaauucuccugccucagccucccaaguagcugggacuacaagugugugccaccacaucuggcuaauuuuuuuguauuuuuaguagagauaggguuucaccacguuggccaggcuggucucgaacuccugaccucaauugauccgcccuccuuggccuucuaaggugcugggauauaggcaugagccaccgugccugacuuauuuauaguauaaacuccuuaaggguagggacuauguauuauacuguuuuauccuucauguuacauguaacaguauagcacaguggggucucaguaaugguuggcuugauaugcugauuugaccuagauaacaaaaaguuuauauuuuugaaauauuaauaacuugaacauuaaaacccauccauuuacaguuaauuuauuuuagagauauauuuuucucuaaauauccuucuuuagacaauuauaauaguucaagcuuaugcauuuggaauuagguagucaauggcugaauuuuauaguaguugguaaauacuauaggacauacgggcuuauuuauauaaauguucuaauacuuauauuugguagccauuauuaaagucuucgaaucauaguuaagucuccaugguagcagugguuucgugauuauguuuuaauggaugcaguauacgauaaaguuaauucauaguuaaaguuugguacugauuuaaauuaaaucauuugagaggccaggcacaauggcucacaccuguaauccuagcacuuugggaggcggaggugggaagauagcuugagcccaggaguucaagacuagccuaagcaaaauagggagacccuaucucuacaaaagaaaaaauagcuagacaugguggcacaugccuguagucccagcuauuugggaggcugaguugggaggacuacuugagccccggaggcugagacugcagugagccauaaugaaaccacugcacucuagccugggugacagagcaagacugucucaaaaaaaaaaaaaaaagaaaaaaauuauuugagaauuguaaacaauuagcuaaacaaacuugcuaaauaaucaguuuguugcagucuuggcuaagagccuaauaauucaaugaaacagcugcauauccucuccuccucuugggcuacagacauuuuuuuucuguguacuccuuaaacuacucucucucuuuuuuuuuuuuuuuaacuacucucauuuuucuaaugagccaauuaagaugacaucucaggccacauauaagaaaagaguaugagaagagacauuuuagaaaagauaaaagugaaaaucacguagauuccucauuuccaaguguugcuuuuacaauuaaacauugugaaaguguaugucaacugagcauguguaaauacauuccuacuaccuuaaguguaaaguauuauuuugaaaaaaauuaucauauuguuuauauggaugaacaauguaguacuauuuuauaaguaaaauagaguucaccuguuaagacuuuauuuacccuaaaugugcaugugagagguauguaugugugguauacuugggcugagauucacaggcugagauuucugaaaaauuggauuauaguacugccgacuagaaggaaccacuagaucugcacuguccaacacaguagccacuagccacaugagacucuuaagcuacugaaauguaccuaucugaauugaggucaaaguguaaaauacaugcuguauuucaaauauuuaguacaaaaaauaaagaauguaaaguauuucauugauaauuuguauuuugauuauaugcugcaaugauaauauuuuggauuuacuagguuaaauaaaauacauuauuaaaauuaauuucacguuuguuuuuacuuuaaaaaaauaugguuucuggaaauguggcuugcauuuguagcuugcuuuauauuucuguuggacagcacuggucuaaauagugugaucuuucaacacaggcaaaauguuauaaugaaauauuaguuuaucaagacccauuuaaaaugauguagaaacucuagcucuuuuuaaaauuuuuuggcuaauacaguguuuuugguuuugagacagucuugcucuguugcccaggcuugaagugcaguggugucgugaucauggcuuauugcagccucaucucccugggcucaagugauccuccugccucagccucccaaguagcuaggacuacaggugcaugccacuacaucuggcuaaucuguuuuauuuuuuguagauacgaggucucacuauguugcucagcuggucuugaacuccuagacucaagugauccuuuugccuuggcuuccuaaaguacugggauuacaagugugagcuaucacccugggccuaacucaguguuuaaaaucaguguaaagaacacuuuauuuuaaauuagcugggugugguggcacaugccuguagucccagcuacuugggaggcugaaauaggagaaucacuugaacccgggaggcggagguuacagugagcccagacugugccauugcacuccagccugggcaacagagugagauucugucucaaaaaacaaaacaaaacaaaaaaagaacucuuuaaauuauuucaaaaugccagaaaaguauauuagcucgccauacauucacuagucauuagcaagcuuucaaggacuuauuguaaaagaggguaacaaagaagggcuaguuguugcuugaauauuuuauucaucccaguuagaauaaguuaguucuauacuccccaaaaaaggaaaugauauauauauuuuuuggauacagggucuuauugugucacucagguuugaauacaguggcaugaucacggcucaccugcagccuugaccuccuggacccaagccaucccccugccugagccuccugaguagcugggacuacaggcacaugccaccaugccuggcugauuuguaaauuuuuuguagggauggaauucucacuuuguuacccaggcuagucucaaacuccugggcucaagugauccucucaccucgugcuucuaaagugcugggauuacagguguaagcuacugcaccuggcugauuuauuuuuuuaaguauaaaauaugucugauccccugggugucuccaaaucuaguaauuucuauacauuuaaagcaauuuuauuuucuuguuuuuugaaagguagguacuuuuuaauuuuuuaaacaauuuaaaaucuuguuuuaaagaccacuagacaaaaaaauuaaauguauauauuauagugcuucggggaaaguauuauaaaaccaagccaugacacaguaucaacauuugaaaacuuggggaauuacuaauauuacuguagcgauaaaauggaaauuuugaugauacagacaauaguccacagagaauuaugacuaaaauuauucuuccuaccaaccauuuuaaguuaguuugccaucuuauguuggugcucuuggaggcuuacaaauuauuauuauuugagacaggaucucccucugucacccggguggacugcgaucacggcucacugcaaccuugagcuccuggucucaagugauccucuagaguagccagaaccacaggcgugagccacagcgccuggccaggaagcuuacagauuauuaaugaaacuuuguuaagaacccuuuaccuuacugacaaccagaaaaguaauuucacugguuugggaauaaauggacacuuaagaaaugaagcaaccucuucaaguaauuuuuuuucaaagaccaaacuauugaauuagugcuuuuugaagagcauaaaagagcagucaucaagugugacauuaaaaacuuucagcugggugcaguugcacaugccuguaaucccaacacugggagguugagacgggaggauugcuugagcccaggaguuugagaccagccugggagacauagugagaaccugucucuacaaaaaaaaaaaaaaaaaaaucuauaucuauaucuauaucuauauaucuauauauauauuagcaagauguggugguggugugagccuguaauaccaguuacuugggaggcugagcccaggagagaucauggcugcagcgaucugugacaaugccacugcacuccagccucggugacaguaaaacccugucuccauaaaaaaaacuucgaacaaucugaccguaacuuauuuucugccagcuucccagggcaagccuuccuaauuugcaugcauuaaucucaccaguauuuuugcuguaucaaauacauuuuaugcucuuuugcuucuugacuuaguguuccugauccaaauugcaaauucucccuuucucugucaaaaucuaucagucuuucaugacuuugcucacaauuuucuguucugaagucuuuccuauccccaccacuccagcccaaguugaggauaauaauuaacuuuuuuuuucuucuuuucuuuuugagacagucucccucugucacccaguuuggaguauaguggcaugaucuuggcccacugcaaccuccaccucccaggcccaaaugauccuuucaccucagccuccugaguagcugagaccacaggugcacgccaccaugcccagcuaauuuuguauuuucacgggguuuuaccguguuggcuggucuugaacuccuggccucaagugaucugcaguccuuagcuucccaaagugcugggauuacaggcgugagccaccgcaccggccucuguuugacuaucuuuaaagcucuuaaaacgaucucauuucguuauuaacuuuuuauuguuugucuucccccucuagaaugaguugaaugagagcaaggauaaugucuaucuaguuaacagcaccuaaaauagugugugacacaaaauaaacacuccauaaauauuugcugagugauugaaauacuuuauuuguggaaaaugugcacuaugauaaccaccuuuuuaaacaguuuguguacccaucaaauacuauaaaauggacagucagauacuguugacaaauuccaaauauaaugaauccaaacuacugucauugccuaaaaaaggacauuuacagguaaggggcgugggagaguaggauuucuaaaacaauuuaagcuuaaauggauagggcuuaaugucuuaaagacacuugccuuaaguuuauguauuucagcuuguaacguagauaagguaagaagugaaucucuuuaaaauuucucagcugagugcgguggcucagaccuguaaucucagcacuuugggagaccaaaauggguggaucgcuuaagcccaggaguucuagaccagccugggcaacauggcgaaaccucaucuguacuaaaaauagaaaaauuagccaggcaugguggcaugccugugguccuagcuacucugggggcugaggugggaaaauggcuugagcucaggaggucgaggcugcagugagcugagauugugagaucaggaacacaaucagccugggcaacagagugagauccugucucuaaauaaauaaauaaauaaauagauuuuaugggucuguaucuuggcaacacauacacaauaaauaaaaauuucccuauuuuuccccuaaagacaaaguugcauuuguagccaucacaaaauuaaaagguacuguaaguauuaugcucuggaaccuuuucacaggaaugagaauugagggucugaguugcaaacuuacaucaagcauuugcucuauagcaaucuaugguaaugauaccucuuagugcuuacugguuuuuuaggaaauuauaguauguagagguaagauauaguccguuauuaaauggccaauaauuugauuuuauauaacuauuuagauauuaucuuaaaaacaggugaaacauuaggauagacacagccuaguacccucuaguuuuauguaaauauuggaacaguguauguuuaagaauugucaagaauaucuuagcucauuauuagacuguagcuauagaaaagcucuuugaaaucuuaucacuugaguaucagauguaugugagaaagcauauggaaguauuuuauaaacuguaaaguauuauauaaauguuauuauggggaaggcauagaacagguuuuuuuuuuuuuuaacacugagaagauaguaaaauucagagauaaaggucugaaaagggaacuuggcaagaggcaagaucuugggggaugccagacuccuuugggggugaaucugguaguuacuuuaaugcuuuaugccaaguaaaacuuccugagucaaaggagacuauuugucaauaaacauccaagugguagcaaaauaguuuauauagcuuaaaauacugaaaauaauguauauguagaugucauauaaauuguagugcugacacauguacuaucucaucugacucucacaauaaucuuugugaguuagguauucagauaauuuaaaugauucaucuaaguuacucaccuguuaagugggagaacugagauuagaaaccaaguauucagauuuuuaagucuuuauucuuuuguacuagcccucuaagaggaauugauaaauaaugguuuccccuagauaauuuucaaguaauuugguacgacugagauaugugaggcaucaacagauauuaaggcuggacagaucuucugauuccaaaaucaaauauauauacuuuaagaauauaaauauuggaacugaaauacaaugaaugcuaccuaugggaaguuuuaaugauuuuaaauuuuaacaaaaucaacaugaaugaguagcaaauauuaacuggaauauuuagaaauaccaauuggacagcuguguguguaugugugagugugugugcauguaugcuuauaaauaagaacauuuuguuaugcauaugguauaguaauuuuccuggaaaaaaaauuuucaaguucauaugagaucaucaucaugauaagaguagccagcacuuugguauuccucacuacgugccaaucacauuuaaguaucacacauugauugcauuuaauccucacaacaauccuaaauugguauuaauguuaccagcuuaacaguuaacagaguuaacucuguuugacagaugaggaagcugaggucagagagauuuaaguccaaggucuuacagcuguaaguaguauuaccaggauucuaacccaggca

SEQ ID NO: 13876 - RNA, 35115 nt, Homo sapiens
cucggaaacaucgcgagauuuuguuccuucagucuccgccccuuuacggcacgauggucgcgcaagaauguaauagagcuucgacggccgccauuuucuuucuuucuuagcuguuagcugagaggaagucucugaacaggcggcagcggcucuuauagugcaaccauggcagacuauucaacagugccuccccccucuucuggcucagcugguggcggugguggcggcgguggugguggaggaguuaacgacgcuuucaaagaugcacugcagagagcccggcagguaaguguggaccgcgcggcggaaucccgaaagcucacgguaauuggccgcugacugaguaggccgcuacccuuaagcgcaugaggaagaggaaagagguguucuuccgggcugaaaugugaagagacacguuuccccauguugguaauaacgauuagagaccagaacccaguuuuguguucuuggugccuaauccacuuagaaccccgacgcgugcuacgcaaagaaggccugaagucuuucucccgcuucugcggcacucgcgugucuccagugagcuaguuuagauaaagauccucuuccaggggauaaagcgcaguuaguuucacacaauuuaauggaagguucugguaaugaguuugggaaagaacuagggucuguccuggagccauagcaagggaagggauuuaucauuaaaguagccuuuacagcucauuuccguucucucucgcaauuaaaaccgcuuucaguaccauucaccgucacaccucuacaaggaagggacuugaaagcagccuuuuucugggcgggauuuacgugucagucuguuccaccaguccgccccccuuauuucucaaaauggccucaggcccauuauaccagagguuucaauuugaaucugccucucaguucagagucguaaacugaccagaccucuuuguauuacguagugcgugcauuugcccugaaggcaccacuuucccagacgaaagcuguuaaaauagugcguguauuccaggaaaauaaaagauaccuuaauuugaacuuuacauucuuagauaguccccuaauauauuuaacauuucaaaauguaugguguugguauagauuugcauguaagcaaaagaauccuauucucugugacacuaugcauauuguacuaggugcugggcauuuuuuacuaguuuuaagcuaaugauaauuagaaaccaguguugugcuguguuuucguugcauuaggaguucacuuaguuaacuuuuuaccgggacaguugaaggaacauugagucaaaauuagaauucauaaaauccguuguaacacaucuaaugugaacgcauuauaaacauguaccuguacuuuuuuauaaccagaaauacuaggaguagucaacaaaaggucaucauuaauauuaguucugcgguuuuuuccacguaauuuaagaaauucugaacauguuuagcaacaagcauauaacuaugacaaacacucuuagcguguuuuauuagauugauuuguaaaacuuaagggaacuauuuuauuuacuggaaccaacuauuuuauuuuaccagaaccagcacauuggauuaauugguaucgcacacuguagguagauacuggaguuuuguuuuguuuuguuugagacggagucucccucugucgcccagacuggagugcaguggugcgaucucgucccacugcaaccucugccucccggcuucaagcaauucuccugccucagccucccgaguagcugggauuacaggcgcccgccaccaugcccggcuaauuuuuuguguuuuuuuuguuuguuuguuuguuuucaguagagacaggguuucaccaugcuggccaggcuggucucgaacuccugaccucgugauccgcccgucuuggccucccaaagcugggauuacaggcgugagccgcugcgcccggccuuguuuuuuuucguuuguuuguuuuaaugcaugaauuguuuccuacuaagaagcuaugauauaguuccuugaccaaaugcagaugaacaggauuaucugauuaauacuuuaacgagagcagacaaaauauggauauuuaauucauccacuugcuuuauaaguguuuauagaguuuguuaggaggggaugcccaauuuccuaaguaaaggugauauaugagcaagacauuauaaaaugaaagagaguuuggccagugaagaaaagaagcagcaugcgcagagguguggggacuugagggaauggcaaggacccagaagugaagucgcuagaagaugggggugggaggacgugaaacgaggcaaggaaagguacaagcggauccagauacuggaagaccuuguguugcaaugcuuuaauuaaaaauuggauuucaggccggguacgguggcucacgccuguagucccagcacuuugggaggcugaggcaggcagaucacuugaagucggaguuuaagaccagccuggccaacauggugaaaccccaucuuuacaaaaaauacaaaaaguagccgggcuugguggccugugccuguaguccuagcuacuugggaggcugaggcacaagaaccgcuucaaccugggaaguggagguugcagugaguggagaucacgcugcugcacuccagccuggucauagagcgagacccugucucaaaaaaaaaaaaauuggauuuuauuauuaggcuaagccauaauuucuuuauacuucuuaaaauauagaaauuguuggcaaauugugaaauuuauuguuguauaaugcuaauagaucaguuguccugaugucuuugcuguaaugauuucuuuauaaaaaugaucuuaaaucugagcucccuaacuuuaguuuuugccuggaauuacccauuacauuugaugauaucucuaaaugucaguuguagcuguuacucugaugauauaaguggaauauacagaagcguacuuagacaaaaguuagguuaauaucugaacuacuuccuccuuguguauuuaagagaauauugacuuaaguuucuagaauccucaacuaauccuaaguuuauuuucuuugucuagaauacuaugcuguuuuuguuuuuggaaggaagagauauaggcauaguuuccugcucucaaggagcuucaaaggcuguaccaguggggaugccauugguauuuuuagcuggauaguuguuauucagaaaagcaggacaaguaauuaugauuccugguccguaccugguaaugccaguaauguuaacucuagcugguuguugacaucuggucauuuaguugccaaucuucuuuuuuuuuuucuggcuuuuaugugaaauuuuuagauuuuuauaauauccugagcuaaauucaacacagggacaccagauugcugcuuuaguucaggguuuccagccugugcacuuaagaaauuuauuuuuguguauaucaagcuguaacuccagagauugggauuguuugauugggucuuuagcagugguacuaauagcaacuucugucucuagaacauuggaaaauuaaaauguguuuaucuaccguuuuuuuccucgagguuauaugaagguagaaaugaaucagacuagaugauuagcuaagcgagacuauuaacccucaucccuuccccucuagacaacuaugaaauuagucauuauguauucgauccuucuugcagucucuucucugacaguuauaaaagugauuuaggcugcauaauguuguuugaaugaaaugaaaauauagacuagagcuguuuuuuuuuuuauuuccaucagucucuucagugaaaacuaacauuugagcaugauucuuuuuuuaaaucauuuugugacaguuuagcaaggcuugugauaagcaaguuaugguaugguaauauuucuaguguccacguuucuucacaugucugguguaugggaacuacuaacuccaucaggaccuugccuauaguagguacucaacauuuacugaauuaaaucaauaaacauuuuuaaugaauuacaguacaagucagaccucuguaucugugggcucugcaucugcaaauucagccaaccauggaucagaaauauuagaaaaauggaagaacaguccagcaauacaaguaauaugaauaaaaacaauacaacaacuauguacauuguaucagguauuauaaguaauuuagagaugcuuuaaguauacugaaggauuugcguagguuauaugcagauacuguaccauuuuauauaaggaacuugagcaucuguggauuuugguauuugcaugguuccuggaaccaaucccccagggauacugagggacuauaguugaucauaccaccugauuuuagagauuuucugagucucagaaguuaauuaaguaaacuacaauagucuguucuuaaccucggaggauacauuccaagaaccucagugaauaucugaaaccacagauaguauugaauccaauauauacacgguaauauuuuuuccuauacauauguaucuauaaaguuuaaauucuaaaucagacacaguauuaacgauaauaauaaauuagugcaagacugggcauagugguucacaccuauaaucuuaacacuuuaacuaugacguugucuuugaaaagaaaucagcuagccaagguggcucauggcuguaauccuaguguuuugagaagcuaagucaggaagauugcuugagcccaggagucugagaccacccuaggcaacauggugaaacccuguuucuauaaaaaauaccaaaaaauaggcugggcgcgguggcucacgccuguaaucucagcacuuugggaggcugaggcggguggaucacgaggucaggagauugagaccguccuggcuaacacggugaaaccccgucucuacuaaaaauacaaaaaauuagccgggaguagugggcgccuguagucccagcuacucaggagacugaggcaggagaauggcgugaacccgggagguggagcuugcagugaaccgagaucgcgccacugcaugccagccugggcaacagagcgagacuccaucucaaaaaaaaaaaaaaaaaaaccaaaaaauuagccagacgugguggugcuugccuguaguaccagcuauccagaaggcugaggugggaggauugcuugaacuugggaggucaagucuagaauguugacaauguuggguccuuuauguaguugcauaagugagccaugaucgugccacugcacuacauccuugggcaacagccugacccugucucaaaauuuuaauuuaauuaaaaaaauaaaauagaacaauuacaacaauacacuguauuacuggacaagaagggcaaauuuaaaaaaaauuaaaccaauaugcuauaauaaguuauaugaaugaggggacccuccccuaccccagaauaucugauuguacuauaucauagguaacugaaaccgugaagagcaaaaacugaagauaaagagacuacugugucuuuuaaguuucuuuucaacucccaaauucuuggauuucucaccucuuggcuuccucaauagaggugagaaauguuaaaguagugaaaacaggaaaaauaacuuacucauucaagaaguagauaaugguccagauggaaagcuugaauuauuuuuguaaaacuaaaauuaaauaaaguagccaggcaugguggcuuacgccuguaaucccagcacuuugggaggcugaggcggguggaucacuugcggucaggaguucaagaccagccuggccaacaaggugaaacccugucuauacuaaaaauacaaaaauuagcugagcaugguggcgggcgccuguaaucccagcuacucgagaggcugaggcaggagaaucgcuugaacuuggggggcggacauugcagugagcccagaucacgccacugcacucuagucuggguaacaucuugagacuccaucucaaauaauaauaauaauuaaauaaaguaaaaaguuucccacaccucauaaaugucuaauaaaaauugaauauguugaguucaaguacucugaaaaaggaguugaauauaguuggagguugguuuuuaggaauuacuauuuuucuuaaauuaacuauccuuguagucaccuaggaauuguguauuuucuauagaucuuagaaaauuaucaaaucuacaguucauuuuguuuuuucaguuuuuuuuuuuuuuuuaagagauggagucuugcuguauuagcguugaacuccuggccucagccaguucucccaucucagcuucugaaguagcuggggcugcaggugccacugagccuggcuucuuuauugguauuuuuauuaaacacuuuucucuaaugucuuuguaacaguucucaguuuuugaaaugcuguuacuguuucuuuagugugaacugucaacuuucauuuuuucuuuucuuuucuuuucuuuucuuuuuuucuuuuuugagacagagucucgcucugucacccagacuggagugcaguggugcgaucuuggcucacugcgaccucugccucccggguucaagugauucuccugccugagccucccgaguagcuggaauuacaggugcgcaccacugugccuggcuaauuuuuuuuuuuuuuuuuuguauuuuuaguagaggugguguuucaccaugucagucaggcuggucuugaacuccugaacucaugaucccccccgcccugccucggccucccaaagugcugggauuacaggcaugagccaccacgccuggccucagcuuucauuuucauuugguuaguuuuugaacuauucaguggguaaaguuguauaaauaagugucuuuucucuguauagaagugucuuggaguucaaggagugcugcuuugcaaacucauagaguauuuauaaaagcuaacugcagaagguauucauaggcuaaaccguuuccuauucuugguagcaccauuuucucuggccugaaauacuuuccuucuacuauuagugccugucgauacccagcaguguauuuacuuuccugaggaacaauucaaaugcuaagugcuuuaagaccuaaggguggaaaagcaguguuuucaggcauuauuaggaaaauaagauuuaaauuagacacccagaaacaaaaacagguuuguaauugguaaagugaaagaugguuaaagaagguuagauugaccaaagcgagaauuuaccuuuuuuuuuuuuuuuuuuuugagacagagucucaugccguugcccaggcuggagugcaguggcgugaucuuggcucaccguaaccuccacuuccuggguucaagcaguucucccaccugagccucccgaguagcugggugacaugcgccaccacgcucagcuaauuucuuuguauuuuuaguagagacuggguuucuccauguuggucaggcuggucucgaacuccugaccucagugaucugcccgccuuggccucccaaaaugcugggauuacaggcaugagccacuguguccggcugagaguguaccuuuuuuuuuuuuuaucaagcaaucuaguacuugauccuaauaaucuuugugguagguguuugcauuuuuagaugaggaaaagggaaaucuaugaguccuaggaaauacaguugguauaugggaacugauauguaauuagacuuaagugauccauguugaauuuaugacuuaagcacuuaacuauaaucuuaaccucuccaguugucugaugaaguuaguauaugggaacugauacauagacuuaagugauccauguugaauuuaugacuucagcacuuaacuauaauuuuacccucuccaguugucugaugauaauaaaaacuugaagcaguuauccauauggggaucucuuuggggaaucccagucaccaaaaguuagguuuucuuuaauauuuuuucauggaagauuucaaauauacucaaaauugaaagaauuauauaauaaauucucaugagcccaucacacaucaauaaugaauguacagcauugcaguguggagcuuggccuauugcugaccacucagcaauguggcagaaccacuccaugauuccccauggaaaugggaacuacuucgguuguccuuuuauagaaaaauucaguaaguaucugcugauugugcccuacuugugacuugaagccagguuuuuuuuuuuguuuuuuauuuuuuuuguuuuguuuuguuuguaacagucuugcucugucauccaagaggggcaugauauuggugcacugcaaccuccaccuccuggguucaagugauucucgugccucagccucccgaguagcugggacuaugggcgugcaccaccacaccuggcuaauuuuuguauuuaguagagauggaguuucaucauguugcccaggcugcucucgaacuccugagcucaagcaaucuacccaccuccaccucccaaagugcuaagauuacaggcaugagccaccaugacagcaaagcuggguauuucuuaaauugguucagucaggugcaauaaauuauuugcccuacucuaaaauuuaaaaaucuucuaagaauuaugguuuugcagcugagguuuuuuuaagacucgagcucccuggacuccuacauauauccuuagaacaacauuguccaauagaaguacaaugugagccacauguuuuguuuaacccagcauauccaaaauauuacccccuuugcaugugcuuaauauaaaaauuuaagaugauuuauauuccagguuuucaauauucagugaguaauuuuacacuuagagcaaguaucauuucagacuagucacauuuugaguacucaauaaccacauauggcuaguggcuaccuuacuagauagcauagccuuugagucccacaaaguguucacauucuauguguuuacacacaucuuuugaagugucaugacagagccagauaggauccagauuuucuuuaaaucuggucucucuuccggauuccuaguugauuacuucuuuguugcuucuuauagggauguaucagaaguuuaauaaucuuaugauuauuauguuaacugccugaaguauuaaugguagcaauaaauugaacuauaauuuuaauuuuucaaguaaauuuucuuaugugauacuaaauauuucacauauacauguaucaggaaguaaauggggguaauuuaguaaugaauaguauauaauaguuuaugaugguauuuuucuuuuuuuuuuuuagauugcagcaaaaauuggaggugaugcagggacaucacugaauucaaaugacuaugguuaugggggacaaaaaagaccuuuagaagauggagguaaguuauacucuaaguauuuuaaauuguuuuucagaguguuuaguugaagugauucucgguauuuuucuguuauuuuauugagauauuaacuuuuauuauaagguuguuaaaauuguaagcuguauauuggccuaaaaggggggaaagaaaacuagacaagguaaguaaaauuugaaagaaauuuuuuaaaaaauuuuuuaaaaaaggaaguuuugucuuaauagaaaacaauuuauuuucccucuuuuaggauugugccagauugaaaguuugcacagacgucuuguuaauaauauuaaaaaacauauaaauugcuuagaagacacuucacugguuuuacucauacgugaauggauuuuaauaugcuguauuuucgucauuuuucuauuuccaauugcaccuuaaagguugaaauuccuauaguuugcuacucuaguguguugcagguuauaccauuuuuuuuuuaauguucuuuacuuucaguacuuuuguguuucacguuuagcuuuaaaccuguggauuaaaacaguggauuuacagugcuauguauuuuuaaaaaucguaaucguugaagcuucugaacuuagaagucugcauguauuuuuuguuuuagguuugauauaugaguuuugauacauuuucuuuuuacccuuuuuuuuaaagggaggauucucacugaggcuauagaauguauuuguagcuuuugaccaggagaacuugguuuccuuuuauuuaagugucuuucauauuuauagugagguuuuuaauguagaaaaaaaaugagcuaaugaugcuucagauguuguauguaauguauucuuuuuauuuuauguguagauggcucuuggacaaguccgagcaguacaacacacugggagggaaugcccucuccuuuuaaaggcaggaauuuuuauuuauuaccuguguucaguauguaaacgugaaauaaaccaguggauucuuaaauggacacaaauauuucuuggauuaugugucugcgcauauuuuauuuuugcugcacaacauucugauguuuaaucauuuaaguuugaaggggggaggagaauguaguacuuugagcuauagguugucuguuccaagguaugcauuguauucaucuguguaauggauuuaggugaagguagucauguaguugcuuugagauuuuauuuuuuugcuaaaguuuuaugcagugaaauguuuguuuauaaauaauagaacaguuuagguugagauugccuuguaauguugugggggguuuuuuuguuuuuuuuuuuuugggcauagcuuuguggucacugucagauacacuuuaauaugucagauuuuuguaguuugauaggcuuuucuccccccagucuucaguuccugagguggaagcaucauuagccuuuagcaugugauauuuugcuaguaauggaccuaaaguacguugucuugugucauucuaaugugcuuaacauacauuaaggucagugauuucuuaagaaucagauaacuauuuuaaugucugugcaucuuuugaacgugaagagaaugaaguaucguuucuuuuuuagauuacugaguugggguugaauuuuggcaguuuugguucaaaugauaaaccauaccuucagauauuucaauaaauguuuauauuguuauuuauucuuguuugggaggggagaagcuuuguacuuaauuggcaaaaaauuaaaagacacuuaauuuugcagaucaaccagaugcuaagaaaguugcuccucaaaaugacuguaaguauuccuuuuaaacugggucaaaagcuaaaguaacaauuucaauguuaagauuuuguucauauuauuggguaucuuugaaguuaguugguuuaugaguauuuuggaucagcuagccugaauuucuuuguaaauauauaccuuuuucuccuauuuuacaaucugucccauuaauuguggccggguauauguaaagauugguugcugaauuauuuuacauauuuaacaacuccaauucuugaucuauacuuguacaacuugaaaaaggaaauuauuuuguucugugccauugcuaauauaaugucuucccuuucauuggcucucuugccccugucaaugccaauauaaauauuguguaaaaaauuugacucucuucaagguguugucugugcauuagggagagauuuuugaauguuugaugugauuguguuguuaaauauauaaguaaauuuaaauuuugaauuuuuguuuuauuuuuauuuaauuuuuugauagcuuuuggaacacaguuaccaccgaugcaucagcagcaaagguauagucacaagauuuucaaaaaguacucugcaaguuuugguugagcuguauguaaaaacacaaccacauugguguauauugaauaugugucuguguauuuuuugguguaccuaguucauaucacuccccuugggaagguaccauaaagugaugauuuuucuuuugagugagaaaaauuugugauuuggagagauagguggaauuaaccacauuuuagaagaacaggggugaauuagaguaacuguuaagaugacauucucuaaacuccacuucaacuucuuuacaguuaaugccuucagacuguuccauucaucaucccuucuucacuugaugugucaucuuaaauuucuuaauuuaacuacucaaguaauaagaucauauuuuuugacaugagucugagccuagaaccuuaguuuaagccauugggagacauuagacuuccauuuuuauuaauagauuaucuuuuauuuguaaacaaaguaucuuucauugaaggaaaauggugcuuucuguuauuucuuagcagaucuguaaugacagaagaauacaaaguuccagauggaaugguuggauucaguaaguaacuugauuuuuaaaguuuugaaaacaugaucaaaacauacuuuagaaucuuucaaccaaaaaaaaaauuuuuuuuuuucuaacuaguaauuggcagaggaggugaacagaucucacgcauacaacaggaaucuggaugcaaaauacagauagcuccugguaauguuacauucucaugguauuuucagugugacuagaaaacuagcuuuuuuuuuuuuuuaagccuucuaguaacaauaaugcuacuuuuaaucuuuugaccugaaguuaucuguuuguuuuaaauuguagacagugguggccuuccagaaagguccuguauguuaacuggaacaccugaaucuguccaguaaguuugaaaaaucuuaaaaaucuacuuaaguaacaacagcagaacucuuugaauuuugucucuucucuuuguuacugcuuuauuuuacacugugguuucgcugccaccuucccucaaaguccuccaacuccuuugaaguuuaugccucaugccuuucucaggugggguucaucaucugaaucauuaaacacagaaaaugguuaaaacaacuccauaucuacuccagucucuacuuguaaagccacguguagccuggagaagaaugcacagucaggucgacuggugacacuuaaaacucagacauuaagcucaaguggacuguuguguugccugcauuucccuaguuccauucacuuuuccacuccucucccaggcucuuuaauacuguauuuccccaccuccaaaucuucagcaucuaaccccacgcucucccacuuaagcuuauuuacugagaaaauggaagcaaaugauaagaagcuuuucuuuuucccuaccacuaaaccuaccagccuucauuuuuccucuguucacauaguacucagguaauugcuuuccuuuuguguucgagugccuaaagccagcccuuucuuccuacugaagguucagcuugcaguuguacuuucuucugcauuguuaguucucccucauuacuagguuuuuucuuuucuuuuuuuugagacgaagucucgcucuguugccaggcuggagugcaggggcacgaucucggcucacugcaaccuccgccucccgaguagcugggacuaccggugcaugccaccacacccagcuaauuuuuguauuuuuuuaguagagacaggguuucaccauguuggccgggauggucucaaucucuugaccucgugauccacccaccucggccucccaaaguccugggauuacaggcgugagccacuucccccagccugauuuucuuuauggcacuuuccaaauaauguguuauucauuugacauguuauuuuuacuuauuuaaugaaaugaagccacucuagcaggaacccuguuucuuugagugcuauuaccccauuaccuagaauagcaccugcacauaguugauauuuaaauauuuguugaaugaauaauuguagcauaugaguaagcaaaaugguaguuuaaaaauguaaauaaaucauuuaguucuuggaagaaucaguuuaauucugagauaacuuuagcauuagaguucuuucuuggaaauuuuggacuauucuuaaaaauaaaaauuguauaucuagaaaauuuuuuugcauaaucucucaaucuuugacccuugauggcauuuucuuucaguuaaaaguaaaagcauuguuaaaguuagcaucaaggcaccuaauccugaacugggauaggaggaguacuugguuauauuguuuuauauuucucuauuugaauaagcuuggguaugcuacagcuuacuauuuaaauauuaauuuguuaacaggucagcaaaacgguuacuggaccagauuguugaaaaaggaagaccagcuccuggcuuccaucauggcgauggaccgggaaaugcaguucaagaaaucaugauuccagcuagcaaggcaggauuagucauuggaaaagggggagaaacuauuaaacagcuucagguauuguuauuuuugugaaauggcuacuuuugaucuguuuugaugcccauuuuuguccacuucuuuuguuaauauauauuauuucuaugauuguaacaggaacgggcuggaguuaaaaugguuaugauucaagacgggccgcagaacacuggugcugacaaaccucuuaggauuacaggagacccauauaaaguucaaguaaacuuaacuuuauacuuuauaaagaaagaguggguugaaugggguugggcaaaauaugcaugaauaauuaaaauguuuugagacaugcuuucuaaauuagcuaacuuuuucugcuuuagcaagccaaggaaaugguguuagaguuaauucgugaucaaggcgguuucagagaaguucggaaugaguaugggucaagaauaggaggaaaugaagggauagauguaaguaaaaauacccauucagaaaugguuguaugcuaauucauaaauauaauaguguuuucuguuuuguguuaaguagcucuaacauuguuauccuuuuauuucaccuuuauacuuuagaauacagaauucuauauaucuuguuacccuauuuacuauaaauauagaauuauauguacuuuuaugauuugaggcagauuuucaggaaauggcgcuuuuuuaaaauacuuuuuuuuacuuuaaacccugagaagcuagcuuucuuaauacuuagucuuuuuuacauaagguccccauuccaagauuugcuguuggcauuguaauaggaagaaauggagagaugaucaaaaaaauacaaaaugaugcugguguucgcauucaguuuaagccaggugaguacauauaauaaucuuguaaguguuggcagcagugaguuuugacauacauuuauuguuuaauuaauuuuguuucuuuguuuugaagaugaugggacaacacccgaaaggauagcacaaauaacaggaccuccagaccgaugucaacaugcugcagaaauuauuacagaccuucuucgaaguguucagguuugauagaaaguuaacauuuucauuuuuuguuuuuauggaaaaguauuuuccuucaugaaaucugaaguuaccucuauaucagagucugcuugaugaugcuuuauuaauggagaaaguuuaaauugcuuuaagguaaagaucuuggagcaggaagaacuacuaccuuaagugcuaccuuauuuacucuuguauuuuaaaaaauguuauuacuuauuagggccaguucaucucuacauuucugauucagguauaugagagcugggaaaaauaaacuuaauaauuuuaucaugaaacaaaaguauuucugugcugacucuucguucuugucuuucccucucuauaggcugguaauccugguggaccuggaccugguggucgaggaagagguagaggucaaggcaacuggaacaugggaccaccugguggacuacaggaauuuaauuuuauugugccaacugggaaaacuggauuaauaauaggaaaaggcaauguauuuuaaacucuuaauguuuuaacacauuauucauuuuucuggacacuuucuguugcugucguaaacaaguggcaaugcuuuuucucugaccguauuuuaguagaaaagaauucuuauguuaauauguaacaaguaaaacauaaaugagggaucucauguauauuuagagaaagagcaggauuuuaaucuuacuagcuucuagagaaagcgaacuaagagauaauuauuagcauaagaaaugucuuuugacccaaaaagugguuugaguguuuuuguuugugcauuuugguuuuucccgacucauauuuuaaaaauuugaauguuuauaaguguauuaguuuauauuuacacugcuuuuaaaagcaguuaauucaaauauuuuauuauaaucacauuaaguuuauguuuaaacauacuaaguaaauguaaauguauuuuaagagaagcaugaaaugcuuccuaaaauuugauuuucaguguagaauauuaaaugaaaaaucuuaauacaauauugucaauuaggauacugaccaaaccauauuuuuaauggcccauuuaauugugaccauuuucuucuaaauagcuccuaguacacccuugaaaccuuuagagaaauuacugucuuuugauuuuaggaggugaaaccauaaaaagcauaagccagcagucuggugcaagaauagaacuucagagaaauccuccaccaaaugcagauccuaauaugaaguuauuuacaauucguggcacuccacaacagauagacuaugcucggcaacucauagaagaaaagauuggugugaguauacuuuaaacuuuuaauuuuuaguguagacccuuagacuguaguuaaauuaagacguuuauucaaauacaucaaaggaaaauguaucauuacuagucagcauuuauagauuucaugauauguauaauagauacaacgugaagauuuuccagcaaugaaaauaaccuaauuaaauguguaguuacagguuuugagaacaaccuuacauuuggguguggcuagauaagaggaggguaguguuaccuguaggcaugauauuaguguugguguaggauuguggaacauacuugaaggacauaguuaacgggaauucauuauuuauuaagauuuuacucuacugaaccccagcgaggcaaacaagauaaaucagauacaucugccacucuacaguagaaauucauaaauccuagguuuuggacuggcucacagaucaucuggggguauuaaaauguagacuauuugggugcuucccacuccuacacauaauauacagagacagaccugacucaaaaugucugggauagggcccagcaucuaauuuuacauagauguuugggugauucuggugcacagacaaauuuggaaauuuuuccuccaggaaaguuuucuguuagaacaaaaaaguaugaaacgcuuugacugcuuuuuuguaagugaggcagacagugucuuacuggaguuuuuaacacaaagugugcagggggcaucuuaaauuauuagaauugccuaggaaaaauuauuuuugguguuugccaugcugugaauggggugcgugcaaaacaagguugacacuguuucugucaacuugggaagacaaaaauagauguacaaaagacgcuuaaggaacgucuuacaaaauguacacaaacauugugaguucuguuguauggauaguuuaaugguucaaaaaaugaagaggauguuuguagaguaaugauagagguugaugccauggcaaaaaaaugaauagcacucaucuugguuuuuuauuuuacaguauuagccuaacaugcaugcgucaggauuucuguuggauucauggaaaaacaagauagauuguuuuggagaagcaauuugguguggugauuaagagcauggacucuguagucggguugccucaguucagaauucugugaaucauuuacugguucugugaccuuggagaaguuacucaggcuuuucugugccuugguuuccuccuguaaaaugaagauaaugguaucuacuucauagaguuguagggauuaaaugaauguucaugugugugucacuuaaaagaaugccugccacauaacccuaaaaaauguugcuacuuuuucaguauuauuuuuacuacuuggaaagaauaggucauggauaguaagugagagaugacagcaauuggagauuuaaagagacaaguuaauaaaaagaacuuuaaaggucaugaaguuuaguuucccuauuuugcagugagaaauuuacaacaaaauguaguguuagcauuuuguccaacaugucgccugguuguguuaacuacucagaaggagcauuuuaggacaguuaaguguaaugucuuuguuggcuuaaccaaacagaaaucaguuaagcguuauuaaugauguggcaugcaugcaugauaaggauauaaaauauccugauuuauugaaggaauuaaaaagggaauuuuugugcuauuaaacaucaugauacaugaaaggccaaaaaggauauaaauuauugaucugaaugggauuuuagugacagaaauagguugugagguggauuuuaguuucauagugaaacaacuagcuauuaacguuaucagugaaauguucagaagacgaugauacaggacccaagcgguuugggaauauauugucaagacgguugucucauguuaggcaaguagauauagagagaagagcugaagauaaggaccugauuucugugaguaagauggaaaaagauaguaaaaguaagaaugauaaaaggaaagggaacuacugcuguccgcaaacaagcuaaaggaaauuuaauugcuaauuuaaauuuaauuuaauuuaaauugcauuuaauugcuacugcuauugauuuuagugaauuuuacaugucucauuauuauggcagaugaaauaguuuuugcaaaaugaaugaggaaaggaaggaaaaccuaaaauuuguuauuugugacuauaagaggguagaaauggaugauuauuuggccguagaguuguuuaaccauuacuguguuuuucugauuuuucuaugucauccuuuuuuuuguagggcccaguaaauccuuuagggccaccuguaccccaugggccccauggugucccaggcccccauggaccuccugggccuccagggccuggaacuccaaugggaccauacaacccugcaccuuauaauccuggaccaccaggcccggcuccucaguaaguauuggguuuaguucugggcuuuccccaaagauucuaguuuugggacuguuuuuuaugcugauuuuucuuuucagugguccuccagccccauaugcuccccagggauggggaaaugcauauccacacuggcagcagcaggcuccuccugauccagguagaagaugcuuauuauuuguguguuaucuguauuauuuuccacuccuguuacauuauuaaauuuucuaguguugauucuacauuuguaugcaucaccuucacucacuuuacucuuucaacaguguuaggcacugccucuaccccaguguauaggacugacaugaauaugagcucugcuuuuauggaauuucuuucuacuugccuuuggcuuaugaguugauacaguagaaugauaaaagcuaaaagcugcaggaaagagcacagugucauagguuuuggauaccagugcugucaaauguguaguauguucauugugacauuaucuguggaaaaauaguuuuuacuuauuuagaaaaguaugugauaggggcugggcacugaggcucacgucuguaaucccaccuauucagaagucugaggcugaggcuugagaccagccugggcaauauggcaagacccaucucuaaaaaaauuuguuuuaaauuagccgggcagggugguaugugccuguacuugaggcugaggugggaggauugcuugagccuagaaguucuagauuguauugagcugugggcacaccauugcacuccccugggcaacagaaugggaucccaucucuuaaaaaauuauguauauauguaacagucuauauaaauauauauauauaacaguccaacagaguguuaaguauuggggcauuaaacuuccaaauugucaaauaagauaucuguucuaguacuccucauaugacaacuucaugugaguaaaaaucaggccuguauuuaauaacugcaugcuaaagcccaaauacguuuaauuauuuucuauauucagauuuauuuuuauccuauuauauucuggcaucuuuccauacccuguaguuugcuuuccaucuuggucaaagagucauucuuugaaaccaauuaacauuuauuuaugauccuuuuuucucaccugcuaccuaccuuuuaggccucuuucacucguguaguuucaaggaaaauauacucaauuauggaauacuuucuacacauaauacauuuaucccaaaaaaacuugaaguaauuuauguaaaugaaauugcuugauuaacuucauaggaagugugcuguuuggaauaugaugacacagcaugacaguuaccaagcaugacuugaguugugcuaggauauaggugugcaaaguugggguuguguucuauagcaaaagaaugcacucccagcguaagcaacacugauggaaggggcucacaggguacaggauauaauacucuuaacaacuaauuuuuggagaaugaaagggcuuuucuuucccucuuguuggcugauugggaugguauaauuaaugggauugaagaguuugaguagguuaaaaggcagauucauauuggguaacuuggaucugccaggauuguauuuuugagcacuacugggugguuagcaugauugaggaaaaaugaugggaauaagaaguggaaguggucuuuguaucacaaguugaauuucucacuuggaguaguagugaagucacuacuguaagagcuggucagugaaugugguugcagcauggccuuugggcaagaaguaacccauuuaacuaaaaccagcugguuggccccacucagauuuaucaaaggguuacugggucccuggggguggauauugcuuauauuagacuuagaauagcauacuguuuuaauauuauaugaacuaaaauguuucuuuaaaaaaagaguggucuguuaauggauuuauguaguggucaagaauuuagacuucagagucaaauaaaccuauaucaguccuaguccuacaguuuacuaauugugagaugucaagcaaguuuuugaacuccucuaagccucuguuuucuuaucuauaaauuaauaaaugaaugaaucggguugagugaauauuuaguaaauucuuaguacauacuaguuauuuguaacugugagacugguuuuuugguaugguuuucacauuugggaguagaaauaccacuuccuaaagucuguuuuaucucaaauucucuauccaggcauaguguaaagugaaauaccuagauuucuugauuaauauacagauaauggccagacgccauggcuaaaaccugugacgcuagcacuucggaaggcugaggcgggcggaucacuugaggucaggaguuggagaccagccuggcaaacauggcgaaacccugucucuacuaaaaauacaaaaauuagcuggaugugguggcaggugucuguaaucccagcuacuuaggaggcugagacaggagaacuccuugagaauugcuccacugcccuccagccugggcaacagagugagacacuucaucucaaaaaaaaaaaaaaaauacagauaaugacacuauugagauauguaaacauccaacauaaaaaagcaguacauugggcaauugagaaaaguuuggcagguguccuaauaacaccuuacaauuauauuaccuugcaauuuucuuuuucuagaaauucuugcucauuuuucucaaacuugacuaaccuuuauuaagcagcugagaauugcuacuguucagaaugaagguauaauagaaaauuuaaaaguuuuaauuguaugguauuccuaguauaaaagacaaucaaguuuuuucugguuucuagaagauugaaaggucucaaacuguucgcacuucaguugaugugggagaugagugagggucagucaaguguagaggagacaacauagcuaaaagccgagacacgggcauagugauuucugaaaaguacaagcacuguguuguggcuggagcuuggguguugaagagauacaaccaaagggagagaugaggcugaaauggaaaggauaagccaggggcuucaggcuguuaaagauguugaaugauaggcuguacuuaagcuuugaacauccugaagauugcagagaaugaagaauuucaaguaggaugacaucaaguuuauaacauucaaugugaaauaggaugaaauguggcuaaucuuuuuuaagauuuuuauauuuucucuucauugaaaauaaggacaaaguucauuguucuaaaauaauuuucuuucuuauacagguuagucccuagaaauguuuuucuuuagucaucuucuagauagagcuguuugugcuugaggcgaaaccaauuuagaaaaaaacaagggcacaggaugguuugagacagagcauuggauuuggagccaaaagaccuuuauucauaucccaguuaugccacucaguaguuuuuaaccuaggaaagucacuuagucucugagacuugguuuucuuuaauaaaagcugauggugacaacaaaaauaauagaaaauuuaaguuuucauauacuuuuuuuaauguucuaguuaauuuugggggcuguauauuugccagagagcugggcggggggguggugugugugugugugagagagaauuacagacuucacaugcaaaccuugaacuuucauuuauuuuagcuaaggcaggaacggauccaaauucagcagcuugggcugcuuauuacgcucacuauuaucaacagcaagcacagccaccaccagcagccccugcaggugcaccaacuacaacucaaacuaauggacaagguaacuacagaacuuauuguaugugaaagccaaaaguugugcuuggaauuauauaugaaguacaucacuguauaauaccuaaaauuucugacauuauuuaauuauaauuuaagcagacuuuuccuuuuuuaaauuguuacuuugaaauaguuucaaacuuucauaaaaguuguaagaagaauacccggagcacccagauagcccagcuguuaauguuuuauucccuuguuuacucuguuaccaucuauaucauacauguguaucuguauuuauuuuaaauauccauuauaauuaguucugaaggaagcuaauuauauccagcauaauuaguucugaaagaaaucacugaagacuaaacuguagacaugauguccuguuggguacuucuucaaaaauacauaaccaucauacagcccuccaaaucaguaagucaacauugauauauuaaguucuuuauaucauuauggauuucugauuuuugcaguagguuauauuuuuaaaguauuuuuauaauuuugauaaucagauuauccuggauuuggccagucagggaguauauucaggguggugccuauauccuuuugaaauaccugucauucuuuuaagcacuuccauacugucuggcacaguaagauuguuauuuugugcuuucugggcuccagcccucgagucagcuauuucuucaaggagcucuuauuccuuuuaguagaguaugguaguuagaaacgagacuugaguaugcuuguugcuacugagguguaauugcuucuagcuucuuucaacaggcagaacuaggaaauauauuuacauacaugcauaccuacauacacacaccaaaaaacacauaaacaucgauauauguauauauuuuuaaaaacuauguucauaucaccacauccguuucagcauuuugggguuuucaagccuuuuccuuuuuuguacuuguuuacaaacgugagaaaccugguguccucaguguauuuccuuauuugacaugcauuuacuuauauguucaacauaaccagucuucaaacagguugguuuucuuuucuguccaccaccucuguacccccaguaccuucuaucuuuggcacuguuagggaugccaccaccacauaguacuucccuccuacccucacugucacauugcaggccccugccagcuccugcacccaaggaaacggccaaaauugccuuuuaaaaacuuuaauucuguuuuuuguuuuguuuugcuugaacaaggagaucagcagaauccagccccagcuggacagguugauuauaccaaggcuugggaagaguacuacaagaaaauggguauguuuuauacauuucuugaaaauacauacuuaauuaaauugaaacaaauuauucucuucaggaagagaauaauugaauaaaaucacuggacuuguaaacauaucaagacaguuguaaauuauaguuuuuaaauuugugguuauauggcaaggaaauuuuuuuuucuaauugcauuugucaaccaguuauuaauugaaacuagaaauguccuuacugguacauacaauauuaacauuacuauacuuuugacaaugacaguuauauauauuaucagucuaaaugacauaagguuaaauuuuaaugugucaggcgaaaauugugugugauaccauuauuuuugcugcaagauaagcagguaagaaguaaucugcagugacggaaaguaaccaagugauggaaccagaaucuggcuuccaagagggucugagucccaagcuugucucccaaauuugucucuuuaggaaccauuuggaaccugauacuauacuucuggacaaaucacuauauuucagcugcuuuugcucuuagucauuuaaaauuauuacauaccacagcuagaugucacaaaugaaagcuaaauugguaagcuugguuauccuucacuagcagaaaaagaaccuauaggugguagaguuuugucauaagagaacggucuacuugggauuuucaauguuuucuuugccaaagaauguuucucauucuccacagaaagaaaaauuuccagaaaggugaugauuuuaaucuucuagauguaaaauuacauauaccugaugauaaaguuguuuugcacaacugguuucuuuuuaaagaaaaauuguuuuuccucuuagaauggcuuccuaggagagucauguuccgucucuuucugaggcuuuaacagauuauguuuuugugaccuagcuuaggcagaucuacaguagcuacaauucggcaaaaagaaacuuuuaacuuaaaaacagcauacucugauuaagguugguuacauaauuuauuuucugaacugggauccuuuuuagaaugaauagggaugcuauuaauaaucaugcccugacagcauuguggucaggaccuguaaucaacuuaacuuuaauuaaauagcaucaccauuuuaaaagacuugagcaugagccacgugcgguggcacacacuuguagucccagcugcuugggaggcuaagguggaaggauuccuugaacacaggagauugaggccagccuuggcaucauagugagaccuggucacguguuuggguuaaaaaucacuaacuucaacuucuauuuucucaauggguaauguccccuagauagggucccuaguuauuauuaaguagguaaaaauaaaggcuuguuaauggauuuagguaauuauggaggaaugaguuuggcuucugugcuuuauuuuaccauauugauuauuuguaauauggccauuaauacauuuacuguuuagucuuuuuuguuuuacuuuuuauguuuuacucaaaaugaguggguggguggaauucuaauuuuuauuguuaagggaagacauuuuaccuugucuuuaauuuuuuauuuuuuuuuaccauuucccugccaguuagagauacuauacuauacugucuugaauccucuguaggaaaacauggcauagaaauaauuaaauaauaauuagauguuaaauaauaaugcuguaugacuaaagaaccuccuuaccccaccuuuucuguuguuguucuguaguaccacaauaaucacuuguuaauuuuauuuauuuauuuauuugagagggagucucacucucgcccaggcuggagugcgguggcgcaaucucagcucacugcaaccuccgccucccagguucaagcgauucuccggccucauacucccaaguagcugggauuacaggcgccugcuaccacauccggcugauuuuuuguauauuuaguagauacgggcuuucaucauguuggccaagcuggucucaaacuccugaccucaggugauccaccugccucagccuuccaaaguguugggauuaugggugugagccacugcacccagccucaccuguuaauuuuaugagcaaaacagauuaguugggcaaguccuucacaugcauaucucguuguuguuguuuuuuuuaagacggagucuuggucuuacuccccaagcaauggugcgauuucgucucagugcaaccucugcuuccuggguucaagcuauucuccugccucaacuucccaaguagcugggauuacaggcgcccaaccacacccagcuaauuuuuguauuuuuaguagagacagaguuucaccauguuggccaggcuggucucgaacuccugaccucaggugauccacccgccucagccucgcaaaguguugggauuacaggugugagccacugcgccuggccacauguguauaucuuaaaggaaauaaugcuagguaauuuagucaggugcuugaugagcauuugucaucaucauacggagucaauuugucuuuuucuauaaaaguucuuuuuguaaaugauuaguugcuuaacugcuuuaauuucuucuagguaccuuaccugucaucaggaucuuuuuaccacaaauaagaaaccuuaaagcauaaaacuugguucagucuucacauuucuuaaauggaaggagaaagggaauaauagggagauaucuuuaucucaaagccaacuguuguugacuuuuccaguggcagggguaugaugcuaggacuucagauuuccugauuccccauccuagugccccuuuugccaaacuaggcaggcuuucacagcuuuuggagccuaauuuaaguuuuucuuguuaagaacagaaaacuccauucauagauuuuaauuugucauuauuugcuuauuuacugaaaaaaaaaaaaaacuauugaaaacagguguggguuaaguuucccaaaauuagguuuauauuucaaaacaauucuaaguucccaaggauaacaccaaacuaagaggauaaauuuuuauuuuauuuuuuuuuauuuuauuuuuuugagauggagccuuucccugucgcccaggcugaagugcaguggcaugaucucggcucacuugcagcauccaccucccagguugaagcaauucuucugccucagccucccaaguagagaaaaucuugauaagauuucagaggcuuauaaggaacagcaguaaagauggguguuuuuaaagcuagaauacagggauuuuuuuaagacccuuaagagaacaaacaggguuucaaaauagaaaggaguaauucuuguuuggagaagugaagacauuugggaaaaguuugacuugaggaaggccauuaugauaaggacugaugugguagacucugaacccugaagaaucugguaccuuaagccuaaaggaggguagagugaggacuugugggaaagguacaguuauaugggaagacaacugagugugaaaaucuauucaugcaaggcuggcucuuaggcucuaauagaaucuugcaagcuaacucuagagcaagucuuuuaucuuugggaugaaagaaauuuaaggcuaaacuuuauacauuauaauuauaaaacuauaauaaauauuagauaauguucuacugaaguauaaacucaacuaucuggcaucaaacaguaacuaagccaugaucacaccacugccacuguguucuggccuaggugacagagcaagacccugucucaaaacaaaauccaguaacuaaagagaggaauaaggggagcgcaagguaaggcaguacaugucugaaggggcagggaaagaguucuuucucuacuuccaacugggcaaaauaaaucacauuugcccuuuagauuggaagagugaaauaagcuuuucuugaacaucuuuuaagauuggagugucaaauauuaccaacuuauuuaccaagaauuugguuuuucuuaaagucuaaaguguuuacuauuagcuuuccacagggauauaggaguuugcagagguuguaguuuuuuaagggaacaucaaugaauuuucuugaugcauaugccuguuucuaccauuuuacauuguuaauuugccucuaaaaugaguaacucuuacaaugggguuuaaaaccugaagacuauugauugcuaccuugaucagguuugguuucaagugugcacccuguaagagacaaugugugguuuuauugcuauugucacaccaguuuuuuagauauugaaaccuguuucagauuugcuugaauugugucuuguaagaggaaaauguuaaacuuacuuccucuuugagaacaguuauuuauagaagacaggaaaauaugagaauuuuuaauaguauaugagaguucucuguuacccaagaaaagaggguuuuuuucaggcauuuuuaaagaaucauaaaucuuaaauucuuucacucaguugcuuugagucugugaccuguuuuacaauggugauagacugcuuucugaaacuaugaaauuggucuuguuggcagcauccuacaaacauaaaaagagcuuccuguguguccaugcuccaguauuuuugucuaugguaguuauuucacaaagccaagcgaguuacaaacgaaauaaaauagugcuuaaguaaagaaacugaauaggagaacauauacucucucuucucaauuuuuuauuuagaaaauuauauaccuucagaaauuggggaaauaaggcaucagacacucagcuucaucauuuuuuaaaaguuugcuguaugcgcuuuauauguauguuuuuuguguaugaaccauuucaaaguaaguugcagacaagacaguuugcucuaaauaaacucaaugucugggcacagugguugacgccuguaaucccaggacuuugggaggccaaggcagguggaucacuugaguccaggaguucaggaccagccuggacaacauggcaaaaccccaucucuacaaaaaaagagaaaaaugucagcuaggcauggugggccuguagucccagcuacucuagaggcugaggugggaggaucaccugagcccugggagguugaggcugcagugagccaugauugcaccgcugcacuccagccuggguggcagagugagacccugucugaaaauaaauacccucaauauuaucacaaacauacagacuauauuuaaauuuccauaguugucaggaauaugucuuuugucgucuguguguuuuguuuaauucagaguacauucaagauucaugcguugcauuucauugcuauauuucuuuaaucucuuaauucagcaaagucaccuuauuuggaaaaagaccugauugugaaagcugaguuuuauguguuuucauugaucuuguucuuuauuccuugucagguuacuuuuaauaacauuguguuguaauuggaauaaauuauuaauacuuuuaacaucuuauuauguguguguguacauacacuuuauagguuacuaaucaggaaaaagucuuggcuaggucuuaauacagucuuuaaaucauugccuuuaagugggcuuaaaguuuuucaaaaauguucuuuuuguaauucuggaaucgaauuaagauuaugccuaaaucuuuaccuuccuuagcuaaagcaguguggauuugggguugauucuguuuuuuuacuaauaaugacgcucuagaacuaaaaguuaacgauuaauuauaaggcaaaaagaaaagagcguucuuuuuuuuuuucuaauugcagaguaguuuccugacacuacuaaaugaauauuuuaaauaaaacaggaguaauucugacccucugugcuuuugucuuauaaccuguacuuacaguggauguaauuuuauauuaaaguuuagggguuuuuuuuuuuggucaacaagggcaaacacaagauuauucaaaggcuugggagaaauauuacaagaagcaagguauuguuuuuauuagaaaugagauguugggcuuauaauugugguuacagcaacaaaguucuuuuuuuucaaaggucaggcaguuccugcuccgacuggggcuccuccagguggucagccagauuauagugcagccugggcugaguauuauagacaacaagcagccuauuaugcccagacaaguccccagggaaugccacagcauccuccagcaccucagguauaauguaauugcuaauuuguugauuucuacuccagucuguuuucugcauguuuacuguuugucuguuugggaguguuugccuuuuaaauuuuuaucuggcaaaguauaauaacuauuuaaaugaaguacuacgguguauuguuuggguuuuuuuguuuuuuauaaugcuuuccagcaucugaguggugaauauuucugcaaugccuuugauuuuaaaaauaaauuuucuucccccagggauuugcaaaucaugcaagaagccaccaccauuuauauuaaccacuuuuucuuucuuaaaggauucacuccugaauuagcuccauuucaaggauuuucuuuaacuuuuuguguauuucuuauguaucucuucugcacagggccaauaauaagaaguggacaauacaguauuugcuucauugugugggggaaaaaaaccuuuguuaaauauauggaugcagacgacuugaugaagaucuuaauuuuguuuuugguuuaaaauaguguuuccuuuuuuuuuuuuuuuuuugaaaauguacaaaauaucuaucacuacugauaggagguuaauauuucuguguagaaaugaaaauugguuuguuuuuaguauuuaguguagauguacacauuccagcaaauguauuugcaauuaugugguugaugcuuugugauauaaauguacuuuuucaauguauacuuucacuuuuaaaaugccuguuuugugcuuuacaauaaaugauaugaaaccuccugugucgguaaguuggauauguggguauuuaaaggauucauaauuucuuagcaaugauaaauuaagauacauauacacaaauauauaagcuuuccccaugaaauauugaguuuuuaaacacuggcauguuuuuccccccuugcaguauagugguagauuggaggaucuuuuccauuuauuguauuggcucuuucagcacaaguaauccugauaucuucauuuuuuuuccuucuguuugauuaaaaacugcauguguguacaaugaucuuuuggcauacuuccauugcauuaacagugaaauuuccuuuuauacaugaccacuguuucagaccuguacugcugcuauaacaguuaaccuuucuguucuuaauuugauaauacuugauuuccaagacuguuucggcauaacuaauuuuaaacaguuuucagauagugaauaugaguagucuaauaagaacaguuuuuuuccaugugaagcaacucuuucaauguauauaauguuaguguguuucuuucuaaauuuaggauagaaaagugaauagugugcaaaaaguauagcuacauugcaucugccauugaaacauaaaugggguauggaaacguucaagcuuuuuuuuuuucuuuaugcaguauagauaagcuuuguuuuguaaaugcacaaguccaaucauugaaucaacuuaauuuuuuuauguacuugaagucauuuuauuacucuuuaacacucaugcugaaguucugauauuuuguugaaauccauuguuuuacucuuugcauauuuguuggcucuuugcauauuaauauauuagacuacaugcaaauacagucugucuugccauugucuguugaagugcagguuugauccagccaguauagaacuagcucuguaggggugaggaggacugugcuguguaucauccuugauuguguuccuucaaggagcauugcacuguaaguacaucagaaugacaaauugaugaacugcaacaguaucuuuuugucaauguuccacauaaugcaaaugccauacguugugugaauauuauguuggaauacagugcugauaucuuggaaaaccauaacugccucuuaauuuaacauagaauaauacauaguucuguauuuuuuuuaaagugagcuuaauggguaaguauuuuuuauaugcuuuagcuauagcuaaagaaaacugauacuuaacaaaguugaauaguauuauucacuggugcuccuaaaauauuguuuuucaguguaaaauaugcauaucuucuauauuuaauaugaaagucuugaaauguaucagacagaaggggauuucaguuugcaaauaaugagcaauguagcaauuuuaacacauuucauaaauauauauuuugucauugguggagagcaccauuuguuguuuugaauauacuuuaaaggaagagguacaaggacauaaauguugagauuaccuacaggauggaaauagcaguacaguucauuguagauauuuugaaauguuuuugauuguuuuauauaaccuagagugacuucccuuacccuuauuuagaucugcauauauaguucuaguaugaaguuuaauaguuaaggaguuagcuauuuguuaucuuuaagaguaggguauugacgugaacaauugcaguauuuugcaugauacuguuuuauagaugaccuuuuaggaaaguggugcauuuauuaauugaacugaagaaguaguucaguugaauucaguaucauaauucacaaauuggaggcuguugauuuugauucauuuaagguuuaaaaucuuuauuaauugcaaacagugcaauuauuuauacuucacagugccuucccagaccuuccaccuuagguucugcugcaaaaagcaccagguaagcacaaccuaaggacauauauaaauaaauauuucaauacauuaauguugucccugugagguuuuugugguuguguauucaaaggcaaucugcuacugcuuccccaaaauguauuuuguuauuuuaugcuaccaucuuaguggaaagucuguaaguuguuaaagcaacuguuuacauuucuggguaauguuuuuuauuuuacuuuuuuuuuuuuauuaagacaagaaaaugaugaguagauugcugcaguaauugaacuacauccaaaucuuuuuguauuuuuuccccaaauauagaaguguuaauauuaagaaaggacaauuacacaguuuucaagauuuaggaaaucacuuguuuagaaacuucaacagccuucacaaucuguuuuauaugauggacagaaaauuucuuugcccuccaaaauuauaauuucuuuauuuuuuucuuauucuuaaacuauaauaauucaguaaggauauuauggguuagaauuuuauuaugauuuuuuucuuagacaaaaguuauaugcugaagaaggaaaaaguuauaaggcaguauguuuugauaaaaggcaugugcaucagugaaauguuaacuguauagcaaauaaccuuucauaaucuguagcaaucaguauuuuucugauuuaauaauauuuuaauaacugacgcugcauuuaauuuuuuugccaguuuaaaauguuuguguguuuuuauagaugauuuuaacugguacauauuuugaguuaaguugaauguaugaaagcagcaucuuaucaguuuuguuuauucgauuucuaaaaugugcugauccuuuuaaaacuccugcuuaucucugcaacaaagaaaaauauucaaaaauacugccuucauuuucacacacagugcugaagaugcugcaagcaccaaaucauagcucauaaaaucagguccugagauaguuacccauaaagaggaauccuuugaguguaugccauuggugagccgaugagcauggaccauagaagggcucaauguagaagguaaaauuggcaaaucauaauugagaaauaugaaauguauucccauacauaauaugguauaggguguaauguaccugcuuuugaucacuuuucauuuuaaagugcuauucacuugaucuuaaauguuccaugaacuguuaaauuucuuaaguuacauaguuacuacaccacauuuauguguauguuauguuuuaauagucaaugauagguauguacaauugauaauauaaaggggcucauugaaacuugagagccuguugaguuuugguuaguuguagauugcauuuuuauaaaaaaaaauacagauagauugaugauaauagauauuggggcauuguuucugucucaugagaauucuuuuauucauuaccauaagccuucacugauacuauaagcauuauuuuaaaugacgcugaucuuaagucugaaauaaauggaaagcagaaaaggugagccaguugauuugaaugcauuggauauuaguguuagaaacaauguauaguuuagauugaaacugaacugacuuauuuagcacuuaaacaaaaauuugacaauguuuuuaguuuuuuuuaagacagcuuaguguggugauacuuagaauucuaugguuugauguuucuuuuagaaaugagaaguauaguuuuauuuuuuaauauaaaaaaugguuuuaauacuaaaacuaguaauuugauacuaguuguuuauaaacauuguaaaauauaucuuuuaaacaaauuaucuugguaguuaauucauaaggguggguuuggguaggaauagcagaguacuuucagagggaaaggggagucauucagaagugauagcauuuuauuuguuugaauacucugccaguaaaaucagcuguacuuagaaaguuaucuguuguguagaauaaugauguagaguuuacuaaucagugaggaugucuuguuuuuauuuucugcaaacucugccucacuuuaaaaugcauuauaacaauaccuaauuaaagauaauuuuggcucugaaaguuaccuuauuuuuuguugaguuagugacuucauuuuucuugccacaauauaagcuuuugagggauuuuuuuaaauuggugcuuuuaauaagcaaauaaaucccaggguuuuauuuucuucagugauaccccuauagaaacucuuaaauguauuugcgcauauauauauauauauuuucuuaugcaugcucgaugcauuuucguccugagaaaaauguucucuacagaaacuacccguguguaaaaagaagauuggcuuaaaauggcuacugugaugggaacagugucuuagggagaugcagcuuggacuugagguaaauugaauacuuuacaacugugguuuagaguuugcuuuaaugacauuguauguaaaaggucacaugauugcuguaauuuuguauucauuaugguuuccucaauaaauguacauugaugacuauuau

SEQ ID NO: 13877 - RNA, 35115 nt, Homo sapiens
auaauagucaucaauguacauuuauugaggaaaccauaaugaauacaaaauuacagcaaucaugugaccuuuuacauacaaugucauuaaagcaaacucuaaaccacaguuguaaaguauucaauuuaccucaaguccaagcugcaucucccuaagacacuguucccaucacaguagccauuuuaagccaaucuucuuuuuacacacggguaguuucuguagagaacauuuuucucaggacgaaaaugcaucgagcaugcauaagaaaauauauauauauauaugcgcaaauacauuuaagaguuucuauagggguaucacugaagaaaauaaaacccugggauuuauuugcuuauuaaaagcaccaauuuaaaaaaaucccucaaaagcuuauauuguggcaagaaaaaugaagucacuaacucaacaaaaaauaagguaacuuucagagccaaaauuaucuuuaauuagguauuguuauaaugcauuuuaaagugaggcagaguuugcagaaaauaaaaacaagacauccucacugauuaguaaacucuacaucauuauucuacacaacagauaacuuucuaaguacagcugauuuuacuggcagaguauucaaacaaauaaaaugcuaucacuucugaaugacuccccuuucccucugaaaguacucugcuauuccuacccaaacccacccuuaugaauuaacuaccaagauaauuuguuuaaaagauauauuuuacaauguuuauaaacaacuaguaucaaauuacuaguuuuaguauuaaaaccauuuuuuauauuaaaaaauaaaacuauacuucucauuucuaaaagaaacaucaaaccauagaauucuaaguaucaccacacuaagcugucuuaaaaaaaacuaaaaacauugucaaauuuuuguuuaagugcuaaauaagucaguucaguuucaaucuaaacuauacauuguuucuaacacuaauauccaaugcauucaaaucaacuggcucaccuuuucugcuuuccauuuauuucagacuuaagaucagcgucauuuaaaauaaugcuuauaguaucagugaaggcuuaugguaaugaauaaaagaauucucaugagacagaaacaaugccccaauaucuauuaucaucaaucuaucuguauuuuuuuuuauaaaaaugcaaucuacaacuaaccaaaacucaacaggcucucaaguuucaaugagccccuuuauauuaucaauuguacauaccuaucauugacuauuaaaacauaacauacacauaaaugugguguaguaacuauguaacuuaagaaauuuaacaguucauggaacauuuaagaucaagugaauagcacuuuaaaaugaaaagugaucaaaagcagguacauuacacccuauaccauauuauguaugggaauacauuucauauuucucaauuaugauuugccaauuuuaccuucuacauugagcccuucuaugguccaugcucaucggcucaccaauggcauacacucaaaggauuccucuuuauggguaacuaucucaggaccugauuuuaugagcuaugauuuggugcuugcagcaucuucagcacugugugugaaaaugaaggcaguauuuuugaauauuuuucuuuguugcagagauaagcaggaguuuuaaaaggaucagcacauuuuagaaaucgaauaaacaaaacugauaagaugcugcuuucauacauucaacuuaacucaaaauauguaccaguuaaaaucaucuauaaaaacacacaaacauuuuaaacuggcaaaaaaauuaaaugcagcgucaguuauuaaaauauuauuaaaucagaaaaauacugauugcuacagauuaugaaagguuauuugcuauacaguuaacauuucacugaugcacaugccuuuuaucaaaacauacugccuuauaacuuuuuccuucuucagcauauaacuuuugucuaagaaaaaaaucauaauaaaauucuaacccauaauauccuuacugaauuauuauaguuuaagaauaagaaaaaaauaaagaaauuauaauuuuggagggcaaagaaauuuucuguccaucauauaaaacagauugugaaggcuguugaaguuucuaaacaagugauuuccuaaaucuugaaaacuguguaauuguccuuucuuaauauuaacacuucuauauuuggggaaaaaauacaaaaagauuuggauguaguucaauuacugcagcaaucuacucaucauuuucuugucuuaauaaaaaaaaaaaaguaaaauaaaaaacauuacccagaaauguaaacaguugcuuuaacaacuuacagacuuuccacuaagaugguagcauaaaauaacaaaauacauuuuggggaagcaguagcagauugccuuugaauacacaaccacaaaaaccucacagggacaacauuaauguauugaaauauuuauuuauauauguccuuagguugugcuuaccuggugcuuuuugcagcagaaccuaagguggaaggucugggaaggcacugugaaguauaaauaauugcacuguuugcaauuaauaaagauuuuaaaccuuaaaugaaucaaaaucaacagccuccaauuugugaauuaugauacugaauucaacugaacuacuucuucaguucaauuaauaaaugcaccacuuuccuaaaaggucaucuauaaaacaguaucaugcaaaauacugcaauuguucacgucaauacccuacucuuaaagauaacaaauagcuaacuccuuaacuauuaaacuucauacuagaacuauauaugcagaucuaaauaaggguaagggaagucacucuagguuauauaaaacaaucaaaaacauuucaaaauaucuacaaugaacuguacugcuauuuccauccuguagguaaucucaacauuuauguccuuguaccucuuccuuuaaaguauauucaaaacaacaaauggugcucuccaccaaugacaaaauauauauuuaugaaauguguuaaaauugcuacauugcucauuauuugcaaacugaaauccccuucugucugauacauuucaagacuuucauauuaaauauagaagauaugcauauuuuacacugaaaaacaauauuuuaggagcaccagugaauaauacuauucaacuuuguuaaguaucaguuuucuuuagcuauagcuaaagcauauaaaaaauacuuacccauuaagcucacuuuaaaaaaaauacagaacuauguauuauucuauguuaaauuaagaggcaguuaugguuuuccaagauaucagcacuguauuccaacauaauauucacacaacguauggcauuugcauuauguggaacauugacaaaaagauacuguugcaguucaucaauuugucauucugauguacuuacagugcaaugcuccuugaaggaacacaaucaaggaugauacacagcacaguccuccucaccccuacagagcuaguucuauacuggcuggaucaaaccugcacuucaacagacaauggcaagacagacuguauuugcauguagucuaauauauuaauaugcaaagagccaacaaauaugcaaagaguaaaacaauggauuucaacaaaauaucagaacuucagcaugaguguuaaagaguaauaaaaugacuucaaguacauaaaaaaauuaaguugauucaaugauuggacuugugcauuuacaaaacaaagcuuaucuauacugcauaaagaaaaaaaaaaagcuugaacguuuccauaccccauuuauguuucaauggcagaugcaauguagcuauacuuuuugcacacuauucacuuuucuauccuaaauuuagaaagaaacacacuaacauuauauacauugaaagaguugcuucacauggaaaaaaacuguucuuauuagacuacucauauucacuaucugaaaacuguuuaaaauuaguuaugccgaaacagucuuggaaaucaaguauuaucaaauuaagaacagaaagguuaacuguuauagcagcaguacaggucugaaacaguggucauguauaaaaggaaauuucacuguuaaugcaauggaaguaugccaaaagaucauuguacacacaugcaguuuuuaaucaaacagaaggaaaaaaaaugaagauaucaggauuacuugugcugaaagagccaauacaauaaauggaaaagauccuccaaucuaccacuauacugcaaggggggaaaaacaugccaguguuuaaaaacucaauauuucauggggaaagcuuauauauuuguguauauguaucuuaauuuaucauugcuaagaaauuaugaauccuuuaaauacccacauauccaacuuaccgacacaggagguuucauaucauuuauuguaaagcacaaaacaggcauuuuaaaagugaaaguauacauugaaaaaguacauuuauaucacaaagcaucaaccacauaauugcaaauacauuugcuggaauguguacaucuacacuaaauacuaaaaacaaaccaauuuucauuucuacacagaaauauuaaccuccuaucaguagugauagauauuuuguacauuuucaaaaaaaaaaaaaaaaaaggaaacacuauuuuaaaccaaaaacaaaauuaagaucuucaucaagucgucugcauccauauauuuaacaaagguuuuuuucccccacacaaugaagcaaauacuguauuguccacuucuuauuauuggcccugugcagaagagauacauaagaaauacacaaaaaguuaaagaaaauccuugaaauggagcuaauucaggagugaauccuuuaagaaagaaaaagugguuaauauaaauggugguggcuucuugcaugauuugcaaaucccugggggaagaaaauuuauuuuuaaaaucaaaggcauugcagaaauauucaccacucagaugcuggaaagcauuauaaaaaacaaaaaaacccaaacaauacaccguaguacuucauuuaaauaguuauuauacuuugccagauaaaaauuuaaaaggcaaacacucccaaacagacaaacaguaaacaugcagaaaacagacuggaguagaaaucaacaaauuagcaauuacauuauaccugaggugcuggaggaugcuguggcauucccuggggacuugucugggcauaauaggcugcuuguugucuauaauacucagcccaggcugcacuauaaucuggcugaccaccuggaggagccccagucggagcaggaacugccugaccuuugaaaaaaaagaacuuuguugcuguaaccacaauuauaagcccaacaucucauuucuaauaaaaacaauaccuugcuucuuguaauauuucucccaagccuuugaauaaucuuguguuugcccuuguugaccaaaaaaaaaaaccccuaaacuuuaauauaaaauuacauccacuguaaguacagguuauaagacaaaagcacagagggucagaauuacuccuguuuuauuuaaaauauucauuuaguagugucaggaaacuacucugcaauuagaaaaaaaaaaagaacgcucuuuucuuuuugccuuauaauuaaucguuaacuuuuaguucuagagcgucauuauuaguaaaaaaacagaaucaaccccaaauccacacugcuuuagcuaaggaagguaaagauuuaggcauaaucuuaauucgauuccagaauuacaaaaagaacauuuuugaaaaacuuuaagcccacuuaaaggcaaugauuuaaagacuguauuaagaccuagccaagacuuuuuccugauuaguaaccuauaaaguguauguacacacacacauaauaagauguuaaaaguauuaauaauuuauuccaauuacaacacaauguuauuaaaaguaaccugacaaggaauaaagaacaagaucaaugaaaacacauaaaacucagcuuucacaaucaggucuuuuuccaaauaaggugacuuugcugaauuaagagauuaaagaaauauagcaaugaaaugcaacgcaugaaucuugaauguacucugaauuaaacaaaacacacagacgacaaaagacauauuccugacaacuauggaaauuuaaauauagucuguauguuugugauaauauugaggguauuuauuuucagacagggucucacucugccacccaggcuggagugcagcggugcaaucauggcucacugcagccucaaccucccagggcucaggugauccucccaccucagccucuagaguagcugggacuacaggcccaccaugccuagcugacauuuuucucuuuuuuuguagagaugggguuuugccauguuguccaggcugguccugaacuccuggacucaagugauccaccugccuuggccucccaaaguccugggauuacaggcgucaaccacugugcccagacauugaguuuauuuagagcaaacugucuugucugcaacuuacuuugaaaugguucauacacaaaaaacauacauauaaagcgcauacagcaaacuuuuaaaaaaugaugaagcugagugucugaugccuuauuuccccaauuucugaagguauauaauuuucuaaauaaaaaauugagaagagagaguauauguucuccuauucaguuucuuuacuuaagcacuauuuuauuucguuuguaacucgcuuggcuuugugaaauaacuaccauagacaaaaauacuggagcauggacacacaggaagcucuuuuuauguuuguaggaugcugccaacaagaccaauuucauaguuucagaaagcagucuaucaccauuguaaaacaggucacagacucaaagcaacugagugaaagaauuuaagauuuaugauucuuuaaaaaugccugaaaaaaacccucuuuucuuggguaacagagaacucucauauacuauuaaaaauucucauauuuuccugucuucuauaaauaacuguucucaaagaggaaguaaguuuaacauuuuccucuuacaagacacaauucaagcaaaucugaaacagguuucaauaucuaaaaaacuggugugacaauagcaauaaaaccacacauugucucuuacagggugcacacuugaaaccaaaccugaucaagguagcaaucaauagucuucagguuuuaaaccccauuguaagaguuacucauuuuagaggcaaauuaacaauguaaaaugguagaaacaggcauaugcaucaagaaaauucauugauguucccuuaaaaaacuacaaccucugcaaacuccuauaucccuguggaaagcuaauaguaaacacuuuagacuuuaagaaaaaccaaauucuugguaaauaaguugguaauauuugacacuccaaucuuaaaagauguucaagaaaagcuuauuucacucuuccaaucuaaagggcaaaugugauuuauuuugcccaguuggaaguagagaaagaacucuuucccugccccuucagacauguacugccuuaccuugcgcuccccuuauuccucucuuuaguuacuggauuuuguuuugagacagggucuugcucugucaccuaggccagaacacaguggcaguggugugaucauggcuuaguuacuguuugaugccagauaguugaguuuauacuucaguagaacauuaucuaauauuuauuauaguuuuauaauuauaauguauaaaguuuagccuuaaauuucuuucaucccaaagauaaaagacuugcucuagaguuagcuugcaagauucuauuagagccuaagagccagccuugcaugaauagauuuucacacucaguugucuucccauauaacuguaccuuucccacaaguccucacucuacccuccuuuaggcuuaagguaccagauucuucaggguucagagucuaccacaucaguccuuaucauaauggccuuccucaagucaaacuuuucccaaaugucuucacuucuccaaacaagaauuacuccuuucuauuuugaaacccuguuuguucucuuaagggucuuaaaaaaaucccuguauucuagcuuuaaaaacacccaucuuuacugcuguuccuuauaagccucugaaaucuuaucaagauuuucucuacuugggaggcugaggcagaagaauugcuucaaccugggagguggaugcugcaagugagccgagaucaugccacugcacuucagccugggcgacagggaaaggcuccaucucaaaaaaauaaaauaaaaaaaaauaaaauaaaaauuuauccucuuaguuugguguuauccuugggaacuuagaauuguuuugaaauauaaaccuaauuuugggaaacuuaacccacaccuguuuucaauaguuuuuuuuuuuuuucaguaaauaagcaaauaaugacaaauuaaaaucuaugaauggaguuuucuguucuuaacaagaaaaacuuaaauuaggcuccaaaagcugugaaagccugccuaguuuggcaaaaggggcacuaggauggggaaucaggaaaucugaaguccuagcaucauaccccugccacuggaaaagucaacaacaguuggcuuugagauaaagauaucucccuauuauucccuuucuccuuccauuuaagaaaugugaagacugaaccaaguuuuaugcuuuaagguuucuuauuugugguaaaaagauccugaugacagguaagguaccuagaagaaauuaaagcaguuaagcaacuaaucauuuacaaaaagaacuuuuauagaaaaagacaaauugacuccguaugaugaugacaaaugcucaucaagcaccugacuaaauuaccuagcauuauuuccuuuaagauauacacauguggccaggcgcaguggcucacaccuguaaucccaacacuuugcgaggcugaggcggguggaucaccugaggucaggaguucgagaccagccuggccaacauggugaaacucugucucuacuaaaaauacaaaaauuagcugggugugguugggcgccuguaaucccagcuacuugggaaguugaggcaggagaauagcuugaacccaggaagcagagguugcacugagacgaaaucgcaccauugcuuggggaguaagaccaagacuccgucuuaaaaaaaacaacaacaacgagauaugcaugugaaggacuugcccaacuaaucuguuuugcucauaaaauuaacaggugaggcugggugcaguggcucacacccauaaucccaacacuuuggaaggcugaggcagguggaucaccugaggucaggaguuugagaccagcuuggccaacaugaugaaagcccguaucuacuaaauauacaaaaaaucagccggaugugguagcaggcgccuguaaucccagcuacuugggaguaugaggccggagaaucgcuugaaccugggaggcggagguugcagugagcugagauugcgccaccgcacuccagccugggcgagagugagacucccucucaaauaaauaaauaaauaaaauuaacaagugauuauugugguacuacagaacaacaacagaaaaggugggguaaggagguucuuuagucauacagcauuauuauuuaacaucuaauuauuauuuaauuauuucuaugccauguuuuccuacagaggauucaagacaguauaguauaguaucucuaacuggcagggaaaugguaaaaaaaaauaaaaaauuaaagacaagguaaaaugucuucccuuaacaauaaaaauuagaauuccacccacccacucauuuugaguaaaacauaaaaaguaaaacaaaaaagacuaaacaguaaauguauuaauggccauauuacaaauaaucaauaugguaaaauaaagcacagaagccaaacucauuccuccauaauuaccuaaauccauuaacaagccuuuauuuuuaccuacuuaauaauaacuagggacccuaucuaggggacauuacccauugagaaaauagaaguugaaguuagugauuuuuaacccaaacacgugaccaggucucacuaugaugccaaggcuggccucaaucuccuguguucaaggaauccuuccaccuuagccucccaagcagcugggacuacaagugugugccaccgcacguggcucaugcucaagucuuuuaaaauggugaugcuauuuaauuaaaguuaaguugauuacagguccugaccacaaugcugucagggcaugauuauuaauagcaucccuauucauucuaaaaaggaucccaguucagaaaauaaauuauguaaccaaccuuaaucagaguaugcuguuuuuaaguuaaaaguuucuuuuugccgaauuguagcuacuguagaucugccuaagcuaggucacaaaaacauaaucuguuaaagccucagaaagagacggaacaugacucuccuaggaagccauucuaagaggaaaaacaauuuuucuuuaaaaagaaaccaguugugcaaaacaacuuuaucaucagguauauguaauuuuacaucuagaagauuaaaaucaucaccuuucuggaaauuuuucuuucuguggagaaugagaaacauucuuuggcaaagaaaacauugaaaaucccaaguagaccguucucuuaugacaaaacucuaccaccuauagguucuuuuucugcuagugaaggauaaccaagcuuaccaauuuagcuuucauuugugacaucuagcugugguauguaauaauuuuaaaugacuaagagcaaaagcagcugaaauauagugauuuguccagaaguauaguaucagguuccaaaugguuccuaaagagacaaauuugggagacaagcuugggacucagacccucuuggaagccagauucugguuccaucacuugguuacuuuccgucacugcagauuacuucuuaccugcuuaucuugcagcaaaaauaaugguaucacacacaauuuucgccugacacauuaaaauuuaaccuuaugucauuuagacugauaauauauauaacugucauugucaaaaguauaguaauguuaauauuguauguaccaguaaggacauuucuaguuucaauuaauaacugguugacaaaugcaauuagaaaaaaaaauuuccuugccauauaaccacaaauuuaaaaacuauaauuuacaacugucuugauauguuuacaaguccagugauuuuauucaauuauucucuuccugaagagaauaauuuguuucaauuuaauuaaguauguauuuucaagaaauguauaaaacauacccauuuucuuguaguacucuucccaagccuugguauaaucaaccuguccagcuggggcuggauucugcugaucuccuuguucaagcaaaacaaaacaaaaaacagaauuaaaguuuuuaaaaggcaauuuuggccguuuccuugggugcaggagcuggcaggggccugcaaugugacagugaggguaggagggaaguacuauguggugguggcaucccuaacagugccaaagauagaagguacuggggguacagaggugguggacagaaaagaaaaccaaccuguuugaagacugguuauguugaacauauaaguaaaugcaugucaaauaaggaaauacacugaggacaccagguuucucacguuuguaaacaaguacaaaaaaggaaaaggcuugaaaaccccaaaaugcugaaacggauguggugauaugaacauaguuuuuaaaaauauauacauauaucgauguuuauguguuuuuugguguguguauguagguaugcauguauguaaauauauuuccuaguucugccuguugaaagaagcuagaagcaauuacaccucaguagcaacaagcauacucaagucucguuucuaacuaccauacucuacuaaaaggaauaagagcuccuugaagaaauagcugacucgagggcuggagcccagaaagcacaaaauaacaaucuuacugugccagacaguauggaagugcuuaaaagaaugacagguauuucaaaaggauauaggcaccacccugaauauacucccugacuggccaaauccaggauaaucugauuaucaaaauuauaaaaauacuuuaaaaauauaaccuacugcaaaaaucagaaauccauaaugauauaaagaacuuaauauaucaauguugacuuacugauuuggagggcuguaugaugguuauguauuuuugaagaaguacccaacaggacaucaugucuacaguuuagucuucagugauuucuuucagaacuaauuaugcuggauauaauuagcuuccuucagaacuaauuauaauggauauuuaaaauaaauacagauacacauguaugauauagaugguaacagaguaaacaagggaauaaaacauuaacagcugggcuaucugggugcuccggguauucuucuuacaacuuuuaugaaaguuugaaacuauuucaaaguaacaauuuaaaaaaggaaaagucugcuuaaauuauaauuaaauaaugucagaaauuuuagguauuauacagugauguacuucauauauaauuccaagcacaacuuuuggcuuucacauacaauaaguucuguaguuaccuuguccauuaguuugaguuguaguuggugcaccugcaggggcugcuggugguggcugugcuugcuguugauaauagugagcguaauaagcagcccaagcugcugaauuuggauccguuccugccuuagcuaaaauaaaugaaaguucaagguuugcaugugaagucuguaauucucucucacacacacacacaccacccccccgcccagcucucuggcaaauauacagcccccaaaauuaacuagaacauuaaaaaaaguauaugaaaacuuaaauuuucuauuauuuuuguugucaccaucagcuuuuauuaaagaaaaccaagucucagagacuaagugacuuuccuagguuaaaaacuacugaguggcauaacugggauaugaauaaaggucuuuuggcuccaaauccaaugcucugucucaaaccauccugugcccuuguuuuuuucuaaauugguuucgccucaagcacaaacagcucuaucuagaagaugacuaaagaaaaacauuucuagggacuaaccuguauaagaaagaaaauuauuuuagaacaaugaacuuuguccuuauuuucaaugaagagaaaauauaaaaaucuuaaaaaagauuagccacauuucauccuauuucacauugaauguuauaaacuugaugucauccuacuugaaauucuucauucucugcaaucuucaggauguucaaagcuuaaguacagccuaucauucaacaucuuuaacagccugaagccccuggcuuauccuuuccauuucagccucaucucucccuuugguuguaucucuucaacacccaagcuccagccacaacacagugcuuguacuuuucagaaaucacuaugcccgugucucggcuuuuagcuauguugucuccucuacacuugacugacccucacucaucucccacaucaacugaagugcgaacaguuugagaccuuucaaucuucuagaaaccagaaaaaacuugauugucuuuuauacuaggaauaccauacaauuaaaacuuuuaaauuuucuauuauaccuucauucugaacaguagcaauucucagcugcuuaauaaagguuagucaaguuugagaaaaaugagcaagaauuucuagaaaaagaaaauugcaagguaauauaauuguaagguguuauuaggacaccugccaaacuuuucucaauugcccaauguacugcuuuuuuauguuggauguuuacauaucucaauagugucauuaucuguauuuuuuuuuuuuuuuugagaugaagugucucacucuguugcccaggcuggagggcaguggagcaauucucaaggaguucuccugucucagccuccuaaguagcugggauuacagacaccugccaccacauccagcuaauuuuuguauuuuuaguagagacaggguuucgccauguuugccaggcuggucuccaacuccugaccucaagugauccgcccgccucagccuuccgaagugcuagcgucacagguuuuagccauggcgucuggccauuaucuguauauuaaucaagaaaucuagguauuucacuuuacacuaugccuggauagagaauuugagauaaaacagacuuuaggaagugguauuucuacucccaaaugugaaaaccauaccaaaaaaccagucucacaguuacaaauaacuaguauguacuaagaauuuacuaaauauucacucaacccgauucauucauuuauuaauuuauagauaagaaaacagaggcuuagaggaguucaaaaacuugcuugacaucucacaauuaguaaacuguaggacuaggacugauauagguuuauuugacucugaagucuaaauucuugaccacuacauaaauccauuaacagaccacucuuuuuuuaaagaaacauuuuaguucauauaauauuaaaacaguaugcuauucuaagucuaauauaagcaauauccacccccagggacccaguaacccuuugauaaaucugaguggggccaaccagcugguuuuaguuaaauggguuacuucuugcccaaaggccaugcugcaaccacauucacugaccagcucuuacaguagugacuucacuacuacuccaagugagaaauucaacuugugauacaaagaccacuuccacuucuuauucccaucauuuuuccucaaucaugcuaaccacccaguagugcucaaaaauacaauccuggcagauccaaguuacccaauaugaaucugccuuuuaaccuacucaaacucuucaaucccauuaauuauaccaucccaaucagccaacaagagggaaagaaaagcccuuucauucuccaaaaauuaguuguuaagaguauuauauccuguacccugugagccccuuccaucaguguugcuuacgcugggagugcauucuuuugcuauagaacacaaccccaacuuugcacaccuauauccuagcacaacucaagucaugcuugguaacugucaugcugugucaucauauuccaaacagcacacuuccuaugaaguuaaucaagcaauuucauuuacauaaauuacuucaaguuuuuuugggauaaauguauuauguguagaaaguauuccauaauugaguauauuuuccuugaaacuacacgagugaaagaggccuaaaagguagguagcaggugagaaaaaaggaucauaaauaaauguuaauugguuucaaagaaugacucuuugaccaagauggaaagcaaacuacaggguauggaaagaugccagaauauaauaggauaaaaauaaaucugaauauagaaaauaauuaaacguauuugggcuuuagcaugcaguuauuaaauacaggccugauuuuuacucacaugaaguugucauaugaggaguacuagaacagauaucuuauuugacaauuuggaaguuuaaugccccaauacuuaacacucuguuggacuguuauauauauauauuuauauagacuguuacauauauacauaauuuuuuaagagaugggaucccauucuguugcccaggggagugcaauggugugcccacagcucaauacaaucuagaacuucuaggcucaagcaauccucccaccucagccucaaguacaggcacauaccacccugcccggcuaauuuaaaacaaauuuuuuuagagaugggucuugccauauugcccaggcuggucucaagccucagccucagacuucugaauaggugggauuacagacgugagccucagugcccagccccuaucacauacuuuucuaaauaaguaaaaacuauuuuuccacagauaaugucacaaugaacauacuacacauuugacagcacugguauccaaaaccuaugacacugugcucuuuccugcagcuuuuagcuuuuaucauucuacuguaucaacucauaagccaaaggcaaguagaaagaaauuccauaaaagcagagcucauauucaugucaguccuauacacugggguagaggcagugccuaacacuguugaaagaguaaagugagugaaggugaugcauacaaauguagaaucaacacuagaaaauuuaauaauguaacaggaguggaaaauaauacagauaacacacaaauaauaagcaucuucuaccuggaucaggaggagccugcugcugccaguguggauaugcauuuccccaucccuggggagcauauggggcuggaggaccacugaaaagaaaaaucagcauaaaaaacagucccaaaacuagaaucuuuggggaaagcccagaacuaaacccaauacuuacugaggagccgggccuggugguccaggauuauaaggugcaggguuguauggucccauuggaguuccaggcccuggaggcccaggagguccaugggggccugggacaccauggggcccaugggguacagguggcccuaaaggauuuacugggcccuacaaaaaaaaggaugacauagaaaaaucagaaaaacacaguaaugguuaaacaacucuacggccaaauaaucauccauuucuacccucuuauagucacaaauaacaaauuuuagguuuuccuuccuuuccucauucauuuugcaaaaacuauuucaucugccauaauaaugagacauguaaaauucacuaaaaucaauagcaguagcaauuaaaugcaauuuaaauuaaauuaaauuuaaauuagcaauuaaauuuccuuuagcuuguuugcggacagcaguaguucccuuuccuuuuaucauucuuacuuuuacuaucuuuuuccaucuuacucacagaaaucagguccuuaucuucagcucuucucucuauaucuacuugccuaacaugagacaaccgucuugacaauauauucccaaaccgcuuggguccuguaucaucgucuucugaacauuucacugauaacguuaauagcuaguuguuucacuaugaaacuaaaauccaccucacaaccuauuucugucacuaaaaucccauucagaucaauaauuuauauccuuuuuggccuuucauguaucaugauguuuaauagcacaaaaauucccuuuuuaauuccuucaauaaaucaggauauuuuauauccuuaucaugcaugcaugccacaucauuaauaacgcuuaacugauuucuguuugguuaagccaacaaagacauuacacuuaacuguccuaaaaugcuccuucugaguaguuaacacaaccaggcgacauguuggacaaaaugcuaacacuacauuuuguuguaaauuucucacugcaaaauagggaaacuaaacuucaugaccuuuaaaguucuuuuuauuaacuugucucuuuaaaucuccaauugcugucaucucucacuuacuauccaugaccuauucuuuccaaguaguaaaaauaauacugaaaaaguagcaacauuuuuuaggguuauguggcaggcauucuuuuaagugacacacacaugaacauucauuuaaucccuacaacucuaugaaguagauaccauuaucuucauuuuacaggaggaaaccaaggcacagaaaagccugaguaacuucuccaaggucacagaaccaguaaaugauucacagaauucugaacugaggcaacccgacuacagaguccaugcucuuaaucaccacaccaaauugcuucuccaaaacaaucuaucuuguuuuuccaugaauccaacagaaauccugacgcaugcauguuaggcuaauacuguaaaauaaaaaaccaagaugagugcuauucauuuuuuugccauggcaucaaccucuaucauuacucuacaaacauccucuucauuuuuugaaccauuaaacuauccauacaacagaacucacaauguuuguguacauuuuguaagacguuccuuaagcgucuuuuguacaucuauuuuugucuucccaaguugacagaaacagugucaaccuuguuuugcacgcaccccauucacagcauggcaaacaccaaaaauaauuuuuccuaggcaauucuaauaauuuaagaugcccccugcacacuuuguguuaaaaacuccaguaagacacugucugccucacuuacaaaaaagcagucaaagcguuucauacuuuuuuguucuaacagaaaacuuuccuggaggaaaaauuuccaaauuugucugugcaccagaaucacccaaacaucuauguaaaauuagaugcugggcccuaucccagacauuuugagucaggucugucucuguauauuauguguaggagugggaagcacccaaauagucuacauuuuaauacccccagaugaucugugagccaguccaaaaccuaggauuuaugaauuucuacuguagaguggcagauguaucugauuuaucuuguuugccucgcugggguucaguagaguaaaaucuuaauaaauaaugaauucccguuaacuauguccuucaaguauguuccacaauccuacaccaacacuaauaucaugccuacagguaacacuacccuccucuuaucuagccacacccaaauguaagguuguucucaaaaccuguaacuacacauuuaauuagguuauuuucauugcuggaaaaucuucacguuguaucuauuauacauaucaugaaaucuauaaaugcugacuaguaaugauacauuuuccuuugauguauuugaauaaacgucuuaauuuaacuacagucuaagggucuacacuaaaaauuaaaaguuuaaaguauacucacaccaaucuuuucuucuaugaguugccgagcauagucuaucuguuguggagugccacgaauuguaaauaacuucauauuaggaucugcauuugguggaggauuucucugaaguucuauucuugcaccagacugcuggcuuaugcuuuuuaugguuucaccuccuaaaaucaaaagacaguaauuucucuaaagguuucaaggguguacuaggagcuauuuagaagaaaauggucacaauuaaaugggccauuaaaaauaugguuuggucaguauccuaauugacaauauuguauuaagauuuuucauuuaauauucuacacugaaaaucaaauuuuaggaagcauuucaugcuucucuuaaaauacauuuacauuuacuuaguauguuuaaacauaaacuuaaugugauuauaauaaaauauuugaauuaacugcuuuuaaaagcaguguaaauauaaacuaauacacuuauaaacauucaaauuuuuaaaauaugagucgggaaaaaccaaaaugcacaaacaaaaacacucaaaccacuuuuugggucaaaagacauuucuuaugcuaauaauuaucucuuaguucgcuuucucuagaagcuaguaagauuaaaauccugcucuuucucuaaauauacaugagaucccucauuuauguuuuacuuguuacauauuaacauaagaauucuuuucuacuaaaauacggucagagaaaaagcauugccacuuguuuacgacagcaacagaaaguguccagaaaaaugaauaauguguuaaaacauuaagaguuuaaaauacauugccuuuuccuauuauuaauccaguuuucccaguuggcacaauaaaauuaaauuccuguaguccaccagguggucccauguuccaguugccuugaccucuaccucuuccucgaccaccagguccagguccaccaggauuaccagccuauagagagggaaagacaagaacgaagagucagcacagaaauacuuuuguuucaugauaaaauuauuaaguuuauuuuucccagcucucauauaccugaaucagaaauguagagaugaacuggcccuaauaaguaauaacauuuuuuaaaauacaagaguaaauaagguagcacuuaagguaguaguucuuccugcuccaagaucuuuaccuuaaagcaauuuaaacuuucuccauuaauaaagcaucaucaagcagacucugauauagagguaacuucagauuucaugaaggaaaauacuuuuccauaaaaacaaaaaaugaaaauguuaacuuucuaucaaaccugaacacuucgaagaaggucuguaauaauuucugcagcauguugacaucggucuggagguccuguuauuugugcuauccuuucggguguugucccaucaucuucaaaacaaagaaacaaaauuaauuaaacaauaaauguaugucaaaacucacugcugccaacacuuacaagauuauuauauguacucaccuggcuuaaacugaaugcgaacaccagcaucauuuuguauuuuuuugaucaucucuccauuucuuccuauuacaaugccaacagcaaaucuuggaauggggaccuuauguaaaaaagacuaaguauuaagaaagcuagcuucucaggguuuaaaguaaaaaaaaguauuuuaaaaaagcgccauuuccugaaaaucugccucaaaucauaaaaguacauauaauucuauauuuauaguaaauaggguaacaagauauauagaauucuguauucuaaaguauaaaggugaaauaaaaggauaacaauguuagagcuacuuaacacaaaacagaaaacacuauuauauuuaugaauuagcauacaaccauuucugaauggguauuuuuacuuacaucuaucccuucauuuccuccuauucuugacccauacucauuccgaacuucucugaaaccgccuugaucacgaauuaacucuaacaccauuuccuuggcuugcuaaagcagaaaaaguuagcuaauuuagaaagcaugucucaaaacauuuuaauuauucaugcauauuuugcccaaccccauucaacccacucuuucuuuauaaaguauaaaguuaaguuuacuugaacuuuauaugggucuccuguaauccuaagagguuugucagcaccaguguucugcggcccgucuugaaucauaaccauuuuaacuccagcccguuccuguuacaaucauagaaauaauauauauuaacaaaagaaguggacaaaaaugggcaucaaaacagaucaaaaguagccauuucacaaaaauaacaauaccugaagcuguuuaauaguuucucccccuuuuccaaugacuaauccugccuugcuagcuggaaucaugauuucuugaacugcauuucccgguccaucgccaugauggaagccaggagcuggucuuccuuuuucaacaaucugguccaguaaccguuuugcugaccuguuaacaaauuaauauuuaaauaguaagcuguagcauacccaagcuuauucaaauagagaaauauaaaacaauauaaccaaguacuccuccuaucccaguucaggauuaggugccuugaugcuaacuuuaacaaugcuuuuacuuuuaacugaaagaaaaugccaucaagggucaaagauugagagauuaugcaaaaaaauuuucuagauauacaauuuuuauuuuuaagaauaguccaaaauuuccaagaaagaacucuaaugcuaaaguuaucucagaauuaaacugauucuuccaagaacuaaaugauuuauuuacauuuuuaaacuaccauuuugcuuacucauaugcuacaauuauucauucaacaaauauuuaaauaucaacuaugugcaggugcuauucuagguaaugggguaauagcacucaaagaaacaggguuccugcuagaguggcuucauuucauuaaauaaguaaaaauaacaugucaaaugaauaacacauuauuuggaaagugccauaaagaaaaucaggcugggggaaguggcucacgccuguaaucccaggacuuugggaggccgagguggguggaucacgaggucaagagauugagaccaucccggccaacauggugaaacccugucucuacuaaaaaaauacaaaaauuagcugggugugguggcaugcaccgguagucccagcuacucgggaggcggagguugcagugagccgagaucgugccccugcacuccagccuggcaacagagcgagacuucgucucaaaaaaaagaaaagaaaaaaccuaguaaugagggagaacuaacaaugcagaagaaaguacaacugcaagcugaaccuucaguaggaagaaagggcuggcuuuaggcacucgaacacaaaaggaaagcaauuaccugaguacuaugugaacagaggaaaaaugaaggcugguagguuuagugguagggaaaaagaaaagcuucuuaucauuugcuuccauuuucucaguaaauaagcuuaagugggagagcgugggguuagaugcugaagauuuggagguggggaaauacaguauuaaagagccugggagaggaguggaaaagugaauggaacuagggaaaugcaggcaacacaacaguccacuugagcuuaaugucugaguuuuaagugucaccagucgaccugacugugcauucuucuccaggcuacacguggcuuuacaaguagagacuggaguagauauggaguuguuuuaaccauuuucuguguuuaaugauucagaugaugaaccccaccugagaaaggcaugaggcauaaacuucaaaggaguuggaggacuuugagggaagguggcagcgaaaccacaguguaaaauaaagcaguaacaaagagaagagacaaaauucaaagaguucugcuguuguuacuuaaguagauuuuuaagauuuuucaaacuuacuggacagauucagguguuccaguuaacauacaggaccuuucuggaaggccaccacugucuacaauuuaaaacaaacagauaacuucaggucaaaagauuaaaaguagcauuauuguuacuagaaggcuuaaaaaaaaaaaaaagcuaguuuucuagucacacugaaaauaccaugagaauguaacauuaccaggagcuaucuguauuuugcauccagauuccuguuguaugcgugagaucuguucaccuccucugccaauuacuaguuagaaaaaaaaaaauuuuuuuuuugguugaaagauucuaaaguauguuuugaucauguuuucaaaacuuuaaaaaucaaguuacuuacugaauccaaccauuccaucuggaacuuuguauucuucugucauuacagaucugcuaagaaauaacagaaagcaccauuuuccuucaaugaaagauacuuuguuuacaaauaaaagauaaucuauuaauaaaaauggaagucuaaugucucccaauggcuuaaacuaagguucuaggcucagacucaugucaaaaaauaugaucuuauuacuugaguaguuaaauuaagaaauuuaagaugacacaucaagugaagaagggaugaugaauggaacagucugaaggcauuaacuguaaagaaguugaaguggaguuuagagaaugucaucuuaacaguuacucuaauucaccccuguucuucuaaaaugugguuaauuccaccuaucucuccaaaucacaaauuuuucucacucaaaagaaaaaucaucacuuuaugguaccuucccaaggggagugauaugaacuagguacaccaaaaaauacacagacacauauucaauauacaccaaugugguuguguuuuuacauacagcucaaccaaaacuugcagaguacuuuuugaaaaucuugugacuauaccuuugcugcugaugcaucggugguaacuguguuccaaaagcuaucaaaaaauuaaauaaaaauaaaacaaaaauucaaaauuuaaauuuacuuauauauuuaacaacacaaucacaucaaacauucaaaaaucucucccuaaugcacagacaacaccuugaagagagucaaauuuuuuacacaauauuuauauuggcauugacaggggcaagagagccaaugaaagggaagacauuauauuagcaauggcacagaacaaaauaauuuccuuuuucaaguuguacaaguauagaucaagaauuggaguuguuaaauauguaaaauaauucagcaaccaaucuuuacauauacccggccacaauuaaugggacagauuguaaaauaggagaaaaagguauauauuuacaaagaaauucaggcuagcugauccaaaauacucauaaaccaacuaacuucaaagauacccaauaauaugaacaaaaucuuaacauugaaauuguuacuuuagcuuuugacccaguuuaaaaggaauacuuacagucauuuugaggagcaacuuucuuagcaucugguugaucugcaaaauuaagugucuuuuaauuuuuugccaauuaaguacaaagcuucuccccucccaaacaagaauaaauaacaauauaaacauuuauugaaauaucugaagguaugguuuaucauuugaaccaaaacugccaaaauucaaccccaacucaguaaucuaaaaaagaaacgauacuucauucucuucacguucaaaagaugcacagacauuaaaauaguuaucugauucuuaagaaaucacugaccuuaauguauguuaagcacauuagaaugacacaagacaacguacuuuagguccauuacuagcaaaauaucacaugcuaaaggcuaaugaugcuuccaccucaggaacugaagacuggggggagaaaagccuaucaaacuacaaaaaucugacauauuaaaguguaucugacagugaccacaaagcuaugcccaaaaaaaaaaaaacaaaaaaaccccccacaacauuacaaggcaaucucaaccuaaacuguucuauuauuuauaaacaaacauuucacugcauaaaacuuuagcaaaaaaauaaaaucucaaagcaacuacaugacuaccuucaccuaaauccauuacacagaugaauacaaugcauaccuuggaacagacaaccuauagcucaaaguacuacauucuccuccccccuucaaacuuaaaugauuaaacaucagaauguugugcagcaaaaauaaaauaugcgcagacacauaauccaagaaauauuuguguccauuuaagaauccacugguuuauuucacguuuacauacugaacacagguaauaaauaaaaauuccugccuuuaaaaggagagggcauucccucccaguguguuguacugcucggacuuguccaagagccaucuacacauaaaauaaaaagaauacauuacauacaacaucugaagcaucauuagcucauuuuuuuucuacauuaaaaaccucacuauaaauaugaaagacacuuaaauaaaaggaaaccaaguucuccuggucaaaagcuacaaauacauucuauagccucagugagaauccucccuuuaaaaaaaaggguaaaaagaaaauguaucaaaacucauauaucaaaccuaaaacaaaaaauacaugcagacuucuaaguucagaagcuucaacgauuacgauuuuuaaaaauacauagcacuguaaauccacuguuuuaauccacagguuuaaagcuaaacgugaaacacaaaaguacugaaaguaaagaacauuaaaaaaaaaaugguauaaccugcaacacacuagaguagcaaacuauaggaauuucaaccuuuaaggugcaauuggaaauagaaaaaugacgaaaauacagcauauuaaaauccauucacguaugaguaaaaccagugaagugucuucuaagcaauuuauauguuuuuuaauauuauuaacaagacgucugugcaaacuuucaaucuggcacaauccuaaaagagggaaaauaaauuguuuucuauuaagacaaaacuuccuuuuuuaaaaaauuuuuuaaaaaauuucuuucaaauuuuacuuaccuugucuaguuuucuuuccccccuuuuaggccaauauacagcuuacaauuuuaacaaccuuauaauaaaaguuaauaucucaauaaaauaacagaaaaauaccgagaaucacuucaacuaaacacucugaaaaacaauuuaaaauacuuagaguauaacuuaccuccaucuucuaaaggucuuuuuugucccccauaaccauagucauuugaauucagugaugucccugcaucaccuccaauuuuugcugcaaucuaaaaaaaaaaaagaaaaauaccaucauaaacuauuauauacuauucauuacuaaauuacccccauuuacuuccugauacauguauaugugaaauauuuaguaucacauaagaaaauuuacuugaaaaauuaaaauuauaguucaauuuauugcuaccauuaauacuucaggcaguuaacauaauaaucauaagauuauuaaacuucugauacaucccuauaagaagcaacaaagaaguaaucaacuaggaauccggaagagagaccagauuuaaagaaaaucuggauccuaucuggcucugucaugacacuucaaaagauguguguaaacacauagaaugugaacacuuugugggacucaaaggcuaugcuaucuaguaagguagccacuagccauaugugguuauugaguacucaaaaugugacuagucugaaaugauacuugcucuaaguguaaaauuacucacugaauauugaaaaccuggaauauaaaucaucuuaaauuuuuauauuaagcacaugcaaaggggguaauauuuuggauaugcuggguuaaacaaaacauguggcucacauuguacuucuauuggacaauguuguucuaaggauauauguaggaguccagggagcucgagucuuaaaaaaaccucagcugcaaaaccauaauucuuagaagauuuuuaaauuuuagaguagggcaaauaauuuauugcaccugacugaaccaauuuaagaaauacccagcuuugcugucaugguggcucaugccuguaaucuuagcacuuugggagguggagguggguagauugcuugagcucaggaguucgagagcagccugggcaacaugaugaaacuccaucucuacuaaauacaaaaauuagccaggugugguggugcacgcccauagucccagcuacucgggaggcugaggcacgagaaucacuugaacccaggagguggagguugcagugcaccaauaucaugccccucuuggaugacagagcaagacuguuacaaacaaaacaaaacaaaaaaaauaaaaaacaaaaaaaaaaaccuggcuucaagucacaaguagggcacaaucagcagauacuuacugaauuuuucuauaaaaggacaaccgaaguaguucccauuuccauggggaaucauggagugguucugccacauugcugaguggucagcaauaggccaagcuccacacugcaaugcuguacauucauuauugaugugugaugggcucaugagaauuuauuauauaauucuuucaauuuugaguauauuugaaaucuuccaugaaaaaauauuaaagaaaaccuaacuuuuggugacugggauuccccaaagagauccccauauggauaacugcuucaaguuuuuauuaucaucagacaacuggagaggguaaaauuauaguuaagugcugaagucauaaauucaacauggaucacuuaagucuauguaucaguucccauauacuaacuucaucagacaacuggagagguuaagauuauaguuaagugcuuaagucauaaauucaacauggaucacuuaagucuaauuacauaucaguucccauauaccaacuguauuuccuaggacucauagauuucccuuuuccucaucuaaaaaugcaaacaccuaccacaaagauuauuaggaucaaguacuagauugcuugauaaaaaaaaaaaaagguacacucucagccggacacaguggcucaugccuguaaucccagcauuuugggaggccaaggcgggcagaucacugaggucaggaguucgagaccagccugaccaacauggagaaacccagucucuacuaaaaauacaaagaaauuagcugagcgugguggcgcaugucacccagcuacucgggaggcucaggugggagaacugcuugaacccaggaaguggagguuacggugagccaagaucacgccacugcacuccagccugggcaacggcaugagacucugucucaaaaaaaaaaaaaaaaaaaagguaaauucucgcuuuggucaaucuaaccuucuuuaaccaucuuucacuuuaccaauuacaaaccuguuuuuguuucugggugucuaauuuaaaucuuauuuuccuaauaaugccugaaaacacugcuuuuccacccuuaggucuuaaagcacuuagcauuugaauuguuccucaggaaaguaaauacacugcuggguaucgacaggcacuaauaguagaaggaaaguauuucaggccagagaaaauggugcuaccaagaauaggaaacgguuuagccuaugaauaccuucugcaguuagcuuuuauaaauacucuaugaguuugcaaagcagcacuccuugaacuccaagacacuucuauacagagaaaagacacuuauuuauacaacuuuacccacugaauaguucaaaaacuaaccaaaugaaaaugaaagcugaggccaggcgugguggcucaugccuguaaucccagcacuuugggaggccgaggcagggcgggggggaucaugaguucaggaguucaagaccagccugacugacauggugaaacaccaccucuacuaaaaauacaaaaaaaaaaaaaaaaaauuagccaggcacaguggugcgcaccuguaauuccagcuacucgggaggcucaggcaggagaaucacuugaacccgggaggcagaggucgcagugagccaagaucgcaccacugcacuccagucugggugacagagcgagacucugucucaaaaaagaaaaaaagaaaagaaaagaaaagaaaagaaaaaaugaaaguugacaguucacacuaaagaaacaguaacagcauuucaaaaacugagaacuguuacaaagacauuagagaaaaguguuuaauaaaaauaccaauaaagaagccaggcucaguggcaccugcagccccagcuacuucagaagcugagaugggagaacuggcugaggccaggaguucaacgcuaauacagcaagacuccaucucuuaaaaaaaaaaaaaaaacugaaaaaacaaaaugaacuguagauuugauaauuuucuaagaucuauagaaaauacacaauuccuaggugacuacaaggauaguuaauuuaagaaaaauaguaauuccuaaaaaccaaccuccaacuauauucaacuccuuuuucagaguacuugaacucaacauauucaauuuuuauuagacauuuaugaggugugggaaacuuuuuacuuuauuuaauuauuauuauuauuugagauggagucucaagauguuacccagacuagagugcaguggcgugaucugggcucacugcaauguccgccccccaaguucaagcgauucuccugccucagccucucgaguagcugggauuacaggcgcccgccaccaugcucagcuaauuuuuguauuuuuaguauagacaggguuucaccuuguuggccaggcuggucuugaacuccugaccgcaagugauccacccgccucagccucccaaagugcugggauuacaggcguaagccaccaugccuggcuacuuuauuuaauuuuaguuuuacaaaaauaauucaagcuuuccaucuggaccauuaucuacuucuugaaugaguaaguuauuuuuccuguuuucacuacuuuaacauuucucaccucuauugaggaagccaagaggugagaaauccaagaauuugggaguugaaaagaaacuuaaaagacacaguagucucuuuaucuucaguuuuugcucuucacgguuucaguuaccuaugauauaguacaaucagauauucugggguaggggaggguccccucauucauauaacuuauuauagcauauugguuuaauuuuuuuuaaauuugcccuucuuguccaguaauacaguguauuguuguaauuguucuauuuuauuuuuuuaauuaaauuaaaauuuugagacagggucaggcuguugcccaaggauguagugcaguggcacgaucauggcucacuuaugcaacuacauaaaggacccaacauugucaacauucuagacuugaccucccaaguucaagcaauccucccaccucagccuucuggauagcugguacuacaggcaagcaccaccacgucuggcuaauuuuuugguuuuuuuuuuuuuuuuuuugagauggagucucgcucuguugcccaggcuggcaugcaguggcgcgaucucgguucacugcaagcuccaccucccggguucacgccauucuccugccucagucuccugaguagcugggacuacaggcgcccacuacucccggcuaauuuuuuguauuuuuaguagagacgggguuucaccguguuagccaggacggucucaaucuccugaccucgugauccacccgccucagccucccaaagugcugagauuacaggcgugagccaccgcgcccagccuauuuuuugguauuuuuuauagaaacaggguuucaccauguugccuaggguggucucagacuccugggcucaagcaaucuuccugacuuagcuucucaaaacacuaggauuacagccaugagccaccuuggcuagcugauuucuuuucaaagacaacgucauaguuaaaguguuaagauuauaggugugaaccacuaugcccagucuugcacuaauuuauuauuaucguuaauacugugucugauuuagaauuuaaacuuuauagauacauauguauaggaaaaaauauuaccguguauauauuggauucaauacuaucugugguuucagauauucacugagguucuuggaauguauccuccgagguuaagaacagacuauuguaguuuacuuaauuaacuucugagacucagaaaaucucuaaaaucaggugguaugaucaacuauagucccucaguaucccugggggauugguuccaggaaccaugcaaauaccaaaauccacagaugcucaaguuccuuauauaaaaugguacaguaucugcauauaaccuacgcaaauccuucaguauacuuaaagcaucucuaaauuacuuauaauaccugauacaauguacauaguuguuguauuguuuuuauucauauuacuuguauugcuggacuguucuuccauuuuucuaauauuucugauccaugguuggcugaauuugcagaugcagagcccacagauacagaggucugacuuguacuguaauucauuaaaaauguuuauugauuuaauucaguaaauguugaguaccuacuauaggcaagguccugauggaguuaguaguucccauacaccagacaugugaagaaacguggacacuagaaauauuaccauaccauaacuugcuuaucacaagccuugcuaaacugucacaaaaugauuuaaaaaaagaaucaugcucaaauguuaguuuucacugaagagacugauggaaauaaaaaaaaaaacagcucuagucuauauuuucauuucauucaaacaacauuaugcagccuaaaucacuuuuauaacugucagagaagagacugcaagaaggaucgaauacauaaugacuaauuucauaguugucuagaggggaagggaugaggguuaauagucucgcuuagcuaaucaucuagucugauucauuucuaccuucauauaaccucgaggaaaaaaacgguagauaaacacauuuuaauuuuccaauguucuagagacagaaguugcuauuaguaccacugcuaaagacccaaucaaacaaucccaaucucuggaguuacagcuugauauacacaaaaauaaauuucuuaagugcacaggcuggaaacccugaacuaaagcagcaaucuggugucccuguguugaauuuagcucaggauauuauaaaaaucuaaaaauuucacauaaaagccagaaaaaaaaaaagaagauuggcaacuaaaugaccagaugucaacaaccagcuagaguuaacauuacuggcauuaccagguacggaccaggaaucauaauuacuuguccugcuuuucugaauaacaacuauccagcuaaaaauaccaauggcauccccacugguacagccuuugaagcuccuugagagcaggaaacuaugccuauaucucuuccuuccaaaaacaaaaacagcauaguauucuagacaaagaaaauaaacuuaggauuaguugaggauucuagaaacuuaagucaauauucucuuaaauacacaaggaggaaguaguucagauauuaaccuaacuuuugucuaaguacgcuucuguauauuccacuuauaucaucagaguaacagcuacaacugacauuuagagauaucaucaaauguaauggguaauuccaggcaaaaacuaaaguuagggagcucagauuuaagaucauuuuuauaaagaaaucauuacagcaaagacaucaggacaacugaucuauuagcauuauacaacaauaaauuucacaauuugccaacaauuucuauauuuuaagaaguauaaagaaauuauggcuuagccuaauaauaaaauccaauuuuuuuuuuuuugagacagggucucgcucuaugaccaggcuggagugcagcagcgugaucuccacucacugcaaccuccacuucccagguugaagcgguucuugugccucagccucccaaguagcuaggacuacaggcacaggccaccaagcccggcuacuuuuuguauuuuuuguaaagaugggguuucaccauguuggccaggcuggucuuaaacuccgacuucaagugaucugccugccucagccucccaaagugcugggacuacaggcgugagccaccguacccggccugaaauccaauuuuuaauuaaagcauugcaacacaaggucuuccaguaucuggauccgcuuguaccuuuccuugccucguuucacguccucccacccccaucuucuagcgacuucacuucuggguccuugccauucccucaaguccccacaccucugcgcaugcugcuucuuuucuucacuggccaaacucucuuucauuuuauaaugucuugcucauauaucaccuuuacuuaggaaauugggcauccccuccuaacaaacucuauaaacacuuauaaagcaaguggaugaauuaaauauccauauuuugucugcucucguuaaaguauuaaucagauaauccuguucaucugcauuuggucaaggaacuauaucauagcuucuuaguaggaaacaauucaugcauuaaaacaaacaaacgaaaaaaaacaaggccgggcgcagcggcucacgccuguaaucccagcuuugggaggccaagacgggcggaucacgaggucaggaguucgagaccagccuggccagcauggugaaacccugucucuacugaaaacaaacaaacaaacaaaaaaaacacaaaaaauuagccgggcaugguggcgggcgccuguaaucccagcuacucgggaggcugaggcaggagaauugcuugaagccgggaggcagagguugcagugggacgagaucgcaccacugcacuccagucugggcgacagagggagacuccgucucaaacaaaacaaaacaaaacuccaguaucuaccuacagugugcgauaccaauuaauccaaugugcugguucugguaaaauaaaauaguugguuccaguaaauaaaauaguucccuuaaguuuuacaaaucaaucuaauaaaacacgcuaagaguguuugucauaguuauaugcuuguugcuaaacauguucagaauuucuuaaauuacguggaaaaaaccgcagaacuaauauuaaugaugaccuuuuguugacuacuccuaguauuucugguuauaaaaaaguacagguacauguuuauaaugcguucacauuagauguguuacaacggauuuuaugaauucuaauuuugacucaauguuccuucaacugucccgguaaaaaguuaacuaagugaacuccuaaugcaacgaaaacacagcacaacacugguuucuaauuaucauuagcuuaaaacuaguaaaaaaugcccagcaccuaguacaauaugcauagugucacagagaauaggauucuuuugcuuacaugcaaaucuauaccaacaccauacauuuugaaauguuaaauauauuaggggacuaucuaagaauguaaaguucaaauuaagguaucuuuuauuuuccuggaauacacgcacuauuuuaacagcuuucgucugggaaaguggugccuucagggcaaaugcacgcacuacguaauacaaagaggucuggucaguuuacgacucugaacugagaggcagauucaaauugaaaccucugguauaaugggccugaggccauuuugagaaauaaggggggcggacugguggaacagacugacacguaaaucccgcccagaaaaaggcugcuuucaagucccuuccuuguagaggugugacggugaaugguacugaaagcgguuuuaauugcgagagagaacggaaaugagcuguaaaggcuacuuuaaugauaaaucccuucccuugcuauggcuccaggacagacccuaguucuuucccaaacucauuaccagaaccuuccauuaaauugugugaaacuaacugcgcuuuauccccuggaagaggaucuuuaucuaaacuagcucacuggagacacgcgagugccgcagaagcgggagaaagacuucaggccuucuuugcguagcacgcgucgggguucuaaguggauuaggcaccaagaacacaaaacuggguucuggucucuaaucguuauuaccaacauggggaaacgugucucuucacauuucagcccggaagaacaccucuuuccucuuccucaugcgcuuaaggguagcggccuacucagucagcggccaauuaccgugagcuuucgggauuccgccgcgcgguccacacuuaccugccgggcucucugcagugcaucuuugaaagcgucguuaacuccuccaccaccaccgccgccaccaccgccaccagcugagccagaagaggggggaggcacuguugaauagucugccaugguugcacuauaagagccgcugccgccuguucagagacuuccucucagcuaacagcuaagaaagaaagaaaauggcggccgucgaagcucuauuacauucuugcgcgaccaucgugccguaaaggggcggagacugaaggaacaaaaucucgcgauguuuccgag

SEQ ID NO: 13878 - RNA, 5112 nt, Homo sapiens
uaauaauaugaaaauaagauauucugauaugugccaggcacgguggcucacgcccauaaucccaaaaguuugggaggcugacguggguggaucaccugacgucaggaguucaagaccagccugaaacauagugaaacccugucucuacuaaaaauacaaaaauuagcugggugugguggcagucaccuguaaucccagcuacucaggaggcugaggcaggagaauugcuugaauccacgaggcggaggcugcagugaacugagaucaugccacuguacuccagccugggugacagagcaagacuuugucuuuaaaaaaaaaaaaaaaaaaaagauucugauaugugaaaaaggcugcaacaauaugccuaguuaaagcuuuuuguauuuauguauuuacuuuuuaaaauuuuaaauuaauagagacaaggucuuaacccuguugcccagguuuaaguacagcagcaugauuauggcucacugcagcccugaacucucagcccaugcgauccuccuaccuccaucuccugaguaguugggacuacaggcauguacuaccacacuuggcuaauuuaaaaauuauuuuuuacaauuauuuguagagacauggucucacaguguugcccaggaacuccugggcucaagcagugcaccaaccuuggccucccaaagugcugaauuacugaguucucucuguauuguccaggcuggccucaaacuccugggcuccagcgauccucuugcuucagccuccugaguagcugggacuauaggugcacaccaccauaucuggcuuuucuacaccuuuaaaaaaauuuauuuuuauuuuguaaguuccagcauacaugugcaggaugugcagguuuguuacauagguaaacaugugccauggcgauuugcuccaccuaucaacccauuaccuagguaucaagcccagcaugcauuagcuguuuuuccuguuguucucccaccccucaucccucaacccccaccaacaggcccuaguguguguucuccucccuguguccuuguguucuuguuguucagcccccacuuauaagugagaacaugcaguguuugguuuucuguucuugcauuaguuugcugaggauaauggcuuccagcuccauccaugucccugcauaggacaugaucucuuuccuuuuuauggcugcguaguauuccauaguguauauuuaccacauuuucuuuauccagucuaucauagaugggcauuuggguugauuccuuaucuuugcuauugugaauagugcugccaugaacauaugugugcauguaucuuuauaauagaaugaauuguguucuuuuggauauauacccaguaaugggauugcugggucaaaugguauuucugguucuaggucuuugaggaauugccacacugucuuccacaaugguugaacuaauuuacauucccaccaacaguguaaaaguguucccauuucuccacagccucgccagcaucucuuguuucuugacucucucuuuuuuuugaaaaagaggcucacuuugucacucaggcuggaguggaguggcgugaucucagcucauugcaaccuccuccuggguucagacgauuguccugccucagcguccugaguagcugggauuacaggugccgcugucaugccuggcuaauuuuucuauuuuuaguagagaugggguuucaccauguuagccagguuggucucaaacuccugaucucaagugagccaccugccucggccucccaaaguggugggauuacaggcauaagccacugggcccagccuguuucuugacuuuuuaauaacuggcauucugacugaugugacaugguaucucauugugguuuugauuuguguuucucuaaugaucagugauguugaucuuuuuuucauguuuuuuuggccacauaaaugucuucuuuugagaaguguucauguucuuuguccacuuucuaauuggguuuuuuuaauuguaaauuuguuuaaguugcuuuuacaacuuuugaugaugaccaugcgguucacuuuugccuuaaauuuuaaaaagaauguauuuaaacgguuucuuuuauaaugcuuuuauuguucuuaauguuacuuugauaaucugaagcaaauuaauuguauaauuucuuucaaauuacaaaggaauugcuauuuuauagcauuagugguacauuuugacuuguaauccccaaauggagaguuaaaaaauaauuucugggccgggcgugguggcucaugccugucaucccagcacuuugggaggccgagggggguggaucacgaggucaggagaucaagaccauccuggcuaacacggugaaaccccaucucuacuaaaaauacaaaaaauuagcugggcgugguggugggugccuguagucccagcuacucgggaggcugaggcaggagaauggcaugaaccugggaggcggagcuugcagugagccgagaugaugccacugcacuccagcccuuggcaacagagcgagacuccgucucaaaaaaaaaaaaaaaaacaaaacauuucuguuaaacugugaugguugugaacgagccucucuuaccuucuuuccugguucuguuuugggggaacuaagaacuaaaaacgaagaagcucaggagaagacauuaagaauuaaccauaggccagguguaguggcucacgccuguaaucccagcacuuugggaggcugagguggguagaucgugaggucaggaguucgagaccagccugaccaacauggugaaacucccaucucuacuaaaaaaaaaaaaaaaagcaaaaauuagccgggcgugguggugugugccuguauucccagcuacucaggaggcugaggcaggagaaucacuugaacccaaggcggagguugcagugagcugugauggugccacugcacuccagccugggcaacagagcgagacuccaucucaaaaaaaaaaaaaaagaauuaacuauaauaauuugccugagaaauaaccagucugauaauguaguuauaggucacaauuuugucaagcacaaaauuaugcaauuuuuuguuacauuucuuugaaaaauacauuuugauauuuuuuccuuuagauccuccagguccuauugacaauacuaagauugcagucacuaaaugugguaaugugaugcuuaggcaagguaaguuugacucguauuuaagcuuuuacuugugagugauuugucacuguuagaaauauguuaucauuagucaucuauaguacuuuuuuauucaacugaagaauguaauccauacauuaacuagggcaaguaaugaaaagcagccacuuuuuuuuuaucugaggaaaggucuuaaggcuguuguuaagagcaaagcaaaagcaucucugacuuuuuaagacaagccauauguuucagcuuauaacaauaugggcugguagucugcagauucauguuccagaaguucucaauuaucccgagaagauucaugcugggggguacauuaugaacgcuuuugcaauaugaauauauagguuuguaaacauuauuucuucuacguaauuuuaaggagcagauucuggccagauuucugaagaaacauggaauuuucugcagucuauuuaugguggagggccugaaguuauccugcgaccuccgguuguucauguugauccagauauacuucaagcagaagaaaaaauugaaguagaaacucggucuuuguaauuuuuaggauguagagaguucuaaugaggaaucauuuucaugugcccugacauguacacaugcgaaaacauuccuaaaagcguguuuauuugcuuuauuuuuuuucaucauuuaucccauuuauuucuucuuagugggcauuauggaagaauauauuaaaauguguaauauaccacagguugguauauuuaguuuuaaauacuuaccauaaagucuuucaguguaauuuuuuuuugagacagagucuugcuuugucacccaggcuggagugcugugguguuaccucagcucacugcagccuccaccuccuggguucaagcgauucuccugccucagccucucgaguagcugggauuacaggcaccugccaccaugcccggcuaauuuuuguauuuuaguagagaugggguuucaccauguuggccaggcuagucucaaacuccugaccucaggugauccacccaccucggccucccaaagugcugggauuacaggugugagccacagcgccuggcccaguguaauauuuuugaaagaggagggacaauugugaaaucaguagguuaucuuuaaucuuuacacuacaugcagauccauaguauccuuuguaguguuguaaauacuuuugcuuugaaaacuuuuucauuguccuaaaucacccugacucugaccagucuuucaguucuccaaaagcccaauuuaauuguauaguuuugucauggcuucauauaauaaagagccuauuuuaaguugaaaguaguagucagaaaauuguuaauuuccuaaagcucaggaaacuagggugucacuuuuuuugcacugcagcauauacacuaacuagcuuauuaaaauuuacaaaaugucuuuuugaauguaucaaggauauauuuaguuugaguggaauuugucagcagauaucaguaacuuauugccgcuuauauuguacaauguuaaacuucaauuccuguaaccugguuaguauuaaugucagugacuaaaaaacuuagaguuaguuuuagggcacuuuuuauuuugagagcaugaaguguggaaugugucacuacgauuguugauaaagcugaggccacuugcaacuugauuuuuuaaaugaaauagauaaagucuuuuugaauaauauaguaugcacugcuauuugcuugauuauguaaugucaaaaguuuaacuauauuccaaguacaaaaacauacuggauuacauugaggauguugaauagcauucaugauggcuuuguuuugguuuggggcagcugucaccagcuaaagcaauguuguuaaaauuagcucaauaaaaaugucuuuaaaauguaaaacuugaauguugaauuuauuugauagauguuaaagguaaaaggugcaaaguuuguuaauauuaauaccuu

SEQ ID NO: 13879 - RNA, 8879 nt, Homo sapiens
uucaacagccauuuauuuugugcaucauuuaauucauguauggguucuauccacuuucaucaguuaacauucuuguugacaaaccaauuuacaucaacuugcuauagaacagaugaaagguauacaugggggaaaaaucaaguagaaaccuagaguuauuuuauguuagcucaguuauugaacauaacagacacagaaguauacacaaagaacuguagucagaauaacaggacuucagaauaaaaagcagaaaauaaaauaccggucuuuauuuuacaauauguauaauuauauaauuuauuaaaauuaauuuaacacaauauacaaaauauuaacaguagucacuuuuagauucgauaagcacuucaaauacagaaauguuaaaauggcaaaacuauacuaugcaacuuucaauucaaugaaucuagcucacuagcucaggcugaacauucacucucugaagcacuucuucaggcaugcaaaagacaggauuaacagguuuaaucuguucuucucccaaaagugacaauccagcaauuccaaauaagguaugaaaaggauccaccuauuuaaaaaagaauuuauauacagaucacaaaaugaaaacuucuuuaacuucaaauuaugaauaccugaccuuuaccauauacuaauuuuguuagcaacaagcgacaagaaauuucuguaagauuguucuauauccuucauacacucuacaauaaauagaaaaaaaaacugcuuucaaagcaacacucggaaugccacccuggaaauccauggaaccaugaaguaaugcaaacgcugaaauaauuuauagaaauaugucagaaauauuacuugccauaucuccuggccugucugcaaauccccccguuucuucaucuugacaugcuaaaaugaaauuacgcaguuucucucuaucaauccaaugaagucuuccaauuaucuuuagggaagccaggacccaccaugaguagcauacaucugguaacuaggagggaaaaaaguugccacaauuucauucucuuuuauuucccuaauuuugagaacaauuuaaaaguggguuaagucucacucuuagguaaucugauguucaaagugucaaaccauguggaaggacgaaauccagggauauacugauaugcaggguaugaaauacuugcuuagaaugaaagauaaucaauuaauggguaagaagagaccaaacuucaauucauagguaaccaugcuaaauaucucaguacucacugauaagcaugcaucugcuuuguuucuaucugcaaugaaugccuaacucagccccuuaaccaagaagcuagcaguauaaucaugaaauccauggguauaguucuguuuuucuacaagcacuguccagggggguacacaccugcuuaaaaucaacuaaacccuugcucuucaaaauauggugacagaagucuauaaagaaaaccccacucaaggcugaucucauuuuaaugagaucccugaguaacucauagacucauuagaagcugcccuagauugugugcaagugcaggucccggugcuccccacggccacccauuuuucuguugacaguuccucaggcuuuuuauuucacucuauuguagacagcuacugcggguguuucucuacccguuguuauucagaaauacuaagguuuaaaaauaaaaauacaggccgagcacaguggcucacgccuguaaucccagcacuuugggagguugaggcggguagaucaccugaggucaggaguucaagaucagccugaugaacauggugauaccccaucucuacuaaaaauacaaaauuggaugggcguggugguguaugacuguaaucccagcuacuguaccaccacgucccauucagagggcaggggcacagcaagcuacaauccuugagucaaaucuauaguguaggaauaguuuuuacauuuauaaaucauuuaaauauaguccugggucaggcacgguggcucacgccuacaaucccagcacuuugggagguugaugcaggcagaucacgaggucaggaguuugagaccagccuggccaauauggugaaaccccgucucuaauaaaaauacaaaaauuagccgugcgccuguagucccagcuacuugggaggcugaggcagaacugcuugaaccugggaggcggagguugcagugaaucaagauggcgucacugcacuccagccugggcaacagagcaagauuccaucugacauaggaaauacaaguauauccauccauaauaauuguaauuggaacacagccauacucauucauuucuuaccacuuauggcugcacuugcucuacaggacaauuacauaguugcaaaugaguauucacuauuugucccuuacagaccugauaagagagaccuauuauguggaggaaaauuuaauaaucuucucuccaaaccaaauuaucuggguauuccuuaaauaagaagauugcaaacaaaaauucuguagucuaauuuuuaaaaaauccaauuugccaaaaucaacuguccuuaaacauggagauuccuguacaagacugucuggaaauggacauuaggaucaaugaguauuucaacucaugggggucuacuuugucaaggggagucuuuuaguaggauauauuacugaaaauucacaacagggaaagguaauaaauaagcucauggccaauuuacaauauagaaacaggcaagacaaagcagcagcauucacucaagguucuaaagcuagcagaauauggcuuaucaaacaauaccuucuccggccuuccauugagcccgccugaggguaauugucguucacaaagccaccagccaaguaaaucagaauuuacuugaugcaacugacuuguaauugccagaaauccugugcaacaauagaucuaaaauuacagacauaaaguuuauguguauaauaauuucuugacauuaaaagugauaaaacucaaauuauuaaaacaccacuuuauaucuuaaguuuuucuucuugaucugacacuuaaaauuccaaacauguauuaauaccacauaucugaaaaaauccaagcauacuauuacuaguaugcaauucugcacugaaauauuauugucaaaauuucuucauggcuaguauuucacagccauccauucacauauucaguguucucuggcacaagaaaagagguucauaauuuaucuuaggaaagaaagaaaaauguguuguuuuuuuuuuuaucuguaugguuagugaaaaauuaauggaaaacaaaaguguuuuggugcuuauaaacccacuuauguuugcuuaggucagacgaauccaccgacagagaaagguauauaguauauaaagcaaaguaaugauagcaauuaagcaauucuuauguaagaugcccuauuacagucgaauuaacuuuauguguauuugacaaacacugaaauaaccaauuuucuuauuuuacuacacuggcuuccaaaaugacaauacauuuucaucuguauucauaaauuaccugcccagcaugggauucagaaccuggucugcaaccaaauccaccgucaaaguucauacaggauaaaacaaauucgauugccuuuuccacauuaauagcaucaagcuuccccuacaaacaaaaaaaaagaugccuguuaaauuccagaguauucagcagaucagacucaaaaaaaaaaaaaauuccagaguauucaugaacuuuaaucauuucaaucaaauauucaaagcuuaccaacaaagccaaaguugccaccgcacaaaaagagaaucuugugucaauuucuccuacaauaaaaauagaucaaaucaaggcagguguuaccaaaucauacaugagucaucuaaaaacaaacacugcacaacuaccacuuuaaauugaguucaagcuuaacuuucacuuuaggguagucaggaggaaagcuaaaucugaagugccuuuacuucccaagaaaauuccuuugucaaaaauaacagcaaauugaccaggcacaguagcucuugccuauaauuccaacauuuugggaggcugaggugggagaaucacuugagccuaggaguuugagacuagccgaggcaacauaaugggaccccaucucuacaaaaaacuuuuuaaaaaaaauuagguggggcugggcauuguggcucaggccugaaaucccagcacuuuugguggccgaggcaggaggaucacaugaggccaggggaccccaucucuacuaaaaacacaaaaaccagccagguguuguggugcacaucucagcuacucuguaagcugaggcaggagaauugcuugagcuugggagguggagguugcagugagccaagauugcaccacugcacuccagccugggcaacagagcucuccagccccagcaacugucucccaaaauacugcacuccaaccuggacagagccaagacccugccacaaaaaaguaacagcaaauuaucuuaagcugcuuaaagaaagcccagaaagagaagaaaaccaaagagaagaaaacuaauagaacccaaaguauuaguccauuucuaauaaugaaauaaacuuacccuacuuuauaaaaguagauuuuucacaucccaugaagcagcuggucucucuggccugcacuguguucaucccuaaagcagagauuaucuacguuuaucaaauaaaauucuauucccucccuccacucaaauauucagcaaguuuguaaaguuuuuuuuuuuaaauauuuuucccuuuccagcaaguaguuuuuaaaaaacuuuacaaagccaccaaauauuggggaaaaaaauuccaccuaccuuaucuuuuagacuggcccccucuguuccagugcuccuguauaugcugauauaacuaccacagugcaugcuggaaguuccagcagaccauuaacuccaguuagaccagcugcuuagugggaccugaaaagaugaaaaacuuauaaacugguuacuagcaaaaccaguacauuuuaauauugguauuuuggguagaauggacuaaaucugacauuaccccaaauaucuccagcaaaagaaccaucuucuuucuguagaccuuuaacauauuccacaacuuuauuuacgucaauaacauuaauacugucauacagcguaagaaucugcaauaaagacaaguauuagguaaaugucccuuucagguuuauucuaaugaucuuaugcucaacucuuuuuaaguugucaagcacauccuuuugucucuguguauauaaccuuuucucaaauaugcagacucuccuguuauugaauaaaauuagauaguaucaagaaaacucaaaucuuuaaaguauaauuuucuacauauaaauuuuaacuuggcauuccaagauacucaaguauacuaacucacauccacacaaaguccugaucuucccaucucagcacccaguaguaccagaaagacuuuaaaccaccagguagauguucacuaauaucaaaaucaaauagcuccauuuagcuauuuuacaguauuuacacauacugaagauaaaaauuuuacccuccaaggucucaguguaauuuuagaacucacaucaacuuuagauucagcuaauacaugccauuacaucauugaccuuguaggacagcuucacuuguaacaaaacuuuuugaccaaauccugauacaguuucaauuuccaacucugaaguaagagaacauacuaucaagaucguugcaauuuugauuaguauuuaccuggacagcacuaagaguguauaaaagaugaggaucauguccgauacuagcacuuauuccaccacauucauguuggcaagacuuaauaaaugccagaaucucuucucuauucaugcgaugaaguugucccaugagauccauuacugucagaccccaauagaugccacucauucucaaauacucagacauacaguauuccuaaaauaauacacaauuucuuaaaucugucauuugaacugguaacaaguuauaaagagauuaaacacaaagguaacucauuagccaugcugcuauuuuuaccucuccugaccuuaacagcacugaucaguagugaguuuaaaaucugugcugcucaauguuagaagccaucuucagacacaacuauuaucagaaaaaaacaauuaucugagaagcacaggauuaguuaaucuauggcugacaauacaaacagugcuuuaguuucucccaugagccagagacagaaaaacaucuaccuuuuucaucagugaaguucagggagaguauuucuuuccgaguaccuauaccauauuuaucagacaucuauuuuaauguggacucuguacaaaaccuauuaucuauuaguaaauuauauaacuacaugaaaaaucaaaaugcccuaaacaugccaaagauguuuaagcccagauaaaacaguggcuaaucaaugauacaugaaaauuaguauuaggauuccagaaacaaauuuuucccacacucaacaaugcauuauauuuuaagaaguuuuguggcugggugguggcuccugccuguaaucccagcacuuuggaaagcuggggcaggcagaucacuugaggucaggaguuugagaccacucuggccaacauagcaaaacucagucucuacgaaaaauacaaaaacuagcugggcaugguggaaugugccuguaaucccagcuauucagguggcucacuuaaacccaggagauggaggcugcagugagcccagaucgcaccgcuguccuccagucugggcaacaaagugagguuauagcucucaaaaggaaaaaaagaaguuuuuuuaacagguggugcaucuuaguuugcuacuaacccaaauucagggcauaaagauagauagcagauaaaggcagaaacgaguccagccccauccauauggccuuaacuccaugauugcuaauagaguauuuucaagguuaugggaaccuaacacuuaaguaaaaaauuaauacauaccauauaucccacaaaucgguagacuaagacaacugaguuuggauacuacagggaaaaacauuuacucuuaacuaaguuguuuacuacuuuuugcuaagauugucccagaguuuuccucgaaauuuaaaaauuuaagguaaaacuuuuucaaggucucagaguaauucuagagcuaaaguguuauuacacaucagcaauagauucagauaauacaugccaacacaucauugaccuugaaaguauuaccccuaacuacaaaaagagaaacccguuuuguaccucaaacccucaucuacuuugucuggcaagcccucucaguauagguaaaaacugagauucuaauaagcccacagccucagacguccaaagcacacuuaacugaaguucaaaggcacagcacauccucaguucucugcauggaguuggaugccauuuuaagacauaaauacugucucacugcuuaugacugucacacuucuuuaaaauaaacuuuccaacauaaaaaaauuauacauacauaaucaucuuucuuugagccauaggaugcgauauaaucugcauguuucuccaauaacaaaguguccggugcaucugacuugauaauaacauccuucuguggagugcccuuucaaaauaaagugguaaucucaucaauguuuaccucuacaacguucuucugccccacagcauagauucaacauacaucucaauuuucacuugauuucaucuuguaauaggaaaacguuccauuuaaaaauuguaacuaacuagggaggcugagguagaagaucgcuugagccagggaaauuaaggcugcagugaacugagguugugucacugcacuccauccugggcgaccggagaccgacucaaaaacaaaaccaaaacaacaacaacaacaacaaauuguauccaacaaaaaagaacuuaaaucauucaggcuucgucuuagucacgauucagguaauuuucaggucucagaguaauucuagagcuaaaguaguaauaaucaacuuuagauucagaauacaugccaacucaucauugacccaaaaaauuaccaccagcauuucuuguuguucacuuuucauucaaaaagauaaguaaaaaauaaacaccauagaauaucaaagcuuaucauuucaggacaacuuacgguuuacauguggcagaaagcauauuuuuaaaaaauaaaaaaaucuaacccuuaacuugcaagcgaauucuugcuuaaucaaaugcagguuucaaagcaccuucuaaguaccccaaaaguuguucaaauguauuaaauaagcaguuccuuuagcuccaucuucuccaccuuuaauccgagucucuguauuugcagaaguccccaugugaugcggcucuaguucuuuucguaucuauaucuuccucauugagaguacacugcagucacuauaacaggucaugaagauuaccggaagugauuaaguaccgaauuuucuucugaucccauuaaaaaucuuaaagcgagaccacaucacuaacgauuuuaaagaaaucuuugacacccccucuccaagaaaaaaaaaagccaccaaucagccacagcuuuuuagagggguucagaaaucgggcugcucaacucuuaacaggcccucccuacagaagaaggccuggauaaaauuagaagcggcauugcccgcgaggucugcagaaaacgcugaguaauauuucacacucaaaaaaccuuccaaggccuguguccuaaccauucuccagcaccaggaaaccaauccuaaggugaccagugugcuuaacccuacuccacccugucugcuaccaacccauccggacagcagcgcuaaacucacacuuaccaugucuaacagggaaaggagagagcagggucaguuccuggguagacuuaggagccgggcgccugcgcagaugcgccuc

SEQ ID NO: 13880 - RNA, 18012 nt, Homo sapiens
uagaucagaguuuaaaaaucucuaguuuauuucuaacaaacaccacuugaugcuugacucacaggcuuuauuuacauuugucuacaguaucauuuccuuaugaaaugaacuaguacagcuuaguuaaaccaaaugaaaucauaaucaucagaauugucuguaaacuacuauuagcuaaauuauaaccuugcauuugcuuaguacagccaaaguuuuaaauacagaaagcacaagaauaaaccaaugguaacauguagaaucuagaucgucggggcaauuuagaagguagacuuucaaaaagucugaggcacaauuacaagugaguaaaaguucuugugcaaccuacauaaacgcagcaaagaaacuuaagacauaaaaacaugggaaagcucacuguaaaaauauuaucaaaauauuucuacauaagauaucuugcuuucauuuuuagaucagcugaagagaaaaacauucacuuuaaaguaaaaacauauauuuuuguuugguuugucuaugaaauaucuuaaaaugucguaauuuuuauuuaaauugcagcagacaauguuacggaaaaaaaacaagaaaucaauaucccauaacaaaaagcccccaagcacaacuguugauuuccuuugauauacuuaccuugcauugucacuggaaauacuguuaagagaaaccuuuuuauuuuuuaaaccagaaaacaaacuaaagcucaugugaccagauuuuaauuuugagaaauaaacuccaaaagcauuuuaagccauaacuuauuucaaaugaauaggaaaaauaaugacuuuugcuuacaucaugcagcaauaagcauucauuuguuauucagaagaaaauuguaugcaguguguuuauaguuaacaucuugaggcaaauguucacuuaaauucacaaugucuccauuggccuuucaccaaaagagaaauauacuuuaaaagcuuacuucaauuugcucauuaaguaugauuuagccuuuucuaccauauuauauuugguaacuacauuuggaagaauaucacacaaagcuucuuaaaacauugguaaacauuuugagaugucuuuaucaagcaaccguaucagcagagaaaagauaaacucuuaagacuuucuuuuuugccccaaauuaugugucagaaaggaaaauauaucccacuucucuccuuguagacaucacaagauucuuuugcauuaaauguggagcaaaaaaguaaagcuggauaaaagagacacaaugauucuaaggcacccuuagcauagggaauuucaaaauagacauuuacaguuggcugcuuacaacauaguuuaacuuuuuuuggugagaaucacucugacaucuguuaacagcauaaaaaggcugacuuucuuuuccauaaguauguuguuuccaacuaguuuccagucuuucuuccaugcccaaaguucaggcaagccuagguaauccugucuuagccaauggacaggauguauuuggaaaugacaaaaauggguuuaaauuaggaagcaaaguacuuuguuauagcugaaaugguuuuaaaugaagcaaaugguuguaaauaaugaaugacagaacaucuauuuugggacauuauggcuuaaaaugcuauuuacuuuuaacuucacaaauaaacacagcuguauuguuuugaaaagcaaugaaaggcaugcaccucuacuagcagauuuagcacuucugaccaaguaagacaccaacuucuuuaaaaauaugcuucaugcacuguacuggauuuuuuuaagauguaaauuuuaauacauuauuucuuuuuugaacuugaacgggaaccagaaugggaugauccagaugaugaccuguggcgucuguaagacauaauggagagaguaggcauucuaguaagcuagagcuaaaucucagcauucauucuuaagacugugaaaguauacaaaauucaguaccaugaugcuagcaaaaaaauuaaaaauugagauaggaacuuacacacauaaaauuaucugauguuuagacuuuggauaugagcccaguuaucauauaaauacaauaaaaaauucucuacaauuucaaaagaaucucauuucaaaauauagccaccucucaauuauuuaagauaucaaagaaaagccuugcaaaaauguguaaaauuacagaaaauguacaacaaaagcauauaaacuugguaauggaagugugacuaaaccaaucccugugacacgguguagaaaguguaagaagucuauuauguaaaaaagauacagcaaggcuucuguguaugagaaaauauacucauaaauaaguuuuggaaaucuaggucacacaagaugauuguacaauuugcuauaggguuauauucaugcagcuaguaugaauaagucaauaucaaccuggguaaaguagugguguuccguagggguuggcccugggcucaggguuguuuaguguuuucaccaaucaccuggcuuauggaauagagaacauguucauuaaguuuagaugacaacaaacuagggggauuauauguggcuaagauaaaaauuugcagaagugguaagaaagcaacagaaugaauuccacucaaaaacagaguaauuuuuuuuacaaagaaacaaaugcagagaaacaagacugugugaaaucuuaacaucuaaacuccaaaaugugaagaagcaaaacuaaucauucuguacaaguaggaaucaugagauaauccuaccacugaacccagcaauuaauagacuuuacauaaucuuuauuuucacaagcuaauaaaauaugaaaaauuugcaaagacuacaaauaaagccauuaaaaugacuauauaauugggaacaaagagaaaauuaaugaaacugaguaauuagccuguugcagaaaaggcugacagaugacaguugcauucuuccaauauuaaaagugucaguacagauaaaguaaccuaauauaggccuuucucaaaaaagauuuggacugcaaaaugaaaaauguauuagcuacaaggaauaauuuccuuauagacaaagggcaugaagcaauuugcuguggaaaugcauuuacacauauuuaaaugaggacagauucccaaugaucugaaaguuaauuuuuuauuagaugcucuagaauucuugacuauuaguauuuaaagaagccuaaguauaaaagucaacucauaaauuacuucgacauacagcuucugaauugcaaucucaaaagacagaaauaaccgagaguuggcuauaaaaauuauaaauggaacuaaaaauuuaaacaauaaaaugaucaaagaaugguuugaucuacaauucuaaacaaccugaucaaaguacaaaggauaagcaaaguaauguuuuuuugaaguucaaaguugaaaaguagaaagucggaacacaagagauaauaaaaaucuaacccuugacuaggaaaguuuacuuuaucuauuaaacacacuuaagaacacccauucuuauuucuacagaaacccaaaccuuucgggugaccgugaucuuguucgucuuuuuuugcgaucaccagaugaagaagaucuagaacgacuucucuuucuguuccucucaggagaagaugaugaacuugaauaagaucuuuuucguggggaagaagagccccugugggaccuggagcuggaucuucauugauugagaaacaaaucaaacauuucauuaaaagaagaaauaaggaagauuauuuaguuaucagauagcuccaaaaauaaacaggauuuauaacaacuaugaaaauuuuauaaggaagaauacuuacugcuuauucaacagaagacuucuggaucaaccaugaaaacauucuacuuaaacauuuuaauuuugucucuuuaaaauucuaucauguguaauuaaaacccugcuuacuauaucaaaauagaauuuaaacuuuuuuuaaggcuuuucaaaguauacacaaauauuauaguauuauaaaaucagcagauaacugcauuaacaggacuuuacguuuaggaacuacauccuuccauuugaggauuaaaauauguaucuuauauaccacuuccugaggaaaauaaacauaauuccauguggaauuauucaacucauuaaacuguuauggaaaaaccagguauauggcacagcaacaaaagacuaguaacuguacuuaacugcuaaauauucaagaagaaauaaaaacuaacuuuaagaugauuuauauuuacaauacuauuuuuaugaaaacccacuacuuaugaaauaugaaguguugacauucacaugcuucagguagaaguaaaugugcaaauguuuaaauacaaauuuuuuuucuucacuuguauauuuugguugaaggaauuuagcucaaacuucccaaaaaauucaccuuugggcuuaaaauaaaaccagaaagcccaaaaggagaauucuuuggaaaguuacaagcaaugaaaaaauguuugggaagaauaugauggguguucuguaaaccuuaauuauaaugguucccaaagggaauaccagaacuuaaggauuuuuaccuauaaagcgcuuaaauauuguuacuaaauaaugguaacaauaaaaaauaauuugcucucuacuucuauuuuuuuuuuuuuuuuugagacaggaucuugcucuguuccccaggcuguggugcaguagcauaagcauggcucacugcacccuuaaucuccagggcuccagugauccuuccaccucagccuauaagaacacaccaccaugccuggcugguuguuuuaauuuuuauuuuuaguagacgaggucucacuauauugcccaggcuggucuugaacuccugggcucaagcagcccgcccaccuuggccucccaagguauugggauuacaggcgugagccacugagccuggccuuguuaucuauuucuuauuggcuuauaaugcaagugugcacaacauucuuuucuccuuaacaugauuauacuguggcagcccuuuaaugcuaaauuugauucaaagcagcaaauacuuuuaccaaaacagccacaguuagacuucaauaugaauuuccacaaauauggaauuucauuuucuuauuuauuuuuuagaugccuuuaggucauaauaaauuaacuuaaaaacaaagagagcauauuuugacuaaacaaagaaaaauuuccugcaagagcaucuuucaaauuauguuucccucuacagaugugacuacaugcaaccugaaacuuuagaacacuguuuacuacuuaagaccacauccuaucucaacuaaccgacuauacuuccugauuuaguuuugaguguuuugugcucuauaaauaauagcguguguaaaauuagaaaggaaaauguauauacaguacucuaguaacuuuaucugauauaaauggcaaauuuguuucugaaaauauugaaacaacugccgugcaaaacaggaccuguuuugaggcaggguuauuuuucuuccuuuuaauaaugaagaaaauuuuucuuuuuauuuacauauguaauuuuauuugaacuacuauuaauuuuuuuuuuuuuugagacacuccucugucacccaggcuggauuacagugcugugaucaagguucacuacaaccuugaacuccuggccucaagugauccucccaccucagcuucccaaagugcugggauuauaggcaugaaucacugugccuggccauauauaaucuuaauauacuagagauguggcgauaagacuuggcuucaucuuccuacuucauaacaucuuagugccaaaauaauaaacgcugcauauugcaaaauagccaccugauuucaaucaugggaaugucuuggcacacugcuggcaauggaaacauuucauggugagaaaauuaagcugaggcaagugcauuaguuuucuaaugcuaaaauaaaaucgacaaguagaagcaaaauaaggggaaaaaaagcagcaacaccuucugcagccuuuaaauauuuuucucucugcuuuacagagagaugcuaccucauucaccuugauuucgacccacgagaucucgaacguucucuggaacuggaacgagaucuugacugcgaacuggaagaacuucuugaacgggaccuggaacaacauggaacgauuuuuuuuuuccaggaccauuuaauugagcuuugugauaugaacacugaaagaaagauauguauuagaguucauuuucauauaaaaagauaacuauacaagauauauacuuucaaaacauaguauuuuaaauuagauaagauuuaguaacaaaagguaauuaaaaaaauaucacuuuccaggugauuaaauuacccuaaagccacucaacuauaaaacaaaacauuaucacuuuauuacaaaaacaaugaauacuuuguuuacaaguaacuagaagcuacccagaauacauccaagaaaacagaauguugcgauuuauacuuaauuucucuaaaaugucuccaucauuuuccuuuauaaauccccuucuauuuuuguuucuaguuaguacaaaguuuugaauguuggcauguguguauuucaucccuauauuuuucuguuuacucaaugcuuagagaauuaaagggaaaauguauaauucugucauuguuagguaauuauauuauuggaaaauaugacacaagggagacaugguucguacaaauuuuaaaacucacaaaauucauuaaucuaauuuacaacuauaauuugucccuuauaauaauacccuguagaaaaagaucacuauauuuuuaccaaaaaauuacuaguuauagccccacuuuguuaagcuuucaggcuuuguagugcucaauuaacauauaucuaauuguuauacacuaauaucuaguauuuuauuccuaaauaugauuaaaauucauugcccaugccaucacuuaacugugauuaagguuuuucaagaggacacuguuaaauuuaaaucacugcuuucacucaccuaaaauuuuauuuuuauuguuaacuauaaaaucagagauuacauauuuuacaucaacaaacaauauucaaguacaccaaaagaguuuuaguuuacgccuggacuucucaaaauuaugagcaugaagucaacagaacuaauauggcugaauuugcuccguuauucacaauacugauaucaaagcaaacuauuaaaaacauuauguaauaagcaaugauuuaaugccuagaaaauuucugugcuagccuuuaacaucuugaaugaaaauacagaucuccccuuuacuuaauuucuauauguaagcuaucucuuuagauuaauuaaauauaaguguauauaaaaauuuaauucaguuuuuaagucuauuuuagucaaaagcaugaggcuaaaauagguuaaggaaguuucaugcuaagacuuuacuuuucuaaaaauacuggacaacaacuguaugguacuaagcugaaaaauuauuuuaaaaguugauuugaauuaaauuuuuaaaauaaaaaggaaaguuuauuucgucaagaaaaacaaaauuuauaaauaaaaaaguuagauacugacauuuugacugguguuacccuugaccuguacccguuuaccuggaccuagaccuugaacuugagggggaggaugagcgugaugaagaucgugaaugugaagaucgagacuuugagcgacuucgucuauuagauuucuuuuuauuacuaucuucuucuucacuggcaucaagauuauauuuugagagaucagcgucaucuucauccucauccuaacaaaaauucaauuauaauuagacauuuagauauuaguguuaccuaccaggaaagauaaaacaguuagguguacugagcaccuccauaugcauauaucacagguaucucagcaaauuaauucugaauucuaaaauucaccuacuaaacucaucucaaauagagacuugacaacuuugucucagguauugcacagacauaaaccuggaggccauacacacuuuuucugucacacuuaugcaucacccaagaauuuucaaguccaccuccuuaaaaguccuugaaaucaccauuuuuagucuuagacacucuguuccuuauucucuagcauauuauaguaaccucuuagcuggucuccucaaaucugaagauccauucugccucucuaguaucucaauauacugacagucaucacucugaaacacaggacagauaaacacaucucacuuuuuucuuaaaaacuucaaaacuggcuuauuauuucuuuaguugcauuccaagaccucuuaugaucaggcucuaagguacccuuaacauggcauaaaacuuacacucuggccugacagaacaaguaucaccagaccugaaaugugugcugucccccucaucucauucuccccucugcucuaacuauacuggccuauguaugguauuuuugaaggcugcuggcuuaucuccuauuuagggaacccguauuugcuguucucugccuaaaugugcucucaccucggcucuuauugcuggcuccuuccuaucauucaaguuucagcucaaacuucaccuccuuagacauuauccaucggcaaaaccaaaguugcuuuuaaacuguuaucacaucaugugucuucauaacguuacugcuaucaaaauuaccuauuuauauauuuccuccucuagaacuguguaagagaaaacugguucuguuucggucaccacuguaucuccagaacaguaguguuccaaguacaaauaguacuuggcagaguggaaauccaaaaccuuugugagaacaaaugaaaacacagaauauauuuucaccaagugucugaggcugucaaaagcauucauguuaugguauaacuccaauaagacaaaagggaaauaggacaagaaaauuguucaccucaucuaacuuauauuuagaaagaucuucauccucauccucuucuucucccucugauucuuuaucuucaacuuccuuuaauauagaugcaggaccaacugcuuucccucuguauuuuuucuuuuuacguccaaacuagagaaaaacaauuucaaaaugcuugucagcugauaaugcauuaaacuuaauacauuuucuaaaaaauuauuuuagauauuuaugauuuccugaaaaugaucaguugcugaagacucaaauugcacuuaaaaaaaaguuuguuuuccuuugcauuuaagaauuuuuucuguuuuucuaauuuauauucaaccugaacaccaaaauauagcuuaccucaucauauucaccaucagauucuucucuuucuauauauucaacauuuucucuuucauuaaaaccaccaccauauccuuaaaaaagagggcacaaauuguuacccuaugacaauugauuuaaauaauaaacacaucaugcccaaaucuccagacaacaaaaaacaucuaaucaacaauggcugccuacccaucuaauaaauuacuagucuuuagaaagcauauuagaaaucaccacagaaaauacagagaacuuaguuguaacgucauauggcuguacuucuagcucuuuucaauuccaaauugcccuacaugacuuauuuaauucauagaaaguauugguggaaaacaucucaaacuucugcuauaaccaaguuuuaaaggacuuuccucuacaguuaaucguaauucuucugggaagggugggcucaguaacaaccaagcauuaaauuccacuguuuaccaacugcaaauagucugaaaucuucugauauucugaaauuuugcuacuuuaaaauguagcaggccuuauuagagcuuggaaaauuccuaauuacacagacaaacacaauaacacaauaaaggccauccuuuggcccugguuuaauugguuuuaacacauagguaaaagucacacagguucucugaaguagccaguaaauuuugaaauuaaaugauucuauuaaaaaguaguugagauuagcaaaccacuauucucucaugucacaaccaauguauacaauucaauuggcaggucucugacauaagcuuaaaggagagacuggaauuaaagaaaaugagcuaguuuuaggaaaagugaguugacauauuuugaaaaagucucccauugaaaauuaaagagguauguguugaucaagaguaauacaaucuaacuggucacauacuccagagcaguaucaguacaauaaggccggugauuuccagacuuagggacuucauucaucagcaaaauauuaaauagauuuauaauaaaaauauuuuauaaaaauuaggacuuguaacuuaaaauuugccuaucauauuuaaaaaaauauuuuuaaaauuucacuuucugaaaaaaacccacacuaauauagcaucuuuucuucauuauacuuuguacuagugaaaacuucaaaauacuuggaaguuaauaaaaauauuuuuaaacauacgugggaucuaaauuggaaauaauuuacauaggaaaaaacugaaaaguaauaugacaaauauggaaagcucaaaaauauaguaaaauuagaaagugaacuauaacucuaguaguuaauuuuucaaaaguauguaaauaaaauuauuuuaagaggcagcaaaauagucugcugacaacaaagacauugguauguucuaugaacccauacaauauaaaucuagcucauuaacucuguauaaauggaaaauacacuagcucccuaucgugaaaaaacugaagcauaccauuuucacugaauaccugagauaguggaaucaauggaaugauauguauguuuccgucauucuacuaauuucaagcacuucagauaaugcuguauaaauugguuuuauuuccacucuugccgccaccucuccuaauuacuucuccacaaacagaaagaagaguguuuaauccauuacucagguaacucaucuuucacuucuuagcuuaagcauagcuuuccuaaagaggacuucauuaaucuuuggugcuguaagacucuuuugcucaccuagguauccccagcaccuugcacaguggccuauaaaugucuucaaggaaugaauacagaaaacacaauucuggaaucaucuaaugaauuugaauuucuauggaaagcuuuagaaagcaaccaagaauuuccguagauuuuaguaagucuuacaaugaauauauuuucaaauuugucucacaguauaauguaaaaagcugagcaagggccaagaaagaaucaaacacagguuuaaaaugaauguuuggaucaagauugugacaauggaaaaaaagcgggaaagggggaugaauauaacauguacuucaaaggaagaacuaaggcacuaacaggaaaacucugugauucuacacccugaacaauuaauucaacuccugagaacauauucuaaggaaagaauccaaaagaauaaaaaucacaauguacuaaguuuguuuuuaugccauuaucuuuaaugguuuuuuuuuuaaaaaaaagcugacaaaaacaaaaauaauccuaaauccugaaacagagaaguaaauuacugaacaauuugauggaauuaugcaggauaagccagcagcaaucuuucagagguagugaaucacauucucuuuuauucauauccugucucaugcuuaggaaaugcuccccaaacccugcacugcuuuauuacaaauagccaaaagaaagcggaaagcaacagaguaaguuauuucacaccuucaacuguuaccagcaaagacaaauacuuguagcaagggaagugagaaagguucaagacaccagaaugacugaaaaaugacaauaagaaaagugagaaguuaucaaauaaaauuugcuuacuucucuguuaaacuauaguucuugugauaaugaaacuauaaaggagucaggaaauaggucaaaguuuuuuuaaguuuugaaacuguuaaaaagauuuuagacuuuauccuaaaagcaaucaaaauggguuuuuuaaaaaaggauuuuaaauuuggaaauaaaaacauguagaaaccagcuagguggcuauuuuuccacaaaacauaguaauucuuugccuagggugguaauggaaaagaauuuuugggguaugggagauaucaagaaagggcuauuuaggcuaagaaggacaucuagauuuccagcuuauguaauaaauguauggugagugguacuaaucaugagaaagagaucauuggaagagggucaggucccagggguaaaaucacaaauucaguuugaauauaaugaguuugacauuugcauggcaauguugaauaggcagcuggauauaugggucaaagaagucugagcuggagacauaaacuuggguuaucauggcaaaguuacuuaaacuuugggcuuagaagaaaacaccaugaaaauagaggaaagaaagagggccagggauggcugcgaagaaucccaacaucaguggccaaaagaagagaaaccugcaaaggagacagaauaaacaaucaaucaaacggggguuggugggggcggugaaggagguacggugcauaccuuaggugagggaagaaaaaaacgagauccuugucagaaggccuuaacuuacccaaucgguggaaaggcaaaaucacuuccuaagaauaaggcaggauuugaggguugaaaguggcgguugggcuggggaaggggggaucaaggacauuauguuauaauguucucacauaugagaauguaaguuuuaaaaaagggguggggggggauaaaaguagaauuucuguugaagucuggaagagcuaggucgaaaagauugaacaguggcccucugaucccuagaaacuaaacagacaaugaaaacggccuaaaguuagagaggcaaagaaaacagggaagcaguucaccaagccuaagucugacagggugacuagauauagaaggaauccuuugaucaugugacauauaagcaguugaaagacaaaaucagauuuuaaguaaacagauaaugugguugggcuaauuggugauaauggaaaaacuauaugcuauuagguaaacauuuucauuucaccaguaacauacaaagccaaugaucaacuauuauuuaggccaaugauuaucaaacaccauccaaaaaaccugcagauguuggaaacccaccgccaaauaacuuuaacaguucugcauuuugcaaucgauauuugaaaaaguuuuucagauaaucuagcacauagcuuaaguuucagaauuacugccaaagcuuuagaagaacacuuuaaaugguguggcuuugcccuuuaagucacagcaggcuaucaaaagaauuuaaaaaugguaucauuauaucauuacuaauaacaaacaugcaaaccagugaaagggagaggaggagaauauuucugaaaguauucuuaugucccuccuuguuaggauaaaggucccuaacacuguuauuuuauaaauugugaaacaaaagauuuguauguguguauggggggaaaaaaaucccaguaacaaacauucagggcagaauaaacagaauccucacuuacuguggcucuuacucgaaggugauacaauuaucguuucaauauuuagugcuuuaaaaaaaaucauuuaguuacaaugugguuuuaucauaccuguucuuucuucuaauuuagcauacuuuggaguauuacacauauuacacucugaucuucuggcccaauucacauugcugcaacuuuagaagugaaaaauacuaaauuaguaggcuauaauauagaugaauaucaaauuuuuagauauuuuacaauuuuaaaauaaaaacuaggaugaaaccacugucaaagaaauguuuauuaagugguaauguaaacaaagaaaauguacaguggccugaagaguaaauguggguuccaacaacggacugaaccauuuaagcagagaagcaaaauuuauauaguaugaaaagugccucugucauuuugagaaguaaaugacaaauuauaaccacaggucgaguaucacuaauccacaaauccaaaauccaaaaacguuccaaaaucuaaaacuuuuugagagaggacaugacacucaacagaaacgcucacaggagcauuucagauuuucagauuagggaugcugaacccacaaacauuucagguaagugauacugaaccuguauagaaauucugaugucuuaugaaaaaauauaacuuuaaauuaacagcuccacuaauuucucagucucugaauauaccuuaaagaguaugguuauacccuauaaauaauauuaauuuauuuuuuugaggucucaguucaagcacugaauuccaaagcauaccaaauccagugaccaaaucuguagcuggaaacuuuuccaauacaaauuuauaauccugaggaucagaaauuuauuuaagacucuagggucaggaauaguggcccaugccucgccuguaaucccagcacuuugggaggccaaggcaggcagaaugcuugagcucagguguucgaggccauccugggcaacaugguaaaacccugucucuaccaaaaauauaaaaaaaugagccaggcaugguggcaugggccuguggucccaguuacuaaggaggcugaagugagaggauugcuugagccugggagguagagguuacagugaacugagaucgccccacugcacuccagccugggugacugagugggaccucaucucaaaaacaaaaaauacaaacaaacaaaaagagaaauuuauuuaauacuuuuuugauuuagaccucuuucauacacauaggauucaucugcauagagaaaagauggaaguuggaaaaaucaaugaagaauuaaaucuaagccugaaaauaaaaaucauuaagaaaccuaccuauaauuagacuuaauuacuuacggcacacaacuuaugaaucuaacauuauuuuguaaacaggcaaaaugaguuuugugguguauuucacacuaacuauacagucuaaaaauugggauuuuucaauaaaggaaguaauaggccuuaguacuuuuaaguaccaccaccccccgauugguuuugagcuuaccauaagcauuuguuuacugguauacauaauccaucauagugacaacuauuaccauuaaaaaaugcaaagaauaauuuaaaacuucuuuauacuauacuuaaagaugagacugaauaacaauaccuuggauuuaaaagguuacccuggcuugucaaugucacuaauaagagcuguaauauaaacaaguaguggccagaucuauuauuuuggaagaaagagcagacaauaauuuaaaaaacauacguuuuacauugccagucauuagcacuaaauaggccucggcucuuuucugcaagugucuuuccuauuucagugcccccagcuuucaucaucuuggccucaguuguuuucucugaaaacagaaaaaucaugcaauaugaaccuggagaaauaaauaaaugauacauauacaguauaaauagaaucuucuuuaaauacuuaccccgaccacaucgauuacagcugguucuucuagcaaaguuuacauuuccacaucuaaaaacagauuaaaaagcauuuauaaaaauuuaaauuuguaaaauuuuacauuuuaacuuguccucacuacauaucuggaauucauaacuucuaauccaucuuagucauguuaaugucaauguuaccaacaaaaaacuccacacaauuuacugggggaaaaauacuugauuggagccacaaauucagaauaagauaucccaauccuccauuuaccagucaugugaucuugauuaaguuacuuaggaucucugccucaaguccucacauuagcacauaucauuaguuauaaucccuuuacaaaguugaaagugagaguuaacuccacuucacuaauuacuuacaagcuaccagggaguuuuaaacccuagcgguggaccaaugaggaaaaaaacuuauaaaucaaggagggcuucauggaucuuaaugaaauuaucuuuuuacaugcaguagguaggaugcuaaggaaccaaauaugauagguuguacugacuaaaaauacaaaaagauucaauaauuguaagaaaacugaguuuuacagggcauuucucaaaccucugagacuucgcugaaaaaaaugacacaaccaccaaaaccaauaaucucaacacauguaguacaguaagacuuuaugcuuauacucaacaaacucaaaccuaaagaauuacugguucacucacaugaccuuagaaguguacguguauauugguaaaaguauguuaaaugcucuggauaacauggaaugcuuaaacuuuaaaaagcugauuuuuaaggcauuauacuagaauacaauacagaugugaaguaugggaugacacuaaagugaaacacucuaaauaauauuuagguuaaguuuuuccccuaaaaauauuccuuuuaacuccauuaagcauggaaaauauacucugaaaauuuauccugcauuuaaacauauuguacaaacaacauucuauucauauauuuguaaaugaguugaaaugaacucucauugagaguccuaccucugggugugcugucauuaaagacacugacaaaagcacauuauuuuacagguaacaacaaagucagaaguuguuguucuaaaucuuuugaacguuuucaauaaugucuuaccacucagagcaauacuauccauaacauauaacuuugguucuauucaguaucauuuguuaggcuugaacuacuccuucaggucaucuuaauaucaaauuacuaucaauagccaccaauuagaauuugcuacacgucacuguuuacacacccuauccauguuauuucauguuuucauuaaaaaaaaaauucuauuccuuuuuuagcaguuaaauaaguaauagaauuuuaacuaaacccagguuuauuucaaaguuuuugcuuuuuacaaucaaaaccuauuuguggcuaacuuagguacaacaaauaaaaggcuuuuaugugaacaugaguuguacauuaaauuauuuuccauguuauuuccgaauagauacaccuauuugugcacccuucaaaaaaaaucugauuaacuaucuagucgaguacuggcuuuggcaacaaugucaaaaagcagagccacuaacacacgugcuucucugcugcaggcaucuuaagggcugaguaggcaaaaacacaggccucuucccuccuuuucggcucuaaggaggcgaaaagcccaauucuuguggagaaaugauccacaaagaaaaugucagaauuucccaaaccgaagaggguagagcuuccggaaaaggggaaaauaguauggaggaaaaguuugaguaaaaauacaaaacaaggugaacuauaagaggcaaaaggacgagugcgagaaagcaauauuuuccgugaacaagaguaaaguucugcagagaaaagucacgugggggagauccaacaccaagcuggccugacuggagagguuuccuaucgcuaaaaccuggccggggcgggggaggggggugggggcaaaaagguaggccaucucgcacucuaaaaagagaggcuaccuugcggagguaaugucgaggaaacgcugaagacauaucuagaacaaaggcucccggaaagaccucucucgugaggagauugggagccuucuucccgccagggaacuggcgguucgccgccucaacccgucuuaaggcacagaaaaucauaaaaaaggaaaaugccggacggaccucggaaagcuuccacuaacaaacuccgucccaauucaggacccuucuugaacucacuuuuugucagggcaaauccaguccccgucacugacucggaaauucuuggucgacaucuugaacgccaccagcacagccacccgcagcuaugucuucacaggaggaaaacgggccggggacuuucggcaacucggggcuguccccacacugccugacucgcgccuacuacugugucaggguuugauaaugagggaacuagccaggaauucagcuuguacguuguuguccagacuaagaugccugugcuacuguuuguuagauggaaaaguuaaaauacaaauaucuuuucuagaacuaaacucacaggcgccauaaggacaacccaggcaggaggccuucguggcacuagaagccucgga

SEQ ID NO: 13881 - RNA, 860 nt, Homo sapiens
auauugaacucgaguuggaagaggcgagucuggucucaaaauggagggccaugauccaaaggaaccagagaaguugagaaaacuguuuauugguggucugagcuuugaaacuacagaugauaguuuaagagaacauuuugagaaauggggcacacucacagauugugugguaaugagagacccccaaacaaaacguuccaggggcuuugguuuugugacuuauucuuguguugaagagguggaugcagcaaugugugcuugaccacacaagguugaugggcguguaguggaaccaaagacagcuguuucuagagaggauucuguaaagccuggugcccaucuaacagugaagaaaauuuuuguuggugguauuaaagaagauacagaagaauauaauuugagagacuucuuugaaaaguauggcaaaauugaaaccauagaaguuacggaagacaggcagagugggaaaaagaggauuugcuuuuguaacuuuugaugagcaugauacaguugauaaaauuguuguucagaaauaccacacuauuaaugggcauaauugugaagugaaaaaggcccuuucuaaacaagagaugcagucugcuggaucacagagaggucguggagguggaucuggcaauuuuaugggucgcggaggaaacuuuggaggugguggaggagcuauggugguggaggugguggcagcagagguaguuauggaggaggugaugguggauauaauggauuuggaggugaugguggcaacuauggugugguccugguuauaguaguagagggggcuaugguggugguggaccaggauauggaaaccaaggugguggauaugguggaggugguggagg
